United States Patent 9,932,637 (GENETIC POLYMORPHISMS ASSOCIATED WITH CARDIOVASCULAR DISORDERS AND DRUG RESPONSE, METHODS OF DETECTION AND USES THEREOF) - sequence listing, part 3

SEQ ID NO: 13216 - DNA, 380749 bp, Homo sapiens
  misc_feature (1)...(380749): n = A,T,C or G, or insertion/deletion polymorphism (see Tables 1-2)
tagcagtcctatcaccttacagcagcatctgctctgctcgagtgtctgtacccgtcaggtctctgcaaaccgggctctcataatcagtggggagtgtctaaacctccatttagggtcctcctacggtacactcacacagaccccagaaatgcaagcagtcccttgggggagacaaggaggatgttagagagttatggttgggaagctttgtcagggagaaattagcatttcccatcggagaccatgggaagggcactctagaaaaaagagcacaggaaaaagtatggctcaatacagggtccagaaatactcwcctggaggaactatgtgtatttcctgctatagtaatatagcatagtatttgtaatgaaaaattgtattctaaacctaaagattactaagccaattggcttgtattaagagccttagatatctacctagctttgacctagtagttaagcatttaggaaataatgagaggcagataaaaatctacaaatgtataagcaaaaagaaaaaaaaagatattagagaaaggaaggattaaaaagactaattaatcttaagagtttttcctttttcttttctttctagagacaaggtctcactgtgtcatccaggctagagcatagtggtggaatcatagctcactgtagcctccatctcctgggctcaagtgatcctcccatctcagcctcccaagaagttaggactacaggtgcataccaccatgtccggtcacttttttcgccctagagatgaggtctcactatgttgtctcaaactctggcctcaagcaatcttcccatcttggctttccagaagttgggattacaggcatgagcaactgtgtctggcctccaagacttttttgaggcttctgaaaagccaatgttgttttcaccccaacatttaatcattccaatattcctctctgcagtgaggcaggagggagcagagcagtataaccatcacttcttttgcattgttacagtagcagtaacaattcaacaaagtatgtatgtaactgtttaattgtttaacaatgtaactgtttaacaaagtaactgtggagagcaattttgcacagcttatagaaaacgccaatgctaggtgagctgatagagcatgctgttcagtttgcagccactaaggctaatggaaaaccttcagattccttcttgaagtgagagcataaaggaatggagggcatttggttgccatttccgttgggaaattggacaagaggttcagtttttcaaaagtctccattccataaagcaaatctacattttgcatggccaggtttgaaatagtatgcctctcccctccagctggtgaccctggagacacgcccttcaggtcaagtctctgtaaaacagcttattctggcaactaggaaattgagctcactcttgagctcagattatacraataactaatacatgtttagcgttttatggttaggaaatgctgtcctgagaagctcatcaataggtttattagttattggtatccttgttttattgatttactaaaattacacagytgttcgggcctgggagttaaattctcttcaccagatgccaaatcctacgtttttcttaccacatcatggygccacaggttaaggaatacagtgcagggttctgaatctctctcctgtaggacagtgcttcccaagcctggctacttgacaaatctcccaagaggtgttggaaatgcagattcctgggccttgcccctagattctgacctagagtgttattagtaaatctgtatttttaaatagttgcctggtggtctaatatacagtcaggattgacagctactgtttagttaaatcaaacaccaatgctataatttttaaccgatatcatttttagggtttggtttccaaagttggaaatcagtgtgttttagatcagtggtttcctgtcttctaaaacctaccttacctttaaagaatctgttgaaatctgtggatctttccctaagaaacacacaaacacacacatacacacttttatatataattctagagggctatattagtttcctgcttctgctataacaaatggtcacaagcatagcggcttaaaacaacaacatttattatcttacagttctggatgtcagaagtgggacaggagtctcactggattaaactcaaggtgttgcctttctggaggctctaggagataatccattttattgtctcttccatcttctagaagctgcctgtattacttggctcatgggtcccttcttttatctccaaagccaacaatgtggcatctctctgaccccacttccacttcacatctctttctcgtgctacagccaaggaaaggttctctgcttttaaggattcacataattagactgtgcccagccagataatcctggaaaatctttccatctcaagacccttaaccttaatcacatttkcagtccttttttgccatataaggtgacatattcacaggttccagggattaggagggggactattagtctaccaaccacaggggatcttaggacctctgaagcaacatggaaaatgagtgaactctaggttaggagcatctgttctagattccattcattctagatgttaaatcaacaagaaattctgcttgcctacraataacagaatccctaaaagcagtggctcttataaattaggtgtttactttttttcaggtagtaagaagtccccaggaaggcatcccatgtcaggtgcagcagttctagcatgtgacagctgaagtctctgcaattctcctggcctttcctttgaggtggccctcaaaacagctgctgcatctccagccatgacctctgtgcttcatgcaagaggggcaagggcacaggacaaaagccataagtcagctgagttgcctctcctttaagaaacctcctgagaagcctaccacccaaataacatgctcatayctcattggccagacactgcacatggccactctgtctgcaaaagagactgggaaacatagttttatttatttttaaagctaggcatattaacactccactaactctgggctttgttagtaaggaaaatgggaagtataaatattgggaagatactagtgctctctaccacagatgaaaacttcagccaggcacagtggctcatggctgtaatcccagcactttgggaggccaaggcaggtggatcacttgagctcaggagtttgacaccagcctagacaacatggcaaaacctcgtttctaccaaaagtataaaaattagccgggcatggtggtacatgtctgtggtcccagctacttgggaggctgaggtgggaggattgctggagcctgggaggtcgaggctgcagtgaacagtgattgcaccactgcactccaacctgggggacaggagcgagacactgtctcaaaaacaacaacaaaaccaaaaaaagaaaaacaaaagaaaaccttgtgttttgtgttctacaacgagaattgatcatttttcactctcacacaaccaaaacatgaagaaagttaaaagtctccttcaaaatctcccccatagtgcctcatcctcttactaagcttgcttttctttaagcagktcattctttttttttttcatttttcttgagatggattcttactctgtcacccaggctggagtgcagtggcacgatctcggctcactgtaacctccgcctcacaggtaaaagcagttctcctgcctcaacctcccaagtagctgagataacaggcgtgcggcatctcgtctggctaatcttcttatttttaatagagatggggtttcaccatgttgaccatggttggccaggctggtctcgaactcctgacctcaggtgatctgcccgctttggcctcccaaagtgctgggattaaaggcatgagccaccgtgcccagctattctttttctttcttttcttttttttttttttttcagatggagtcttgctcagtcacccaggttggaatgyagtggcgcactgtcggctcactgcaagctcgacccctcagcttcaagcgattctcctgcctcagcctcccaagtagctggaattacaggcatgtgccaccatgcttggctaattttttgtatttttagtagaaacaaggtttcactgtgttggccaggctggtcttgaactcctgacctcaatccacccacctcagcctccccaaagtgctgtgattacaggagtgagccactgcgcccagccagttcattctttcaacaatgtttaagcatctacctaagcctggcactgagctgggccttgggggctacaaagatatctaagacttttttctccttagagagctataccgtctatggagagggacagagagcccccaaaatgatgaacatgttctaagtgttgagatagaggcatgtgaacactctttggcagcccagaaaagaaaggggaagaggaaatggcacagaaagggtgaggcaagaactggcctggaagtctaggatggataggattttgccagttgaagaggggtaggcacatttcaggaagaaagaacagcgttggagaaggcacagatgtgtgtgaaaacccctgttggacacgttcaggggacagctagaagttgtgtgtggatacattgtagggtttgtgggaagtgagtcaggaaaggggcataaaatggggctggaaagagagatggagcctccatgtgaagttatgctaaggagatcgggctccatcctataggcaggagtaggtggtggggggcaacgggaagttttcaaccattatccaaactctgttgtagaattaaaaagtggaaagaagagaacacaggcagggaaaccataatagtgtggtcagacttcaacatgatagcagtcaattcagtaggaatcttgaatttgagtagtcaagttcatagagacagaaggtaggaaggtggttgccagaggctgggggtggggatgggggtagggttagggggaaagaggagttattgtttagggtataaagtttgttttccaagatgaagagttgtggagatggatggtggtgaaggttgcataacatgcatatacttaatcccccgaactgcacagttacaaatggttaagayggtaaactttctgttatgcatatttacaattmcacacacacacacacacacacccttcagtgcacgcaaaccctgctggactccaaccttcagagcttccgatttagcagggctgagtgggacctgaggatttgcattttctgacaagttcccagatgacgttgatgctgctggtccggagaccacacttcgggaatcactggtgtacgagaccaagtgactagaatatggaggggtgctctgctcgcttccacgtggctactattgttatgaacaacaacagccggcgtttactgagcactgctcctacagcttatctcacaactgggtgaaggagcagaggatgcgcagggctagaacctggagtctaaactcgtccttcacccgggttgctctggatcttactggttgtgagacagggagggaaagagagacaaaggcagggagacaggcccagcagggccggcagagcctgtagtgacggaggggagcagccttatctccgggaacccgagcgccccgtscgcggcgggragggggcagttcggggcgccccggcgggtcccaggggctgactcccgcccgggaagtgcgcgcagggctcacggcccgcagggggcgctgccgcgccgtccagccgccgccgcccgggccgcccacctcgcgggcgcgcccctccgcagaccagcgccgcccggcccgggacccgctcgcgcagacttctcgggcggactgaggacgccgccgctcggggccgcccctgtgctcgccttcagcgcccgctcagcccgccgtccgcgccccggtggcgggcccgacgcccgcattccgcccgtgtccaggcgcagagctcccgccccggggagcttcctggccgtcggcgggccccgcggcccgcgcgctsggcgccctgctygccgggcagaggggaaggcggcggccggctggggatgggcggcccggctgcgccgaggggcgccgggaggctccgcgcgctgctgctggcgctggtggtcgcggggatccccgcgggcgcctacaacctygacccgcagcgccccgtgcacttccagggccccgctgactcgttcttcggctacgcagttctggagcatttccacgacaacacgcgctggtgagtgcccgcccgactccgcgaccctggcccgcgcggccaccgccccggcccccaggccagcgccgccgccgcctttccggtctcttccacgccgccgtcccgagggggcgatttaaatgtctccgttgcgcgcggctcggccgccgggggacggcgggagaagggaggacgccgtccggggcccgctaaggtcggggtcggcgcctggaggcgggcgggggcgtccgggtgcctccctggggtcccagcccagagcgtggggggagagccgctaragttgtctcctccgccgcccagctaractcggcttcactctctgaatcgaaaagtaacttggctcctctgcctccgggcggccgccgctggcccagcgagcctcctgaacctcgcagggcctggaggagtcggggcactggagctgcacccctccccggttttggggaacccctgaggaaggagtatagcctctccagcgccgctgcgcggggtggggctccccaggggcagggtgtctgggatccactggggcgcactggagcccagagccccggcgcccccsccccccccagctcctacaagaccctgggtggaagtggagcggagaagctcctaggatatagggaagaggaaggtgagggagcacttcccagtgacaccgccggtggggcaggtagttatctcttgggagagcctgagtctcatctcatatgggccattcgacccggagaccttcaccagaagccttaagagagagacgtgtttctatagtggccaaggggtccagttgtcccctgagtccggaggggtgggcctaagaagggggcagctctcccccattaagcaccataagccgagtggtacagagcttgtgcccaaccccagcagagaagcactaagggggggttggtgccctccttggccacatcctctggaccagagggtataaacagccacayagtggtcacttcttgataggagagagagttaggctgcgggaagttcccccgttcaaggtcgtgcctcatgggggcccaggtgacagccaggccggggttgattttattgtgtattcaccagcctgagcgtccttaggggtggcaggcagggaggtcraggtcactgatgctggtgctctcagcatgtagttatgcaggagagtcactgctctgtattggacagaggctgatggaaaagggtggtttgtggatcgcagtactcaagcattcctggaaaaggggactctgagaccagcccactaagaatcatgctgttcaggagatcagccttcaagagaaccagttttcaaagccctcacatagctctcgcccagctccacatctccctctctcacttactccagttgctgggtataagaccgagtgtgtctgttcttaacacttgtcaaattccccttttaaagcggagcaggctgaacatttttctgtgtcctgcagactcagggtctgaggttgaagaacacatcccagatccccacactaggcaccaggcacgcgggaagcactgtcaaaaatgggagggctgctgtggacagcgggctgctgagaaagggcgggcagctgagcaggcagccaagccagccggagcattgtgtgtgatctgcaggctgaggctggctcaactgccttggagctctttgacagctagagggagagaggccaggccactgtcactgtggatttgcatgggccacaggtcaaagccacactgcctgggaaaggaatgggtagagacgagagcagatctgacagagaaaaggtgttcagcctacttkgatttaaaacggggatgaagaaaagctgtgtgacatgagcagatttggccagtgtgggaaaagacagtctggccttcagcttggtacccagggtaaatggtagggagtgggtgtggagcagtaatgctgtgcatattcttgttgccagttgagatgtgggactggtatttcaggggtccatgggaacccatgtgtctgggctgctgagctcaaaagtgccctctcttgttctgatacaagctggctactctttgtattggagtgcttgtccccatagctgttcaggcaccaacttaactctactgaaatctttttaaaataatgcttctttttcctccctcacccaccatattgacttaattttttcttagattgtgttctccccttgatttctgttctcatgctgttgttttcaagtattttcctccccatccttttttctctttscctttttcccagtattctttgtcttagaccttgaatgtattttttgctgtatgtatgcttgaatgtgttttttacccaggcttggtaaactatggcctttggagcaagtgacttccaacatcttctttctcctttttctttcctctagaggctagacttattgtgcaaggctgctgaaacttaagccaaaggattcttgcttgcataggcccctattaatgccttgtccccaattttataattttatgttaattttcttaaagttagtcaccctaaatttgtaagatcaggtcctgtgaattctggatctgtcctaagtctgtaccttaacttcaactgtggggttggttgattgacttggtaactgattgttggtcgcttactcctaagcagtacctgagccctggatcttctagtcctgcttgagggacrtgtcagtcattttcaattattcgtgattgcaaacagcagcaggggtaaacaacctttaacgaaacccttgaggacaatcttaattatttcctttgaataaattcctgggcttagaattgctgggtcagagaggatggaagcttcaaggcattctttatgtattaccaaagtgccagtgaagtgtgtgtactttagaaaaatacattaatttattcagacactggaggcttgggagtagttttgcaaagggctgctctagtgcactgaaagagtatagaacctacatgggggtgacttaaaaggatcacaaatactcgtcaaaatgagtgaggaaggtaaaatatagacatgaaagggaaaagcagtatagcaaaactttgaaaggaaaagaagacatgttaattaagccttgtatcttacgtctctcttctcgaagaaattattctttgttacttaattcaatattttgcagtctaagatatttgcttcatgctaattaactacctgttttacaggtgaaaagatgtgttgtctctagggaaagggagggagaagaatgtgctggaagtggtagggggagagcacagaccccaaagtcagcacggactctgcaggyggcagagtagagcgttcccatgttgagggacctgcgggtgtacatctcaaagcatgtgaatgtgctctgttggtggaactagcacttctctaatcccataactgagcatttctctcaattattttgtagaccaaaattgtcactaatcggaggatcctagatccctgtgtaagtgtgggggtgatcttgcttttcccagccctggtgactgaacccagctctgtagccatatcacactgagcacagagccccagacccagcttctctcagagtacttgcttgagtggtcccgctgtcactgtgctctgggcagtgagaactgtccccatggctagatggaccagaatatcctggacaatgttccagatgacgtttgtatcagctaggatacaaacatgcaagggactcaattttctttttttctaataacacccagagtgtctgcctgcccagagccagcttcctctcctatagctcccactccctgagtcttctggcgtcctttgaacaacaacagtaagtgccagggaacatggacaaagccgatttctgtccccttcctttagacatggaccggttactcagctgcagggctgacaactgtaacaccctgtgatataaataaatgctgcctggctggcgtgcagcyyccagagcggacgtctttcacaccccaccccgtcccctcctccttctctgccccagacgccctggagtccaaagtggttgggtgcactggcttcctttctggagacgtgcttcctgctccctctcctgggacacatcaagacggctgtgcttaggcacagagcgagtgctcggaaatggaagatgtgctgggctttttgctttgttaaagttgtcagagygttgttcagtgaggaataggaggcaattccaagccaaggagaacatatccttgatttgcatgaaggttgagaattaaaagaacaagctagatagttctggtgagctgtctgatgtagtcaccactagccagatatattggtatgtaaattaactaaaaataaaatttaaaatgcagcttctcagttgcacttgccacatttcaagtactcagtagccacatggggctagtagctactgcattggacacaacacagagagaacattttcatcatcacggaaagttctactgggcagtgtgggtttagagcaatgatgtaagtcttaaagggctagacaaggatcaaaaggagaggtaagaaaaagaaaaagaaaaaaaatcaacccatagcatatgtgagtactaaaaccgaaacgggtgcttacatctaactaaaaattattgcctgctgaagaggttgaattgtctttctactcataaaacaccgcagggcctgatctatatttagggctgggggttcaacaatgaaaactttttgctcacaatctgkcaggtgagaaaattgtggggttctagttgtgtgtctcaaatgaaatttaagatctaggctctgatgggggagaggcttgtcctcaggcaggcatgagttgttcagaggggcagaagagaaactcctgtgaagggaaaacatttagaaggggagccctgggatcataggacctgctgcccctggccctgcccgtcttgctgaggaaacacccagaaatggtggtgggagccctgccttctcataacctcagtggtgagcatctttgcagagttcctctgtcctgtgccagactctaggggaaggtgtaggtccgcttcctcakttgaatttttctagggaaatggcattttcagacattgttcctggtcctcactcaccctacagagcctgctttctcaagctctcaagaaggaacaacacatatatgaggcctgagttccaaggggatccaaaaagcatcttctcggggtttctgggaaatttctctgaagatctggagaagctggcaagggtgctgttttctgagctagtgctgaatgctggctgggggcagagacagctgtcttgcccagtggagaaccttccagggcaagaagacagtcttgtctcaaccagtcattaacggccctgagtgtgagagtgtgaagggccgggccmcagccagctctgattccctggtgacatgctgctgttcaggaaatggtctcctgataacttctattgtgatttgttcagggaaaatgttgtttttacatttgttaaaagcagccatggtgttctctgaaattccttgctttcaaggggttgcatggaattttaacaaccaaaatgaatttcgtcagatagtatctacaagaagtcagatgctttcacaggcataatattctttagttgagtctttgtaacatcctggtgagtggtttccagtttgctatttggggaactgaggcttacagagttacacgccttgttcaaggcccaccccagcctgagagatcaatgcacattcactgggggcttgtgtcagtttgcatcctttaggaagcagatgctaggacagagataggagtgtgagagaattgttgggggcgggtattgcctgtgaaagacaaatggggaagttggatgggacagagagagcctctgactctatgcagatctgattaaagtctcagtcaactcaacagagatcactgggcagaaatagctgtcctctgccagggtcaggtattggctggagctgtctgggaagagcacagcctcagctggaatcctgcagcagatcccaagaaagctgcagctggaggctgtcagctgacattccgccttgcagctgaacagcatgaagtgacccacacctctgtggctgccctggagcctgccacgcgtgaatcactgtgttgggagggtgtgagatgtgctccttggcctgcagtgtggctggggatcatctttgctcatacctctgtaatcagtgtgtggagcgtcaggactgacagtagggccattgggactggcccagaaacagaatcctgagcaatcttgccaccagctgactcacaaggtgcctctttctgatgtcagagaagtcacaggtgatggatttcagaagaaaggagctctgctttacgctgagccaccgagttctctgaactgcaaatccttttagccaagtggatttggcgatcaaccaaagcagaataaaatgttttatcccaaccttcctttttgccagaaggagtcctaggaagccgatgtaagtccaagattgggaaaaatctacagtctttgaaaccacgggctcacttggtccaccaatgtctgttctgaccaaaaaggacttctgtgttgagtttaaattagcaacagtagcaacaataacaccaaaagcagcaacartgtatctgaatattcagtagatgtcaagtgctatctacattggtactcataccagctcatttaatgttcccaacagtcctttcagctggtagccatttgggctgccataacaaactgttataggttgggttgcttataaatgacagaatttatttctcacagatctagagccttggaagtccaagatcagggccccagcagatttgctgtctggtaagcacctgtttcttggttcatagatagtggtgttctcactctaagctcacacagtgaaagggatgagggagctctctggggccacatttataagggcactaactcattcataggttatatcctcatgacctaatcacctcccaaagtccccacctccaaataacattaccttggggtgaagatttcaacatatacattttgagggaacacaagcattcagtctgtagcagctggctatcattttatccccattcatggaggggaagctgaggtacagaggcattattgcccaagttacatggctaatgagttgtcgagcacaggcctgtgcctttgcccmcccaggctgactgcctgtcaggaagtcaagaatccgagtttgggggcttcagggcgctcaaacatctgtcttgtgaagttctgttctgcctgctttcctggaaaagttattgaattgcaatagcagtagcttctctgcggcaccctttggggatgcttattcatgacccactggctactcttggggggatgctagggttctgttttctggagatgtttgatcactgagtgaacagggacccaatgattctgccagggacatttgaagggcctcttctcacaccaaggctgtctagcattaagacagaagtgtcccaggaaagatggagtactctgcaatattccatgtatccctctaacctcctggggctgctttgttactatccccccatccactctgagttctactggctcccaccacttatttaggaatctctgaattggggaaggtagccatggtggccagtgtttcagaatcactcctgggtttgtaactttattaaagaaacccacacagagtcaaacttctgcaccagtgaccaacaatatgtgagaggatgatttgtatcctcaaatatttgaacacttaataaaaggcatgaatgggtacaaaaaattagaaagaatgagtaagaatgagtaagaactagtatttgatagcacaacaaaatgacaatagtcaacaataatttgattgtagtttaaaaataactaaaagagtataattgaatcacttgtaacataaaggataaacgcttcaggtgatggataccccatttaccctgctgtggttattacatattacatgcctgtaacaaaatatctcatgyacctcataaatatgtacctactgtgtgcccaaatcttttttttttttttttttttgagatggagtcttgctctgtcacccaggctggagtgcagtggtgcgatctcggctcactgcgagctccaccttctgggttcacgccattctcctgcctcagcctcccgagtagctgggactacaggtgccccccaccacacccggctaattttttgtatttttagtagagagtgggtttcactgtgttgggcagaatagtctcgatctcctgacctcgtgatctgcccactttggcctcccgaagtgctgggattacaggcgtgagccaccgcacccggactatgtgcccaaatttttaagaaaaataaaaaatcacggaacaaatttcctccatcttagctgatctgttggtrtgttaaggccacctgggagatggcctttcctaccccttcctatctagtgtccaagtgctgtgatgtatgtggatcccagagtaaacttggtgttgtgcagtacacaccagtaggcagcattgcagagggtcttggcacctcttttgcaccaggatgggtcctagagggtggatgttccagattcagctgagtagtgttcctgtctctaccttcattgaatccctggttccacagcaacaaccagatccacgatttttgtgccataaaagggggcactgctgagatgcacaagtgcctggtggccaagagagtgggctccagcattagccctgccctcagcctgccttactcagctctctgcttaggagctgtgtgatcttgaccaattacttcagctgtttgaacctcagtttccttttctgtaaagagtaataagggtacatccctcattaggttggtgggggcattaaatgagatgatatctgcaaagcccagagcacaacacggcacacagtaagcccttgatagatgctcgtagttatttctcttgttacttgatctgatttatgaaaccaatggtctttttcatcctgacttgagatgctgagttttctttcagtatttttgttgattcattcatttattcatcagactttgagtgttgacactcaacactgaaatgaatgagatattctaacatagacacactcttcattatgtgtggcctctaacatttttgttatgctctacataaatctgcatttttgtgcattcatttacaccctgtctgcttccaaaaaggatctgagatggctactttaaatggagatctttgggattgtaaatcctagaattttgcctgcctgtttcttctctgtgctcttggaaagccaaggagcagatgggaggccacccttgttatggggagctccagctcccaccccaggctccagataagtctgggaggtagatctacagttccaggatgggatacttttttaaaaagtaaatgtaaatgtattgccatatttctcttgaaaaaaaattatcacaagaaaccaacaagaagatatcaaggctttttcttagatctgccagaagtctgtaatttgctctatcccttggattttagtgttcacttgctgctttcagatgtggaaggaaaacctcagtccttttgccttgcctccttctccagttgcctcccctcagtgtgtctgccaagacctgagccccaggccagggcagcagcctctgacctttcactccctaacacacaagctggggaccaatgtcactccaaggttggaccctgccccygtgcctctgcttttcccagttgggcatggactccaccaatttcattctctgacttagcgttatgtggtgtggattgtactgctctccctccatttactgtaacctaggctctccaggataaaaattattattgccaaccttttatgaatactttctatatgccagaaccactgtgttcatagttccctttatgcagagcaggctaccactcccgaagcacagagaagccaagtcacttgtccaaggttacccagcaagtaagtaaattacagagttgtgctttgaaccaaggtgggactgatttaatgctaaactgactgttctcagggttagccatgctaccctccctacctccacctccatcaaggccctgtccaaggtatcaggtttctaaggaaaaaggagaagggccctgaaaggaaaagggcttcttcggagggcatttgtgtctgctcttggccttgcagataaaataccataatctactcttgcaaatcargccatcctggggtgcatggtcccccaaacactttcatctgccttttccttttgtgcctcatcactgccttgggagggggatcatgcatttgttattatccttgttttacagaaaaggaaaggaagggtcagagtggccaggggacttgtctaaagtcacatagctgtagctggcacactcctgggtgtgacttcggatacactctttagggcctattctactactccaccatgcctgtcccatctcagggccttcagtaaaagtctgtggtcctggttggtgatgagattcctttgagggagggaaaggagaccaggtagctagaggagccatagcaatagttgtcagctgcatagttggataattggtttggacttagcgggaattagtgggcgatggaattaccacggtccagattccgtcagaagtggcatgccttagcttgatgacgtatctgttttctatcascacaatattgctgcatccctaacaaaccaccccaaaacttagtggcttaaatcaaccaccacctgtagcttattctctggttggcagcttaggttgggttcagctgggtggttcttctgttctctscaggactcactcatgcatctgtggtcaacttctgggttagctggttggctggctggcaaaggatggcttcagctgggagggcttatttttgctccatatgtatttcatcctcttgcaggctagcctgggcttgtacacatggtggttgggtagggtaccaacagaacaatcagaggcttgcatgatttcttgaagcctaagctcagaagtcaaaccatgcccctctgccacattcttttggccaatgtaagtcacaggtccagactacatcaagaggaggcagaaacacatttcatctcttgacaagagaagctgcaaagtcacactgaaaagagcagggatacaggaaggatggggaattgtggccactttgtaatatattacyggtggtgaaagcatcctggctgtccctgaattactgtgacagtctgaataaattcctgcccagcgcaccagaaaagggaacaaggttctattaacctaaatagcaaacacagagagaggctctctaaaagaaaatgtttactcaggaatagggcattgcagtgggaatacatgtgtcacagtaatctgcatgaatattcagggaggtaaaggaaaacaaaggcttttaaaggaaaaatgaggattacttaattgttttgagataattatctttggatacaaggatcagtgacaagggtggcaccagtttgaggttggatagagagttgctaggtagatttcctcacagaaggtgtgagtgtgtgtktgtgtgtgtgtgtgtgtgtgtgtgtgtaaggttgtgatggcctttgtgcaagattgtgtttttgcagatttttttgtgctagttcttgttatcagttgtttatgcatgaaaacctttccttcatggcgtcccacagctctatttgtcagggttttttttttttttttaaacataagtgactccattttgattctgacaacttttgcaattctaaggatctatgagctcttgggtgctgccaggagttagaactgggatgagttgagtgtcaaggtgtttgacctactactgcccagcagtctaacatttctttraacacctactttgtagcaggcactatgatgggtgttttataaacattcttttgcttaaaycttacaagaaaccttcttaggtacacttttattcctcctgttttacagaagaggaaaactgaggcttggagtgtttaagacacttgtctaagagacacagcttgtcagcagtagaggcaggacttaaaccctatgttactgcctgtgcttcttacactttatcaccatgcataactttcccataaagcttagaagccaggtagaactactggcttaaaaccctagaaagcagtcagtatccactgcttaaataccaggagcctcagtttccccaaatataagaagagcttatgaggcctttcaggtcccatggctccattgggcaagcattggtccctagtgagtcccctccctctggaaatgaagggtttggtgtggtyagaggtggctatcctggcaccagctcttcctttactcaagcctgggctgctttctgcccagtaagggatgcggacaattcctggggtttccccgtggtggacacacagtgaagaatttgactcatgtaaccaaaacrtgggtccctggggaagctttggctttgggatcaaatgctgaaagcaaacctaatgggtttaaagtttttaatccccagttgctgtccttgatctggctataattttgcctgtggaatcgctgctgtggtgtttgtggggagggagggaatctttgagacactgtcagttctcagtcctgcccagggaggcagctgcggctcagtccttctctgtcacccgctctccagagaatttacctgcagattaccctcaaaacatgagacaggttcagagcgaggtgggcggytggaatggagccttcacagacagcttgaccacacacagrgagctcaggaagcagctttgttggaaaaatgcagggcacttaaactgccacaccaggagggggtttggagaggytggaaagagcatgccattggacacagacactctgggttcaaatcccagctctgccacttactggtggtgtgacccaacatctctgaatggaaaacacatgagaggctgcctgacaggatggccatgagcaagaaagcacccttgtgagcataaccagtgttggtgcatgaaccgatgcacccacactgcttattaagagaggcaaacctctggttaacaccatgacagcagtgtcaatgctttggaaaagcaaggtgattgaagttcaccttttgagtcacctgagcctgatggggaggggaaggtcttttctcttccaaaccccagcatgccctttgacatgacggagctttcacatcagagttctcacttcagagctgccctcaaaggctcactggggcttgctcaggtggggattacatatgtgagtagctggcaccagagggggcactgggtacctgttggttcccttttcctcctttcaggctgatgtggggtgggtagaatagggcacgggtgatgtatttgactactggggtgcrtgctacagcttggcatcttaacatgaataaccatcttaacctcctctggccacctgcttccctatctgtaaaatggggataatattagtacctcccgtagggttgctgtgaagagtaaatttgatcctgcccgcaatgagcctaacccagcacctgcacactctaygtgcctgctacatgctggttgccctaattagaagtttagagtcctgcattgatgagaggacctaaaaggcttatgaggccaggcatagtggctcaggcttgtaatcccaacactttgggaggctgaggcagktggatcacctgaggtcagaagttcaagaccggccttaccaatatggtgaaaccccatctctactaaaaatataaaaattascggggcgtggtggcgtgtscctgtrgtacccagytactagggaggctgagacaagagaattgcttgaacccgggaggtggaggttscagtgagcggagatcgccgcactgcactccagcctgggtaacagagcaagacaccatytcaaaaaaaaaaaaaaaaaaaaaaaaaaaaaaagggcctttgagtttgtggcatctttaactggggatgggataggaggagagagccttgcttctcaagggcaatctcttctactggctccaaatgaacataattatttgtaatcagtttagatagttacatagtacttcttaaactatcaatcacctggagagcttgttaaaatgcattctgatttaatgggctggggcctaagattctgcatttccgacaagtgccaggtgttccccatgctgctggtctgaggaccacacttgaagtagcaagcaaagcagagaagtagcttgatgctttgttgatggcagcctgttggtggggacactcaggcccttttatgtggtaaccatagcagaaaggaacatagtcttgttgagagtaccaggagagttggggcgatgtttgaagtggctaggatgtctttttataacttagcagatggcatcttttcagtggcttgttctgaactctgggccatggtaatctctgtatcccttgggatcagcctggtaaacagccagctgaattaacttcagaaaagacycactcatgggctggcctgcggtagtcttgctggatggtggcctaggtacagagcagtgctgggctgcggaggaagccacgatgttctgtaaacacatagatacaagcacattcccgcgtgccacctygtgagtgtcatgcatgtgtgtgcatgcccccttatctctagcctgattttccattgcacaggatttgggaaaaacctttcatctgaccagctgatcagaagttttgaactgaaaggttgttatcagggtttgaatcagctattgttgttagaaccattgagtaccttgggcttggaaggaaataataattcagcaggttcctttccactttagattttggtgtaaactttgtccctgtcagtcttggctctaggctggaggaagcagtgcctgggaataagctctccagggtcccctcctgcttagataacctatgaatctgtgtctgtgaatttggagccatggcattatctgaaatttccagggttccaatgccagtttgggagacacagtggaggaagaacctgttgtttcttgcagccttttcccttccctcggacgtgatgaattctcactcttgtgaatttttttgtgatttttgtaaaataaattacaagtggcaattagtcactgtgctgatgtaaatttggagttggtgggaatttttggactctgctgtgtggccctggggtttttgagtggaagaggtattttatgctccccaggtcttaraacctgacctgtggaaaggctgaggatgtttcagcagtttagacagggcaaactgctaattcttctcacctgtgaaaacagctggtcttatgaagcgcaatatgtgacttaccccagtggctctaaagctcagccgctacagcaagggggaaaattgatcccttaatgtggctttcttctcactggagttttgttttgtacgtcattgtgcatttgagttacagcagacaagggccagccaaactgctcttgtgtgggtgagggaggcaatgtgatctgtttgggaaagtgcttgctttgatttccaaagggctgtgggttccagccctgcttctgcttgggaattctgcagttgtgcccagcaaacacctggggaggtgcatcccagggcattattgaggagccgcagggcagcctgggtacctgcaccattgggagtcttgcttctctcactccccagcagggcatcttcctcatggaatcagatacagaccctccaagactgacctggaaggagacactccagtgaggggtgggtctccctggctctttgtaccctccaattcttcaggttctaggtgttgagctcagggcagtgggaattaagatgggacccacacacattcccatgaaccttaacaccatgtctctgagccaggttagtgacgatgtcctttgtgatatctgccagcctttgctggagtcccctttgagggcctcagacttctgttgtatgatgtagaggmcttgtttgtctgcccctttgcctagctggagtgttgcaggaggagcagcagcattccaagaccagggtgcagtgaatgactgagatcccaagatgaaggtggctttcagggcagagggaagggagcctgggtcagctttctacatccccaggaaagctgtccagggtcatcctaacctctgctaaacaccttttccacaaatacataatatgtaatgcactctattccaaggcatgtgggagatgatctatttcatgatacagaagaaacccttgtgaggtgaattccctctcttttctaggctgctggagataaggaacaacgcctgttctcactaagaagtggcttggcattttctactctttgaacatcagtgtggattttgtttgaagtctcattgtccaagaccttttccaaatggctcgtagctcagcacaaaccgtgcctgattagtgttgtttggtattctttgctatagatcttctgttgactgctttccggaaacaatgcataaaactgtaggtcagaattatttttgtaacatctggaggggagcttactgccatttcccccgtgttctgcactcacacaggcccaaacctgcctcttctgtcttctgggtgggtcttgcccctttcctgtagccgggggatgctcctgctggggatggcccaccctaggcagcttttcagttcaagatggaggatacagaggttcattcttgctcctstttgcatgcaaactgttctatttctgttttgcagtgggagagaggatacggtttataattccgcactgctgctattttttttcctatttgcccctaaatgtccatgctgtgtgtgtggtgggtggtaggaggaggagagggagacagaagagaaatagcgtttctaaattttctatttgttactgaaatgtaacacatccaggaaagtgtccatatcatatrcagttatcacaaatttgtataatgtcactgaggttgaatgacaacattatccgcacccccagcaattcccctccctaattgcaaccctgctttctcctctccagaggtaaccattatcctgccttctaacactatagttaaatttcacctgcttttgaactttagataaatggaatcagactgtgagtatgctattgtatctggcatcttttgttcagtattgtatttgtgcagttcatctctgtggttgcagttgaatgctgttcatttgttttcattgctgcatagaactctttttttgttttgttttgtttttgagacagagtctcactctgttgcccagactggagtgcagtggcatgatctcagctcactgtaacctctgcctcttgggttcaagcgattctcctgcctcagcctctcaagcagctgggattacaggcacctgccaccatgcccagctaattttttgtatttttagtagagacagggtttcaccatgttgcccagactggtcttgaactcctaagctcaggcagtctgcccacctcggcctcccagtgctgcatagaattctgttgtattgctgtaccatgatttacctgtccactctagcactgatgggcctttaggtttcttcttgtttttttttttttttttttgatattacatatgcagctttgaacattttgcatgtctcctggtagaaatgtatgcatctctattaggtatagtcctagaaatggaattactgggtcaaagggtaggtgcatgttcagctttattaggaactgttgaatagttttcccagtggttttaatggtttatactgccactagcagtgtatgaaggttctagttactctatatccttgccagcacttgggattttcagtctttttggtttgagccttctggttggtatgaagttgagtttctctgataactaacatagttgagcaccttttcatgcatttattggccatttggctatcttcttttgtgaagtatctatgcttgtctttggcctattctgttgacttgtcttttcttattaatcaatgaggagtttttaaaatagattttggataggaaccttttgttggttgtacgtgttcccacccatccatcgcagtctcctgggtaggtgggactaaaagcgtgcgctgccttgcctggccatttttttttgtgaagatgggatttgccatgtcacccaggctggcctggaattcctgggctcaagcgatccacccgcctcggcctctcaaaatgctaggattacaggcatgagccaccacattcagcctccttaagctttaatatgcctgggaaagatctaacaggtttcactttaggacctctcccccaagcccacacagaaaagtataataatatgattttcaaagtgagcactcagagagcccacccgtggttgggtgaatacttagccatctgcctcctattttcttatcgtaggttgtgacagaatgcctttttctcttgctgcagggtccttgtgggcgcaccaaaggcagattccaaatacagcccttcagtgaagtctcctggggctgtgtttaagtgccgtgttcacaccaaccctgaccggagatgcacmgaactggacatggctcgaggtgggtgaccattactgctgysgtggaaatgggttctgtacccttatacctwgctcttcttcttcccaggatggcctgaycattcactcacccatccatccttccctccttccctccctccttctstccaacaagcatgtattgagtacgtaatagttattaagcactgggatacaccagtgaacaaaaaaaacaaggatgctgccatccctagtcccataaattagtgggcaaaagagatattaagacaagtaaytgagagagaaaagaccagagggaaggtgagtatttgatttaatctagataggagggtcaagaaaggtctgggacctttcgacatgattagaaggatgcgtagtcgttagctgggcaggtgcaggaagcacagccttcaagcagaggtgccatttggaagcacagagcgaggttgtgcagctggagagggagccaggagagtggagcacaggagggcagcaaggcaggctggggccaggccacgtggggcctagcaggccagggcaatgtgctggaattttatyctgtgtgtgagtggggaggccactgaaatcaattttgggtrttacaktttaactagggaaagatatgatcagatggatgtttttaaaagctcactttgcgctgggcatggtggctcatgactgtaatcccatyactttgggaggctgaggtgggcacattgcttgagcccagaagttcaagaccagcctgtgcaacatggtgaragcctatctctactwaaaatacaaatattagctgaacgtggtgatgcatgcctgtagtcccagctactcaggaggccgaggcaggaggatcacttgaacccaggaggtcaagggtgcagtgagctgagattgtgccactgcactccagcctgggtgacagaactgagactcttgtctccaaaaagataaaaaaataaaataaaagctcactttgatctagcagaaaatataagatctttggaatcagatggttctgactgcattcaaagcccagctgggactgattgggaatgtcctatagcttcttgggcctcagttccctcaccttcaagatcaagactaatatacctacctcgcaaggatggtcttgagaagattaagtgagataatacaggtgagtacacagaactgtgcttggcacatcagtacaaaggaggtattttgttataatcatgactgcaagcatttctttctccaaagtctttttgcataaagattttctaatttttttgttgttttttgtttgyytgtttgtttttgagacagagtcttgctgtgtcacccaggctagagtgcaatggtacaatctctgctcactgcaacctctgcctcccaggttcaagcgattctcctgcctcagcctcccgagtagctgggattacagtgtatgaccatcttcggctaatttttgtgtttttagtggagacggggtttcgccatgttggccaggctggtctcgaacttctggcctcaagtgaaccgcccacctcagcctcccaaagtgctgggattacaggtgygagccaccatgcctggccaagatcttctaattattttttaaataaagagttattgtgattttctttagcagaaaaagaggtttgtgaactgtttgttactggtgcataacaaattaaggagcttacttcagaacataaatcaaggccctgcctctttccatgagaaagtcttgccatgtggttgggtgcagtggcttatgcctataaccccagcacttcgggaggttggggtgggcggatcacttgaggttaggagtttgagaccagcctggacaacatggtgaaaacccrtctctgctaaaaatatgaacattagtgggatgtggtggcgcacacctgtaatcccagctacttgggaggctgaggcagggcaatcgcttgaacctgggaggcagaggttgcaatgagctgagatcgtgccactgcactccagcctggacgacagagagagactgtctcaaaaaaaaaaaaaaaaaaaaaaaaagaaagaaaaagaaagccttgctatgtaaaaaaacagttgtctggattaaacagtatagtacatagtgatggagttgatttacattttgtggaaagttccttatttcctcatagggctgtggaccaccctttgaaagcagccagcagamcatcactcctcaacccaagtctggctcttctcctctttctccagggaagaatcggggcacgtcctgcggaaagacctgccgggaagaccgcgatgatgagtggatgggggtgagcctggcccgrmagcccaaggctgatggccgtgtgttggtaagtccctcctgggggtgctgtgggaagggggtggcactctgagaatgaatgatctgttaggaaggctggatggcatggtgacaagtgcatggctttgaggttgcttattctggactactgcttagacaaatgacttatcktcttattttctttatctgtcaaatgtgaataatgtctgtcccaaggtgctgagatgtgactattgaaaaataaaacatatgtgaaaagtgctttgtacatctcattcattacataggtatttgtgtgtgtgtgtcttaaattgaggtataatttacagtacacaaatcttaagattacagtcttgattttcacaattgtacacacctgtgtaaccatatgcccactgagatatagaatatttccatygtcccaaaagtctccgatgtccctttccagccaactcctctcacctgagacaaaccacagctgtgakttgtataatacattacttttgckttttctagaatktcatataaatggaatcctacagtatgtgctcttttatataagacttctttcactcaaaataatattttctgaaattaatccccattgtaygtatcagtagttcattcctgtttatctctacataatattacattttatgaaataaatgttatttttaactagttatttatcggacctccaaagcacctatgctgtattttgatccgtaggtgctttgagggagatagaaagaaaagtctttgcatttgagactcctgagatcctggagttgtgctgtgcagtaaggtggccaccagccctgtgtccttatttaaacttaaatttatccaaattaaactagaaattcaggtttttagtcatattagccacatttaagtggctcartaatcacaaatggttactggctactctattggaaagcagagagagagaatattttcatcatcacagaaagttttattagactcaacacraaaggaatktctaacactgcagaggttttgtttttgtcaatttttcctttaagcktttctatgaggtataatactaaagcacttaacacacccagctgtgagtgcacagcccgatggkttttcacgcatgtacacttatgcatccccattgccagtactccggaagracccctgcaccctttcccagtcagttcctctgcccttggtgagtgaacaactrttctgacataggctttctcttgcccttgacttttatcagaagctgtaygaagatttttgttataaaagcrtaagctcaagaggggaaagtaatactagctgccgcttatggagggcttcatttgggtcacatgctgcaaagctgagggtttcgtgtgtattttatcccagggaaacaggttttccttaaggcactaggcaaagtgtttttgtcccctctctaaggagcccacttttgtgttaaacttcttcatggcataagctgttaatctgaattccgtcctcagcacaattaagcatctcccccttgtcgggccccttgggagaggaggaagcagctggatgctgtcgccagcatggtgggggcctccctcctggaagccgttgtaggtcctgcacaggctccctgagcccgctgtttgccttggtttccagtcctttcatcactgtcatggctggccctggaccctctccaaacttccacattccyccaggcatggtggcctgaccctgactggacaaatgggccccagaggggctgaacccttgtctgccattctggggaaagaaagggaagaagctgactcatctgtaaatyaaagggtagcccaaggtcctgattcagaacaaaaaggaggtggtggccccgtggcagcataacacaagatgctcttaagggcatcgagcctagagtcagagtttgctcctgtgaaaatatttcctctctgcaaggaaggataacctctctgtggctgagggcttgtttccagaggggcaagacagaattctgtgttaccacagatcagtatcacaaaggagtcatttctggggacagtgaacagcaatgaggaccacagggaagatttagcaaagggagccaagaaggcagcactrgagcatttgtggataatggtgccatggatagtcctgtctaattaattgcatgcaggactatttttttaatgttttatgaagttattgcatcatccactcagtaagccactgtatatgggtgctgggcaaagaggagcatctgacaccatctgctttccttgtgccttttgtttgkttttctaattgtggccaaacacatgacataaaacttaccaccttaaccattttgagtgtacagtagtggtaaatgtatggcacattgttgtacaacaaacctttaaactttatcttgcaaaacttacatccattgracaacactctcctttttctccttcccgtggttcctggcaacattgtatttctattaagagtttgactactttagatcttatgtgagtggagtgtggtgttcgtccttttgtgacgaacktayttcatttagcataatgtcctcaaggttcatcatgttgtagcatgtgacyggatctccttcctttttaaaggcagaataatatttcattgtatgaattcaccatgttttctttattcatctattgacggacatttaggttggttctatctcctggctgccgtgatgaatgctgctataaatgtgtaccaatatctctttgagatcttgttttcagttctttggggtatacacccggaagtgggattactggatcaaatggtacttctatttttaatttttaagaaacctccatactattttcccaaatggctgcagcattttaagttctcaccaacagtgcacaagggtttcaatggctccacgtccttgccaacatttattgttttcctttttttttttaaatagtggccctcctaatgggtgtgagataatattttattgtgattttggtttgcatctccctgatgattagtaacattgagcattgtttcatcatctgcttgttggtcattttatatcttttttggagraatgtttaggtcctttgcccaattttaaattggattgtttggtttttattgttgttgagtyatcstcatggcattttgcacatgggcagtcttgctaggaaakgcttgtcctaagtcccctctgcccctgccccactctgtcctcggcacttctctttcttcccctgtatgggctctgcctccttcgtgaagcctgttaagggttttctggaacaagctgagcatcttttgtgtcattaggaactcaacatcatcttattacttatattgtgtgtataatttattttgtggccayatgtccccttttatggaagccacttggggatagagaccaaatctacccactttcattctcagcatctggaggacatctctctaaggaatggcatctgaaagtgtgtttgaataatacagggactgagggtcaatgttaaaacaattagaaaccaaattagttgccatcttttcttggtggctgattctaagtggctgaaggaaacaccaggaaacattctgtaaaatgttccttggaaatggcaggcaaaaacaagawacagtgagtgtccctatttacatttggaggtctcatagccatttgcttttttctttaatgtttcaaccctacctgtcagagctttctgggaggcaagtatttacttttaaattaaaaatgggaaggatatgtgttgttcaggtgcattttgagaacttgagaagtgcctgggggtgtaggcaagagaccagtatccccaaggagcacaatattggattccaaggttgggkttgaagagggagaggtgggctagctcttttgaaagtggtgtctggtgctgatagaaaacctaagaacaaatggagaatttgaaagctgcaatggggcgtgaaatgtctcagtgaccaaaggcattatgtggaccmtggacccagcaaccagctctggcaaggaccagattgtcaggctggtctggcaggttgaccttggcttagtgcctgcccatctcagctccatggacactgttgcacctcccaggttttccccagaaacaaatgatactggatgtaaagatagcatcaggattagaggcaagccccttcccttctcactctctcatcctgagcttcctgtgtgcagacgacattttaagaaatgagcggggaggggaatcacttcttgaaataaccactgaacaaactctgtataggcactgactgctgctcagactttggaggacaactcaaaatgttcaagtctaatgtcgccccttttcatcagacttgccaaggctcagacaacaaataatttaagcttctagattatttttgtgcagaagcagtattctctggttctctttgtcatttcctttctaattatcagggctgtccttatctgttcagkgcttcccatctgtccatttttttttttcaaagccacagggtacatttttgcatttacttctgttgctctgtttcctgattttttttaaagtgaactttttattgagctgtaacacacatgcagaaaaaggtataaatcatcaatgtatacctcaataaattttcattaggtgaacgtcctcagaataacattttcacaccccagcagccccttcccaatgcccctcctggccacttcctcctcggttggggagcttcttaggggagtctcatggcatctcagcctctctgtgatcctgctccccaccacacaccattcttagcagccaggcccagttgtggccgtgcactgtggacctggatgcatgacaaaggctttggccatctctatggcaggtgcgaatgtaggagggttggcagggactgatgtgcctttgtggccgaagcacccggaaagtgccattacccacctctaggagggatgtgttgtttccatacaacaaaaaaggcctttgaaataaagtgtttattttctttctctttttcctcttttgggaggaagagcaatccttataccttgaaatgtgtcagattctaatatttggagtgggmcaaggccctccttcccctttcttatgattagttgaaatctgagtttgagcaagtcttgctgttttcagagaatgctctccytcycctgtycttccctcacagccgaactcatttggagagattgatggagttactaatgctttggagacagtccctaggaatttttttaaaatgtagtggtcagattgacatgtgtgtatatataatgataatcaaggctaaacacagtcttctctttctgtaatttatattcagagacactttgcattgttttcctacatgaatccttcctttgacactttgatctctgacctcccagaatgcttttagtttagtatgaaatgcaatatttggatcttctaggaattttccaagatcaccccttaaatagtttatggcacttaaaaaatgagacaatacaccagacattaagtacagcaaagccttcctataagtgtcagtgtgcagctggctatcagacagcaccatgataaacatccgcctcttttcacagcccctccaactcagaaatacaataaaacatggtcaacccttgargccaagggctttgctaagtccaaaaacttagcaaaaccaaaacataactgatttacccacaaattagataacaataagtgattcargtttgcgagccataagaattgagtcagaactttaaaaatcaattatttagcagtatggagtgrttatttacttagtgatatattttttatagttctctgcctcatatcatttcagtctatttagaaacctgctattttagcacaaaacartatcaargagaggagtgaatgtggtttgcagcagraaaaataacaatagattgttttctgtagtttaatgtcatacgacaagaggcagaatgtgggcaagctcaggttttgagagtcattctgagtgtgtcctcttttgccattgggcagagagtggccttgtccagggccttggtggcagtggcttgaaggatgaagagcagagagcttagaaggctgtgatcttatcatagaatgatgtcagggagaaccaggccccaagagccccctcactcactcggtgacgtggggcattccattcgaccccagagtggttatttcacatgtcctgggacatgtggcaggggggctgtaaagaggataaagtcaccaggcctgccccagggggtgggttttgatggcctctcaggtaggaatgagaagttttaagatggaaaatgcttcatagtgaaacaaggaagactcagaattcctggattccagtgctgtttgcagcacttactagctctgccacttaggcaaagcactctttgatacatggtgctcttgtacagaaaatgggaattctaaagacacctctgctcaccttccaggattgcagaagaggtcagaggtaggccataagaacgctaaatgttatcacttacgaaaacaatgcgtttgagggaggcaaaccaagatgttaaaaactgattattttcaaaagcaatattttaagaaaatgcattcactggctggggtgaagtgaactgatatcagaagtgagtagtgaatgcccaggagaagtggaacgggctgggcagggtagagtgtgtgcctctgagtaagcagctcggctcttcatcagcacagcagtgacatctggatgtgcagagacatgcacgggaactggggccactgtcatgtccaagcagaaggcaggggcatgtttagtgtggcagaaggacgatccaggcctgcatcctggctgctggcactgctccagtgtctgttagcagagctgccctgcctcatggtgtcttgcgtggcttcgaccctagtgctgagaggctcctctggagagctggccaatgcatctgtccatcttcttcgccagtatgcggasctctcrtgcaccccaagacccttggccatgaaccttccttcagctttctcctcagagaggccttccttgacctgcctggcaaaaccagccactccctggcatgagggaactttctggtgagatggagatgttctgtgtcttgctagggccttggtgacatgagtgtgtacatttgtcaaagcycatttgtgcattttgctgtatgtaagtttccataaaaaaacaactctccacacacatttacttctagttaatgagatgcatgctgaagtgtttctgtgggtagaaacatggttgaatatcagccattcctcccttccctgctgtctccacatcggttcagtcccttgggcctgtcagctctgaagccacccccgtcgcccatctccactgcccctcctggtccagacctgcatcatctctcacctggtgttcatttgcacttttgccctcctgcagtctccaccaagcagccaaatggtctttccaaactgtcacttggatcatgcttctcaactgtgtaagactctccaccacttcccattgcagatctgctgaagtcacagccattcctacgtccccctgtggtccaaccttggccgcctctttgatcttatctccttcccaccatggkcactccagaccggcctttctttctcttgagcctctgagcctttctcacgatgtatcctttacattctgctatcctttgaatcctcccagaaccctcttcccctcatgcttcaggccttcccgacctctggtggaaactatccttcccactcccagattctctattctataaccttgtttctttccttcccaatgctcaggactagctacaattctcatttgttgatatatttatttcctgtctcctagtaggctcccagtggcttgttcctgttcatgcagttttctgatgcccaraaaagtgcctgttatgaaggtgtggctttctggtccctctgctcctctcttctcccacagaaagaaacatctggcactgacaggagtctgctttgtgatcttttggggccaactttcctgctctcaactgctctctatccctttaggcctgtgctcatcgctggaagaacatctactatgaagccgaccacatcctaccccatggcttctgctacatcatcccctccaacctccaggccaaaggcaggacrctgatcccttgctatgaaggtgagcatggattgatttttcctcatccccctacccacctcatgccctaagcccgccttcccacctctatgcaccaccagctgaacatttccccagctttccacatgctcatgatagggcagcactgtttgctcccagatggtctcttggtccccaaggccctgcccagagaagaggcaggtacagagggggcagcagtcccaggcctttccaaccctcacctgacttggctgcagagcccacggtgcttaccaagcattatgaagtctcagggaccgaaattcaccaagcctcagccaagtgacctaacagctgccttggttttctggtaatgccaggtgctgtgttgccttgggaaacttaccttctctctctggacctcagtttccttgtccgaatattcagtggttggcccagatgatctctacagccccaggcagctccaagtcagtcattaggctcccacacagcttctggctgcactgtggacagatgtcctgaggctggggggagaggagacccaggattcataaagcarcagctggacagaaacctgacactctgaactttcagcatttcatgacatttgaggtctgactttccttcccatgtggtcctgcagcccaggcagatgctggagaattgggcgcatcctgaatgtggttttaagagctcctcgccaaggggcacttggaaggaaaatgtatcctctcagacttagaaccttcaaatgcctgggcatcgaggacagtcactaatagtgattgagtcagtcactatttagcccagtcgaatctgagctttaagcgttcagaaaacacggttattttcttcagtttgatagctcgtagtttcaagttttctcagcctaattttgggtaagctggaacctgctccttctgtaagtgctggactatttatttcttaattcccctcctactttatttggacagaagtctcactggcttatgtccacattgcctttgggcctccctgggttttcctaggtttcaaattttgtggacactaaaaaggattcatkagaaacactatatggacactgggacccttctgggtactgaggtgacacaggtagggtgctctgggaaacgtcccccacagaagagccagcaagatctctgcaggaggcacaaaccctctcccctatagagtgagccttcctttggtttttctttctcctctgtatcagcatttgatcagctctggctgggccatgtagggaaatgaaactctggccctgtttatatctgtattgtcccaaacagaagaagaacaaacttcatcttaaaaatagaggatgatataatcaatcaagagtggagggatcgttggtttcagaaaygcaaagcatgtgtcaagcctgggtttccactgccccagtttactcctcctttttcctaaggaagaaaaaggaaaagcctctggaacaaccggtggggcagctcttcaggctgagaaggagcgatgggctcagcagggtgatggaggcagtgattgttgaaccatactagttatgcataggaccagtactttggttttcccagaagatgacatgttgtgacagggacacatgatggtccctgatgattcctctatatataccacaagcacaaggacagccctcygaagagggaggtggagttcaatgtccatgtgtacgcaggtccacgaggctcataattctgcattactttctattaagtagctgtggatcatcagtaggccagtgttgatctgaggtctttacacattctctcatctaatcttcccagaagctgtgaaaaatgtttgtttcttttttttcttgggtctgattacaggtatttwattttggaaattgttctagaagacaccagtgaggcagggggaagtaagaatgggaagggaaggcagcccatggaagatgtactcctcagcacgttacctgggcgagtgggtgcagtctctggggtgggtgctggggccagtgtggagcacacatctagagtcctcctgcctgagggctgaggggaaggggcttcctccacctggcatcctgtcctgccatgtgtgtgggctgggaaagcctccaggacagaggtgctggcaggtggcagtcaggccacatcataggaacggtggtaggagctggggggagacaggtgggatgcccaaaggccagcttctgtgttgtcattctcctgtgacaggagtaagtggagactcagagtgtatgtgaattgccccaggtcactcaaacaataaatggtggagcaggattttgaagctggcctctgtctgactcagcaaaccattttgtgtcctggtaattaatggtaatttctgttagtttgttttttagggtttctaatttaaatgagaagtaaaagccagtcarcaaccctcacaaagcaagaaagggtgactgaactatcccaaaaatacaatggacttaatgatggttaaawggaactggtgaagaaattagcaaaatgattatgcccctgcccaatcttccttcccatgggcgcacacacacttttatatgctaacccattcattggcccagggtgggaaataagggatggatgggkctggcatgtggagtaytggggtgtaagagcagccccttagaaaaatgggggactaaattgaaagtttcygtagttcttggccctgtaagaggagaggggtagaagatgctgagtatttttctagaagactggactggacgggtggggctgggaggatgcyggccgtagtgagagggctcttgtctgtgctctgttggctttaggcatctccacctccctgttttgtggtttaaactagacctactwtggcttttaaggccaccattatttcctyaatgtggagaaactcagtaatgcaagttctctgttccacrttagggrtcacattatggttaaagacaatgggaagattttagagtttgacaggacctttcagataccacctagaacagcctcctgtctttcatgaggtccagagaggtgatggcctgagtttttctttctaatctgtwattcacatgccacacaatggagaggcagagtagcttggtggccaatgcacagattctggacacagactgccggagttcaagtcccggctctgctacttcctcttattaacagtgtaatctcagatgggttatttaagttctctgtgcctaaccaacctcaagggtctatgaagaggactgagttaatgcttctaagtccttagaacagtgtctggcatatacttgctaatatatgctaagcatatatatactaatatgccatgtacaacatactgtattctgagcaagtgtttgttaatcatcatagggtgactgacttgtgtaccgggaatagaatccacttaatcttaagtacttgttagttgccagatagacaaaacccaagtgacacagttccagctaccaagaagctccccatctacaggggaaaacagagaggggacagggtgttttaaaagtgggagggccgtgtggagagagaatttcctgccagtgtgtactgctggagcccgtccccaagggcttgagctgcatccaagtgcaaggtggcattatttcattttacaattggaaaaactgaaacccacttaaagtctgcaggctgttgagactatggaagagagggatggtggaaattcgagactggtcatggtggtgggaacagggcaagggaggagggggacggctgcctctaaacccacttcttgtgggatggtggaaagaccgtgggaggggctgtgggttgaggacggctctgctgcacttctgcccctttagcctcaggcctgtcacttggcctctcagtgggagtcgatgctgtgatgcctccactgcatttacygctttgggttatggtgaggagctcccgagaaaactcaggtgaaagtgctcagcaaggccacccattgttctataactgtggcctcatggtaagtctccatatgggccagctgtgctcctwtacaacattggaaggtcggtttggttgcagagactctaaatatgtggggatctctccaaaatgtctcaagcttttgaattcttaaaaaattggtctctggtttggcactaggacatggcttctcaggtgcttcctgtttctggttggatgggaaaagctaccagaatatcctgttggaaccaggaaaaacagaggaaatgggaaataaaaatgaatttaggacataaactcatggagcatatccttcagtcagtttagtttgtgtttgtctgatgtgagaacatcattacctaccatatgttctttggttttatcagaatgtgtgagaaaacgagakctttggtgggacgatgtatagggaaaactacttgtaaattaaagggcaagcactataaaacattaattactattaaccaagctatgatattttaggactccgaaatgttaagtcaatgcatgtgataaaatcaagtacagagatttctttcatcctttgcccttgagaccactgaggcaagaagccggaacttagcaggagtgagactgcaaacaagttgyctttttattgtgaccgaaaaacctgatgagtgtggaatagtttgggagcagcatggcaaattaacaaagcctgttcaagattaaactctgagaaagaaatgcaagaggtaattatgatgccatggtatgttagacctaaattgtggaatctggctttactactcacttattgctatgattaaacctatatgctcctactttctgacttagtgaccttaggcaagctccatgagcctggtgccctcatctataaaatggggagattaagatctacttaagaggtatgtgaggtataaagtgcctaccacagtgctcagtcgagagtgaatgctgctcattgccttcaattagaaaatgtaaattttctaattaattttcaagcaacataatagtattcttaaatattctcagaaggtgtctaacatatcctgttttagtgactagataatgaagggtagaaagctggatattcctaaaatgattttaagagcccttggcaagttataatttctcaaatactgttgaagatcatattggcacaatttggttggtaagtgttccttccctctttttgtagatgacctaaaactttaactcatgccatgtttaaatgttcttaaatttgggattgttgaagtctgaattttactgtgctttaaaattgtgatggaaaaacttcctatggattccaaagatttstgtaccactctattatcagggaatgactggcttttatttctagtgtgtgtttgcatttcctaggacagtgatcatttccagggaaggaaatagattacccattcaaaggtgaagatttttttcccctttaatgttaaaagtggtctccacaagggataaaaatcaacgaaggtccatttacaaatgaaaaggaattggggttttgttgtatttttgttttgtttttgttttggagagaaccataaaaggctaagttgatccatttaaaaattcaagaacaagcctcataaatttttattaaataaagacctctacatttacataggattttatggtttccaaggagctttaataaacatatcttatttaaataaatagagcaaattaaagagaagaggatgcagttgtacattatggccagttaaacagagagggattctgagggggaggaagggagggwggccccagaggacagccatggctgtaaggaggaggccagaggtctccagcagggcctctctggggctttccaggtttccttggagccaagaattttaatcttgggcaaacctgtctcctatacttcaaacgtgtttccatgtattacgtggaattatagactacctaaactgmatcttttgtttctctcagaaaaattcacagattcagattcacctaatatttattgagcacctacctggtgccaggggttgtgctaggtacttaacatttttgatcttactgagtaatcacatcattctcagataagtattcttatccttgttatacagatgagaaaactgaggcccagggagcttgatgaaggtcacaggcttattagtcagaggaggggttgacggcttttaagtgtgtagtaggtttctttgtagctacctgttctgttgggatcctggttttcttggtgattactgagtgctgtggcctatcacagaaaaaaaagtcatattttttttcaatggcataattttatgaatttttgggacactacactatagacttgttaagctatgtttcagttttgcaattatagatacactctgtagacaagtcccagtaggtacagagggcagacgtgggtcctcagactgataaaatgtagccaggagaccaatctgctctagtctggagtggctgcttactgggaacatttggtttcagtatctgcacagcagtttgtctgtccatgctttggtgccagttatttcatgagtctttttatttttattttttggttatatagatcagaggtttcygtgttgcccaggctggcctcgaacgtctagcctcgccttcttatgcgccwggacaacaggcctgagccactgcagctccctatttcatgagtcttttagctttggtcccaaaattgaattctgctcagttctgagctggggttctcactgaaatgtgactgtcccatgttcagggtcacttttttttttctgagagtagagcatgacayaatrcatagtaagttgcatgtctatatatacattattatgtgcctgtattattacttgctgctgaagtagggagttggcaaaatgggttgctaagttctaggtaaagggaacgctttaaagattacaaaactccttttttggtaatattaaaaaattattgsccaggygtggtggctcatacctgtaatcccagcactttgggaggctgagactggcagatcacctgaagtcaggagttcgagaccagcctgaccaacatggtgaaaccctgcctctactaaaaaatacaaaaattacctgggcatggtggggtgcatctgtaatcccagctacttgggagggtgaggcacgagaatcactggaacctgggaggcggcggttgtggtgagccaggattgcatcactgcactccagtctgggtgacagaatgagactctgtctcaaaaaaaaaaaaaatattgtaaaaaataaataacataaaaattaccattttaaccatttttaagtgtacagttctgtagcattatgtacattcacactgccatgccattatcaccaccatccatccccagaacttttgcatcatcccaaactaaagctctgtacccattaaacatgaactcctcattccctgcttcccctagtccctggcaactgccattctactttgtctctgaatttggatactctagacacctcatgtaagttgaatcatacagtatgtgcccttttgtgactggcttgtttcacttagcataatgtccdcaaggtgtatccatattgtagcatctgtcagaattttcttcctttttaaaggaaggaatatttaataakattccrttgtatgtgtgtgccccacatttatctattcatctgtttataaaacattttstttggrtgataagaatgttttcactggaaatgtgctttgtgaagcataagggagtggcagaagcagatcagaagttgggagccttgctcttgggtcctgatgctgaggctaatcagcagtgtagctttaaacaaaccacttgctctttctgagcaaaaatattccatttgtaaataaatggacagagttagagttattaggcattccctaaagrtcttttccccttttaaaatctttctttcatttaattctaagtttctggctttatgcactttgtgtttcatgcacaccatagcttagtcatcagttattttcataaaatgttctcgcttcctctttaacctagctgtttaatttatttacattttttcccccatttatatggtggtcccttgtaaactgagggtagttttattctctcttcatttttctgtataattgcccttttttttttttttttttactagagctgtgtctgcccaaatgcattgtttcctgtattgtacaattatcagttatttagatttgccastctgttagaaacaaaatgcttgttcctcagtgccacaatgaaatagcacttgaacataaatttaattttctcagcaaggcaatttttacttctaytgaagcgtgcgacttgtggatggagtaatggtgagagcacacctggacaggggaggggcaggggttcttattcctgttgcaggtagcccctactgctgtgtcgttcccctatttcctggggttcaactgcatagtctgagctaattccaaytggctgttttaaagagagcagastacgatcctgagtggcggggtgagtagtttggtgggaagggtggttacagaacaggtgactcaggatgatttgggtcagagcaagtgaccaggggtgactcaagatggagcaggtaaccagggtgacttaggttaaagcaggtgaccaggggaacagatctgaactactgattagaactggcgggaaagttgtttactgaaackagaggcaagggggccaaagagaaccaggaagttaaactttaaaatggaaaatcaaagaataagagagctgaacatattgacatactgattctttgaagagaaacttggaattygctataacaactccttggtgaaattcagaataaagactggcaagctatttttcccccagtattttatttcagagctaagctaaggaactacagaaaaataattgtaaaattgatgtgttaaaaagctttgaaagacagaactttctcaaatgggtaatatgaagggagattattaggaagaatatatgttatgctgtatgtgaatcttgatctttctgtggaatggttttatcctggtcttttggaaagggtacaggaagtgaccccacccgattggtggtctgcttgaattacattcattaatgtaggctccatgcattgagttgcggattgtgaacatttggaaaccagtattttttttcctctctgaattgccttctgtttagacagggcttaataaaaccagcagctaaaccaaggaaaatactcccatttttagaatggaggagccatacgacttaatgaattaaagcatgtaatgcaggccaagtaattcaaacccacccatggcaggaagagttccacaacctggttccagctcctctaagtgacttctaagtccccttgttcaaccctatcttttgggtctcagatttggcttccyccccsctttttttttttttttttttgagaccgaatctggctctgttgccyaggctggagtgcagcggcatgatcgtggctcactgcaacctctgcctcccagactcaagccatcctcccacctcagcctcctgagtagctgggactacaggtgtgcaccaccgcatccagctaatttttgtatttttgtasagatggsggtctcactttgttccccaggctgattttcaactcctggactcaagtgatctgcctgcctcggcctcccaaagtgctgggattacaggtgtcagccaccgtgctggccagcttccccaaakgtaagggttaggtttgttacagtgcctgtgagctgctgtcaggcaaagcctgcttttcccctgcttctttgaggtggataaatgttttgttcagtagtggagagggcactagctattgtagtcctctctgcagggccatgtccctgggggcatttggagaccaagtagacatgcccaggagcagccaactgctgggccccacggcctttgtgtttgtgcaggaaaagttcttcctgggaacacaggagactggaggtcacccccaccccttcccaggtccctccaccctgcacttcctggacttgtcaatggagggagggtgtgtgacccaggcttgttggggatgttgtttgtggggcagccccttgcctctctctgcgcctacctcacttcccatagctttgtgatataggctgtcctgccatctcaggtctagacaagcaaaatcaagttgtatttttaagttttttagatacgagtatggtagaataaccctatgtacatactctttggggaagaaaggctcgtacatgaacatttagaagatggattagggagaaacctaaacctgccctcttgacatatatatgaaggaatcaggttaaaataatagtagtgcccttaactcacagaaatagcattcaaaggagtgaaaacaatggaaagcatgcttgtggcctaggctgtggaaggtgtggaatgtgaaactgtctaatccaataacacccactaactttcctagactagagttgccaggccccacaactgcccccaaagtgtgtgtggcagggatcggataggtggtagaaggattagaactggattctactctaccttgaagggattaatgacagtcacagaagtttctgggaggctgggacatggcctgctctctgatctagatttgattataggagccagtcaggggcccccattgtttgattccttgccctagagcatcctgagaaggcagcttagactttgggtttcagaaacatgaaagtcagtgatggtaccgacttccatgtgtgtcccaggccctcagacctctggtggggcagtcccagcttgggaaggcggaggctggcctgaaaacagtgcttcatgctgcctgaaacaggggtgcctttaagggcttccccttgctggccttcagcctgggccagaagtggggtattcttagctcccagtgaggctgtcaccacctcggaaacccgaggtcctgctcccaacatagaccacaccaagtacagtttggggaggaggcactgaagttctcaaatctcccattttttggagaccttgtcataaagagaccttgagactgctttaaaagatgaaagagtcccacacaattcctattcatgtcagaaatttatgaggctgaactggtggtgtgtcttgcactatagtttcattcagctcatggggtctgaatttcctttttatgtttcattttttcaagagttacaattgggtgtttagtctctagrgtcagtgggatggatatgctttttgccagacttttcacatttaatatgtaactgtttgtttaggttgagacattttgatcctttttgccgttgtgctatttgatgcaggatttattattaatttgtattatttcttgctattatgaaatttgatgcaggatttgttcattgctttgcactagtctcactcgcagccctggtgcaagattctgcagggaacaaacaagttccttttgtcactggactgctttctggcaggtctagcagttgtccttataataaccggacaaggcgggagaactgattttatcctgcatggaagaggagtaactcaattgacattctttgtcatttagcagtcagttaatggccacttactggaaaatgttactaggctctgtggtgagtgttgttagaaactgaattactctgtatatttccccagggccctttttccccttgcctggagtagacactcagaacggcaggaagtggcactgtgttgcaatcatagtttcattgttcctttgtattttgcatttcaaaaataatgatattgcttttaatggtaccagagacttgccaggagcccagggggtggtacagggtcactggggtagccccagcctgagggtgcccaggagtggtctgtggaaggtctccagcaatgtcagcctcacatgtgattaatttgagtcactgtgaacatctctccacctccttgactttacccatgaaatgatttccaacatccagtcactttcctgggtatttttagtcactcactttgcagaacctttgatggtctacagaagtgaaggaatgggttkctaagtccaagctgaggtagaatcctggcattgccatttactagagctgtgtgaccttagacaattcacttaacctctctgagcctcartattcttacctgttaacaagtggggatatgggttcccagggatgagggaccggtgaaatgatatgcctggagacagctaacacaatgcctggaaaatgctaagcacttgtcaaaagtttcctacccctcttccttgccagcttaaaattataactgcagcagcagaacgcccccatttgttgggtagcagtgttgtgagctgagggggtggaggagaaaagcttatctgttagttttctttccacctggagagatcttccccctttccttccacacagcaatagtgtaaccraatgccagagcagtcccttcttcttgcggtcctctgtggacggcttgtttctttttggatggtaggaggcatccaaagcctcttttagggaagrttggtcttcttccaggagactccacactgggatggccacatcattccatttctgggtcacgttttcagctccttgggcctgcaagggatctctgtcccttctggagtaaatraaataattgtmactagcctcccacttaatgactgtggctattgctcctctttctcgcacacgaggggaggaagtctgctggggcactgggyagcctcccttcccgatggcaccagagcctggatttttgaggtctggtggattcctgagactttccttcctcaccccagtctggayrgcatccctgggcccagcctgccgcggcactcgtgggaagtggctggctggctctsctggctccacgcacagctggcatacactgacatggctgtggtttgcttctmtctccttccttscccctagagtataagaagaagtacggagaggaacayggctcctgccaggctgggatagcgggcttcttcacygaggtgggtgtctgctgtctgggcatttctgttctcttgtgggtgttcatttccttgcttatatgattttgrcaacccttagaggtgggacttctggagtcccagatacttgagcctcgagggagcagattctggtcctcacaccagaggaggctatttctacctgccmggagggcaccagctggccagagaccactgggcagaggaggtggggtggctcatctcgaggctacccctatttgatgatttytgtaggagtctgcttgactctgagacctggggaaggagtcgatttggggatgtgtgagtgagatgacattcagtcaggttgtgccccatcattggcgrctgtgcagatacatgaagcgtgtgagcatcccctcctagcagccttctctccttagtggagagacttgtttgtttttcgagacagagtcttgctatgtcactcaagctggagtgcagtggcrtgatctcggctcactgcaatctccgcctcctgggttcaagcaattctcttgccttagcctcccggttataggcgcccaccgccacacctgtatttttagtagagacggggtttcgccatgttggccaggctggtcttgaacacctgacctcaggtgatctgccagtctcggcttcccaaagtgctrggattacaggctgagccaccacacccggcctgagagacttggttttacacacaactctaaccattccttttcccagattcagaaggacaggacacctgcatgcttatgtgcccgtgtggtagtagcatgacttttggctggtagtacatttttagggactgttttcttgtgtcattcttacttactgtaagtttgcccttcgtatcagttcctyctctctcaaacactttcatgactgcctgctggcactgtctatccatgtggttgctcaggccaaaaaaagagtactttttacttctaattcatctgcagtcctgttgttttagcctccaaaacacatcccaaatatgacagcttttattactattacaatcrcctccattatcaccatcatgcttctagaaaggccaccaccatcacctggaggtacactggccctgattggtcttcttaygtctattatgcttttttaaaaattgtggtaaaagatgcataatataaaagtcaccactttaaagtgtgattcagtggcattagtgcattcacagtgttgtgcacccatcaccatgggctaggttagaacactttatcacccagcctgcatccattctgacctgtgaagtgtgctttctgcatactagccccagggtccttcaaatgaaacccatccttctgactccgaggcttcccagtccatggaggattacaatgtaaagctcctcatcctggcccctggacttggctccctgaggccacctctctcttttcctcactccaggagagcagagagctggggaagggcatgggacatggggggtggagggaggatgaagggtgctctctggcttccaaagtgagggcccctcctgagtcaggagcaagactgcctaccttcctttcagaaactgctgtttaaatccaaagagracatagacagttggcaatatagtgtctgatccagaaagcaagaaagaaaaggcagaaagtctgaagttttatttycactctcaaaccaataaataggagatgctaccctccaacccccattccgcaccctcagtgattcttacctcgctggagaatcatttttatgacagtcgacagagttctatgccctgggaatggcaccgccaatcatcctaaccattgaggccgaatttaaagattgttctctcacctcactctcctacttctaagccaccttgcaagtcccaccacctcctatgccctcaaaacctctaacawtgacatccattgccctccacatcctctgccaccctacaaatctaagccatagttgtcttgcttccaacccactgcggaatccttctgccgtcttgcttccacccttgcctctggacagactggtccccatgtagcagccagaaccaccttttacaaacaggaaaaatatcatggtgctcccttgctcaggactttctggtgtcttctcatcctacttagaatgaaatgcaaatgccttcccttggcctcccagccttcatacctttccaggctcatctcctacctcacccactacatggtattttcagctgctgctaggacatgccggactcccactggtggcattgcactggagatccattcacgtggctccttgtacacaagtgtttctttagaagagacactaatggaggaactgctgggtccaaaggcactcagatttgaattttgatacatgttggcaaattgcacttcagacatgtttaccagttgacactcccctgcattgcttctgtctctatcttctctcactcagactttaaatttttgttatgaaaaaacatctcgttttaatgtcactttccctgattattaatgtcatttaatatccttttaaaatattgaccatttgtatttgttttcctggaagttgcctgtttatgttctcagtacattattctgttttgttgttgttgttgttttcctggtttttaggaacttgttacatattttcaacagtaatctcttacctgatctatgtgttgcaaattttttcatcagcctttttcttatgttttaagtttgcctatgatgtctttatcatcctggcaataaacatgcacatttggccaaatctatcagtcttttttttttttccctctagattctaaacttatctcttaagaaggttattccttatgtatactgcaagttggcatgaacagctgggcaggagagtgcccgggatctacaacacatgtctgggctgaacaaactcccatattttatacttatattttcaatatacttgtatttttaatagcactttcataggttgtttttaaaaaagatttcgatctttaatctttctggaatttgtgttgtatacattgtgtgatagaaactaactacrttattttyctaaatatatagttggttgtyctgatactggtttgttaaacaacttttcctctccccattgaaatgccatcctgccgtgtggcgacttcactctcttcttccatctcagcaaacatttagattgtgtgacaactatggctgttgttcctccaacaggcctgtctagtattgtatgacttgagtcaataggcagtgggaaccactgtaagttcayaagcaggtgacacactggcagatggcagtgttgaaagaaaggctatttgagctgggtttgcccagaactttgggagtggaagggcctgaagggaggcctggtaggaggccgtgatgtggtaggaggccgtgaagcaacaggacagtgtagagggaggcttaaggaataaaaatgattgggggaggcagagaatatgaaggaaatgtcaaggggctgggtggccagggagctgtggggtagaggaaggagggtttgagccaggcttctggagaatggtggtgcctctggtgaaaaggggttgcctgagaaagaacccattgggagatataaactgccaagtctgctttcagacacagggagtgtgcgatgtttttagaggacgtttggacttagggactggagtcctgcctggggcagaaacttagatttggcccttgctcatgactctcttaggggatgagtgtgcttagtgtagggcatgggggagacacctccctttagatgggaggagaagctagattgatgggagacatcagaactcaacggagatgttgacagagagccgaggagaaagtgttcccaggagggaagtgtcattatgtttgccgcagcagctggcaagtcaggcattgggctgagtggaggcagggagtggtaggaggaaccggcggggcaggagtgtggaggggaagtccaggtagytgtgcaagctcagggtgaccagaagaacagaagacctgctgaaatccaggctttgggatttagaacctgagggaaacatggggtgtcagcatgtgctggctgtgctcatggtacagcaaagtggggacatggtgggtgtacagagtgtccggggagggtgggcagtggtgagtgggawggcagcccctctgggcgccactctgtcctctgaccccggcctgctgtctcctggctactttggactttggcctccgcttcagttcccaggcttttggcctccttaaacaggaggtctttgaactcactgcctgccttgtttctggaagttcagctgtttgtggctgagcaggaaatgtggttgaagggtccaggccagcgcgactcccctcctctgccctcttgctgacctcgccacttgggcttgccttttctgtgagctgttgtcccctcccaagctggacatggatctgtggccttctggtcatagctatgttgccccaaaatattttggcctaaggtgcctgcttgacctacaggtcagtgaccctgagcttaacaaagccttcggagctatggataccacctgaattttagcctgacattgaggattagagagaatttcctgggaggtttatttatttttgtagatgaggctaacagaggtagtagatactgcttagcagcaagagaggatttggaccagctgggctggcgttcacgcctgctgtagaagcctagaggcacttgggtgggagtttgttcagcacggacttctgttgtagatcccgggcactcctgcccagctgctcatgccaacttgcagtacacagaggaaatatatggcttctcccaggcccacctacataccccggttcctctaggkgttctgctaataaatgcatcttgggaaaaagctgcattgcttattgatgggattccacaaatgtgatttaggtagtggtggcctttgcttagagaagctttcatttgtgtgtgtgacattgacactggctgttcctgcatggtggggagctaagtattagtcactttttcctagcacttgtgaacagcaccagaaaggtcacaagcatcatccatagggaacagaaaaaacaactatgagggatttccaggaaggcactgtccctcccttcagcctcagccctgagggtcgcaggcttggccctgttttatgtagtatgggctgaagggagaggggtgtgagcactgggggcggrgtggcgtggtgcggtaaaaacaagagctgttggttttaaaggtttttgaagacaggaattactttatcttaccctgtttataatgtttgagaggggatgcagtggtatggtaggcatacatttttcmacttttatcctgggttagtctaaatcatcagaaagcaacatatcccatccctgcccccaatgttccgaagagcctttgcaggcctgtgctgatgctcaaagctttggcctgtgcaaagctgcaggtggagaaagctctgcactgaggatacatctggggctgaggaggttgctcattaggttcttcagtgccctttgtattatatttggacactgattacaaattcctttccaagctcaaggccaggagaaaaagtctctcctctgatgaacttatttctgttttttgtactctttctagaactagcgtggtctcttatgcaggacagatgagtgtaaaaagaatgagtggatggatgctctgctgtgtttcccagtggagcgtcctgactgcagaaagctatctatttttataaaacagtgagatacccctgggaacatctggcttatcatcaacagcttccttcaaggggggtaggatctcaaaactttaaaatgaagtgctcatcaacagtcatttcttgtctacaccctcctgaattatcaaaaagcaagcctttccggcgagaatctagtggcttttcttccatctgtgttcctgccctatccyytgttaaggctcttccccaaattaaccataacacgtattgtttaaggcattgccctcttgcctgcaggctctatcctcctctctctattttttttctttaggtacttctggcttttgcagacacttgctccctgagaattcagtggtgactttakgaattgtcctcagaaattctaaatctctgcggcaggatctagcctccagggacttgtcagagccagcagcttctgccagtgcgtgggctcgtctctgcagagggagatcaacctgaaaagatctgtttctgaaatatatgtgggtgaccaagggacggggtgcaggggaattctgaaggctyaggggaaggtcaggtgggtttcagcagtgagagacttgacctgcacagcatctgttatccccatgagccttcatgaccagtatctttggagttttgtctatagctgaaagatttcctctagaaattttgttgattttaacctgtttgcatagaatttttttctgaaatactttgcacattaccatgctgtcttaccccaagaatgatctacgaagggactttatttatctttatatctagtgtgaactctgagatataatagtaggtgcccaataaacattgttgagtgaaaaattactgatttcattagaaaaataattctgattatttcttattgcagtgtcgaaactttagaaaataaaggtaatccaaaagtagggattccctgttggggaaaggaaggactgaaagccagggacctctgatggatacaagcacagcctgcctcctagctccagcacagcctctgcacaatgggagcttcgtcttaatgcttgtaaaatgtcatctcattagcatgttttgtgtttttatgtgatgacttccttgttagtgtttaatcactgttctggaattttaaaaagtcaagattattaattaaaaaaattaatacatataataaaatacactattttaaatgcagagttcgatgagttttgacaaatgtgtataccatgtcgtctctgtctgaatgaagatgagaacatttccatcactttgggaagttcctcatgcccctttgcagacagtgttcctcctctttactccaggtacccactgatctgacttccatcagtgtggattggttttgctgattctagaacttcctatgaatggagtcatttttttctcatcaacatttggtctaggattcacccatatttcaactgagttttgaatactgcgaaagggttacacaagcagaggaagtgtgagggcattgcacagatggagataaaaagatcagagggagttccgaagaccagaattagtttagagtgtcctaggcatgcagtctgagggggcagtggcaggagaagagcctaatgtggttgaaatagtggacagtgttgaattttacctgagccctgtactcttggaaaacagtgtggtctagaattttgaaaaatgcaaaggaaataaactttgggagtgagagaacaggggatgttgattgatttccattatcgtatcacccaggggaaaaccccagcagatatctgtgctgacttccttgggtgaccaaatcatttctgggaacttagggttgttgtcagcattggtgatggttctggggcacaaacatgctctcagccctgttgaccatttccccctgatctaaatgctgaagacagctgtgcctcttatgttcttgagtctttttttttttttttttttttggcagagtcttgctatgtcacccaggctggaatgcagtggcatggtcttggctcactgagacctctgcgtcccgggttcaagcgattttcctgcctcagcctcctgagtagctgggattacaggcatgtgccactacacctggctaatttttgtatttttagtagagacagggtttcaccatgttggccaggctggtttcaaactcctgacctcaagtgatccacccgcctcggcctcccaaagtgctgggattacaggcatgagccactgcgcccggccttgagtctgtttttaacagtgataccgtctattgctgccttgtggtcccctcttccagtttgtgtttttccttagttgaccttgctggtctcttggttttgttcttccatgtttgcagtggactgtaatgatcggaaaaccatgttctagaacgtccctgagagggtcttgagtgtggtctggaggggattccctggagtactagtgcacagtttcctctcgctacgcatcaggtcgggggagttgaatggtgagcctggagtccaggcagggtgcggtattgcttactgcttttcatgagtggtgttccccagaatctgtggttgaggtcaatktcagctgtttgtcatttccttgttagagcctgatgtaaagttgaggaaacgtgtgtggtctcatcgtggatagaataggggcctggcctgtcgtgaattctgtcaccttgctcagtctcttcacatctttagtcctgataatcccgtctgtataatagattccataatgctgatgaatctggtgaaatctgtttttgttgcttagctggggmaaaaaaagttcttggtgtgaggaatttctcctttgttgtgactgtggttctcattgcattcccctcctcccctcctcacttccttctctgcttaccgttggatttctttttggtaggagctggtggtgatgggtgctccagggtcattttattgggctggaaccatcaaagtgctgaaccttacggacaacacctatttaaaactgaacgacgaagtgatcatgaacaggcggtacacctacctgggtgagtactcagggagagaacaggtaagaaaggggaaatgggagtgattcccaccagattcacaaattattgcttcattgttggaaagaggagttagttggctttgacgcctgttgttctaatgacttacatctttagccagggcatcttcacatctagctccacaaacacaaggtagagaggaaaaccaaggagggaactgaattaaaactgtatgctttaattaaaaagctgacagttgaacctccagggaaataaacattttattttctcattttatcaattgttgaagttcagatggtcaggtaraaatgagtgtgatggagtcttgattttccacgggcgtccctttggatggagtccttgctttctgatcacaaaactggtagcaaatagaaagataagaactagaaattatcatgacagatggcaacctaatgctgaaggttaattaaaggctcagaaaaatttctcttgctttcttaactcttttaatcttctggaaagaagatagacacaatttaatgtagctatcaggcagaatgacactgggacaaggtccatgccaatttaagaacagacataggctgtctttgcttgtgtagatgacaattacaagactcttttctttaatttatgccctaaatgctataattctggattgaaagcgaagywaaatttaggaaggcctaatgatgacacacaatgctctttcgcactcatgatacataacttacagggaaaggccctgactccctttttgcatagcgtcactgggaacttcttgttaaayggggttagggagtcrttgacttgccttttcccttctaactacaagttttttgcctggtagcatagacccaacaatccttctactctggggtgtttgctcctgtaggcacccagctgcctagtgctgttgcttattaagcatttaccctatgccaggctgtatgtattatttctttttaatttctgaaacaaccttatgaagtagctattattatctacattttatagataaactgaggagcaaagaaattatacatcttgccaaggtcacatggctcctaagtagcaaaattagggtatgagcttgtggtttctgagtgcagagtctaaatgctgagctgccttccctgtgggtgcgtctgagagagcacctatcactggtactgtacttctcactgggctgggagcaccttgaagacaaaatgtgggattgtgtctcacatttggtatagtgcctggtgtatagtagtaactcaacacatatttattgaatcagggaatgaagagagagcagaagaaagcccagtttggatgatgggtttggggtctagaacagctcctttgaagcttcgagcctgtggtttctctttgtatacacattagaggctcttatcagctgcagggattatcaaggatccgttcaggctttgatctcactcagaatactcttaggtactatcagtcgccagtctgagagaaatcagccacatggtgaggaagaattgatcatgatatgatgtcatcgcgaaactcaaacaacttacaatcactttagggttagagggtgatgacaagtttggggattatatggcagcctgtacaggatttatgctggccagaggagagctttcagcctgctagcaaggctctcagaaagcaggagacgttgaggctaagcctaggcaatcttttcctttgtttctaggttccttttgcatccatattttttcactgaccaccctcccacccatccacccatccatctacccaaccatgcatctacccacccacccactgacagcttcttttgccttcttgtaggagggagtgtggttaacagcaggggctttagaggcacagattagatttgagtcttgctgtgtgatctttggcatgttgtttaacaggtttttctaattctgtatctgtaaaatggaagaaacagtcatgccttcttcataaagtttttagactgaaagagatacctaaagacatgcataaaaatgttggtagcaaccttgttcatattaaccccagcctggaaacaacctaaatgcccrgcaacagaataaacatatgacatatttatataacggatattactcaataataaaaagaaactactactgtactcaacgatgtggatgaatgtcacagatgttatgttgagtgaagttcaagaaaaggcaaacctaatatatggtgatagaaatcagaatagtggctacctgtgtggggcatattgactgggaaagggcatgagggaaccctctggggttatggttctgtggttatagtcacttccttgatctgggtggtggttgcatggctacgctcatgtgtgcattcattgagttttacacgtcagatatatgaccttaccgtatgaaaactatgccttgaaaagaagaaaacagatatatagtatttcatacagtacttgtccgaaagaagacactcagaaagccctctttcctgccctgatatccttgtgaacatgactttttgtgagatgagagccatttcagcatgagaaggttgacagctgccatttttttcctggtagtttatgttccaagagtagggagcatgcttgagaaacattttcctctgatggatgtttttttttcccttcccttctttttcaaccgtgtgcttggtttccgcccatcctgttcaggctacgcagtgaccgctggccacttctctcacccgtccaccattgatgtggtaggaggtgccccacaggacaaaggcatcggcaaggtgaggagaaacatctgtggaatagctggggtcagacagaagaggggagcatgctgtccctggtgcagaggtttgccagctgacattgacctgaacattctactgggtggctggtggggaggtgatgaggaaccccctgactgccccactccattggaaagtttcccttgaaagctcaattagagtgtgagtatactcacactctcgatttcctgcacactctcatctgaggtttttcacagctgaccatgtgtgtgtgtgtaatttataagactgagccctggccttatggtgtccttcaaaagaatggcatttagtgctgtccaacttcaaatcccaaacccttcccaagtttggctttgatttaatggagctaggtccagtctcagatatctttgaggctttattcatgccccaaattattctcgtatttatttccccagtgtttgagaaggaacaytgggttcccaagactggttcagcccaaaggctggactggaaatatgtgggtctggctttccctaaactatagtatctgccaaaaaacccaccccctggatctagggctgcctgaattcctttgggaaacatgacctctgaggggcctgaattgtgaactacgcttgttggttctttatcatgaaggtacaggaaatccagattgagtaggtacagatggatcaggaacccacatttttaagaagctccataggttgtctgatgggaaagactgagtgaacagaggaatgaactttggatctggacctttaggggtagacctgtgatagagtctggtcatatctcccagggcttggagaagtggaatctggattctggattagcccagatgagctgagaccactggtaattggagccttcagccaggaggtcaggatgatcagggagctgacgaactttccagttgactaggcttgactaaggataatttctgtggatcctcctgggcagaggttaggagctgctgctcacgtttctggascatgtgcctccctcctccctaacactgatgctgtggaaagaggttcttcaaaactgaaaccagataaaccagggccctgagctggcagggaggagggatcaagcaggtgaccttcgatcacctcaagaaagaggtggttctttctgagttgcatgaatttatctaagtagagaaagaagcactgagagctgttcacattgatgttgtcttcttggggaggggctgcgggctaccgggcatctctgtagaaatggtaaaaatgcctacgtctagttcacagtgatgcgggtgcctctatgctaatgatagcagctttcttttctccctaattgcagaaaacaygayccagttttatagtttttccttcagatgattgtgatgaacttcatagtccctgtcaagtcttaagatgacccctccgcaaacccctctcactggctatctggggggtgcaaggtataaagttaaaaagttgagaatggtacttataattgatagagccagacagcgggactcctggacccagtttataaagtacataaaaatgcttctttcaattagaccacctgagaggcatggggaaactggtcatagtgacaaagttgctgacaattccacattcccagggattggggctagtacagacttgattcccaaggacccctggccttcaggattttgctggatattctagtgtcagggcacaaaagcactcacactaagatggcagttccttatctcatgggaaggttatttacactggttctcatgagacactcttcccacgagatgtaatccaaaaaaaagaacttccatagtcaagtacatttaggaagttaaatgtcagtgatcgtctttgcagtggcgatgcatagttcacatgaacatgctaaaggctctaaaaagttccacagtcaaagaatttacttaatgtytaactccacattycccaaatgaaactcatttttacccaggcagatcacatgactctaatattacgtgaaatcactttgggaaactgctttgtctacagtactcatctccacctatccctttatcttctgttgtaatgcctggtaaagtcttactgggaataaagtccaatccataccaccaactaattttaaaaacaggaataaaggaaatatttcaagaaacaaaatactagctttttctcagagttgaattgtttacttgtaatttggaagcttcttgggtcttattgtgtgtggcttttataagtattgtggttcaggagcagtggaggtgatgtctgcctcaggattgaaggacccttttttttgcagggctggtaaaatgacagctgacttcttcatgatcatcagctagcataagcacatctgctgtgcacctggctcttaagcttttaaataggactcccaggagagtgctgataaatatctttgatcattgatttcatcctaactagattttttttttttcattccataggtttatattttcagagctgaccgaagatcaggcaccttaattaagatctttcaagcatcaggtaaaaaggtgaggttcttggtataagtgactattttttatttgagagatgtgatcatgtgggagtcagtactttttagaaaattggtttgaaggccctacctgtgccctgtgtttatatggcagtgctgtctgcttgttggtgtctttaccttctcagcggtatgtgtaatctgtacattcatgggattcatactcgctttaggagacattctgtagcaagatgagttatatggggccaagttacagcacagagttttaagagattgtccrtagttcagactgtcatcaaagtgactgcatgccctgtctctctgcctccatcctttctcaacgaatctccacctccagagagagcagatctttctgagtacaggtagcaataaatgcttctcactgagcctgtttcaccagcccaacattacccccttccctaatcctcagccctcaactgtcattgccaaggtgactgttgccacacaaagaaaatccaaacacaggttgcctgattcctcttagaaccttgaagcagaaatagctcagggtgctgccctaaagttagcctgggtgagattactctgcctgggtcctccccaccctgtccctaatcctctctctgctttctgaaagtttccattatactgccctgttgtctaaaattaagccaattagagagtcctgctattaataagcaacagttttcatgagcttatcagtcatgcacttcttgtgtggcttagatcagcaggactgtttggctgagcttggctactctaagggacacaagtttaggctgggagctgtgggggtaatttggaggtcttggtggaggccttagtgggatctgggaagaagcataggatgtctgggacatgggaggaggccatgtgcctccycaattctgttcctgccgagttagaactgctgtacgccagcctaggatccttccatgttgttctcccattcaagtagacctttttgcaattttaacwatccgaataggtacacttagtgtataattgtcattatcttttgaataaaaaatgcatcaccaaacttggttttgcatttttcctcagaatggctctgccttcccgagaactctgctggcttgtgttattttaacatttccaaaaccccaaagcaacagcactggaaaatgactgtgagccattctgcaaaagggttttccaagcacccttaaagttagaaaagaaataactctgtgctacttgtgatttacaaaagagagtttcaaagagcaagtagggtatgagtggaattaaggctaacattttagatcttctgcagaagataacaaatgggtgaatgtatctagcatggaaacaatctccctcttcccttcaaatgtacctgggtttgaaagcctaaaggtaaaggattcctttttttttttttttttgagacagagtctcactatggcatgatcttggttcactgtaacatctgcctcctggactcaagccatcctcctacctcagcctcccargtagctcggaccacagacatgtgccaccatgcccagcaaatttttgtatttttttttgtagagatggggtttcaccatgttgcccaggctggtctcagactcctgggctcaagggatccacccaccttggcctcccagagtgcgggatgataggcatgagccaccgcacctggccaaggattatttaaaatgaattgtggagtttctgagtatctttatgttcagttgtagctgtgcccccccaaactgcttttccttccctgccctactccttactgtctgtgccctggggaggtccggttaattcctattgccttcgagtaattaacaatctgtaattgtgccctctctcctccttgaaaacctcttggtttggatgagaacctatgctcaagttgatcaggtttttgggggtagatctgagagtgggtggtgcaaggaggatgagattaacctttgagaacccacttgtctaaacttcctgaagacttctgccattgagttccaggacaggttcaggcctgaatgtctgcttggatgtccttatcataccaagatacatcaggttccctgagaagggacagaaaggcccaggtattcaacttcttggcttcgtagccatttgactttttcttttctttagggctcttctggccctaacctttgcaccattccataggcaccccttctttctgccactcactcacagtcctcttgccttcacttccttctactagtgtctccaactagatttaccctgtcatcatcgttctgcttttgaaataggccatgacctttctttatacaacttattctacttcttgccagaagaaatgagacattcatgtctttctgacttctccattacctcctacaaaaggacatgaccccaggctttcaaaggatgcctttagatttatccctatgtccagagtyacatagacaggagggttctaactcagcaaaccaccggttcacttctgcttccgtttggctagaatttggtcagatagttctgtatcctggcttcctataagaagaaacaaagcaaaaagattaaaaaaacaaaaccaaacaaaaaaaacctggttcttgtctttattggttgactttctccaaatagtacacttaagaaatcaccaacatgtgtgcagttcagatgttaatacagacacacatctccacatttccaggctgatggggagctctgatcatcggacacacaccccaaagcatgtcattgccatattgaagttttattgaattaacggagtatgtgaagcatttgtatttcaaaactgagataggaaacttcacatatagagatttctaatttaacattgatgaagatgccaagttaaatagtcctttggaatgaaacaaatagttcccctggggctcagccagtgagcgcagccagcagcttggctctttgggtctttgcctgtgtcttactgatttcttttaccaaagctcagatggggagattggcaaggccactgaaatagtgactggcaactcggtttctttcctcctcaccctytgtgatttcaaccctttcctgctccgttctcctttgagaatgggtaatcagaggggaggaagatggccttggcatatcactggggaaggatttctgagcggccactacaaagccctcctgtgaccctgttagctgcaggaaatagattggagtgtcctctacctctctccctcaaackccctgggtcagctgccaacaaactccaacagtaaaagaaaaggcttgktcatgtccatcaacccaggggccttttattagaaaacatttattttaaaagaataatgctttttctctttcttttcttttcttttcttttcttttcttttcttttcttttcytttcttttcttttcttttctttctttctttctttctttctttctttctttctttctttctttctttccttccttccttccttccttccttccttccttccttcyttccttctttcttttcttttcttttcttttcttttcttttcttttcttttcttttcttttcttttcttttcttttcttttctttctttctttcttctttcttttctttcttgacagagtcttgctctgttgcccaggctagagtgcagtggcatgatcttggctcactgcaacctccacctcccaggttcaagcgattctcctgcctcagcctcccttgtagctgggattacaggtgcctgccaccacgcctggctaatttttgtatttttagtagagatggggtttcaccatgttggccaggctggtctcgaactcctggccttgtgatccacccgcctcccaaagtgctgggagtacaggcgtgagtcaccatgcccggccttcttctttwatttttttttaaagtagaggttgcaaactgacagcctttggaaagaatacagcctacaaatacttttgtttggcttgcacagtatttgtttattgtttttacacacgaagaagttgcgagcatttaaaacactggcactttaaataaagttttaaatttttggcttcttttggaaaatggaaaggttgctcctctctgggtcagcattcctcttggtggcagttagctgcagctgggttgaagctgctcctttagccaggcttgtgggctccagtttgccacagtctccaccactccctattgttatgtagacaaggaagacaagtgtcacttgccacattaattttttttcttatgcctgttatatcacctgcctggatcctgttggtatttgggtttgagacccctaattaagctataattaaaagtcaatattatcttgctctgttccctcatcagttaaacagtcttaaaagttgtacctttttctgtcacttcagctcatgccttcctaaccaatctttcacctgtgcataggaccaggagagaataacctatttccccatgtaacatttattttcatgcctttcttgtgttgtgagatttcatattcctacttgcttggccttgtcaaatgtctgatataaggagcatttttattatggttgtaacataactttgtgtcctcagcttgcatttttaaaaacagcacctcattctgtgggcatcaatctatttatcttccccttgataggactccaggaatgggggactttgggccagttagctttgtctcacattgactggggccctgccttgctgctggaagttgggtatttcactctttgctaggcattctggtttagggggcagcatagccatccagcctctgagggatgtttctttttttttatgtttttattttttagtatacattaagttttagggtacatgtgcacaacgtgcaggtttgttacatatgtatacatgtgccatattgatgtgctgtacccattaactcgtcatttaacattaggtatatctcctaatgttatccctcccccctcccccaaccccacagcaggccctggtgtgtgatgttccccttcctgtgtccatgtgttctcattgttcaattcctctgagggatgtttctaaagccaatggggtggaggaaagcgagggcatccttgtgtgagagcagacactgaatgctttgttgcaactcaacttggttgcagatgggctcttacttcggctcctccttgtgcgcagttgacctgaatggggacggcctctctgacctgctggtgggggcccccatgttttctgagatcagggatgagggacaggtcactgtctacatcaacagaggaaatgtgagtacaatactgggcaatgtgcggatgggtgtsggggagggacatttgtccagccagcagtggccgagcacccctctgggccggcactgggggcaatgttacccagaggagatgaaaatatgtgatatctgtcttgaataagctcaatggcccattaatggaaagttatatacaatgttacaactgcagacacccaggggccaaggaagaatcttaataattgtcttttgagtgcttactatgtaccagggactcttcttcctgctttctgcgagagatttctatgcaatatacacatggtatcaagggtgcccatttttcaggtggaaaaactgaggcccagagaggttaggtaatgtgtcccaaaccacacagctaagaagtggggctgggatttgaacctaggcaagctggctttagagctggcatgctttgtctcaaggttatgccacctctctgggagcatatgcacattttcccagggaagcagaggaggacacaatggctggggaatcttgaagaaggagtaggagttagcagacaggcagggtgggctggagcagagctcccagtgcagagctgggcaagtgggttggggtgtgaggtggcatcaccactcatttcagcatgggggggcaggggactgcatgggaaccataatctttttgttcgtttgtttgttttgaggcaaagtatcactccatcacccaggctggagtgcagtgacgcagtcttggctcactgcaacctctgcctcctgggttcaaactcttctcctgcctcagcctccccagtaactgggattacaggcacttgccaccacacccggctaattttttgtgtgtttttagtagagatggggtttcaccatgttggccaggctggtctcaaactcctgatttcaagtgatctgccctacttggcctccctaggattacagacgtgagccaccacgcctggccaataatcttggtgtccyctattctgcagaaccatgaaagggacgtgacatggacagaaagatgcctctggccctctgtagctaatggagggtgggtgagtgggggctgggttgggggacagcagtgcatcgtggaagcaggagaccagtgagaaagcagtcttttcaggatctkgaagtacaagtgttcaagtacaagtattcagcaagaacaacatggttcaatgaaaacattctggtgccgcctaccttttctctaacatgagaaaacgcttatggagataatcagtggaaaaatgggatgaaaactgcatgtacaaccagtcctcagaaatatgccaaatacatagaaaatgtgaataacagctctctggatagatgtttagttttatctttatccaaatagtgagaatataatttcatatttwaaaaaatcgaagtgtactgttaagcagtggctgagatgctaggtatcccagttgggagagggcagaggtttagctataactaagtgggcagatgccagaaaggaaggaagcagtgaaaggagagccagggattgttagagccttatgttgcgtctgaggttttcaggctcttcaggaagtcagatctaaaaccagggaggtttgggaggcccaggtgggaggatcacttgaagccaggagttcaagaccagcctggccaacatggtgaaaccctgtcyctactaaaaacacacaaaaaaattagcctggtgtggtggtgcttgcctgtggtcccagctgaggctgaggtgggaggattgtttgagcccaggaggtggaggctgcagtgagccgtgatcatgccactgtactccagcctgggtgacagagtgagaccttgtcaatcagttagtcaacaagccaacaagcaaggtgcagtggtggttgcytaggaggctgaggcgagaggatcccttgagcaccggagtttgaggtggtagtgagctatgattgcaccactgcactccagcctgggctacacaatgagactctgtctctaaaaaaaataaaatatctgggagggaaggtgcttattggtacctgttgcaggaactcttgkcacctgcatacccactgacattccaggaagtcagggcagggtgcagggagaaatgaaggggacattaaataaatgagtgctgtgggcattcagtggtgcctgccattgtatttgcaggagactgagacatttgtgtaggagtcaggtccaacagccagactgtgwgtctaaatcagaaggtggactcttgaagcacaagaactcccccaggcctccactgggcatgatgcacccacaccctcccctgccaaccagtgtttcttgatgttgtatggttattctaagtaccagagtattctcatttctgttgaacatcagccatttgaataaagatcggaaggcagtgtggagtagtggaaaaaattctgactttggagcaaggtggacctgagtttgaatcttggttttgccatgtcctagcctgtgtgatgtggacaaatggcttgaaattggtggcccaatttcctcatctgtaaagtgagaggcatcataagatcttccttatggagtcattgtgtgatttgaatgaggagctggctgtacagtacctggtacataggagcaatcagttgctggtgttcctctcctcttccccactacactgaaagaaagaaattaatgcatatttgtgttttggggtggaggtttcattcayccaagaaatcatctcaccttgactgttttcaaggtgtaaattgtgtttatagtgaaaaagaagacttggtcatgataaaagccagacactcgtgggatggcctgtaggatatagtgggcccagactgcctctgcactggggaatgcatacatcttctcatgtctcaggacatcagattgcattgtatcactctggtcttcatgtgtcagtgatttggggtgagagtaggtatgactttttcccccaagttagatgacttttcctgcctttgtacaccattaaccccctccctctgttggttagtattttctcaggaaattcatacctgagccatgcatgaataataggcacagtgacgtctgccatcacagccaccctctggccaagaacgactgggtgcttggattttctgaaccatgactccctctatcaagataactcatatatgcactttgcaaaacagttttataaacttgtaccaaaaggcacaggaragaaaaaatagaaaaatgtatacccttttaaaacaacattggggaaaaagtgctatgccttaaggacgtggagagcacatgggggaaaggtgggtagggaggtttgcttgtgtgtagtgtattaggacaaggcagagagtgtagtcattggctaccatgacattctccttccctcaaaaatgcatctcaggctatgggagaccatcctgctaagcaggtaaaagggackcattttgccagcaggagagagaagtttgggttcctgtaattctgcccaggtgtttcctgtcaatgagtgtgctctagcagggcagcattcaaactctggttttttattgatttttattgtttgttctgtttgtttttgttttgttttccattttctcctccatcctgtttcccagggagccctcgaggagcagctggctctgactggggatggtgcctacaatgcgcactttggagagagcattgccagcctggacgatctggacaatgatgggttcccaggtgagtgagtgctcctggtgcacggagcccctccaggtgcagcacgctgctctgtttcagaggggcagcctgctcgctgactgtccatctctagtggcatgctcctgggtctactgatccccttcgaaggcccatcaatgtgctgtggggagataggacacgtttagaggtgctctccctgtagacacgcagggctgagcttccagcccactggagttttgcctctgcataatcccttctcaccagctcagtgttctttgttgtttgcagtggaagcaaaccttggggctggtccrtttgggacttcttatggcaagaagtttgaatagcttcatcctgccatcaactctccttgtttctgagcctttgatgctccatcaygctctaccatgttgatggggaaatgagtgaggagaraattagaaacccagacatcttctgcctgattatagcagcagctagattgacttttgagagtgtacgcktgtgtgtgtgtgtgtgtgtgtgtgtgtgtgtgtgtgtgtgtgtcttgggaggcatggaggcatatgtacctaatgyctaggtctgtttggacagcagtgttcctcacagcctcttggcctctctctctggcttgtttgagcctcttcacctcgctgcatacacagcatacagacgtcgggaggcagagcaaccatgtcaccagggcatgtggtggtggaggtggggcaacccttgcccaggccagccatccagacgtctttgatacctcctaccactggctacagtgggcttyattttcctcccccttggcctcacttctgcagacacatgactttgttagaagcaagggaaaaaagttaggaagatctaggttttgttctaggagttgccagtttgtgagagtaatgttatttcttgtgtgtgaagtgaatgcccttctgtatatttcctttatccaggaatggatttattatcaaataataataaggaatggtcctttatccaggacctcagactttctcagttacacaatagccattgtctatggaattctccctgatggaaattatggcacgtagtttatatttgcatttcttttattggatgggtcagtggtttttcttacgagcataaggtagaaacttttttggaactaaattcttctcagtcagcttctatagttttcactgkacttttttttttttttttttttttttttgagatggagtctcactctgtttcccaggctggagtccagtggcacaatctcagctcactgcaacctccgcttcccgggttcaagtgattctcttgcctcagcctccagagtagctgggacaacaggtgcgtgccaccacacccagctaatttttgtatttttagtaragctggggtttcactatgttggccaggctggtcttaaactcttgacctcaggcracctgcccgccttggcctgccaaagtgctgggattacaggcgtgagccaccacactggcctacttttttttttttttttttccygctgagggatcttgtscccaaattaatgcttgaacaatcaacaaccaataatttctggtatccagggactcagacatrrcaaccagaattagggaagctgcacttgtattrttaatgtggctttttaacccatagctgtttttttaccctcagatgtggccattggtgcacccaaggaggatgacttcgcaggggcggtctatatctatcatggtgatgccrgtgggatagtccctcagtactcaatggtaattagtgtgagagtgatatggcaactgttcatacattcattcagcaaacatgtatggaaccttcattatgcaccatgccctggaggtacaaagaaaaacatttttcttgccttggcmttcctacccttttgtgaaagatacaattaatattgcttattaaatactaaaaaaagcattcttagaatcccaagttcgctaacactcagggatgcattttgcctaaagaagataattttcaactcttactcagagttggagccatttatttaagaaaggaaaggaagctttctctttttggtgactactttgtcaaccgtctatgctaaggcaaaggaatatgttttaatatataatctagaagaaaaatggtccatggtggaggggcctgaaactgatcacagactgtcgtcccagctggcctcaaaaccaggagccagttaggactctgcgcttgcgccctatacttgggaacatggaagtggtgagttctgttttttgccgtatcagcttggtgttcaatcttgctgatggtgtcaagcccagcccatgggaaaaaaggaagtcatgctctcagcagaagcattgtcaggatatttgtggatgtctgcctgtggagtggcactggctctggtctttctcccagtgggtcagagacagaaggggacacacattgagaaatttccaatcaacaaatatttatttattgaacacttactacatgctgactacttcctactcatatgtatttgtattttaattttaagaggcagcaggtaaatgcaagtacaacttctacatgaataattgtccttggcagatagagataaactagttaagggtggagggttggttggttgtcattcgtgcctyagatcccctctctactggcctcctgctgagctcagtgcctcacctgcaggagacagggctttgggaggcgctgcgaagaggagggactgttttttgggtgcctactctgccctttctttacctttaatcctcgcagcagccatgtaagatgggtctgtttattatccaccatttatttatccacgaggcccaaggaggttatttaacttgcccaaggtcataagtggcagtatggccacagaatctttgccagtctgctgcctgaaacttgttatcgtaaccaccatcctcaactccacattgcaaaaaggaacgctcggaaactcagtaggaaaacttasgaatatggaaactattttgccatgaggcatacatastctgaggggcatttatctatccagaccatcctcttttcattagaartacataacaggagattaataaacttcggtgattcagcccacaaggcaggaggaagagagctttgggcacagtttgggggccacatctgagtcacaagagctgccctaggctgcggcagggatgctcttcccagggtgacaagctaaaagtcacccaaggagccccgtgctcgggcagcggtcagggtcattctccacgcatcctccgggaagcttgttttcctggacctcggaagctaatcacacagtgaggcaacctgtgagagaccccagcttcccctcctccggggccctcccagtgttttgtttggttgctgggtggaatccctgtagagaaccacagtataactcttgtggttagcgtggagcgtctttagtgggaagcagggatagcatctggaccagcctgcctttgtcagcacgcaggctggctcctttgctttgacaaagagaagtggttttgggctcttaaggaaaaaaaaagaaagaagcaactatgactgtacgttcccaagctgctaatatgcatatgataagggcagagatttaaaagaaaaaaaattctttaatggcagattcttgcaggcccaggtcctggacagagcaggcattgtgtgggtgaactagaggaaggaatcagaaacaactctgggcaatggaatcactttgctttggcccagatttgtattatttctgctgggtaaattgtgagatcagggcctacacttcttccacattgctctttaactctctctcgagtttaccacggagagtgtttattttaagatccttgtgtgcctttcccaatgtgagagccctctgggcatatggcggcccctatgatccttctcttgctggaggggacactgcatagaaacctggtcaagtggaggtttccagggctcctggttttcatttagggttattagcactgggcagacttatcttcttggcttttagcataatggcctgcagatgtctgtgggataacttaascctgcatcaccaccccagatggaccaccccttcgctctgcccctcgtcccagccacagcataccttagaaatgtagatccaggggcaggctgctgctagagttcttggacttcagagccaagagggtctgcttcaaaacgtggcttttaagaaatgtgcagacacacgtacatgtttgtktagacagagccatgtgggatgtagggctttgcctgttagtgtgaaacatttcttcagtgtttcctacagtgttctgatttgtactttggtgcttggacatttcctgttggatggcttaayggaggatggcaagcagccttctctgatcacttctaggagggttatttgcagttatcagctgctgggggtcagggggcatctctcgtgcctccatctgtagatcctgtgaaaactcccccctccttgccttcgtgacttctctgcaggatgactcgggaaagagaaggataaggaaagaaagtcaaagtgagcccctagatagctgtaaacctggttctattgtactttgaaaacaaagcatttctcttgtcctccacagtgaggrcatcaggaagtragcctcccctgggggaccatgcagataaaggcagaaggagtaggtcagaccccagaagatgggacttttctgattcaagaagttcagtatctttgtgaggaactgcgccacacgaatgttgatgcgcagcttcagtgtgacaaaggctgtttgtacaataaatattgttgaatcagtgctgcctgtgtggatatgtgatgaacttaatgatgaataagaagtgagcacagccaggagtggtggctgtaatcccagttccttgggaggctgaggcaggaayatcgtttgaggcttggagtttgaaaccaccttgggcaacatggcgagaccccgtctgacaaaaaaagtaaaacagctgggtatattggagcatgcctatagtcccagctacttgggaggctaaggcgggaggatcacttaagcccaggagtttgaggctgcagtgtgctatgattgtgccattgcattctagcctgggcaacagagcaagactctatctcttaaaaaaaaaaaaagagaaagttttttgtttttaaaaaacatataaagtaagcatagatgctagtgtgtcccatggtgaagttgtgaactctggttggttgagggggctgttttctagagggsagggcagggcatcttcttcagctgagtgcttttgatttcctacagtttaagaagtgttcaggaccatggagttctagatttactgggtaaaactgttcactcctgtctgtgaagctccagaatctatagatcatctggttggctggatggagaggtagtttccacatggccatcttttccagctggacatgttaattacctgtctgtctagggaaagactctgtaatgtgtgcctcttaggagcagagtgttaaatatttagtacatatttgggaagaaagatacaagctaaatatgttcttagaatttcagccagctacacctgtgtaaaaacaaacagaacctgcattaggaatggaagttaaactttatccattttgaatttcaacatgtcaaaacattatcatggtagtctaggtggatttttttcattaacacagaacttagaaaaaattttaaatgatgacgtttggccaagacaagtaataataaaggagtgtgtggycttcaactgcctgctaaagacttgctgatcacattaggattactttttttttttctttcaacaactttaasaccaagtgtcctagggaagctggaataaagcagtcacagttsttatttgtgactgtggtcttttcctgtgactccatttccctattatctgtttcagaaactgtctgggcagaagataaatccagtgctccggatgtttggtcagtccatatcgggaggcattgatatggatggaaatggctatcctggtaagctgtttttctttaaaggcacatgagataaatgaagataaatgcatgaagtagaataattttcagtctggttagcaatcatcacatccatttaggattaggacaattcacacaatagaatagggtgttttgcctggtgttcaattttaaggtgaaaataatgttgatatttattttggggttttaaactgatctactctgaatggcttagcaccaggagggtggatttgtgtagtggtttctggggcggtaattctaatgaagaaaaaaagcactggccacatctaaaatggttgaatagtgaaacctcatgttttcctttgtatttaaccacattcaaaggcttcttactcttgagagggaaaaagakcagcacccccaccgccccctgcccctactcttgaaataaaatgatggagaaagatttggagttaaaagaaaaccaagtcctcttgcgtgtggacaaagcagaccttcaccattcaatgctggctggcttggctttagagttaattattgcctgtggtggttgtggctaactggataaagatacatgatttcaaacccaaccccaagtgatatctggcctaggtcaaattgcctgggtggtggagtagtggttcttcaggtgtttcaagatggagtggggtaaggtaaggaaacaacagtaagaatttgaaaaaatccagaatggtcatggaattcaggaaacatttctctaaattttatagtcatcttgcttttgagaaatatttctttccactaaaatttaagaaaactaacgcagtcttgtatgaggacaccacattgtgtawttttgtacagataggagttttggaaattcctcaagacaacagagccaggaggaagtaagggaatagaaagaagtcagtgttgaagcttttgtcccaagaaagacccttgtgggcctttttaagtttgagaaagcagttcttgttctggaaaatttgtggccatccccaaataataccttatatgggtttagcatttaatatgtacaaaatgcttccacatgcaatgtgcatctcgcagtgaccccagcaggtaagtaggatagggtgttttccccactttataaacaaggatgctgagactcattgtgaggggctgcccagagcctgcagtgcacggggatccatgcttcccagtggttcagctacttttctgtaaatgtgaggtgagcaaggtgttcacagttcacaatggatctgaatttctgatcttgtgtttttcataagggaaattgacaaattcatcaggttcttttatttttaaacatatagcaaatttaaagactattgaagaacaaaattgatacaacacccaagtggagaaattttaggaacactataattcatggatttgccatttgtttttccctaatgagggcatcatatagatgctcagtgcatttagtgatgtacagattcagaccctcttggactcagatacttggttctgtgaagtagtagtgggaaccccagggccagggatttatatggccgggttggggtggtagggagaaaggcatagaaccactggaagagtaagtacttcctaaattaaagttatttaggaataaacattaccagttaaaccagggtcttggtttatagcttaccaagtatttccatgaatttactgacttaaatatctgatttcatatatttaataaatatttactataaatctagtgggtacttaatgaatattatataatgactaataaatattttctgatttaaatgtaatgaaatattatcagcttttgaagaaggcccyggggataattatcttcattttacagacagggataccaygagatactcaggtcacatagagtgaggggtggagggtgacaattccatgttcttcagaacctagagcattttccaagagtcactgaattctaggtatgtctttctctaattcactgatgtgaaaagaagtataagccatatgtgtaatctaaaatattcctgtaattacataaaatgataaaaaaggtgaagttaattttattaatttttttagcccaatatagccaacatattatcatttcaacatataatcaatatgaaagttattagtgaggtagttaatggttttctgtactaggtctttgaaatgtggtgtgtagtttacactcacagcacctctcgactgagactagccacatttcaaggccccagtagcctgcgtagggattggctgccacgtcagagagtgtggcttccattcttacaagatcattgtatagcccagacagtggtcgtctgagggctctccggcctcaaggctgggtctccatccttgtgagcgcattcccagggcgcggttgtgtatgggcttcagcaagtttctgaacgctgtaaacttctcattttcagatgtcactgttggagccttcatgtccgacagcgtggttcttctcaggtgagaggccccactcttgctccttgaattgtgctgttcagggtgagggatggagccattcaccattyatgggctctttcctctgtcctgttccttgtaggctggaggtgcttagtaagtggaaatgctaccttattttctcattctaattattctctatcccagagtttctagctgtggccttgaatggcttgcaggtatgagatgataacatcctgggagcttctaggtaggggttggggtagcctaactcttaagcctaaggtaggggttggggtagcctaactcttaagcctaactcttaagctatttgcttttggccaagaaccttccrtaatgtgccataaaaatattttataatttcctgcgggtgctgggaagcactgttcattctgtctcttcatctgtacaccctgcatttgtacctccagtcagtccacaacaccctggggaccgggagcctcctgcccgttagacagcacgtcattccctgttggctgcagaggtgagggacatgagctgaggcccagagcttgctgaggcccgtgcagtctgcatctctcctgcaaaggccagtgggccgccgccaccacccgtgaaccctctccaagtatttctagctgtatgagtcagaggaggcagaattacactttggagtgggagccaattcttaggttttgttaataacctgatggcagaactttctaaaatagactaataggatctcagagctggaagggatcccagaggccatgtagttccacaccccagatccttcttattcagcggtaccttctgctggtctccactgcagggctacacagcctcctgtttgagtgagatgccccatgagtgggagcccagttacttctaagggaaccagcttgccccgggtaacattaaatcttgaattattaaagaggcagaagagccttgaggttgaatgtgaactcaggggccaggtggcygggttccagccctgactctgcccttactaggtgagtttcctgggcaagtcccctgacctttctgtttcaggattctcctctgttggccaggacagcaatacagatgctccttgacttaggatggggttatttccagataaatccattctaagtcaaaacatggtagtttcaacttaggatgggtttatccagatgtagcctcatggtaagtcaaggagtgtgctgcattcctatggcttttgcaccgttgtgaagttgaaaaatcataagttaaaccattataagtcggggactatctgcagtacatgtaaaatgttcagaacagtgcctggtttaactgcttaataaatcttagcaagtttgatgtaaattgggttaaatttgcctccctaaaattctgcttctcagtcttgtgtcttttatrtagcaaccctttagtatctgaagggggcaattgtgtcccccaagtggtgacttcactaagataaggcctccctggttcctgtaattatttcccatgtgactggattttcactttctttatcagcgcttcctctggataaaacagcttttgtggctccaaatgattgaggttagatttgtgaatctggttgctctagttggtgctttcatgatgtcatctttgctctcttcattatcctgagcatcttactttggtttgtcaggattcttctcaaataaaacacactcctcaacttttacagttgaaaacaggctttttttttttcttcttttctttttttgagatggagtcttgctctgtcacccgggctggagtgcaatggtgtratctcagctcaccacaacctccgcctcctgggttcaagtgattctcctgcctcagcctcctgagcagctgggatcacaggtgcacaccaccacacctggctaattttttaatatttttagtagagacaggtttcaccatgttgatcaggctggtctcgaactcctgacctcgtgatcygcccacctcagcctcccaaagtgctgggattacaggcgtgagccattgcgcctgacccaacaggccctcttaaaaccggggccatctggctgaaggtccatcatatagactctgctttctcatcattcttgtrttttttaatcttcctgctgtgagcttaatccaaagggtattttctttttctcttcttcatggtgagggacagccttctccaggagtttgctcacatatggatgtaaagtaaagcgaggcagttacacaatgggtgggagaccccagactccagcctaggatggagggttgaatctggtgagttggagctcaacagggacaaatgtaaagttcttcaagaagaactccagggagagcacatatcaagagaagagacctaggagaggagcctggggagccctgccctgaataagagcatggaaggcccaagaagagtggtcgggccatgacagctgtagagtagcatgcaaggatgttgtggtcacaataatccattatcttattcattcagctaaggtgcattgacctgttgagatgcagccatgcatcagatcctggggatttgatgggaaacctgacctagcctgtgaccttagattatagccagagagccatatgcaagtgaataataatgcaaccaatgtttggtaagctcctaccgcatgcctggcacagtgtgagcacttcatttgtgttcattctttgttattgttttctttctgtattaaggtagaatttgcatgcaataaaatgcaccaatttgagagtatgactccatgagttttgaccactgcatacgctgtgtgactaccaccccaccacaataaagaatacttctgtcaccccagakagtttcctygtgcctctgkctggtcatacccctctcctgatagacaaccactgttctgacttctatcaccatagatccatcttgcccatkctagaatttcacattggtgggaatatacagtatggactcttgtttctggcctcttttaatcagtgtgatgcatttgagattcgttcatgttggtgtgttgcttgtttttccccttactgagtagcactccattgactgaatatccttgagtttgttcatccatcctcttgttgacagaacacatgacaactcttagtcttcttaacaatccatgacataagtggggctgttatccccattttatgggtgaggagaccaaggacatgcagatcttattaatataaaagggaaggtgattccagatggtggtaggtgctgtgaggattctaaggcagggttacttggtcaggcartggtgtcaaagtcagcaggaagggccaagcagagtgaggcctgagacttgttggaggtggcagggggaggtcaggggtgcccttggctgtggtggctctagagaagtgatggggcaaaagccagatggcagtgggtgggtgagagaagaaacaagaaggacagtgactcttgactgcttctccagaagcttggctgcaaaggagcaaatgggaccagcaggtagttcagggaggtgttttaaggacgggaagctctagatcagtgattaggccaagaacgtctttgagccattttctggtctcccaagtcccttaccctcttggaagagatcagaggtggtcaccctcagcttcrccctcatctatgtgaaccctgatgccctaaccctgtgcctacacccaagggtcctggagaggttgaagagacaagagggaggatgggaggctgctccagrgatgagggatggggggatgaggttggtgagagtgatggaatctggtacatgggctgggggcgaggggccctcatcttctgagccaggccccaagataggaataaggtcagagcaaggttcagttccggtacatgggctgggggcgaggggctctcatcttctgagccaggccccaagataggaataaggtcagggcgaggttcagtttgggatgtggatgaggatgaagcagagggtgaccaccctggtctattccaggaggacaagggaatcagggagagcagggaaggcttcaaagacaggctggagcccctaagagaggaagcaaggtggggcaggcaaaggggttgctgagcatgtctgaggggccagcaggctggatgtctgcaggggcagccgttgataaagtcccaggattcagctgagcagcagtgaaggcctggaggcatcagctggctatgttaagtaggggcttggctcagcctggcctaactgatgttagattttgagttactttaggttttgggtgggactagaaaagcagggagrgctaggagaccacgcatgtgcaagcacacatagatatrtattgcccatcgttcctaaccctcctaagggcaggaggccagaggtatgtgggttaggaatgctatgggctgcagctaagagaaaacctggctgaggctttcaactatatgacctcaaattagctccctggagrtaggtggccccagggctggcttagtaacctaacaatggcaccagtggcaccaggggtgaaggctctttatctgtccttgccttgcagaaggccaaggcamcttgagcaacatgtcaaagggcatcccaactggttgtattatttaccttgaagtgaagtgwcrggatttgaactgtcagccctcagggagaagtgttccagctmccaggttttttttttttttttttttttttttttttttttttttttttttttttttttgagacggagtctcccgctgtcaccaaggctggagtgcagtggcgcgatcttggctcactgcaagctctgcctcccgggttcacgtcattcttctgcctcagcctcccaagtagctgggactacaggtgcccgccaccacacccagctaattttttgtatttttagtagagacagggtttcaccgtgttagccagtatggtctcgatctcctgaccttgtgatccacccgcctcagcctcccaaagtgctgggattacaggcgtgagccaccgcgcccggccgctaccagcttcttaagaaaaaaaaagcactgaaagcrcttgtgrtgctgtccttgggtgctcctttgcttttatctcagaggctggcacatttgtaggcaggactgtgagacrcagtctcccctgcccccaggagtgtggctggcccrctctgccctcaggaagtttgcttccctcagattagctccggggcaggtcctgtgtcagggtgatargcacacggtgctctcccattgaaggtcacaggaagcgatcagagaggcctctgaaagatttctgggcttttcttcatccaaaaacaatacttggagttgaaacaaaaaggttgaagggaactgatccgacagctgtgggaaggagatgtacctgtgaaggtccctgtggtccatttcaaaggatactgtttttccaacttccactgaggtcactgtgtctgggctgcccacgtctgtttcctgcctgccgcactgtcttctgcagagctcttttgtgagaggaggattcggcctcctccctgacgaggtggcccctggggatgatggggcgggctaggcttttcttctgtaccatgaccaggcgcgtcagggaccaggcaaggtggagaccagctcttcatggtacttctgtccatctgtgaggctttggacactcgtggttttcagtctcctaggctggagtaaaatttgtayttatttaacaagggtgtttgcacatttattatgggaacgagaggatgaattcaccggatcccagcccttgcagggtgctgcaggatggtggggcaggtttggaaatagacaatgactgttcaccttagtaagtgggggccrgaggtgtgtktacagagctggaagcacagagagggaggatgcctgtcaggggtactagagaaggcttcctcagggtgggaacatttgagctggctgttgaaaggtcgacggggttttatagggtgtccattggcatctgcacaatcacactggccaggggtaagagatccactttccgatttatttctagtatcctataaggatgaacccagaagaaaatggaaagactaaggtgttggccttctttcaggcactgctattgtctgacttccgtttgtcctgtggccagatttgctctggaagtcccgcagttccactgcmtctgttatcactactctctgttgaccccatctcccagcatggtggcagcagtggagtcccctcaccctatctgtgcctcgtgtctcttcacttcctttgttcacccagattttccttaacgctttcttccattggagttggtgtgggtcatcattcccatccgccctatcaccctgggctctctttgagggatcattgtacacaggggcatcattgttctcaagctactaatgccccttaatcttgttatgtcaccccagtggtgtgaaggccagggctccttagaggtaaaagggtctctttgtgaggcctggaggggagaaggttgagcrgtagcttaggtgaatgctgcctgagcagatgtctgcagtgggagcagaatggtgtgatttactctttgtttttgtgggatgtccttggggagcccaaggactgtccattcatcaagcactgggagatggtccatggcagggaggagagtatggctwtttattgagtttcatttggtcataagactgggcaggttgatttcttctgccctgaagcactttgctattaccagctgggactccacttatcaagttcttttaggaaattacccaatgaattggtggaggtaaatgatgcaggaggtttgaccaactgsatggggctacaacattgcagttcatgctcataatggcagcaaatgcttgagggaatccctgagtatgcatctatttcttgaatcatggcatctgctmtaggaaatcctcttaaatgtattcttatytccctaataawatggaaattgrtacttaattggtaaaattttaaataattacccagcatctggtggttcatttatggcttcaaccagatgcgttttattaacaacaaacttgcttttattattgggacgctaactattaatttactaggcaatatgccccttctaaaaccagaaaaaaatgctcacagaacatactagcccttctctcttgggatatttcatgctttaattaaatgctgggttgaaggcctaggatttatcctgttggtctagttcttgtttggttctgagagctgctccttaccacgactaagtcaccttcctctcttgccctgcagagcaaggcctgtcattacggtggatgtctccatcttcctcccgggctccatcaacatcacagcgcctcagtgtcacgacggacagcagcctgtgaactgcctgaacgtcaccacctgcttcagcttccatggcaaacacgttccagragagattggtaatgagccaccaagtcagggctcaggatacccgtttagctggagtgggctagtgggatatttccgatgttccctgtcrctgttcctcccagctggttttgcaggcagcaggcacacaggctggacatcctttccctctgaggttcctccccttctatttcctgcttatcaacatgtttctaatgtcacacaacctccagctctaggacaaataatgttggaccccaagcattstttttgcaaatatgagggctagactgaagcctcattkgaccacaggtcctatgggactggtggagatatagtgccyggagcctggcccttagggaacattcgagcagttagaaagcagaagtgacaggactttggaggctccttattgagcttgtagcatcagccagatgtcaggggacttataccatttactatggaattggagaccaaagatggatggtgggattcggatgctggtgttacagaggcttaggtttctaaaagaggggtgctgctttggcagctcagaattgaaaagaggcaggcattgtcctgacagctggtaactgtccctgccatttktctggctggggaaaatcaacttgctagcccagctctagagactggattaaaccccagaacaagatagaaccagtgttgattggaattcagagcacgtgatcacctgaaggaaatgaatctggagctttatgcatattactaggtgcttcatttttatttaaaaggctgatttaataatagaaagaaaaactccaggcaaacaaaaacactmasggacctgaacctactgacgttcttagatattttkaatgtcatgagtgactccttttgctactcacagtgtagcccctggcctagcattgtcagcatcactgggaacttgttagaaatgcaggactttgggctccgctttggacttctgaatcagaatctkcattttcacaagagccccacaagattcctgtgcacatttaagtttgagaagcactgctstggagcacacatgtgtgcacacacgcccactcatgcagaaatatttacgtgagctagttcattcctcagccacacctcaaatgttctaccttatttaatatgttcatccttcttggctgtctcattggcaatttctcttgatcttcaggtatattgaataagctcaackattaaacatatttattttatcattttttaaaaagagcttagaaatttcaacattgaatgaaaccataccataaaacttgggaactggttagtgagggaggattaacaacattttcttgtgcagctcaatgagaaagagcagctcactcaagatcacacagatattgttgaagccaggagttgaatttggatcttatgatacttagttttgctttctaacaactatttctcaccacctccataattgtttaagatactacagtcttaaggaaaaaagctttctgatagttctgggactcgtgtgtcctccacataattaagcagtctgtcttctgtccagtgccagctcatcacgtagttggactctgttaaaaaacatttttaaagaatgaagattaattttgatacacataagaatgagaactattctagaactctcaaaaagggcaaacgagtaatagtktctgtgtatgttcatttgacacrtgcttattatgtatccacatgtgccaggcactggagatatagtcctgccctcatggagcttctaaagggagttacaaagagtttctactattttggccttgaagcagtgttagacaacgttcacttatcgctgttgtgaaagtgaaggtaaattggcatagctgaagcagagaagaagaaaccaagatgcaagttagagcaagagtgattcagagcatgagacaagtggtagagcaaactctgatttgaaggttcatgagctgagcgcagaggagatgtgggtgcctcctcatgctgttcccgaccagtggctctttctggggccccatctagcatgagcctttcacagactgctaagcayaattagaatgaaggtctaggcttagccatagccccagaagtrttggggtaaagtggaagaggcyggcagttggatggcatcttgtactgtaccttgtgggcaatgcgaagcaacctggcttatatctgacattaggtggggcccattcagcaccagtgtaccctcccattaatttctcttccctatcctccatctgccacatgggttcatagataaagtcaaacatccctttayactctaagggtgtgtttccccrataatcaggcttaaaggggatggtaactggagaattttgatatctcartataataaggcaatgcagaaaattattcatccccagcatgtttctgtcactttctctggcattcatatctcaatctttgcagtagaaagagaaatgtagaaatctgccagaaaatgtgctggcagtgaaatggagagtttggggagggaaaaatgggcaggccttatggwaatgtgataggaaatgaggtggaggtgaaaggtcaggtaactgtgggggcccagctctgggtgaggtgtcctagaattcagcaaggaaggcagcctcttggctctgcacagttkggaaggtcagtcttcagatggaggaaagatgggcacttccaggacacagataccctccactyccatccaagctcagcagagggtgctggccaactctgtcatytccaggcctcygcctcaggaacccacagctgagacactgggttaccagccttcctactctttgtgctggcagctgcagaggaaccatgtggatgatgactttgtccatggaatgcctggtgaatgagtgccagccctgggcaggccttccaggcacctctcaatgtctgcatatcttgggctgagtttgttakyargacggctgcatttgggcagagcaatacacagatacctgtggtgggctaggtactgctgtcagaagtggtatcttctgtggtatttatctgctgctgtcttcagctacatgacctgctctctgaggatggttttgagagccataagcagctgatgttagtcttgtgcctttggtttcttcttctctacctggcagggttcaagcctatgtacagagaagggacaccaactgcctctttatttcctgctttagaaatgggagaccacagtgcctacttggtcatgggagtgttcaggaccagctcattagcgggacacaagctgctgtagcctctgtaaatactgtaggaaatacagactttctctgtaggaggtgaatctgccttgscctctgaaacaggcagagtccagtcaggaaaacaaaaaccataccagttattttaacagaggaaatttagcactgggaatgggttaaacaggtcatggacgacctgggagtaactgcaggaagcagctgccgcctccaggtctgcaccagtggatctcaaagtgtggtcccagaccagctgcattagcatcacctgggatctcattagatatgcaaattctgactagaaactctgaaggtgggacccacatctgtgtttttacaagcctccagatgggttcaatttgagaaccactgttcaaggttatacttcgggttaaccacttccttggggttatcagaacctatgagcttggagaaggggccctgcggagctaggacctgaacctctgaggaggrggctggtgctgctgatctctctgagggagtgcaatgaggctggctctgggagaatggggggaaaattgaaaactacaattaactgctgttggggccagctgccgtgagaaactgttgctgggataagctgctaggaataggaagcagggaggaaggagcgagttcctttgccctytccagccttgcaggctccctcygatgctccatattagcagagcckcacagcragcctctggcaaaacaagtgaggtttgcagggtcccagctccagtgtcacagtgcagggtagagaagggtgggttggagctgaggacaacagcttcataaaccagcacagcaagcatccagttacattgagttgctgaatccctgttgggtcattcaatcaaacaataataattaaggtcctacagagtgccagacaccctgcttatcctggggcacggagcagtgagcaggacaggcaaagtccttgccctcatggagctggcattctagtgggaggggggcaggcagacgggacaaaaacaaccagctgctctcttgctggcttttctagatgagctccgggccccttgtgtggcatgcactgtgcttagcactgggacacagacagacacagacttctcactccgactgtgggctcctccaggagmrggtttacaacgtatttcataaagcactttaaaataggagttcttcctgtccctaatagtattattcatcacttcattcttggcctgggaacagcctgtggccccttggagcctcctggctagcataggtgaaggtggtgaatgctttgcccaaggggaccctgcccctcacccrtggacggtgcttgtacctactcactggccaggctgaagcctaaacttgcttgtcaatctctggaggctgggaatcaagctggcagttctgggctttcaccagagtgtgaaacgaaaaccaggaaggggcgctctctgagtgattgcattttgcactcwgacccagtgctcctgtgtttccatggttagcctgaaactcgggaaggagaatttgttagaatttcacagctgaaatcttgttctgacrgagagcaggaattaatcaaaacttgctgggagagaccagagctagagttgatgagagacagctggctccctcctggcccaggcccgtgcaggggggctcctcgggaagcagccgggggcagggcagggaggtggctgaaagtattactcggggctgatcagcttttccatcaccatgacatcattcgacatggcagggacacaagctgccagaaggaaaaacctaaagatgtgaaatgtgctgttggagcaggccctaatcagaactagcagcctcccagggacagacaggggctggccaggctggcttacctcatggccggctgtgggcaacttggacagcctgatccacccaccttcccagggccctgaccgcggagcccgggcagctgatcggctgcttcccagacatgtcctctgcttccctttccaccagaccctttaccagtgggtgctggtaaaactgccagttccgctcagggctttggaatgagtggtcagcatttcttcttgcctcctcaggcagggtctctcgttgtgactcttgctttcttctagaggagacagkctgatgtagaagtaatttcctttggggtaatttaaaatgtcaaaatttaaatcaaggaaaagtactaattaggcagttctagagatgaaatgcttccagaatgattgcacttggtgaattggataatgcggtatgtctgtgattgtatgttttaacattttagagaaatctgaaagtttaatgtgctrgcatgcacacaccccgctggagaggagcagcagttgccttgtcctcagctcagtttctgtgaactgtgggttgtttctctcttccttgagttgcaagagatcagtacttccggatcagtacttctgcagtgasatgaaactttggaggagtaaagttggtgtttgtaaattatctagcacagtgcttggcmcmcgttgcaggttgaatttatttgyttttccttacttaccctgtgttaatatgggttctccccaaaacagagcctgggtcaaggatctgagtgcatgtggttgatacacaaatgatcccaagaggtaccagtaaggaaatgggacagtgagacaggaaaggaaggcagttgcaggcctcaggcttctccagagaaacagaatggagagagaaagaaatggattagttggttgattttcaggaattgggttgtgagattatgaggtctgggaagtctgaattcttgggggcaggccagtaggctggagactcagggaagagttgatgttgcagctcaagtctgaaagcagtctaaaagcagtttatttttttgggaaccttagtctttttctcttaaaaccttcaacagatgaggcttgcccacattttggagggtaatctgctttattcaaagtctactgatttaaatgttaatctaatataaaaaaataccttctcagtgacatctagattggtgcttgaccagattctgggtactgtggcccagccaagttgacacataaaattagccatcagagcagccaaatagagggtgtcttaytgagcaggttaccactgtgggcagctggagctcagtcctgctggggaaccctggcagtcagtgtagaccgtgccccagaattaccccacatcaaggggcaagggagctggggmcctgcattatggagggctgctctggggacttgagttccctggcactcctggcttgccaggcacatggacagagccactagagaaagccctcaggagaagagatgcaggtactggcagttgcaatttgggccggacagcagagaaatggtaaaagccaagaggatatgggtgggggagcaataccatcmgttccatcttcctgtgttcctttccacccaggttttctctgagctcagctagttcatctctggtaagatagtccagtctcgctgttctctccattgtctcccttcctgagggaaggcagccattcacctgggaaggaggctggtcaggggaccccgaggagagtctgctcagcrgctgcctccaccacattggttcacccaactgtggcctctggcttgtcttccagcaatgtgtatctgtagccatgactttgcttaagcraacttggaaattcacttcatttaaatgtaatctttcttacttcagggcagttgttcagggaagttgtgatcagtagaaagtaaattggctagagttcagttgtagatctctgcacttgtttggacctgctatccatgcattcaaaaaaatgggaggttttggtcaagtaatgtacaacatgcagcaagaacaagtgtggtgggaakagcctggcaccagagattaagggagtcctagattcagctgtttgatgggtggccctctggcytggagcaagtcttgttcccttttggggcctcagttccctcatcttaaaaaatgaaggtttttgagcttagtggtctccaggattgcctcaaagctttgccagtctgaatctacccttttcttgctattgtccccattggarttggtgtgtgacacttgcacaggtgccagtgttttctgtgtgggagcactttcctgtatgcattattttcttcttaataatggcacctcctgagagtwtccaggtctcagatcccttctggtgacacagccttgccttgtaagtcaactgtttgctggcgttaaacaagttggggcagatggctctgctgactaggaatttgccagctcggcatggcaagatccctgagatggcagaggcccagggaggccattagaagcatcaaaaatacgccctgtggcaggtgcagaatgcccattcaggtcaccttcctctctgcctgttcatacctcccctggtggctgatcccwttgatgtcattaaaagccggagccttccctaatgcctgacttcacttacttaaatgccagtgggctcggggctacttgttactgatgcaaagcccccagattctaagaggcaggtgtgtggagacagggcagggctgggtcatctgccttctgttgcttagccatcttgccttgtcattccagggacagagattcctgttctctcactttaaaaataacatatttccttgaatccccaaaacagttaaaaaataaaaagggttayggaggggatgacytctggcacagaaaagcagtaaaataggtgtattgacactgaagtcatatttctrtaatgaaatacatacctatctatttacttattgactctgaaataacagaggtagatccttccaggtttatctagcctgcatttgatactgtgatcatcttttttttccttctttctttcttcttttttttaaattcaagactgtgttacaaaagttctgccatctggcatacacattcaggtatgggggtgagttattctttgcaggagaggacctcagtacaggccctaccgtggtcatagttttgttgaaaggataggcactacaaaatgtttgatcaccacactcggctacctgggaataaaggcaactccagccttcatctgggttcctgtgcatgtaaactacctgaaggcaggagtttatgcctgcgttgttcattgatacatcccctctacctttagcggtgcctggcctatagttagtgctcagtaaacgatggcgggcacatggtctggtccatgtactgattatagagcacgactcaactttgttgagatgagttaaaattatcagacgagatggttcccttgtgttgggcataaaccatgtgctttatagaagtcagtattacacaaagccttgataatttcagcagcttctggtaatgttctgtaggtttgtcatgatgttttgcttgtcaggacactaacctgtgttgggtacaccttgttaatgggcatattgctggctcagttgatacctcatgatggcatgaggtttaaatcagggagagccgtgaagtatgacacaaggagagtcattagaaargcagaggacatcatgcttctctctcgattctttgagcaccctggctgtgtgctgctttctgagcaagtctctgcttggggctgcagtctcctgccatggaagggtaggtatcatatgagatgtgcatgtgatcctgtgacaaggamaagaggtggcctcatcacagtgtgtcggtcctttctgacattttgacctctcatttattggcaggcctgaattatgttctgatggctgacgtggccaaaaaggagaagggccagatgcccagggtctactttgtgctgctgggagagaccatgggtcaggtcacagagaagctgcagctgacttacatggaggagacrtgtcgtcactaygtggcccatgtgaaggtcagtcctctcctcctttttatcctcaaactttgatctctgcagatgttcacttggagctggtggaaactatttttattatgtattatgtgtgctcttccaaaattttatttcacagggaggagcatatccatttcttcttttcttttaaagttggcctctgacagcccttttatttatcttactgtgttgatttcagcctttaaggggggtcgtggtggtctaggagaccagtgatggtccctggctttgacttgttcttttgagaggtttctcatcctctcccctctatgaggcttggtagcctttycagaggagagccttggaagcatgtgcctctgggtctgcagtgatgctggatcacactgcacctgatgcctttctcagtggtctactacaaattagctcatggtcacagttaaggcattttaaaactggttggactagattcttcccccttgactactttctatttattttaggatgcattttttggcaacctttcccctcgcactctaaataaacttgcaaatgtttttctcctcttgaaattgtttgttaaatacactttgctgctaattcaggaggccaggctttgattagctacagagtggcccttgcagcaggcgctggcagggtggaagacctggcagtgcctgatgctgcaggaatggccagacactgacccatgggcagggtcagagagyggaggaggtggaakaatgcacttaatccaggccacatggtgggtggaatgagcatgggttttggagacacatagatccagtgtgtatccagctggacacataattgtgacctctccctgtctcagtctctgcatctctaaaatggacacagtagtccttaccttgaaaggtggtcatcaggattaaacattacacaatgaatttacttaaaggaccttgaatggtgtctgataaatagaaagcaaccaaattattattatttggttgggctgtatataattgccaatattctttttgacttacaaaaatggaaatttcatatagctcaacccaatattgtttattagccactggatttctgactgatagtttgaaaagtctgcagattagagatgaagtgtcctcctgttagtgccagagcagaagaataacagctgcttctagatgcttcagggctgtgtatagagagatgccccacacacccatggcccagagcccatgagtccatgcccctcagatgcttctcagtggggctgggctgtgtcttctgccaggactcctgcaggggcctgcccagaccagctgcctgagggcttgggatgctggccatttataaagctgctcctgtgcctgttaagccatacagccccgccccgtcagtcttagattacattggcttgttggtgcctttggtggggtgtgaggctgcgcagtacagrctcgtatgcaaacactgtcaggcctttgaatgcctgtgattggtgtttttatacctgctggggacagggcatcttctctcgggcctcttcttgctaggtctgttcacaaaacctttcctttaggtttctttgcagcttcttgctttggctgagaagttatcctttgttcctagttaccaagggtactggctatgagatgccacgtagagtggcaatagtgaagtgcaggccagaggmagggctgtttctatggtggccctgagggttactgggaaggatcagggttgcgcaaggggttggtcctgctactttctgatatctagggttgccagacttagcaaataaaactatagaactcctaattaaatctgaatttcagatcaccaatgaataattttttagtatgagtgtgtcccaaatattgcatgggatatacttatactaaaaacattttgctgtttatctgaaatttaaatttaacttggcatcctgttggcagattcaactctgctgatcttcctctacccaacaagtggcatttcttcactcaagcaaaacctggctgccaagaagagagattgagatgatggttagaagagtttggaggctgagctcagggctctcgagtgcagatccagcacagaccttgacgtgattattttggtcattctagggagagcaaaagagcaggcctgcttcagtgaattgggacctagagtcatttggatacagtggttgcttggccattttctcatgcaaggaggtgggagcggagaaatacaccagatagacacatgtctctgagacctttatggttcaagaggcaacattgttgccaaggtacactcaaggtggctgatactttatagccatactttataaccatgagaatgtttatttctggcagttactgtctgggctgtagcagaggactgggcaaatggcagagtgcacccgtaggatgagtgctaatggcctagctagctgtccacagaggaggcagcaggcaccgccccrgcttactggctgtgggaacacagctatggaagctgaggcaggaagcaaggatgaggggaaggggagtggcagccgggccacctcctggagcaggaactggggcctggggggtgttggtcaggggtcaagagcaggatgcagtctctactgcaagtggagctttctcagtggagctggctctcggctttatggacaaatcaaagaagataaataaaagcattctggcttatcacacaccatatggctagcagacagtggggccagcatgaggggctgggcctgctttgtttaggctatctttaggtatttttttctttttttctttaagcctattccaatctttttttttctccctctccttttccctggaagttttcttgccatatatggtgataagtgactttatcatggaagaccgcacaggctaacacctgttttccaggctaactgtcttgtaccagactttgttccattcaccgtattggagggcacctccggagggtataggattttgtgataaggcacatcctcctgaggggagggcaggtactttctcacrgcctcactgtggtcagcagagctgaggcagctccagccacttccttggcttctctgcctcagagttcacacaccccggcttatcttccctcttccccgagaccagcccagttttggggatggggcccctcccactagccagtcaggctggaggcctctggtggatctcacagtcacaggcgaaagcccaacacctcccctcagcatcgggctctccatgccctgcctgaccttacctttctagacccatcttctgccaccacatcccctgggccccagctcttgtcatgacctgcccctttcctcctggaacctgctccttacacttctttgccttggttcttatgctcacagaagtcagaggccyggtttgtgtcatattcatgtagaaccatctaccacctgcatgatttttacatttttttggtcttaaactcatactkcctgtgatattttctttcatatttttctctttaaatcagccaacttttggtctcaaataaaataatttaaaacagaaactttgtacctttctataagcagaaaaccatctaacatgtccccaaaacagaaagtaactgtaaaaataaatatattgaagacacaacagtgtcctagaattctagctggatttcattgtttgtcaaagttgctgataaagcgcccactccattcatgtgttagaaagggaaatgatcaagttctagggaaggcttaaagacatactagcaccgcgctggaactttcttcctgatgcaaccagaaggactgcaggggaattgactgggaacaacttttcaaatatgagagttgttttacagagtcatgcctatgtgccatggaaatccaccttgtgggcccagtctgggaagccctggccatgctctgctttgatcagatgtgccttgccccatcctgcctgctgaaggcttgctgttgttcaaggctcagtccacaggttttggacatcctcagtggcagctactgtcctaggccctggggatgccactgtcrtcttcctgacttcttggagcttgttccatgctgcctgactcctgctttggggatacttgtcaggcagaaccttgttggagtgactaattgggttagctggagtgtggggtcacaaaggcttctgatatggagtggggcctgcttgcctctgtctggactgactgctgggaagtgatggcttgagatgatggagaagagaatttgggatgcatggtgtgtgccaaagaataaatgcaggtgtcctgttgttactccatctgtttctggtttatgtgttcttacctggatgacagctgtgctcatcctctaatcctgtacaataccttgagagcacaggccttttgtgagatcaaatrcctatgcatgacaggcaaataagcaggctcttcaggaccagggaaacgatggcaacagttctgagtctgatgcagggatggcagagaagcccaggcagagtgcaggggcagtgatgtcattccctaytgtgaggatcagtgacaccctctagaggcatttagggaactttttttgaacagaaccatgtgtcagacactgtcaagaaggccaataacggtattattgttaaaaacaaaacaaaacaatctacactagacgagggaatatgcacatcagcttttctgagaagctgcagatgttcataagattgttcttctatgttcctgaaggatttttcaaggaactttgaaacctaagtggctgcagctccttccttgcttttgtgggcagatgctcatcctggcctggcgaagggtgggacatcaccctggccaccaggtctcctgagagatcayaccctgggatctgcccaggtgttttggcctgtttccattttcatatccaacaaaatgcsttgggaccatggcttcaatcacattacatgctgtgrgtttagagtgttggatgctggttttcagaggtgatcaaamctttttttttttcttgtttaagaaacagatagttaagaaagggagattaagttggagttaataagaactctgagaaagaggagaaagaaaaacagcaaaagtttcttctttatctggaaaataacatgctaaatctccgggtcatcttgagaaatcaaagaaatagctaagaaaaaaacagttgcagggtttggcaaaaggggacrccaaccttagatatgaggtcttctgaaaacttttaaaatttgtttattttttgaatcagtagtgtgtatagttaaaatttttaaatggttataaaagttgtcaaagaaaggatgtctttcagctatcctatttttctcccaaaggcaaccacagttccattttcttaacgtgtctttcaaaagcttgtcaataaatatagaaatctgtgtgtgtacctccttttattttatgcaaatagtagtatactgtgtgcacactgtagtaaacttactttttcttttaaaacatccaacagcagaatggaggaacagattttggcaaatcgcacaaaatctagctgtaccagatgaaatacaactcagcaataacaatattatgttattatgatacacacaataacatgaatgacttttgaaagcattaaactgagtaaatgaagccagacacaaaaggctacctactggatgattcatttatatgacgttctggaaaaggccaactaaggagaaagcagattggtggttttcagcggccagggtttgggggaagggctgatgatgattgacttcaaagagggatgagacaactttctggggcgatgaacatattctaagatcgtggttgtagyggttgtatggttgcatttattaaaacttaacagagtgcacacctaaaattagtgaatgttatgtatgtaaattatatctcartcaaacttattttgttaaaaaaagtttcgtggagattrttccatattggtgcatatagagctttcctgttctttttcagtagttctttttcactattccttgatttatttaacctgtccaggtggtcttctatatgtcagttccagactaacctgatctgatgcttgtagactagttatcytagtttgcttctccagaagaggctcctcttctctcccctagatccatagtatcctggctgaggacccctgagagggcagcatggaggggccctggtgctctctaaggtgaccttggacatatgtcctacagaggacaagcctctcagctatagggtgcccaaggaaaatgggagatttttcttgattcctgcagttggctttgtgcccttggcaggctctcctggtctgtaggtagcatagatggcctgaatgtttggtaaggggtgctggaaactagggcaagaaaagaggggaaggytgggatgcatagaactgatgtgtgggaaactaccttcatcatccagctcaggtgtgaagccgctgctcatgcgatatgctctgctcacacagatggcactaaggaaccgggaagctgggctttggagaccacgctggaagtcagctcactgagtgtgggttgccttgaccatctcctctgggaggccatgttgtgcatagctggagaacaaactggggatgaatcaagaagggaaagggtgtggtgaatgttcagcatgggagctgatatctccgatgagcactgtttggccattgatttatttcttgggtgcaatgaagggctcttaatcttctgcatttggacacttgccacagaggacattgtgattagcaaaggaaggcacaaaaattctaatccaaaggctttgcccgccttaagtccktttttgaaatggagctgatttaaatatgtaagtatggtcacagcattgacacttcagtggttatcgtaagcttatttstacagtatgtgagatgcagtttgtagcaattgctatgggtaaaatttttattttaagaggtgactttctatttacagttattcatttacactgggttcatctattaatatatactgttgatgcccttttaacactggtattctttgaagtcacacatgataatgtgttctgttttattggttttgtctttatatttgagatgtgattataaagatcccttctgcctcaaaccttgaacttagatattcattataagcatgattcccttcaaagtaatcaccttctagtcattcctgttttgaaatttcttccatggtttgtttattcacttttatcatggtccatttttactctaggagttaattcaaattttggaagcagcaagatttctctgcaatcctctctagtagataatagtgtgtttggggaaaagtgaggtataataatacaggaattagtattaargaatgtagtaattaaactccttttgaaaatgattttaaaagaattcccatratattcaggtaatagcgataaaagcagctaacactaatcgagcatttagtatgtgctggttactgtgagtcactacatgtgagatagttactgtttttatcctcatcttactgtttcaaagacaaggcatagargagtgaagggacttgctcacaaccttacagttgacaagtagcagaggtaggatttaaacccgcaagtctggctcctaagacttgggtttaaaccactacattgtaacacccctcataaatacaagctagaactattagtaactagtacttattatatgccagatactcttctacaggctttacatgaagaaagagaggttaagtaacctgactcaggctatgaactagtgagagacttcactgcctcttcataatagagtcctgggaccttctctgtgttaagcatatggcccccagaggtgacagcttttgggggtttatgttctagagcagtgatgtgctgctaatgtttaacaactagctcttggaaagaggggacatgacttttgtagcattttgcaaatttccctggtgtaaatattcttatcatgtctgatttcaagctaccaatgagacatcactgaatgtggagttaggaagagatgcacaatagcacacagttgtttagtatttccaatagctctaaatatctttaagagcatagatgatagtaaagtatggtaaaataattaggaagttatgagtgttgagtatttattacatttatcttaatataatttacttatttttaagtttattcaatttaacttttaataatggctgtgtttaacaaccctggctcataaactttctgaaaatttaacagttggcttttggaaacccactgcagcaagctccagcacacaactgaatatgttgagggtttttttgttgttattgttgtttttaattttagattcacaaggtacaggtgcttgtttgttccatgggtatatcgcatactggtgagtattgggcttctagcatgtttgttaataagttggtcatatcactcaagtcatgcctgatacacagatgtttgattatcagagtctkttttctttcttgtttcctgtggctttttaagttgatgaataataggaaagtaaatttgtggggtcagttaaaccaccagacgacagcttttatgtttgtacattggttcagaggtactctgtattttgactggatttattggatagtgtaattgtttccatttaaaacaatggaaaagatttcatttaaatttattgagatcttatttttcaccctcattccrtgcacatttgggattctgttcgccagcccctctgcactctgaagatgcacagcagcctctctgtactctgaagacgcatgaattgctgactgttgggcttgcttggaggggactgggggttattacctcccacaggactgtttaagctctggaagttttcctacctcctgcaactgaatttagtcttaattagtacagagtgaactagctgtgaacaatctggttttcttgctttgtgccttgatcatgtgagacctaagggctggtcctgcccttttcttatccattgctttaatcagaaataacatatcaaggtggcccaaattgtgtcactattctttcctttgtcttctccacccattcccacggcatccattcctaaggtcatttggagaattctctgttccaataagtgggatccacatggctcaaggagcaacaggccttggaatcactctttgagtagtagctggtccctcagtctaccccaaagagctgcctcgccagacctccccacctcccggacatacagactccagatgtggaaaaagcccttgccatctctatcctccaacacagagctttggtgtccgagacacatccaagtgacaggcccaagagggcctctgaatgaagacgkatgagccgtgtggacasagccacactatgttytcgtgaaggcataagaccatgggccaactttctgggcatccagggctggctgcagaggctggagtgagtggctttcaaggcaagactgataatgaaagtcgtgtttgggtgggaatcacaagcaggggaagtgggggagccagcttcccttcgtgctgtgtgtcacaataagataggacacagatgcaaaagcagatcgctacagctggatctgggtaaaggtggcagtgacgcgtcggtgcagagaattcctgttttgaggaaagattmggagccagctaaggttttctgagggcccgtcatgtctcagactgtcacacttattcctctgtcatgtatgcttaagtcygttttagatgaccccttgtaaagaaaggaagcctggcccctgaagcctcattgcgtgggataaggggactaacatattctgtggttgtaccagcaaattattatttatttcttattttataaaagtatagattttattcatgcctatattgttagagaaaatcattatttttagtcaacgtattagtattaatatcatggcctcttttcttctcattttggaaggggaatatttttagactctttaatgagagagtcattttctcagtaaatatttgattggcctgaagttaagtgggtaggcgtaaaaaattatggaagtattggacttgagcaaacttttgacaaatagcgctctctttctctcttgggcgtatgcgtgtgtgcatgcatgtactccagctctctgkgtatgttacacacacacacgtttttcgcataaaacatttttattttgggccaggtgtggtggctcacgcctgtaatcccagcactttgggatgctgaggcaggcagaccatctgaggtcgggagttcaagaccagcctggccaacatggtgaaacccygtttctactaaaattacaaaaattagctgggcatggtggtgggtgcctgtaatcccagctactctggaggctgagacaggagaattgtttgaatctggtaggcggaggttgcagtgagccaagattgtgccactgcactccagcctaggasaccgagcaagactccatctaaaaaaaaaaaaaaaaaatctttattttgaaataatagcagtcttacaaaaaagtcattaggatagcacaaagaaataccgtaaattcttcacccagattccctaaatgtcatttgctttgtaattttctatctattcgtacttcttacctgtttgagagtaagtcggagacgygatgcccccttatccctaacatcagggatatttcctgagaacaaggacattcttttaygtaaccatagcacaattattgaaataaggaaattaagtgatacattactgttagcttatctgcagaactcactcaaatatcaccagttatcttcatgtccttggtagcaaaagaaaatcccgcactattgcatttggctgtcacatctctttagtctggaaaagtcactcagccttgctccttcatgtccttgacatttttgaagagtacaggtcagtttgtctgtttcatcatgattagattcaggatgtatattttctgcaggaataccacagaatacttgtgtcctatatatttaaaaacatatacatccaacatcactgaaggtatgtatttttaactcctcctttaaagtggttttccaaagttagttgccatccccaaaagggagcttttagacattgagagaggtgattatgaaagtacgatagcttgctcaccacctctctcctctgctcctgggagcacaggggagtttcaactctggggaaggygatcatttgggtcattagtagcgctttgagtaccatggtgtctgcagggagttcccagttcttactgctgtctgagaataaaacataatatctttggtcttcacagaggtatcagacaggaattccactcagcttgcaggaattgagaccccaggacaggggcttaagcacatcaagataatttctctctcttctagaggaagagaagttgctgatgttggttcagtgactcgaggatgttctctgacctttcacttattcaggaaatgtgcattgcatacctattatgccgtaggctggggggccctcagctctgctgtgaagagacaaggatccttgtccccctgggagtttatatcccagtagggggagacagacaatagatataataagaagaaaattaaggtgcattagaaggcgatgaggctatggaaaaaaagaaagaaaatagagcccagtgaagcgggtttgggagtgcaggcatggggttatgggggtcagggtgaccycactgacgaggtgtgatttgagcaaagcatggaaggaggctggggagttagcacagcgggytcctggaggagggctcagaccagtgtctgagtgtctggtgtgtctgaggaggagcagggagaccagtgtgggcaaagaggtcagagtggcagtgatggttgtgagcgggtcatcttgggcttcctaggccttgggaaggatttgcctttactcagagggggatgggagtgtgtgagggatctgggcagggtggtgacctggcctgccttccatttttacaggcccctgctggcggctatgttgggaaggcctgtaggaggcggtagagcagcaggaacggggttaggagactgagcgttacccagggaagagggtggctccactggggccatagtggtaacattgtgagaagtggtcaaattctgcgtgcattttgaagggggatcctacagcatttcctgagggtttgattgtcagttgtgagggaataagatatcaagggtcactccargcttttcagcctgagtacctaaaaggatggagttgtcactggtggtgttttcaacggaaggtgcaggtgagcaggttgaaagggggaagatctggagtttgtttttagacacactggtagatgtttaagtgtgtatgcgtatgtatgagtcttcagtttgagtagtagtctgagtaagaagtatcaatttgggagtcgccagcagacagatggtatttaatgccaggagatttgatgagatcacccagggtgtgaggggagatagagaagagagggggaccaagggctgagctgtggacactccaacactaagagcatcttttcctcctacccctaaaatggctctggggctccagccattgtatgtgtttttcatgcaggaagaagtgggacatgcaaaggggctctttataatctggtctgaggcccctgtaaagagcctccagtgacttctgcttataacgcattgaccatccatattttaaaagaggttggaagatgtctaagtaccagctagacatcttataaatcctatcactatagagttttgctctscagcagaactttctgtgatgaaggaaatgttccgtatcagcactgtccaatattggtggccagtgaccacatatgactgtgagcacttaaaatgtggctagtgccaataaggcattgactttttacttttctatacttttaattaatataaattcaaactgaaataacacatgtggctagtggctaccatgttggacagtgcagatattgaagtttgatttttaagaaggagagggacagacactggacagacaactcacagctcctgccacagtacagcatggagcctcccaaggcactagtcacacagatcaagccacacagccaaatggaawtacaaataatagattgaggtcacattgactgtttcacgttgtacttagacatgctgattaaaacctgagttgcaagtgtrccatggaacataatctctccctctagtgttttggaacaatcacacacaaatgtttatatccacatacaggccccatatacaatgggggaaacagaacagaagaaggttggatggttcaccaagttgagtgggtccttcaaaggatgtcaccatcttggatgtgatgttttctgttttcagtggcatagaactagataaaaggtggcagtgcagaggatggaagtggtattgctcagtgggaaagggaaggcattttaggtttgrgacatattacaatattgccttttagcgtagaaaagccctccttcctgatgctcttgctagtgctgggtggaaagattccctttcaactcaacatgtgtgaagcacatgaactgaagcactcttcctgcttagcatggcaggggctgggccaggccagggtggaccaggtcttgctctgatcaaccacatggtctcaggcaagttgcttcacctttactgctgagcttcagtgtcctcagctgaaatggggagcagaatactgacttcttagtaggggtctggtaamcactgggccccttttyccttctgctctaccctgcaaatcttttcctctttctaactgcctctgcatttggaaggggtcaagactcgtttcatagttttttgggggattaaaaaatgattagaagcagatggtgagaagaaaatagaaagtatggagcaaataagaaatgtgggaagagaagagggcaaatggtaaggcagctctcggagctggcacgttctttctctctggaccagagcaagccagagcctctcagtcatcttcacgggctggttgacaaggactcctcacgttagcgtgcacacgaagaacctgggaccttgttcaatgcagatcctgatacagcagatctgaggtgaatttctagcaagctccctggtgacgctggtgctgctggtccatagaccacaaagcaaggagctcgaagacatagataccaaaagttacaggggaaaacggacaaagccaccagctggcagttgatgcaggtatcagaagcaagtgggcctcggaggggccagatgcctctctcctcacactgaccgtgagagcgagtgctcctcatcaacaacgtggggccaggcttgagtcagcagcactgactttatgtgayctagtgcagctcgccagcccacgctgatgtgtgttaatggagggggtgcmccttataggagggtggtgtgggctataatttcttctgcattctctgcctattgcttgaaggacagtgttgtcagcagtcaactgactgagcttgacttttcagcagtttttttaaacttcactgcagtgtttttggacacagctatgtcagaaatctatttccccttctcagagaccaggaagctcttgaggtacaagctcttattaagcagaaaattttaaagtggttttccttctccttttcttgggtctgctttcttggggcaaacagaatacgagaagccagcttagaaattgcatgggtccttcctgcattttgtgagaaaatggtggcctcctatatttcttccctgacaggttactgtgggccaccagcctccttggtgacttctgttttgcagatggggaatttgttgattgtagtgagtacgctgtgtgyggcagaaaggattctgtcacctacagagagctagggaagcgcccaggctgaggaaacccaccccttcgaagcagccatccataggtagcctgggggtcttttcacaagacagccctagccccagttcatgggagttggaacaatggtgggtccaatggtggatgaatagtttattcacatgcatcccaggagatttgtgtgaagagggtgacagagagttgcttcttttaaaaaaaatgtattaagggctatgtaaataaaaagaagaaattaagttgtaacagtaacaataatagctatcttttattgagcatttactatatgctacatgttttacatgtacatgaagtccttataaagaatacaattacatatgttaatatgtgattatatacagaaaattgtatcagaattatatctacatatataaaaataaaataaaatctcattttaccattgagggatctgagatttagagcatttaatttatttaagatctcacagctggtaagcagccaagtcttgggtttgaatcccatccagcaaccaactagttctatgactttgaatgcaaaagatgatggcttttctcattattattacctagttagtctgagaaagagaaaactccattctggatggcccatttctgggtggattggtgctaggtttctcctggtcttggacgaggttgcacttttcagccgctcctgtgcacgtgtgtccgtgctctgaggtgggaggaaagctcaatgtgggtctgtgagtccagggcaggcaggagtcctggggactggaggttctctgcacttctgtttgatcttccctgcctgtctgtggcctctgcagtttaaacaatgactgtcacttaaacctcttctgaagagcttgaagtctggtccatgccttcagcccaccagcrtgtgttgagtacctgttgggtacacagctctgtgtctggtggaggggaaacaaagattaaaaagacygggccctgtcctccaacagctcaggttatttcatgcctgcattcggggcactgtcttacttggcctagtcccacacttgtccctcccaccccttgcttctctattttcaattcacttctgtttctacacacatcagtgatgyagtgtcctatgtacaggtgtgcctgggacagtcctggtttatgcctgttgtcccagcataatcattaatagttctctatttcactctcaagtgttccratttggatggcaccctatttattgagtgctcattgtgtgccagacactgtgctgggcccggggcagatggagactygtaagccataaccgctgcctcccaggagctagtctgctggggcatccgttctgaataccatgacttggcaagtgaagcattcccatgccttccagactcctggctctgcctgtgtgaaacgtactccatttccagagccagctrccgagctttttcccctgggctgactttccaccaccctgacctgcgattcctctctgctaaccctcctctcaccgttctccccagggtgggctgtgggccttctggtgctgagctccctcacatctgagctgtcttagcaccttctttccrcctgtatttgtgttacttggatatttgtgttttatcttctgtaccagagcataggttattttaaagcagggagcttatggcattcaacactgtcaccctgggaataggacccccaaaacactttatttctcaaataaatgatggagtaggttccagcgttgtttcttccttgctgtccatttctaaggatgagtaaagagttaacgtattgaacttgaaaggagagatttttttccctcttgtaataaatcaaacttttctgaatctggaaaagtgatggatgaaactatgtgagmacacacacacacacacatatacaccccataaccattttgaggtcatttaataagggattgctttctggataatctcgctccttgggtataaatctaatgtgaaagggcaggggtcagatatttaccccaaagggttggtgtgaggataaaatgaggcattgcttttaaagtgctaagctcagcccactgaaaaatacgcaaatgcatcagaagagtcctctgtaaatccactgagctggaatttccaagcaggtgtccttgctgcctcttgttagccttttgtgagttaattctttgtttaataacaaagagctgccagatggtaattttggaggctcagatacactctgttgcacgtgcctgtccagcttacttaaaatatgtcagaaagaatgagggaatgactcaaacaatttcaggaaatggttcaaggctgtgtaacctttaaggaaaaccacacggagccattaccttgtgttgaaaggcagctccctggctccctgggaggcctggtggcaagcagtgagacacttgatttaggtgaaggggggccccaaggcagtggtgcctcccttccttctgcccagaattgaggtgttgtccctacagtggaaactcaagagcagcactgtctgatagaaatataatgtggtcacatctgtaattgtaaatttccttttttttaaaattatgctttaacttctagggtacatgtgcacaacgtgcaggtttgttacataggtatacatgtgccatgttggcttgctgcagccatcaactcatcatttacattaggtatttctcctaatgctatccctcccccagcccgccaccccccgacaggccccggtgtgtgatgttccctgccctgtgtccaagtgatgtcattgttcaagtcccacctatgagtgagaacatgtagtgtttggttttctgtccttctgatggtttgctgagaatgatggtttycagcttcatccgtgtccctgcaaaggacatgaactcatccttttttatggctgcatagtattccatggtgtatatgtcccgcattttcttaatccagtctatcattgatggacatttggattggttccaagtctttgctattgtgaagagtgctccaataaacatatgtgtgcatgtgtctttatagtagcatgatttataatcctttgggtatatacccagtaatggrattgctggatcaaatggtgattctagttctaggtccttgaggaattgccacactgtcttccacaatggttgaacgaatttacactcccgccaacagtgtaaaagtgttcctatttctccacatcctctccagcatctgttgtttcctgactttttaatgatcaccattctaactggcatgagatggtatctcattgtggttttgatttgcatttctctgatgaccggtgatgatgagcatttttttttctagtagccacattgaaaaagttaaacaggtaaaactaatttcaataacatatatcagtttgctagagctgccataatgaagaccacagacttgtggtttatatgaacagaaatgtatttgcccacagttctggaggttggaagtccaggatcaggtgtccacaggtttggtttctcctgaggcctctcttcttggcttgtagatgactgccttttccctgtgtcccygcatggtctttcctctgtactcatatctctggggtttctgtgtgtccacatttcctcctattctaaggactccggtcagattggattagggcacaccctgagggcctcgttttaatttaatcaacccctttaaaggcccagtctccaaatacagccccattctgaggtactgggagttaggactttaacacaggaattttgggggaacacagttcagcgcataaaaatgtatattatttagtccaatatagccaaaatgttattatttcaacataaaatcaataaaatgttaatgaaatatttgccttctttcctgtactagggctttgaagtctggtgtgaatattagccccattttatgatctcattaggcacacgtgggtagtggtgaccgtatcagacagtgcaggtctagtgtcgaacctcctaatctcttgggagaccttgggattgtcgtaaggaggcctgagtgaattcataaaacatatgcagttcctgaatcaactaataagtaaaagtataccttttatcacctgaggttctggtaaatattttggtattataaaggttgctttcacacttacaaaagttaagaagcatggttctgactttcctaaactggggtttctagagcccaagctccattagcatggtgatgacggcctgcaaaatctttccagcatttcagaaagcctggtgggatcacaggggttgccattcagctactgacaaggtcagcatcattgctttcagctggcgttttagtacagtttttctggtgaccttgtgctgatcaaactttccgcgtggctttttatgacactgtaacaattactggggtcatgcctggagaggtggcccacagttcatgcacaggctcgagtacaagccttccggggactcatctctcagccctgttattattctcagggatttggagggtgcagaggtagatgaagtaagcaagcactattgtgcttcctgtgttgaagtcagggaataagaatttcctctgtgccacaaataatgctccccacctgtatagaatgcctgggaaatgcaacactggccatccttcagctcytctgcttacagctgttgtgctggtgggtctcctcctattctcagagcagagagccacgaatggggcactcggggccgtgacaggcatcccttagctctggccttctggttgtgggcagactctgctgtgtccggcagcccmtccagcgttggatggcatcagcaacctgaaagccctttcttaggctgaaccagagtctacctccatgtaatcacacactcccctcctatttctgccccggagcacctacagatatctgtctgtctgtccccatccccactgcctacttcctccagactcagcatcctgagttcctttgggttactagttcattttggaacttattccactattgaattatccgtattctttggttttatacctttattcctctttagttgaccttttagatacttttctaaccawgccccctccccgctgccccgaaagatcagggaaaataagaagaaattcaaacccttgttktgctcctcatcagcgacagtggtagggaagatgcccacggcacggaggttcagtggttgttttcattctttcctgttagccaktttcctcaaattggtcagtataatcctacctcttggagcgatagctggctggattcttctgccattttggcagttatatattggtctggatttaaaagtgatgtttattccatagctctcctgaatctgacatttgttcctctttcatcctatacttccctgggcatgatacccttctttccatcagctgtgttggagaaatgtggcatgtggcagatgtatccttgcttgtttaattaatgagccaaacagtccagaaacttaggttacaaccaaggtagtctggcaagaaatatacatgaattcaaagaggtttgggataattttattaatgataaaaccataaagaactcagaaaatattttaagatgcttggcatcaggaactatttcatttgtctccatatccccagcaccacgcagagtaattgacattgactaattgcccaataaatgttcactgaatgttaggagaagctggagtatttccaaaatgaacatatgctcaagatattctactagaagtttacaatgttatcttttacatttagattagtgatccattttgagttaatttttgtgtgttgtccaggatagtttcaaacagttgtgcaaaacaattctgtttgttkgttatcatgggtagactaatacctgtcagatcatataacccgacagtcagctggaaacacttggtcacatgagattgcctatctacattttaaatttggcttcagagggagcagccagcaactcccttcaaccccctaaattttggattgtcctaatgaaatcttggactgaagcagtacatttttaaccaggctttctcaggagatttggttcggctggcactcagcccacactttgcttaactctgagcaaaggtgtccgtgggtggataatcccacctccccattctggatgtgccagcacttttcctactcatccccagttatggaatgtctaattctttctcattttctcctgtcactaccatgctgcagtgagcatcttgggtcacctaactattaattctggaggacagattccagccgtggctttgctgggtcaatgttacagccatttatgtcccctcagatgttgggttggtcctggatgctgccctgtaactccatcacacccatctgaagtcctgcctggtaggcagcagacactgggtgtggcttggtttctcatacctttttatttcagtccctggtgtttttgtcatcttgtgtggcagtggcagtgctccagctgatcatttttatgggacagtccttccttgatgagacccagatccctgtcacttgacaacataaagaatattattcttcataccagcatttcccaaagcattttttcaaaggatagtaacgacttttatgtcaaaaaacaaaacaaaattttgaattcaaattaattttggaacrtaattgaatttaacgcaggctttttattgcaggacttcatggagctttagaagcccaggcacgcaaggaggatgcactgtttggcatttcctaaatgtacttraccacggaacaccatttttctcctgaggtttaggaaatggtgctatgatatagattagttttctatgaataacttggctttatgccttcatataccttttctctctactcatgtagaaactcttcttcagcttcatgttttaataatggaagaacttagtgatgtttcatatstagagatttttctctaggtccttctcatcgatargacctgtttcaagatatggcaagccctagttctgatctctggggtcctcaccatttatagacttccattagtcctgttgtgacttaattgttttgttatatttttggtggcctcctacactatggaagactttctgaaagcccatatctcatgctaaatttagctggatttttaacagccttgattgattgctggtcttaatggaagaaaatgtgatcctttctcttcctcccttgtcattaaattattactaatctatgaccagaggaagcagccactgcatacgtgggtgtatttttaaaaattgtgacacatcatcaagatggrtatacttgcccctttaattcaacaggcacctgttgaatgcctgtgcatgcaaacatgatgctgggctgagccctggggcttmccctgaagagctttggagcccacagcagaactcccagccaggctcatccaccactacagccacaaccatccctacctggagaaaggggctaaaagaagcccatgggattaacagacattctgaaacaccaacccttaggaaaggagtagaaatgggagttgggattaaaagcagaggtgaggttaaagggtttgaacaaaatgggcctgatcttgggcttctgaagtcctgtatagtgtaagtgctgacctgagggcctgtggctctcctgtagtgagggaggatccaactggagtatgacttccacctctgcatggccagcctggtgaygtgaagcacatttcttatgtcaggttcccagtttcctcttctgtaaaatggaggcagcatgggattgtaatgaggattaatggagctcatttacctgaacsscccagagggtgcttagcaaatactttatgcttcttgtgggtccattactttcccttgcctgtttttttagggaccctggagtgttaccttggcttctgattaaaagctaggttggcagatgcaagcacacatgcctcctatagtgttgtcctagactggggtggtgttagtggtcaggcaaataattgatcactctgtgttctcaagacaagcaatgggtaagaagacaaggccacggaggtcaaagatacagaaagataattgccatatatgctatgcagccagtkcccctacctcatgtgattgtagagtggttcttacactagggtggcatagaatcacctgaagggcttgtttaaacagatcatgggtggtgggtacagcatttcaggtgcggaagatgaaaggttctggaggtggatggtggtgatggttgcagaataatgaaaatgtacttaatgccatagaactggacrcttgaaaatggtgaaagtgatacatcttatattgctctccctgccccatcacaaatagattgctaggctcactccttatagattctgattctgtacctctgaggtggaccttaagagtctgcatttgtaacattcccacgtgatgctgctggtctagggaccccagtgtggaacccttgctgactgggttgggagtgacgttgggaactgtttcgccagaaatactggggacccttgagtggtaatggaattggttgtatattttagtatgatagttcttatagatgataaagacctcagaaaaatctcactatgtccatgcccaagagttccaccatgagcacatgccttgagggcagtgaccctggctcctattgtctctgtctctctatatctataacttttaatcttgaaatagtttaagattcataagaagttataactcataagaagttttaactcataaaaagtcaaaatagtacaatagtccccccttatccattgggaatacattctaagacccctagtagatgcctgaaactgtgggtagtcctgaaccctttatctrctgttttttcaatctgataactgagacagctagtaagggattaatgggtagtagtgtaatagcatggatgtgccggacaaaggtgtgattcccatcctgggcagtatggcatgagatttcatcacactactcagaatagcatgcagtttaaaacttgtgaggatgaggggaactactctatggaaagattcaggtaccctttacccggcttttcccaatgataacatcttacatatacatagtacattatcaaaagtaggaaactgttattggtttaatactatacattcttttaaaagagtgctcaactcaagattaggaatctatttttcaactaccattagccccactttggcaaggccaggtgggataagtgctggggctcctatggtgggtgtgctgcagtcttcagcagagcttggctacagaggagaaagatctaaactggaccaatttcatatggtcawkkcctctggcttgtggctgatcatcttgttctttggaattgactgtctcatgaaatagtgagtttcttgtcaccagagagatttaagcaagagccatggaatccctgtccccagcactgagaaggaacatgaaccatgtattccctgaatgtcttattccttaaaaatcctgtgattctatcaattgttttgttagagtttgtggctgacattgattacactatgagtcatgtgacattccatgttgatgtagttgccaaaatgctcgccttcctgggttctgctttcattagtttgagagaggagctgagccacagaaaaggggctggagtctgctagattaatgaagatttgggatgtgtagtctgttttcacactgctgataaagacatacccgagattgggtaaattataaagaacaagaggtttaatgaacgcacagttccacatgactggggaagccttgcaatcatagcagaaagcgaaaggcacgtcttacatggatggtggcaggcaaagagagagaacttgtgcaggggaactcctctttataaaaccatcagatctcatgagacttactcactatcatgagaactgcatgggaaagacccatccccatgattcaactacctcccactgggtccctcccatgacagtgagaattgtggtagctacaattcaagatgagatttgggtggggacacagccaagccatatcattccgccccggccccttccaaatatcatctcatcacattccaaaaccaatcatgccttcccaacagtcccccaaagtcttaactcatttcagcattaactcaaaagtccacagtccaaagtctcatatgagacaaggcaagtcccttccacctatgagcttttaaaattaaaagcaagttagttacttcctagatacaatgggggtataggcataaggtaaatacactcattccaaatgggaaaaattggtcaaaactaaaggctaaatgcccccatgcaagtccaaaacccagcggggaagtcaaatcttaaagctccaaaatgatctccttttacttcatgtctcacatctgggtcatgctgatgcaaaagataggctcccatggacttgggcagctctgcgtctgtggctttgcagggtatagcaccccacctggctgctttcactggctggcattgagtatctgtggcttttccaggttcatggcacaagcagttggtggatctaccattctagggtctggaggatgggggccgtcttctcacagctccactaggcagtgccccagcaggagttctgtgtggaggctctgaccccacatttcccttccacactgtcctagcagaggttctttatgagggcccccgtgagggccccactcctgcagcagatttctgcctgggcatccaggcatttccatgcatcctctgaaatctaggcagaggttcccaaaccttaattcttgactttgtgcaagctgccaaggcttggggcttgtgccctctgaagcaacagctcaagctgtaccttggccccttttagccatggctggagtggctgggacacagggcaccaagtccctaggctgcacagagcagggggaccccaggcctggcccatgaaaccattttttcctcctaggcctccaggcctgtgataggaggggctgccatgaagacttctgacatcccctggagacattttccccattgtcatggcgattaacatttggctcctcagtacttatgcaaatttttgcagccagcttgaatttctcctcagaaaatggatttttcttttctatcgcattgtcaggccacaaattttccaaactttaatattctgttttctttttaaaactgaatgaatttaacagcacccaagtcacatcttgaatgctttgctgcttagaaatttcttccaccagataccctaagtcatctccctcaagttcaaagttccacaaacctctagagcaggggcaaaatgccaccagtctctttgctaaaacagcaagaatcacctttactccagttcccaacaaattcctcatctccctctgagaccacctcagcctagatttcgttgtccctattattatcagcattttggtcaaagccattcaacaagtctctaggaagttccaaactttctcacatttcctgtyttcttctgaaccctccaaactgttccaacctctgcctgttacccaatttcaaagtcgcttccacattttcagatatcttcacagcaatagccccctcctggtaccaatttactgtattagtccgttttcacactgctgataaagacaacaataccccactcctggtaccaatttactgtattagtccatttttacactgctgatagacactgagactgggtaaattacacagaaaaagaggtttaatggactcacagttccatgtggctggggaggcctyacaatcatggtagaaagsaaagacatgtcttacatgggtggcagcaggcaagagagagracttgtgctggggaactcctcattataaaaccattagatcacatgagacttattcactttcatgaagacagcacaggaaatacctgtccccatgattcagttacctcccactgggtccttcccatgatagtgagaattgtggaagctacaattcaagatgagatttggatggggacacagccaaaccatatcatgggggtagagttgagggaaggagagaacattccagggataggaaatagcacatgcaaaggtcctgtggcatggcctttatgtgtaaaggagatattgataaaccttggtatgaaagactgtaggtctctgggtgcaaagtaatggctgagcatgaagctgaattagacttggccactagcttactttgctgttgacagaatgttggtacagattgagcatccttaatctgaaaatctgaaatctgaaatgtcccaaaatctgaaactttttgagtgctgacatgacaccacaagtggaaattctacaccttacctcatgtgatgagtcacagttaaaacttttatttcatgccccaaattatttcaaatattgtataaagttacctttataggtcatgtgtagaaggtgtatataaacataaatgaatatgaagtttagccyttagtcccatcctcaaagtatctctttattatatggagatatttcaaaatctgaaaaaatccaaaatctgaaagacttctggtcccttatatttcaattaagggatatgcaacgtgtacttctgcagctgccttgagaatgcatatcattgaataatgttagtgggaggttttaaactatctgaagatcacacaactgtgagagcccagctcccctgaaatgygtagggttggtcagtgattttgctatgcgccaaagcagctgccttgatccctcagagccccggcatttctgcccggggtttggccacccctggccttggctgacttctcatggatgcagcaaaaacccagtaggatgcacctctcaagtggttggcagcttttactggacagctttagagtcctgtgggttattctggttgttgctattcttaaatattgagtgtccaaaagattcgtgaactgcatctcagctgggtgggaccctttgggacaggagtaggggaataatgccgtcgttaaytgcaaagaggagttttgggaccaggttgtcttataggtttattttgaacaactgataggcttggtattgctggaagtggatagatttgggttgcctgtgtctagcaggtggcttccttttccagtatgttgcccactggtctcatctatcagactcacttgagagtatttcattattcatctaataaaggagtatgtgagattcccagaggaggaggatctacttctgtacttgacctgggtgaggaccactgggaacatttgcacctttcaccattgcaaactttgacatgtgagagtttccagaaatacagagattcttattttaatcctttttctttttaactgcagaagggaaataataatgggatagaataactgcagggagtagagagatgagaaaacattagaaaaaatagtacagaagtagagctggatgagaatccaagttatgagaacctattgatgagaggcatgcagaaataaaaagcccaaattcagtgatctaaatcagggctcagatgaggctgtttgtattgcacggtaggaatatatccagaaacagtgggccttttataaattaagcctgccattctccaattgcttaagacactgaggcccatcaggccagaaacatatgacccactttttctgagaaggaactttccctttaggagtggtaatttagaagaaaagaacaagcccaatgaatagtcccttatgggaggcatctcagcagaggccctttttgggggcaggagggattgcatagcaatactgcctacccagagttgttgttcccaggctagggtccaamtcagggcagggagatctactggaggcagcgtatcacacactagttgtccaagagatggagagagagtgcaaaatctgagctgtgcttatgggaagctcggagtctcacaaaactacacccatgctgcccatggtttatgtttaatgaatgaaatgatgattaagataggacaattggacaaaaaggctgggccttcttaggtgggtattgagtgggaagtgattcaagaggscagacattctgtctggayattagctggaagtggggctggacaagatgaactagagccctcttgtggtcccatcattcaggcctgtagctttcatttgagaccagtggttcttaaacttttgcagggatcagaatcacctggaggacttgctaaagcacaaattgctgggccccaccccagcgtttctgattcagtgggtctggggttgggactaggagtgcatttcaaagcactttctggagatattgatgctgctggtcctgggaccacactctgagatacagtaatctagaccatgaaggaggtctggatcctggggagggaatccgctttctgctttcttaggcactaggaaggcaaggagatacttggggctggaaggtggcaggggagcatggaagggaggagtccttgtccatcgtgtctcaccatctgaggagctgtcatcctttattcatcctgcccttctgcttgccctcagtctcagaaattccaaaagacagcttatgaccctgcatttttggttaaagaaaggagggaactgaactgtctgctctatgaattctgggctagtggggatcatggggattttgtaaattattttggtagcccgttgagttttgtctcaggatttcagcggaatccaaaccatgtgacatggaccattatcattcagctgccacctcctggatcctgccctgtaaacatgcccaggggtctctgaggatggaygcgtgtcattcacacaccaagtgtgttagagacaacagaaaaccttgtttttttcctgtgttctggtgaaagtcttttctgtctttccctttgtttcttcgagggagcttgagtggcaggattattattaagagtactttttaagttcccaacaattagataggaaatgaactgaatgggrgttcacattttatcttcaggaaaatgaccgcaagaaggccttactgtggggtggttaagagcatggcctggctttggaatgcctggattgggaatccttgttttgtcacatcatcgctgtgtgatcctaagccagtgatgtgacctccctgcacttcaatttcctcacctctaaagttgggataatactacaacttatttagtaggattgctgtaaggaccaaataagataatatagctcatgcagttagaattggacctgtcacttacagatagaaggcaatacattttagttcttactgtaagactgagacatccaaagacgtctcatactgtaatgtgtgatatttatgtatatgctttttaaggactacaatccttagtttcctacctactcaaggttatgttttgtagatgctaacagtgtacattctagagaaaatcagctggagggaggaaaatggyacagttctaaaattctttaagcctcgtttaattttttacctgttactgctttcatcatcacctctcactctcattttctaataagcctgaaaagcatgatggagtcataaatcatgtctgtaaaatgaagatgtgtagrctttggtaagatctcacatgtgatgttaataacaataccttacatatctggcctcacacttcacttaaactgtcccatttaatccctgaagtggtctcattagcttctgttagtcccattttacagtttgtacagtggagacttcagagaagaacctggcccaggctccacaggcagttaatgacagagctgggatttttttttgtggaggaataggggagacttttctggtaaagaccagaaaacctgctagacaaattctaaaagagccataacactcagagckgggattttaacttcatcttctgcttcagggaccacattgttcccagtgtgtttaaacmcctggctggtttttcacttggggttctcattcagattcgtgattctgtttactgagagatgatgtcccagttactctagctctgtaacaaatgactccaaaacttggggctgtgaaataatcattttattttgctcatggattctgtgggttattcagactcagtgttccatgatatttggggcctcagcaggggtgattcaaccacaggagctagagtcccctggggtgtctttgcccacgtgtcccacaggtgcatggttaggacagggacctcagatgggctgtcatccagaacacctacgtgtggcctctcaatgtggtctttctgcctgggctgacttgggtttcctcagagcatggcaacctgattcctagtgagatttccgagagagtgcggttgtctggcacttctgtgatctggcaatagcttcaaggaaggaaatatatttttacattgaaagaagagaatatgagccatgtgtgccaggtacggggagccacctgtgaagatcctgagtagaggcttaggtcactgtggacacagtggcagcagtggacaaggacaagggatgccgggtcatgcattcaccccacaaatattccatctatctctgaactaggcagaatgagcagggcaccaatctaatggctcttctggataatcacttcacatgggaatcctaggactccatattatattcttatcctgttgaaaatttgaccttttaaagatttatttatatttagctcaggccttaaaarttccatgtactatctaaaaagggaaaagttcatcccagtcaatgtcctgtcttgcttatgtttaagttggataggaagaaaaaaatccacaccaggagaagattggttgtaaaagtttattttacatttatgtgaagtttatttttggttctgatattcttcatagggtagatatttcttttaagactgttaatagtgtatttcctttttatttgccactccccaccaaaataaaccctcttttatttttgaatcagcttcatatcttcagaacgtccaactttaaataatggttggagaagctccaggttaagtagagagtaaaatcctattgctttctgacctttgggttaggatcaagtgtggtgtaataaaatatcagtcccaagagtcacctttgctgatttttttcctattattctttcctgttattccatattcatgcaggtcttgcagccaaggattgttacattaagatccaatctgaaattaaaacttatggttttaaccaataagctataaagctgttgaactcccactgggatgtagttaccttttcctaaacttcctgcattgtctccttttagccccacagttgatttcttattgagcctttggaaagttccttgccgtttcacagccatttcccgtcagagtggggaatattgactgtgcaaaccacttaaggtcacaggcrccacagctgtgtttcttctttgcagaaggggggtttctttgggtggggctgtgctcagcccttccgggtggtgaaggtctgaggtcacactgggagagcaggtccatatcgggattggggctccagcaggatcagaatgacttcacccagacttctggacctggaactcattctcagaaccttccagaagaccctgccctggaattgctttcaagggtctttttcatctgtgtacagagtatatttccttggaggcagctttgctgaaggccccttgagtcaagggtaatagggtgggagcagctatacacagttgcatttcagtgtttgatgataaaatggtgtccgttggtgagcatcttggtggtgaggaagtttatacgaccacagatgcttctcaccccaaggtacccgtgccctgtgctgctggtgccactcatcctagggcattcctgcttggcagtagcagattctagattgtcctgtttgctggtttgggggctgcaggggtctgcagagtgccgcaaggaggaggagtcccagatcactggttgaccttcagcgggcatttaacagcatattccatcaggcctcacctactagtgttttgttgaggctgctrtgtaactttgactttctctgctgtctcctatttaagagtaaataaaggtagtgacagtcacaaaaatagcatcaatgatgacaactagcgtttactgagtgctgactatacccaggcaccattctaacctctttacccaagttgtctctgctagtcctcaccacagccctgggaagtgtgtgctgtcatatacccatgaagaaactgaggccwngaaaggaaagcagctctgcccaaggtgttataagcagagagcaccragacaggacccaagcccaatttgtgttgactggggaatcagtactcagttctcttagtctttggctgttttgttgagtgcccaggtcatcctggtagaagggagacagtgacccacgtgaaaaaggatggctacagatgcatggctgcatggctgtgcrtcatccaccctggagtatctgcttgccaaaaatagggctacctgcaaaatgctttgagcactgtggaaaccagccgttacaactccaaacgtttatttttctgataataggtcaaggttttcataattgagttttaggggggctaattttagactttctgaaaatcagtctcaagaaacaaaacccagagtcaagtaaaaggatgcttttggaactgatgattctcagaagaagccatgaagggctcggccataaccccgggaaagctcactggccagcagcctggagccagtggagcttcaggtggctttaattcttccctggatgctggtggtctccagagacacaggggtaaacaggtcagcgtccttgtcctcaagggcgtcatcctccagggaggacatagctggtaatgacaaaatgtgggccagcgccttcttgcagctgggcacacagggctaggggaactgagaggagaaaaggatgaatttggccttggcttggagcagccttttaacagaaacacgcgtaactttcctgcagatgcacttcctgtgaatgaagagtcttgatatatatttttctttaacaagagaaagccaggcttttgattaataatttatatgtcaatgttgggatcttcattttgttatgagagatttcagttacaacagtgtgaggtgggtggtcaggaaacattccccctgggctcactttttgcttagaaaagtcctgatggaraggttgaggtgggaagagagtgagggggaagactccatggagcatgamvrgcatgctgtgcctgccacagccaagcatggaggtcycaaccataatgtgtttttgagacaggatctggctctatcgcccaggctggaatgcagtggtgcaatcttggctcactgcaacctccgcctcccaggctcaagccatcctccctcagcctcccgagtacctgggactacaggcgcaccaccaccatgcctgcmtaattttttgcattttttgcagaggcaggggtttcgccatgttgctcaggctggtgtcgaactcaagtgatccacctacctcggcctcccaaagtgctgggattacaggcatgagccaccacactccacctccaaccacaattcttgttttaaaaaatgaaaatagagtgaaacagaartggtagaatcaagtcaccttgctcattcacagtcatgtgtggctaggacaccatgtggtccagtctgacacaggctgatcctttcccctcaggacccatccttggggtcgtccagtccttgggctctgttcctctgatgtggcacaggtggtcagtggggcagggaagacagaaagatgagggccacatccacagaagtcatttccttcctgtggtacagacatgacaccaccctgtgggatgaatggggattcccatgtttgctagttacatatggccaagcccttcagcctttctgccccacttccagtttctttcttgggtgggaatgccttgagcctcagttaattgtttgagttttcttgagtataaaaggaatcctggctgggcattgagtgaatacaatcataaaacccaaatgatgctgttggcctcatctgagctgagagtggtgttggcaccttcatagctgacatcaaatggatctccaagcccaaacactaacagtggaaccagctattgctgcttctggtgtatcatccaaatgggttttcccagccatcttctggtgcatttctaacatacccttaaaaggcataaaaaagtggcatagatgatggctggaaagattaagttcyttctggtggcttctttaattttggaataaccagccttccttcaacccccttacatgcattagaaacttctgaactgtttttgttctgtttttaattaggttgtggtacaagaggagcaattaataaaaccttccatttccacatctactgtgaaactctgtgacttcttcccgtgtgatgatggctaagtgcgcagaacatgtgaaatttaagtagatttgtggaaacagaaacacatttttatttagtcrtgagcgtcacttggagtakaaatagagccctytatgattcgtgtgctggtctttcttcctggagggcttcagtattatctcatgctgtcatctttatgttgtattggaaaaatctgggattctttttcccttggtcattatttgctttttaaaaaataatgtagttttaaagaattcttgctatttaatctcaagcccaaacatggtttttagtgaggaactgatacttaataaagtttgatatttttagttctagaaagaattgttttggggggtgggaggctgcagttgagaggtacaagaaatgttcaatgaggggaagacactctactgtggttccatttgctctttgaaaacttgtgtttctgttggaaagaaaggtttgattttggaagttttaaatgtactgcatgatgttgctaaattttagttcgttgctgggaagttttggatgagctcatttcataaggatttatgtgccttataggccagtgtggggtaaggggtggagaagcttgcctccttcagaagggtcttcattcctagagggatatggaatgacccactgctttttggtgggaaacgtaaaggccagtcagcttttggatgaattttcaaggaagacagcagctgtccatcttcagtcttgacttgccattcccttagggagttccttcctttcacccatctttttctccccatggcttggccatgccacagtggtccctcggcttcaacagtcttgcttgcttacatctactaactgggcaagagagaccattctcccattggccctggaccaccactctgatttggatttagatgggctcaggaattttgtttggaatccttttggccttaaacaaaataatgatgagagaaatctgcctcccataagtcataatctcagcaggctcctgtgtctgagctatttctgtatccaggtccccaagagggctacagggaaaacttcatcatgatgggagggaagaaagaaggtaaagtcctaagatgtttgcttcctattccttgtaaggtttagccatgtatagtcatgtgccagtcacctagggctgagaaaggggagcaagcagagagggagaagaggaagaasccaaatgagatggktcgtaattgattagtggaagttaaatmatgttaaggataggaggcttgtcccctccatcatgatttagtatatcatccttcccaagagaagttttgagaacttgtcctctggtatccaggaaatggcctccccagcagtgtgcatagtcccagggaagccgtctcatgagcccctccttctcttgactcctctcctaatggtcacatggtgccaccactctttcaagccaagtcaaattgcatgcagcagaaaacccaaataagtttatgcagtagaggtttattctcacaccgaagtaattcagcattggtatggtggctccatggacttcaaggatcaaggatcctttcctctttctgttccaccatcctcagaacatggcttccagtttcaaagttaccttatggcccaatgtggctgttggagctccagccatcacatccaaattccagataggaaaaagaaggaagagagaagattacaaaagaaaattatctcccagctaatttgtctttatttatggagttttcctggaagcctcacattatggtttctgcttgtatcttcttgaccacctcttctccaggggagactagaaaatgtcttttaggtaggcatattgtagattggaataaagttgagtttggttaaaagggaaaagtagagaatggatattggttaggcatatagtctctgccatggtctagaatatatgaagaacctcatgtgtgaaccttaatatattctgccaaatattctgtttataatatctaaccctcctatcagatcctaggccatttggaagccaggagcttatcctctcctctttgtatcaagccaggggcccacatgttggagttatagcccatctttgttcaattgattcagattcagcccttgcctcccatatccctcaccatggatatgcagttataaatgatttcttgttaagcatttttaaaaggttaacttcttcccagagagcttttacataattatccatttaatgtgtttttaatgataaagaatctaatagttatcaataatgttggaaaagtaattctaggcatgaaaattagcagtatggtacatatgaagtacataccaagtactacctgattccagatattaggaaaacaagacagaagggtttcaccactagtcagtatcagtagattgttggggagaaatctttatgaaaaatgccacttttcactctttttttcaagtttgaactgactgtggaaagatgggagatgtctgagaaaacttgtgtcagtacttcatgtttgtaaaaggacagggaatccttctgaaaatctagttacataaatttatgttccaccacaagaaaaatcagtggatggctggaaggcggggctttcccttttgctctggaagggaaggaaactctgacagccagacttctcagtcggaaagtgtctttggtgagccttactatgtgactggctgattcactttgtccgctaagtcttgggagargtgatgtaaccagggactgcaacttctagggaaaggggaaaaatcactgttggccccaccctctagcattggaagcttaacsrggctttggcccacagcasatggaagtttgagctgtgttttgtaattcttttttaaatgttcgccagagcatccattattcttcctcattttctcttctcctcttccctccttttcttctttcttaccttttctcttttttatcctggatgtgctcctgtatggccattctaaatcaactcaggtctgacctttggaaatacgtacagtaataaggaatcctaggggcttcctgctgtatttctgtttttgaatttgattaacatgagctaagaggttgagtagaaagaacttggactttggtgtccaaaagacacgggtatgaattctgactctaccattactggctctgtgactctggacgagttgctttacttctctgactctctagaatctcacctggaacttgaggttaattcctgcttcaaagcgttgttaggaagattgaacaaaataatgtgtgaaggaaaacccagcgagagggatgaagagcagagtgtgctgggctacataggctaaactaagaagtttggattttatttayagtgctctgggaagcagggaagtgacctgatattgtagatattttcaaaaaatcactstgggcctgtggagtgaatggaggacaggagctggagtggaagcagatagcccagctaggaggcaagaacagtggacaagacggctggactagtgtggtcacagagggaacagacggaagcagtgattcttgagaacttttggaggtaaagacactaggagtagctgaagtcttagatgtgaaaaagggagggaaagagaacactcaaacatggatcttaggttgggtcttgagcgcgtgattggtgaggactgtttgacagtgtagcccaggactgtgcatggggatgacacccacaagatgttggctggctggctggattcatgactatctggaggaaagagagaatgcgtgttcttaggccatgttggatgctgaatgcagtgggacagacccggttctatttcttgctttgaagagattgtgttccaattatctgccctgtttagatggcagcttccagaatcaagttggtcagttttgagcaagatctggaaagcaagacaatgtctcaaaagcatcaggacccctgatatccaccttgttaacaccgtagatgacttcggtgccctccctgcagccgtctgctttaattgtcagaacaaagtgaaagcgaactcagagtgggacttgggatgggctttggaactgagcagcattctcaaagctgggtgctgtagtggcatgactattacaggtggggccaggaccccacttccacaaaattcaattggatacatctggtaggaggtgttcacctggaaatctgggtcttaaaccactttgagaaacactgtcctggaggtaagcagcccctgttctggttctttttcttccactttttaaaaaggaaatcagtttggtggcaaaatctccccttcctgtccataattcagactacgacagcaattagaggcaggcagcctcccctccaaggagaaagaaaccctccacgtgttttatgagtatattcctaataatgacaatagcagcaaacaaacaccatagtggtgatttcatactcatgaaattattgtcatggagttagagcctagataaaagtgtttggcaagtctctaaagcatatttcaagagaaaaaggaggccagaatttatagaatctaaaaatagcagttgaagtgcagctgtgtttagcttgtcagagaacctgttgagtcaagatgggcaggggattttatttctctggccctgaggtcatttgtcttgtttaagaaggggcagcaaacatttccaaatagggattgacttttaaggggaggaagatggctaaatgtatatggtatttcttgttttctgctcttactcttcctacctccaaccccattccaaatttcctcttaagaaaaggaaggrgagtttgtttttctcagtagagtaagtagtgactgcctaggtggcaggattttggatggtagtggtgatgttacttattgatggcacatttgatgactgttagtccatggagtggtgggggtagactaactatctggtcttagtgggttctgtacaatcccattaagttgaaggaataaacctgtagttggagaaataacagtgtgacttctccaagactgattggctgayttttggaccctctttgtcccatttctagtcaggaattatgtcttctactgttccacaacccacaaaagaagatgtctgttccacttctggcctaagcaatcctcaagcctctatacttaacaacattggaatgtcaccatcttaaaacttgtcaaccagtaggccttcaaacctcctgccctttaatatttattgaaaccttggtggaaatgaattctgtttttggtggagtgcgtgaagttatttccctccattagtttgtaggccagaggttgaaaactagtggcccgcaggmtgagtcttcctcaccgtcccactttgcttgcctggcaaagtgttaacctatacaattgccaatattggaaaactgggatactttgtttacaaatctttatttctggattctcctgggttgctctaatatatattcttggtttagatttcttttctggagaggtgtccccagactgctgtgcataggtccttgtcctcccagagtagctcacctgtgggtcatgatgagaaatagccactgtattttatttgaggataataagaaaggggttaaataaattgtatgttgagcacctagaaaacatatgcatgtgcatgatgagcaccctgtaagcattagctattattgctatcatcatcagcatgtttaatgtattttctgttgagggttccattgaggacattgttcatgacataacccaatgtcttatgaggcctcatgaaagacatgtctgtcagatctcagttccagaaaatagctgtccttcttctgaattactggttcatctgtaccttactcatgcccccaatcttatttctatctttgcactagctttgcagaagctcagaggcaactatgtagttcatgtctagcaggaggacttggattcgatttgttgatcccttggtttcacatgccataatttccttgcttctctacttttctcacttattttgttgtgagcattattgtaagcagccttaaatcctgttggaacaaggctgggtgtaaattaaaaaacaaatcaagcatccattcctctgagaggttatataatcactgagaataggcttccacatcaggacaggtttcatgtcttagccttgggactacatgttttctctttcccttctggacactactgacctctcattgtcatgttggacttgattctatcagttgtgctcatgctttcccttgaatctagataacctgtaacttctgttacagaatgagatggcttatttccctgggtagactgactgtattagtcagctattgccacataacaaactgccccacaactccatggcacacatcaagaagcatttatgttctcatggatctgtgggatggttrgacagttctgctgcaggtctgcacgttggctggggaagctgttctccatgtctcttatctttctagaaccagttggctactggggcaggttcttctcatggtgatggcaaaaatkcaagaggggcatgcagaaacatgtgagacctcttaaggggtaggctcagaactggcactatcacttctgccctcattccattggccagagcaagtcatgaggcccaatccatcagtagagtggggaaatagagtagaaatagatcagcctctagtgagaggaaccttagagtcaatgacaaagggtaggagtaccaggtggtgggtagggggcagctgataagtaatgcagtctagcctgtaatcccagcactttgggaggccaaggcaggtggatcatgaggtcaagagattgagaccatcctggccaaygcgatgaaaccccatctctactaaaaatacaaaatttatctgggcatggtggcatgtatctgtagtcccagctactcgggaggctgagtcaggagaattgcttgaactcgggagacggaggttgcagtgagccaagactgcgccactgcactccagcctgggcaacagagtgagactccatctcaaataataataatattattattaataataatacagtcgatcacaggcagtgtaattatttgaagaccataaggttgggcatacagcatagagtatctagcccttagtggctatgttggctattctctacttcccctctccagatccattctccaccattatccctcctgctttgtgcccttgggaggctgaccttcccctctgcctttwagttgggttcagtcagaggggagcactggaaaaagagggtggaagagtggccagccatagtgaccatggctctctacggaaggccatagcttctgycaggtggttagttctaataacttaggggttccagtgaccactccccaccttgctccttccgacctagggcattaatggctccctgctttgccacaggggtctcttttaaactgaccccccttactgttgtaaatagtcccttcagtgaattctttttgtctccctggttgaaggaaacatctgcttctggccaggaccatcatggatacagtaggtgctcaataagtgcatggttgattagcaggcctccttgtttttcctctcctctggcctctacatcactaaatggtcacttctcttctagcctgaagagcccatggaatgtcagcttgggaatccctccctctttccccataacttgtccaaccaccatccctctcccaagaacctggcacagtaaattcattagagcgaattcaaataaataaggttttacttttcttctttgggatttcttagcatgcccgttgggacaattagggagggattctttcaagtacaacattttctctagcaattatgggggttttatctcccagatgtgatttatgccatattacaytccaagaagggaacatgaagaatgtttgtggctaaaraagtctcaacacaaggaaactacaggtgaaacgtaacaatagtaattgccttactttatttgcgaaggggtggtgaacactaatatgcctgactccatagagcagtgtatttggttttcttaagcaggaagaagggssccccccccaattttaatttactgaatgagtttaagaaccatggtgtatttcccaagcttcgctagtgaagatggtattttgttaaaaattgagattcccattgatccagatccagttgggcctgggaatctgttttcaacgtgtatcctgagtcatatttgggaagcactgggctctgcttatgattctcacgttctggtctgtgactgaggagaygtgccatgatgagagtgatgatggtgatggtggcagacaagagcatgtcacatttagaaatactgtaactggttgctgaggttttacatatattcyttctgagcttgttttgtctaatattgcctgtgccaacagtattttaccagaattgaatgaaaagaaaggtaccagcagatttttttagatgttctaattgataccagaagcaaagacgtagaaaccgtcatgttataaacatgaaagccccaagcaaacagcctttagcccaccctttgagaaccactacatgacttcttgataagattctttcaactttaccctatgcctggatcatgaaagaggtgtttctagaaagctctgcaaaggactttctctgacagacggctctaggcagggggaagctctgactaactgatctctggagaggaacacagatgttccctcctaaaaaaggacatgctggccttgctttcttacaggtcacgaagtctcttttaggaatgccatttggcatttcaagtttctgcagcagttctgcagaaagccatgcctagaaaatttataattactctgataccagatggctttgcggccttcagtatcaaatgcattgtgattgtgctatgagaattttggggggaaaattccaaactttattaattattgtattggggaaaacatcatgttattgaattttaattagagttgctgggcagcctgggctgccttttaacttacgggtcacctggttattgcctgtgaggctcactgaggaaatgtcttgctggcaaagctgagttcgctcagaatgtggactgtkccatttttctgttgtccaacacttgctttgtttgtgacatttagctccttttcttcctttccatcccaaatccacaccctttcttctgtcttttgcaaaatctatgacactgttgaatgaataatataagcccaaggacttggagggatgagagctgtgatgcccacatgttttagtgttggcatgtttccctcatttttggggatgccttgggttgaagctgatttttcagcatccctggtttagcatatgttgcattatgtatctgggaaagtagcatatctattttctcattttgcattacaatagcatctagtaacattcaagcctcaattaattgaaccaataattattatattaaaaatggtatgtatgccccaggrcagagrttaggctatggtgggcatttgagaccttagggccatagaccccgaaacatgcattctccagaactgagtatgcaactgtttgctttcgaccttacagcacaggctttgggagaaaacagttamgttcaggtcctaactccagtaatgaatttcaagcttcttgttattgtttttcttcctgaaagacaaagggagttttatgccatggtattttgasgacaatgttgaatcaattgttatcaratgggaagatttctgaatgctgaatagtttgtaatatccttcaaaaaaccaaaccaagaacccacccacccattcaccatttatctctccatttgtccacccacccattacccacccatccatccattcacccatccatttcaacattcaccagttcctacaaggtactgagtactgcatttatttgctaggggtgcaaaaataaagtctaataataataataaccatcatttattgagaacctactatgtgttgagcagtttccaatcttcaaagcagttttgtgatgtaggaattatgttctccgttttatgagagaacagaagctaatttacttgcctgggtcaccaggcagtcaaggcggagcaggcctgaggcatccttgcaacattagaaccagaacaacatttcattmttttatgttaaacggactctcctgccyggacccaggcccacgttagcatccagagtggcatgcagtggcagaattggagctggaacagccctcatttgttgtcttctctccttgggaaatcttcctgctatcagtgaaaaagggagagggatcagctcttgtttcttggctttgctctttacagcctcttagaaacttgagttctatctggattcatcstgtcatttgatggtacaggagtacaaatggaggtccacttagcgaatatctaaatatttaaagattacaaatcaaggtaactgttcagtaaactgtgttccatcctaccttgacaaatatacctttataacaacttggaagccctaggttgaattttgatttctcaggcctctcagagtttagtgtagaaatggatggcttggggagagccagcccccagcccacccccccacttccctttccatctgactccatcccgcatggcaatgggccttctgtgcatgcgtgtgtggacacccatccaagcttcgtccaccccctccccacagaggctgcccttggacctcaggtagggtacactcactcatggtgcactttacagtgcaggggacaaaccctggagtagagcccaacatggaccctgaaggaggacttagggctgttggggcagggatttctgttgtcctgggcacacagagcatatctgcaagagggagatgtggagactgaccttggtctcacaaactcattgccccttgcaaagaaataaccaggagggtctcctgagaatggggttcagagtaagggcccctcttgcctgggtcttacccagggtgataccatttctgccaagtcagaggatgaaagggacttcggcggaagccatatgacccacctctgtcattttagggagactgagcatggctggtaaatctcagtgatggctggagccctgggggtccttagtttccyagcaagtgccctgtcctgctcttgcctttctgagcatcatcctcgtggcattctggagcatgaggacccaaggctgggtctgagtggatgactgtagttacgtacacaggctctgctgcagggacaggattacagaagatgtttacacaaagctgtagctttggaaacaggctgtggtgcatatcttagcagccccactgaccagcttggtgatttttgttcaactggagccttggcttcctcgtctagaaattggagataaaatggtatctgtaggtagagttgtgtaggtggaagatgagatgtttgtagaaatcttcatacagcacttggctttcccaaagggaacatcagcgaattgtagccactgtgactggagctgctactattgttcaccaggtgtcctggaccccactgagaagacgctgccattcgttcattcactgattcacccactcaaatattcatagagcacctatcatgtgcaagtactattctggtagcatgggacttaccagtgaacaagagaagcaaaattccatgccatagtggagctaacatcctagcaggtagaggcagagataaaccataaacataattaacatggagatatagaacatatggaatatagagtatggaaacacgaaagctgataagtgctatggaaaaaggtggataagggaaaggggtttggttgacccaaggtgggctgtaattttaaatagggtggttagggtaggcctcatgaaagaggtttttaatcaagaacttgaaggaggtaaggggagagaaccatgtggagggatctgggagaagagcattccaggcagcggaaacagccggtgcaaaggccctgaggcaggagtgcctrttgttccagggacagtcaggaggccagtgtgtctagagcagaatgagggtgtaggtattaagagacgaggtcagagacatgacagaggcctgaccgtgtagggcctagtagaccattgaaaggacttggcttttactcattgcaaagtacggaggggacaaatgacatgaccttctgcatctcctcccacgccttgggcccrcaggctgcctctgcactgttagtcctccctgacttcctgccccaggctcactgcccccatccatgttgcacacccctctctacctgcagccgccatcccctaacaggtagaggtgtgccctgggtccactccctcaagtcccagctgcattaccagccaaggatgtgatgcatagtattctggagctcctttttaaaaaggagttacattgctttgggagttcaggacacaggcagcctgggggtgcttgcttcatttctgaaaaagcaggttgtggccaccctttcatgagccttgactctactgggctctccctgctccccatggagcctcatgctgtcctcaggccaccctagccccctgttctcctggctggctttatcccgctgagcagtgggacagaggacaggaagatgagaggaagataktccagagctgggtggagagtcagggtggagtagagctgtgtgagggtgtgcatgagggagccaacaggaaggagggctgggttcttgttctctgaccaattcccagtcatggctctcccatggggtttcacagctcagtccgaagacacattgttcctgtgcatggtgtagccaagcccaaatatttagctacggccacaccagcccttgttctgcttataactgtggtgtagacctcagtccagacaccctccaagagatacccaccctgccccttggcactggcttgggcggccttgtctggtgctggaaggctctcttgggttctttgccaaagttcagatgtccccctttcccactctgtgggtgggccctagtgggggatggatgagggctaaggcatgctttacccctggctcccaggcacagagatgagggtggcctctgggtcagagggcttcctgttgagtcagagcctccagccgatatgcctactgtcccacccctactccacatagatgcagggcaccctgcagctttgtttcaggaggaactctgccagtggaaaccccatgtccttagcgcagccctgggggttatcagggtggctcagatgcaggaagtcctcgcctctgctgtcctgctctgccccaccctgtcctgcagaggggaggccctgcccatgggagagtctgcctcyactgggcagtgctggcctggaggaaacttccatgccacccctcctgcccctgggctccagggctctcgatttttggggtaaacagaggtgctgggctctgctgaggataagctttgtgatctgggaaggatccctttctcctcattttttccccacctccttttcatcatgtctgtgtgaaaacgaaagctattgtttatgtaaaaggaccatttgcctaatgtccctggaatttatttgctggagcattttccattttcatattcagtttagaccttggctgaagtagggaggttatgtaactgggatggaacaaatcycattggcatctggggaccctagtgtaccccacccttagccattcctgcagtggactgagtgcccccctggctgtatattcaagtcgcctctgtggctgccagagttggggagctggggagctggagtgatagagaaggagttggcagcatttagaatggagtcaggaggaagatttctctggggggttggattcatagatctgctttggggctgtctcctcctcctcagctgtagacctcgggggtccagactttccttgcacacaaagcctaggcctttcctatcagcctgtctgtggaccttagccaacagcctgagcctcactgcttgagccttggctggattagggaaatgtctctggcactttccttcttggctgtctgtggaacctgtctctacattctaacccatccccagcagcactggccttgagggccatgtttctacccctgattcccagcctgagcgccttgggtttctcctcagaagccttgtctgggtctgcatggaattactttgacaaaggatgggatgtttttctaggttatgagggcctggacatttgcctgcctggggttttaaaagaaggcaaatatatagagtgggttttggagccctgaacttagtcatgggtggataggggtgggctgaggagggggtgcaacctctgccttccctccccacrcccccatattctgagatggtagagaaccctttcattcctccagcctgtctctttcatccctctatggactgagacatctccctttacaccagttttttacttaaacatgcttattagcctccattaagaaaaaggtaaccctgtgtatacctgtattaacacaatgctaactgctgcaacaaaccctcagttttcaattacttgacctactagatgtttgttcattgctcatgtgtcagtcaaataaggctattcctcgttgaaggtagcttcctccacgtggtgattctgggactgcagttgctttccattgctgctgctgcaattccttaggacctccaggatttctgcctcctgggggcaggaggagaaagaagcagtggagaaggcacacccaccccttaaacactccagcctagaaatgacccacatcccttctaccgactttccattggtgggaactagtcacatggccacagccggcctcagaggaggctgggaaatgtgggtccaggctgggcaccaccttgggaatgactccacatatcagtggtaggagatggagaggagggggtgtacttgggaaacggcgaggtcaagtcagcagggtggattgagaatatgtagggggacgaagccaggagtccaaggaccccttgggtttctggtttggagaacagggtggatggtgcctctgaaggcaatggagttaacaggaagatggacgatgctgagagggaaggctcatctgtcaagtgcccagcaggggtgggtgctgtaagaatgttttgtgaatgcaggaatgaggagaaacagtagtgaatgaacttgagtcccttctgccaaccccttgcagctatagtggagaaaaactgtttggtagctgtactccatagcctgaaaccatagcacctgatgaaattggaccaatctgttttcaaatacaaagctagtagttagaataaccagggggaaaaaagcataatcagtagccccatgtctttgcacaggctgccataaaaaaaggtacagttgtttctcagtatgcatgggagattggttccaggattcccaatggataccaaaattcatagatgctcaagtccctgatataaggtggcatcgtatttgtatataacctacatatatcctcctgtatactttaaattatctctagattacttrtaatacctacarcaatgtcaatgctatgtaaatagttgttatactgtattttgggttttttgttgtattgttatttttattgtttttttcctgaatatttttgatctgtggttggttgaatccatggatgtggaacccatagatacagagggctgactatcccataaattgggtgggttacacaacagaaattaatttgctcacagttttggaggctgaaagcccacaatcaaggtgccagcatagttggtgtgtggtgtgggctctcttcctggcttagagacggccaccttcgtgctatgtcctcacatggcagggagagagagggagaaagctctctagtgtctcttcttatataccatcatgaaggctatgacctcctctaaaccgaattatatcctgaaaggcccatcacagtgggagttagggcttaaaaatgtgaatgtggtgttggaggacacaattcagtccacggcatccagtggcgatgtctccccaggcatagagtcctcttctgtgttgggtattgtctctctaagctgcggggaaagggaaggcagcagattggtgtcctggcccatccacttcaggtgagaaggatgcctgctgwcctcgtgtggacacaacttcctctgctctccttggccttgccttggcctctttgctttaggatatgatgcccagaagggctcgaaactggagtctgaccaggggcaagcaggctgcctcttgctcctccccagaaagggagagccagctgagggtgacaccttgggctgcagccacaggccactttgccactgggctcacccacgctgctgctgccacacgtggggccaagggtgacaaggytgccagggagcctgggatcggagttccagggccatctgagctctgggtcagcagcagtcattggagcagggatctggggaggcttttcacgtgggggttgttgagataggggtctggccccattcctgcctgactggcagtcttcattaatgtacgtttataccaggagcaagtggagctggggaggggactcacatctctgtctgtgggaagcagggcagagtgagggagagtatggcctgctttctagctgatatctccccttgctctcagcaagctcctctgcctcttcctttccttctggtaaagcataaggagaggactcaacagtaaggactaatatttgacagtgaggagcagatagagttttttaggcaggggtcactgttaaggaagtttgtattttttttttaacttccaaataaagcttgaagtgtctgagaggctgcataacagaggtgaagggcacagacttgggagccccatggccaggatttgaatctgaactcttaggcaggtccctgaactgctcagccctcagtttcccrtctgtaaatggtgataacagtaccttcctaaggtcattatgaggactaaatgagtaaacattgatacagtgctaacaacgcttaatagagtacttacaacacttcacttaataagtgccatatggtgggtgttaaatatatattttggggaacggggtctcgctatgttgcccaggctagagcgcagtaactattcacaggcacagtcagagcccactacagcctccaactcctgggctcaagcagtcctccttcctcagcttcccaagtagctgggactacaggcatgtaccattgcacccagctaaattttwaaaaattaagtcttgttgaagagtgagtagaaaccagagtggtgataatttctggttctccctagtcatctccctcaagaatttcccagttacttctcctggaagatccgcttccttgttttgttgtttttgtttttgtttttgtttttttttgactttgagacaggatctcactctgacacccaggcgggagtgcagtggtacagtctccgctcactgcagcctcarcagcccaggcccaagtgatcctcccacctcagctttccaggtagctgggcagtgtcagcagctctcctatggccagctccaccaccaggtcagacagtacccttggcaacctgtggaccaggctggggaagaagaaaatctaggaagaaaaggccacacaaggaagaagtgcagatggcaggggattccggtggccagggaccagatgggagtccgaaagctacacagagcaaacaaccaaaattgaaagcaaacagactctgagttgagaaacctgttctccctatccagagcatacaattcagaaaatgccggaacagcataaacactgcaaaacaaatccagctatgtaatccctttattttagtaattagaggtggcactgggaatgctggtaacagtggagtttgactcagatccccttgacctcacttggcttttcctccatgttccaacaacttgttaagtctgcttctccattccattcctttcccggcgtggtgtttgggtttgtaggcaggatggccatgtatgcacaaagaaagctttggggcagtttcctgccacccagtttttatgaacattctctttgccccatgtgtggcagcagaaggcaatccagccctcagcctggaccgccgaccttgtgtgtttgtctccctctgtgcctaggcccgagaggccattagaagccccatttgtgtgtctcagcatggcaggaaggtcaaaccgctgcttcctggttggaaatggtttcttcattgattcatcaggtcagtcaagcatttactgagcacccactggagccagcattgtgcaaggtgctaggaatacagtgatgaggaaaagcagacatagaccttacccttctgaaagttccactaaaaatcaaataactgtgaacaaatgtccccttcctgctgtgatacctgccataaagaaacatgttactattaaagtataaccagatactcacatgtgacattctcttgttggttttccctgagtgcaaaagaggtggtgagtctttctaaatcctgagtcaagatgcttgaccacttattaggacttggacccttagttttggacccttagttttggacccttagtcccttatcaacatcgaaggtacagaaggattgacatcagagaggcccaggaagtttgacattggagagaggcgtttttggagaaggctgatgggctggggggtgttttccgacctgagccccttggaggagagaaaagggtgttcttcctccagcccagagaaaggaggagaccagacaggtctagctcctgagagctagcctgactttcttccagagtcttggagagcacaaagatgtgtgttgatgtacagcttaaaggggagttaatggagccctgagaatgtcctgctcccccggaggaggacatatgagtgcatctcagggtgaaagctggctaggagctatttaaaaggggttgtaccttaggtgaccctagggagaggtgatgggaccatacccaaaacacaaggggtctggggccagcggaggagaccttgttccctcttgggagttgcaggggagtgtcccaatgctcaggaagctccagggaaccttcagtgtgcctgaaaaaaagtcaacctggaatacccaccaagctaagggaggtcagcgtgcaatgccacaaagccacagaagtctctagagcgactcagctttaaacagctgccatggccagagaaaagccaacacccaaagacaccagttccaactaggtgtggcttctcctcccctcctctcctcccctcaaaaggtgttctaagcagctgctgggaaagggggtgagaggaagtgactgcagcttttttatctcccacttcccaccctctagcaaccttcaaagcctgaagtagggccaagttggaagaggcgaggaagtttaactttaaatgaaatttggagtttttcactaatacgcaggactggtcattttgatactgaatgggattattctggagattaaagcaatggaaagacttttcatgatctaagagtgatccaagagatagtgggacctgctcaaggtttcatccaggaggccagggagaaagggccaacctcagtatctaagggttaagggtgtgcaagagagtgcaatcwgtattgcatttcagcagatcagccaagctgcaggataggtgacagatatgaaacgataaatgtggaggcagggagaccaggtaagaagtctgcggtggtctaatggtggaggtgaagagaagagggcaggctgcagaaaaggcaggatacgaggtagaactcccacagtttcctcatctctattgtacatagtaatcagggtctaacatagcttccctttcccacctacgacctatgaggtgcacctgtccgtagtaagtactcagtaaatgactggtgaatgaatgtgttttaaataaggtatatagtgagaaaagtgagcattggagtctatttcagttatgtgttacaataataatgctgcagaacaaactcaaaacytcagtggcatayaatacaaagcatatagtttgtgcagctgggattagcagtggcttggctagctggctctgctgatttgggcagggcttgttcatatagctaggggtcagctagctgttggttatctagactggcattggctggggtgactggggcaactcagcaccgctccatgcatatctcactgtccaacaggccagcctgggcrtattcacgtggagactgagaagcacgagaaggcagaattgggcccttgataagatcatcctaacacagaggcagatgtagatttgaaccctatttgcaacagtcactaatcatgtgatcttcggtgatttattttacactttgtggcttaatgtctttatctgtaaaatggggctaggaaaatttatctcactgggtagtcaggattacataagagtaataacatctcattcccactataccatcctgagagggtaaataattctgcctatgacgcaggtatagaaataaaaaagactatgaaaagattaaaaagagctcaaatgaagggaagataattctaggcagaagaaagagcatgttcaaaggctgtgtgagtgaagaggtgggagagtgtgctgaaaggkgggcagaagcctctctgccctgggggaggggatggtgccagggagctctaattgtattttgctggcactggggagccatggaaatttctgtaggaagggagagatttattttattccacaaacatttatttggcacctatgatgtgcaaggtattctttaagatgcttgggagacagtagtgattaatcaatgtccagtgggagagtcaggggggtcaggaagatcttggcacagaatgaggtcagagtgagagaggtcaagattggctggccaggggtattagccctgagatacactgctgctctatgggattttgcccctcattcacaagcagagggcctacccttaggccccaagtgtgtcaagccccctctgcttacaaaactttatttttcacaaccaaaggtggttcataatggtgggctgaggaggaagcaactgaagtaggggaagctcagaagtctctgagggtccttcccaccaggaatctccccacttgaacctaaggctgggacactttggcatgtgtgttttaaaggatccgtgggtttgtggggagggctgcaccagtgaccagttaagcccagtgggtgatgcctttcctttgttacttttcatgcagacatctggaaagaatttgtcaagaattataataaagaataccacggaatgaaagcaaatgtggtgagaagcagagttgccttaagactgagaagccagcaggaatggctgctgctaagaacctcattcttataggaaggattcagttctttccctgagcaacagaagtgcataggtgcacggcatagtgtgtcagttagcatttgctgagtaacaaaccttcctcaaatttaatggcttaacacaacagccatttattattgtgtataagtctctgggttagctggatagttctgctgatctgggtggggcgtggctgattttggctgggctcactcatgtgttagggttcagcttgcaggctggctggaggctggctcagtcagatgttttagagttggctgaggtgacagtgtggctgggccaatgcctatcatcatccagcaggctggcctgggcttgtttacatggttaggaggttctacaagtgagagtggaagtaggcaaggccttttgaggcatgggcttcagaagtggcatgatgtcatttcttacacattctcttggccaaagtaagttcaagggatgggaaaatagcctcttcctgatgatgggaggagctactgtatcatcttttcatgacacatatgtagggacaggtagaacattgtggtcatatgcagtggactgagcccatgggctttggagtcmcatggggctctcaagccatgattctttacttaaccttcrtctataaaatgaaaacactgatagaatctatctcacaagatcattttgaggtaaatgcacatrtrcctaatgcatagtaaattctcagtagaaaataacattttatgtattttgcrtgtttctcataaactgattgtgyattctaattatttagtttggaaaatgtagtctctgtaggtttacccttccctgaggcagtaggggagatcatcacctctgtaatggtataatatgaactcaggagttgagattcgtaaagcagtaaggaatgcatagtcagctatactggaaatwtgrgaaagggaaatggactatgtgggaaagcgggactcttatccttgcagaagtcactaygaaatgaggctttcagtaaacagaagatggrcatttcatcctttctcattactgagccttcctcaagacctccttaacatcctaacattataaatacaataattttagaaattacttagtcaataaaaaataagcacttattgtatacgagactctgttctaggagccagagatacagaggaataaggaattaaggtatttctcccatattcaaggacttcagtttcattacctgtccagaaaactatgagaaccacccatcacctctggttatagattcttaagtgggatgtcaagccccttccctaatgatctcagtttaacctgctgtcctattcctctgtggcctattcctgtgctacactcgagccaaggtggcctcttccctagccccacacatactctttgtttttccattcttccaagcaggcccggagaaggaatgggctccacgatgcagggcccgcggtagagaacagccaggcagagcagggggcctggctggatgtggccascatctgcaggggttcagcattgagatatgacactgtcacctccatctcaagaagcccttacggatgcctcccttcccttcatgactcactgtgatctacaactcctcagagccagccttaaagtggtctgtggatcagtctcatctccccactggagctccatgggcagaaagcactctttctcttctgcctacaacatcctcctcccatcggtatgcaccccttcctaggagccccacaggcaatgacaggaacccccaaccccatgtgtgcacatatacacattcccacatgtgtggggaatgagaggctacatagcctgctccatcctcttcttttaacctgcaattactgggtgaaaagagtaggatatagtaaaatgcaaatgctagtttagtaaatggcataaagacattgaagtgtccctggacatcagtcacgtggctgtggaagggagacttagggtgtggctttccccatggaccatggtgggtctttgggatccctctcttccccaccccagtcctttaaagacccaccagcgactttgtgagattctagactcctttccctcgtacctcctagccttattggatggaaaagagggaacagtggttcctttctttctgccacgcctccaccttccattggagactcctatttctccctccgtgacatctttgctgaacagaacagctcttaaaccagaccttatctgttccatgggtgcagaagggtgcaatgtgaacagaaacagcaagtctctggaaaagagctccttcagctgcaaagaacacagaggtcaggaggaataaagctaatgagagagcagagagtcctttgtctccccaggtgttattcccagaggscaactagggaaaatggagatggggtataaacatctgaattcactgttaaacactccatgaactgttgataattccctagaagcagcatattcctgaggtagcttcatatgatctccagaagcaacttacatgtagacatttttctgagaattccagaaagaatattgataattttcagacaccatggcttccacgcctcatcaacatragcagtattagkctttatctctgacatcaatcaaacttgaacaccatcagcatgggctttaatgaaattctcacatatgtatcagaacttgtattttttcctttagtcagtgtcttgatccatttgtgttgctgtaaaggagtacctgaggctgggtaatttataaagaaaagatgtgtattcggctcatggttctgcagggtgtacaagaagcatgatgccaggcatccgctttgggtgagggcgtcaggctgattctactcatggtggaaggagaaggggagccatcgtgtggagatcacatggtgagagaggaagcaagcggggagtggaggtgccaggctctttttaacaaccagctgttgtaggagcacagtgagaactgactcactacctagagaatggcaccaagccattcacaatggatccgtccccatgacccaagcacctcccatcagacccacctccaacactggagatcagatttcagagtgagacttggtggggccaaacaaatcatattcaaaccatagcaattagaatcttaaaatcaaaattgatggctttatttttctaaaaatgggaaaatatctccaaaacattgttcaaaaacaaaacaaaacaaaamaaaaatgtttgtycttatatcccatcagtttattcaactaacattcactgtggactttttataaggcagtaactgttttatgaataggagatataaaactgggtgaaacagtgaggttcctggccactgtattgtaataatagaggcacatataccaaagagctaaaatacaggcagcaaactctagggactgaagtaaatttccttaatttaatgaaatgtatcaagcagaaacccacaataagcatcatacttaaaggattcatttgaatttttttatttatttttattaaatcagatatacttttctagtttttttaatttttattttttgcatttcttgatcatttcaaagtgaggtcagttacagagtgaatgggttcatcctgtcattgtaaataacagtttttygtttaataatggcattttgtattaccaagaccttgcttcacattaggtgtttygtatacattatctcatttaatcaaaaccagcastctatatcatgggtgccaccattcctctgatttttgctaaggaggaaactgaggttcaaaaagggtaaataagttgtccaagaccacacagccattgtttggcagagctggggcaaaggtctatactgctgcaaagcttgtgatttttggctrctaccctctaatgttctgtgagggtggaacacctaacctagaatttccctgtggatcactcacccccaatgatggcatgtcttgctctggacccatgatataatgatctggatacagccaaagtcactaagcacgctacaccctagcctttcaattcctttattacttcatggagaatcatgtatttcagccactcaagtatctttaaggtctaggccttatcgaatggggtttagtcactcagtacagtctgccctttgtactcatgagttcagcattcatggatttgaagaactgtggggtgaaaatattccaaaaaaatggatggttgcatctgtactgaacatatacagacttttttcaatatttcctaaacaataaagtatagcaaygatttacatattatttacattgtattgggtattataagtaatctagagattaaagtatataggaggatgtgtgtatgttatatgcaaattctacaccattttacatcaaggacttgtgtgttcttggggtttggtgtcagggtggtcctggaaccagttccycatggacattgaggaatgactgtgcttcccctacccaayagaagtggttctcccgtcaggttataatagggaagggatgtgtgatctttcctgagaactgaggcatgctattaagctttaaatggagcatctctaagtttccttaccaaaaagtaatcagacaaagggccatgtggcaagagctcttgcttcaccaaacacgtagtgatggacccccctatacccagtgtgccagacatcatcatgagatgtamctcctttcacatatctcttcccttgccagaggaaggaactgaggctcagaaaggttcaattcctcacccaaaggtttccaacccaaggtttctgacctggagccctgctctttcctccacaccctgctgccattattttgtcttgttgggctggggaagggcaaagagggtgcccactgctggatgaaagaagcagctacattcccattcaaggtgtgctgagcccagtcctaactgctcaagtctttcttaggtcttatgatggaactgaaaagcaggctacctattttatccaggaagcagacagaggatacggatgggcaagcacttctatcagatgctggttctgttgtaagacatcatcaaggttcctccaacccctgctcctcatcacactgcacagccctttggcagagacagggagaagcttgttgtttgagacatctggagttagaaagtatctgagctttaaatggagaaggagtggggagaaactgacagtgaagtgtagacatgaggcttagagagatgctaactaagtagtcatgagtcgaatctcccatttagtcagacacatttttctagtttttctagttttctacccttcaaaatactttgtgttaaactcaattacagagatagatccttccattcatcaagtgaattttagaagccacacctttgggtgggtcttaaaagcagttcatgggaatctataggctattgtgtataactggagggtagcagaaaacaagttccttgtgagatcagacacatgagctaaacatttaggaaaaccttacagaagcaaatctttaacggaagggtttccacactgagggccttgtgttgcttttgggaatggtgtagaaatcacgtgcttagtcttgaattatgattcacctttactgaatgtcccttctcttttctttactcactgtcgaacaggaacccaaaggatgtartttttggcagatgtcctttgtarggttcagtatttctcactcacccctttaagaccctaaagggagagttattaatagtttcagaaagttgagggaaatcatgcagaggttctcagatgttcagagaggcttcctctccccttccatgaaagttctaaggctcatgggtgaggcctaagaaaggcatgtcagttgtctatcaagttcattagtttattcagcttatttctgaagcttttgatgggccggctattcagaggtcaatgaaatagacatgagtactcttcacagaccttaccgtctaataggaatgatagcaagtgaatgtataataaataaataattaggggttgattgttacgagtgctatgaggggaatagccagggtgacatgtttgagaaggggtcagtactgctaagtgttggtcagggaagcattgcaggcagagggaacagcaaatgcccatggtttggaggcaggaatggtgttccaagagtagtagggagcctcgggactagagtttggaggatgagcggggagagtgggaggagatagyrggaaagtctgtggagccagttccctgaggggcctggtgggccatgctcagtgggggtttcatttgacgagccatgggaaggcttccagcaatgggggatgtggttttacttgtaccttaagaagatcacactgggtcttgtttggagaatggacaggaaaggagcaggagagcaagcagagagtctgaggkgcaagaaatgccctgtcctcccagcagactggagcraattctaattctgcctctgctacttcattcctatgcaactttgggcaggtttcctaatctctctgcctctcaactgttcacccctcataaaatgaggacaagtattttctcatgtggtttctaggacaaataagtattcgtaaagtcctctataaacttgggccatatgcttatctgagctataatatgattcatattgaaaggagggggactcctgcaatgttgggaaaacgactcagctgcccctatataaggaatatgttattacagtccgagactaaaaagatgcttttgtttctttactgccatcagtgtctctctaagggagggcggctggttaaaaatcacatggtgtgggcatttataggggtaataacttgaaatgattaaaccctttttttttaaagcttcatgtctctgttctccatctgtaggtggtgcatgagtatgatatagtgtgcatgtgtgacatgctgcgagtgtgaggaatgccagagggagacccacgaaactgccctgcaggcagaaggccacatgctctcagcaccagtcagtggtgctcgctagtccggcagattgctgtattcttgcaccctgtaccacaacattgttaggataaagtttcataagtcttatatggctttgaacaaagcaagtctatttttcatcatagtatgggttatttagaattcatatgttatgaggaaatacactgtttcaaatgcagttttctttgtggtgtctcagcagatactgagttttgctgccctgtcatccaagagggcctcaaggtgcccagagagaccaactgaaaaatgttcactggaacggagctgcaatggtggaaacgttctgtgtgtgccctgttcagtacagcagccactgcgcggctgctgagcccttgaawtgtggctatcagggtagaagaactgatttttaatatattgaattatgagtcatttaaatttaaagagcacagctgtattggacagcacagctgtagaaggatgttttctctcatggaaaaccccaactctgagccccaggggtcctatggatccatgagctcacagactcccctaacgtccatgaagatcatcaccaggatttgagggaatgctgtggtgcatactttgtgttggacagttatgggggattgcttttgccrtctcagcatttcaccgctgtcctcggtatgagattatggtgatgttgaatgggggtcattagaaggctgtccacagaggggatcagcccccctcaatgaccactactccgagcatgggctttcttctgtttgatctcgttgggccctcagctgtgactgtggagaacagcaagtcctcagtgagagtatttgtcacttcctactcttggtgtttaatatcatccctctggcacagatgcttgaaaatcaatggtttcttgacacatcttggcttgtgtgaggggccataacaatagcagggctcatggctcctttttttttttttttttttttttaaagagatagggttttactctgtcacccaggcaggcaggggtgcaatagagtgatcatagttcactgtaacctcgaactccaggtctcaagggatcctcctgcctcagtctcctgagtaactggatctatacacatgtgyccccgtacctggctaatgtggcttcctttatgttcagcaaggaactctcagtgtttgtccatttccttaggaacatgagtgtttttggaaggcctttgatgagtggcagttgggtggatggatgagctaatacatccatcatcctatctcaggaggatgcttggatttgtgtttagaaattgggtaactcagttgttcatggaggaaaaagttgaacattactcaagtgcagatagggaaacagtgtaagaacaaaaaactttttttctatctacaagtgaggaaaaaaatattgacagtgtgcccaagcttcatggtaggatgggtgttaattgggaatggcatgtaattctcttctggaatccagtgtctgggcaagtcctgcctctcagattaaggcaccagcattcagcataagagggtcctgcctctcagattaaggcaccagcattcagcataagagggagtaattgacattctacatggcaaaagacccttgaaagataacagatgaatgtctcatggccagtagcttggtttttttgcatggtgtagatttagaatataacttttacagggaagaaaggggttaaaatgtctggtgccatctgtcacagtaatgagttgtgcaaagcccaatgaaccttgtagaaacaacatcgtgcccagaaatagcctagacctcagagtgacatcagggggcrgggacctgatagatgtggtcctgcaaaaggaccgaaggttcttctttaacaattcaaattgaataggaaccatttttaatttgggggtaactccgtcttcaccattaatggccattcttcaaagctactttcattcctgtgagggatggccagacacgagaaagccaagcagggattttcagttacaggtgagcatccgatctgcagccagggctttttctaccgggcacatctttgtgcgcassctggtttgagctgatctgcacataaacaggcactctgggtgtggatgggggcatctgtgtactctttatggctatatttccagaatatgcttttaaagactgtggtcacatttaccttggttagggaagatagtgacttataaaaacctcaaacatttatgtttccctttccaatataaaaagtgttaataatttacccacttaaaaggttaagatcaaagagatcataaacacacatgaatactatttcaggaacataaaattcagctatttctactaacagaaagtgagtttatgggataccaatgcaaacaaacatagatttagtggaaaatgactcaaccaagtaagatttacaaaamaaacaaaactgttttcatcatctttggttgtagttttataaagaatgctggttcatggactccagacacttcaytgaaactgtgtgaatcattttaaacaggtttgtccttgggccccagatagtacattggcatttgtgaatcattttagatgagtttgtcctcagtacaaatcgtgctgtgtttaaagttcttggagacacttctctcttccaataaaaggcttttactagatgtttcagtgacataaagttgaagacataaatactgttttatattgtaagcaggaccaactcttttatggtgtgttttatacgtctagaggatttttgttgttgttgtttctttgaggttttctctgaaacttcagattaaggtagtccttgaagtggaggctattaagacctagtgttatctgtytcagggaggtgggggactaggtggactgatggaccccagaactccagattccttgcactggaagctggtgttttgtgtttggaagagcctctgccctctgtgtcatgctgcagtaaagtatgggtcaacatccccaaaatgtgtgactcgcccaaattaagtggtgtcatactctgatccttcttccactgaacatcacattcttcatgagaatcacaccattgtcctctgtctgccctgcctgtgagacgggccaygctctatgcttgcccgcctcttccatcaggaacactcacacagtcattctyctcacataccccactctcatctgctgcccctcacacctgcccttctatagaatgttctaccctttaatagggaagggtttcttcttcctatgaatttttacctcactttgtgtctttttaggtttgtattggaactatttgcaaacaggtcttggcttatctaaagaaaaattgtaagctccccatgacgcaagacagtatcttatttacctttgaaaacctcatcacactctgccctgctcagagtacaatctaaataaaagtctattgaatgactgaagtagagtttcttttttaacacttatatgcacattcttgtgacaggcacagtgaaagatttatcaaggaatgacatggtccccacccatgacactgttaaatccataatttgtgatgcattgtttttagttatctagtgctgctgaacaaaccactccaaacttaatgatgtaaaacaacagcaattttatcatgctcacagacattgtgggcaaggaattcgggacagggcacattggggatggctggtctctgctccatgatgcctaggacctcagctgggagagacttgaacagttgggggctggtgaatccatgtctaagcttcttcattcacatgcctgtcaccttggcagcatggcctagaagcctgggcttagctgggcctgagacccccagcattctcttcaaggttggggaattggaccctacatttgatgggagaattagccagttcatgttgcagaagagcatgtggagtcggagatactttacaagcatctatggaaaatacagtctgaagtgaatgcccaaatgagtggcaccaacactgattattactgggtgacagaggcacatggagaaaatgtcatgagggaggaaatgctgggatttgccttgacctctggctgggggacggggagggatgagaggtccaaggcaagatggataagtrggaataagcagccttgttttggggaaaaagagggacagacctagaatggctggctgggtgaaatggcttgttgtgtctcctaaattagattttacatttttgagggcagagctacttaatattgtatttaccccagaggaagattatttttttcattctctaaattgtttaattaaaactcatagttcatgttaaatttgttcaaastttccatctaatggtgaggtggtaaaggaaataaaacttaccaaaatagaagagggagaaatgaaaaggaaatatgatcaatgatttctgttctttttacttcctacttgcaaagactctggaaatgtaatgatggttcagagtgttctgctataaatcctaacagcttaaacaatctcctggratcatattggcaaactctaagatgatacaagtatagacttagtttgtctgagcccgaggttcagtgtttggagaaaaataatacctatgtcgagataatatcagataacctataaaagcaggtagcccagtcatgcacattggtgatcaatcaatgttagctgaatccaaatattacgagtgcagatgctgaaaggaacaaaaggaaatctcactcagtcatccatctgccagtatttccaccctttcccgcaaagaggagctcagtgtctgtctctgttattgcatcaggatctcacattatccagtaaacccaaatgctgtaggtaagagatgtaataggtggtatttattaagtggttttaataaagttttgtggataggtatgacaccatttcttttgagcttaaagatgcttaaaatagctaaggttaaaaatgagggaagatctgaaaagaaaaacagtaaagagatgtgagatgtaaacactgaaaggaagtaagggtagagcaaaaaaaaagtaaagcatcaggtaaatatttaataaaatgtttatacatgtatattgactgtaggtgtagggttagtctattgaataaagctgcctttcttaggaatggtggtctcaaaatgcaccagtgccttcctattggctgaatgtccacttctgttctatgcactgtgctaaagggtggacatgctgagatgagtgtgagtggcctctgcaccaaagagttcagtctaattctgggggttggggataaatatgttagccagtaaatgccatttattgctttagatgtcatctcagaaggataaggagcagtggggacaggaggagcaagccatctcctgggggagtcaagaaagatgaggacagagagagaatgtcccttggatccaatatggtggccattagtgaccttgttaaaaccagtaggaatggggtggcaagaaggagagtagaacagaytataagaaagaatgagttttgatgaaagtattggaattttgatgaccttttttattacaggtttgggagcaactactttcttcactctctaaactgcaaatcattcagggtaattgtsctggttcagttagcccccaagctgagaagacaggcccactgtggtttgagtaacttggaaatcttgtggggtcagtgttttgactctcttcattttggtcatggttcaggattttcacacaccactaaggtctaggggaagcttctcagctttctggataccctctcagggctcatgaagtggcaggcctgccctgggaaggtcaggattcttctgtaaaagcagagaacactgcatggagcccagagagcccactctctgcgctcttcccttcctatgggctcacacggggaaacagatgctttcctataactctgagcactgaagcagctttgctctgccttggccgaaacatctatccaggaccaaattcttaaaaccccaggggccctggggtgattttcagcccaggccctgaacctgtcataaaatgtaatggatgatatatttttaactgctgagaccagagagttcacataacctatgaagactgaaacaacataatgtttctgcagttttgaagcatttcaaaaaccagaggatggtctctctcattaggcattactagtaagacaaaagttcttaaccatttctgtgcgtggacgcctttggccgttgggaagcgcacgtggatcctttctcagaatatgcttttacatacatagaataaaatacatagaattacaaagaaattcagttatactgaaatggagttatcaaaatttttaaagaccactttatgatataataatataccagctttttcttgatgcatgaaataagaagatctacagacattttgagtactgttaagcataaacaatatttcaaggtgtctacaactataatatagtgtgtaatatctcagatttctatcgacggtagagtyacaggtctttctaatacttttgtggtttgatgcctacattttataatggaaggaaatgctaaatttcagttagaggttaataaaaataaagaaggaaaattcttttcctctatctaaatccacagatgcyctgaattctcttcgaggttaagaacttctggtttaagatatgcttttggttgacagtagtaaaacaagccaaaagaagttgaccatttatgtgatgtgcagtaataaattagcaattcagagttgaggagctcattactaatctgtggatagtcctaatcccagcccttttctttctgagctttgccttttgtaaatctcagtgcttcacacacatcagacaaagatattttgtgagtggctctaaaaatgggggcaaaacatgaccctgaggaggcctggggctgatctgagccttaagacttatttgtggagaccttgtgctgttctttttttttttttttaattatactttaagttttagggtacatgtgcacaacgtgcaggtttgttacatatgtattcatgtgccatgttggtgtgctgcacccattaactcgtcatttatcattaagtatatctcctaatgctatccctsccccagccccccaccccacaacagtccccagtatgtgatgttccccttcctgtgtccatgtgttctcattgttcaattcccacatatgagtgagaacatgcggtgtttggttttttgtccttgcgatagtttgctgagaatgatggttttcagcttcatccatgtccctacaaaggacatgaagtcatcattttttatggctgcatagtattccatggtgtatatgtgtcacattttcttaatccagtctatcattgttggacatttgggttggttccaagtctttgctattgtgaatagtgccacaataaacatacgtgtgcatgtgtctttatagcaacatgatttataatcctttgggtatatacccagtaatgggatggctgggtcaaatggtatttctagttctagatctgtgaggaatcaccacactgacttccacaatggttgaactagtttacaatcccaccaacagtgtaaaagtgttcttatctctccacatcctctccagcacctgttgtttcctgactttttaatgatcaccattctaactggtgtgagatggtatctcattgtggttttgatttgcatttctctgatggccactgatgatgagcattgtttcatgtgtcttttggctgcataaatgtcttcttttgagaagtgtctgttgatatcctttgcccacttgttgatggggttgtttgttttcttcttgtaaatttgtttgagttcattgtagattctggatattagccctttgtcagatgagtagattgcaaaaattttctcccattctgtaggttgcctgttcactctgatggtagtttcttttgctgtkcagaagctctttagttcaattagatcccatttgtcaattttggctgttgttgccattgcttttggtgttttagacatgaagtccttgcccatgcctatgtcctgaatggtgttgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgttttcgtcaggtttgtcaaagatcagatagttgtagatatgcggcrttatttctgagggctctgttctgttccattgatctatatctctgtttyggtaccagtaccatgctgttttggttactgtagccttgtagtatagtttgaagtcaggtagcgtgatgcctccggttttgttcttttggcttaggattgacttggcgatgcgggctcttttttggttccatatgaacttgaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaggaggtccttcacatcccttgtaagttggattcctaggtattttattctctttgaagcaattgtgaatgggagttcactcatgatttggctctctgtttgtctgttattggtgtataagaatgcttgtgatttttgcacattgattttgcatcctgagactttgctgaagttgcttatcagcttaaggagattttgggctgagatgatggagttttctagatatacaatcatgtcatctgcaaacagggacaatttgacttcctcttttcctaattgaataccctttatttccttctcctgcctgattgccctggccagaacttccaacactatgttgaataggagtggtgggagagggcatccctgtgttgtgccagttttcaaagggaatgcttccagtttttgcccattcagtatgatattggctgtgcgtttgtcatagatagctcttgttattttgagataggtcccatcaatacctaatccattgagagtttttagcatgaagcattgttgaattttgtcaaaggccttttctgcatctattgagataatcatgtggtttttgtcgctggttctgtttatatgctggattatgtttattgatttgcgtatgttgaaccagccttgcatcccagggatgaagcccacttgatcrtggtggataaggcttttgatgtgctgctggattcggtttgccagtattttattgaggatttttacatcgatgttcatcagggatactggtctaaaattctcttttttggttgtgtctctgccaggctttggtatcaggatgatgctggcctcataaaatgaattggggaggattccctctttttctgttgattggaatagtttcagaaggaatrgtcccagctcctccttgtacctctggtagaattcggctgtgaatccatctggtcctggatgttgtttggttggtaagctattaattgttgcctcaatttcagagcctgttattggtctattcagagattcaacttcttcctggtttagtcttgggagggtgtatgtgtcgaggaatgtatccatttcttctagattttctagtttatttgcgtagaggtgtttatagtattctctgatggtagtttgtatttctgtgggatcggtggtgatatcccctttatcattttttattgtgtctatttgattcttctctcttttcttcattagtcttgctagcggtctatcaattttgttgatcttttcaaaaaaacagctcctggattcattgatttttttgaagggttttttgtgtytctgtttccttcagttctgctctgatcttggttatttcttgccttctgctagcttttgaatgtgtttgctcttgcttctctagttcttttaattgtgatgttaggttgtcaattttagatctttcctgctttctcttgtgggcatttagtgctgtaaatttccctctacacactgctttgaatgtgtcccagagattctggtatgttgtgtctttgttctcattggtttcaaagaacatctttatttctgccttcattttgttatgtacccagtagtcattcaggagcaggttgttcagtttccatgtagttgagcggttttgagtgaatttcttaatcctgagttctagtttgattgcactgtggtctgagagacagcttgttataatttctgttcttttacatttgctgaggagagctttacttccaactatgtggtcagttttggaacaggtgtggtgtggtgctgaaaagaatgtatattctgttgatttggggtggagagttctgtagatgtctattaggtccacttggtgcagagctgagttcaattcctggatatctttgttaactttctgtctcgttgatctgtctaatgttgacagtggggtgttaaagtctcccattatattgtgtgggagtctgagtctctttgtaggtcactaaggrcttgctttatgaatctgggtgctcctgtattgggtgcatatatatttaggatagttagctcttcttgttgaattgatccctttaccatkatgtaatggccttctttgtctcttctgatctttgttggtttaaagtctgttttatcagagactaggattgcaacccctgccattttttgttttccgtttgcttgrtagatcttcctccatccctttattttgagcctatgtgtgtctctgcacgtgagatgggtctgctgaatacagcacactgatgggtcttgactctttatccartttgccagtctgtcttttaattggagcatttagcccatttacatttaaggttaatattgttatgtgtgaatttgatcctgtcattakgatgttagctggttattttgctcattagttgatgcagtttcttcctagccttgatggtctttacaatttggcatgtttttgcagtggctggtaatggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgcaaattcttttctttaagaatgttgaatattggcccccactcccatctggcttgtagggtttctgctgagagatccactgttagtctgatgggcttccctttgtgggtaacccgacctttctctctggctgcccttaacattttttccttcatttcagctttggtgaatctgacaattatgtgtcttagagttgctcttctcgaggagtatctttgtggcattctctgtatttcctgaatttgaatgttggcctgccttgctagactggggaagttctcctggataatatcctgcagagtgttttccaacttggttccattttccccgycactttcaggtacaccaatcagacgtagatttggtcttttcacatagtcccatatttcttggaggctttgttcgtttctttttattcttttttctctaaacttctcttcttgcttcatttcattcatttgatctkccttcactgatatcctttcttctagttgatcgaattggctactgaggcttgggcattcgtcacgtagttctcgtgccatggttttcagctccatcaggtcttttaaggacttctctgcattggttattctagttagccattcatctaatttttttcaaggtttttaacttctttgccatgggttcaaacttcctcctttagctcagagtagtttgatcgtctgaagccttcttctctgaactcatcaaagtcattctccatccagctttgttccgttgctggtgaggagctgcgttcctttggaggaggagaggcactctcatttttagagtttccagtttttctgctctgttttttccccatctttgtggttttatgtacctttggtctttgatgatggtgatgtacagatggggttttggtgtggatgtgctttctgtttgttaggtttccttctaacagtcaggaccctcagctgcaggtctgttggagtttgccagaggtccactccagaccctgtttgcctgggtatcagcagcggaggctgcmgaacagtggatattggtgaacagcaaatgtagctgcctgatcattcctctggaagttttgtctcagaggagtacctggccgtgtgaggtgtcagtctgcccctactcggggatgcytcccagttaggctactcgggggccagggacccacttgaggaggcagtctgtccattctcagatctcaagctgcctgctgggagaaccactactctcttcaaagctgtcagacagggacatttaagtctgcagaggtttctgctgccttttgtttggctatcccctacccccagaggtggagtctacagaggcaggcagacctccttgagctccrgtaggctccactcagttcgagcttctcagccactttgttaacctastcaagccttggcgatggtgggcgcccctcccccagccttgctgctgccttgcagtttgatctcagactgctgtgctagcaatgagcaaggctccgtgggcgtaggactctcygagctaggcacgggatataatctcctcgtgtgctgtttgctaagactgttggaaaagcgcagtattagggtaggagtgacccgattttccaggtgccatctgtcacccctttctttgactaggaaagggaatgccctgaccccttgtgcttcccaggtgaggtgatgcctcgccctgcttcggctcaygcttggtgtgctgcacccactgtcctgcacccactgtctgacactccccagtgaggtgaacccagtacctcarttggaaatgcagaaatcgccygtcttctgtgtcactcatgctgggagcagtagactggagctgttcctatttggccgtcttcgctgttatttttaagaataaattttaaaaggacaaagtaaaactccaagttgaacttaatggcaaggaagtgtcaaaatgagactctgcatgtaactccccatgcctctccactactgatatggatctgcctggtccacatcatcctggagtgctagggtgaccctagcactgtatccagctcttctcacctctttaggaattttaagcccacaaattaagtatggaatttattacatggtatcttgsatttcagaagcagaatctgagatggggatttttgccagagatttattgggggagtgctctcagaagtgaggaaaacagaaagggacagagaaaaaaatgttgagtaaggatgtggtctcaggaaaagtctagcctcagcctgatcccgtgcagaagctctggagcagagcttatcccacccagcagcaagggggatggggtgttatcctgctgcatctgccagctagggaatggggcaggtattagttttctaggccacttcaaaaattacaaatttagcagcttaaaacagcataaagttactatctcacagtttttgtcagttaggagtctgagcatggcctgcttagcgtttcacaaggccgtactcaaggtgccagccagatcttttatgcggcttggggtcttgctccaggctctcatggccgttgctggaattcactcctgcagctgtggagcccagggtgacttgcttcttcaagactagcagaagactctttttgctgcttctagtctcttagctcagccttccagtctcttagctcagccttccagtctcttagctcactgctctccaaggattcttgacacttgcactccaacccactctgggtcagaagctattcctccctgtgaaaggggtcacttgagtaggccaattcacgccatcctttctgattcactcaattgagctgattcagaactttaattacatctgcaaactcccctcacctttgccatttaatgtaacatcacaggagtgagaaccatcatatgtccagtccttcctaccctcaaagggagaagattatacaggggcatgggtcactggcatcattttaggattctgcctgtcacagggcgtcacttgcaggcttcgctggaggagatggctcctgtcacccaagggcagttctcctgagaaagttgtgggcataagcaatgcatgtagcggctagggcactgaggtcccgtgacctggttccagcctgctctccttccctgtccatagtccctccctgcccctcccccgtgatcttgccccacagacctttctcaggtggcggtggtgatggtgttgtaggggcaactggcttttttagagtgtcaggagctctccaaggtgcttgacatccatttctctaatcttcacaacaagcatgcaaggttgattctgtcatcccattttacatctgagaaaacaagctcagagagagtaagtaaagtggccaaggttgcagtttgcaagaaatggagcttggaccccctctgaccttgaactggctgacatcaaagttgtcgctttgcctggtcctgtcacctstcttcctcagatgtctagtgtttattagacctccatagtatcttcaccaactgagaaggtgccccatcagcctgaggaactcccagggtcacccctctmcaaggattcttgacacttgcacttctacccactctgggtcagaagctattcttccctcattggattgccaccattcttgtaagggcaccttctctgcaccacagttttttgctcacactcctcctatttttctcttctcagcttccctatgcctcatgatgccaggcataaggcacacagcaaccaagtgttggcagaaggcaaattatatggtttggctgtgtccccacccaaatctcatcttgaattttagctcttataattcccacatgctgtgggagggacctggtgggagataattgaatcatgggggtgattttccccatactgttcttatggtagtgaataagtctcatgagktctgatgcttttataaggggaaactcctttcacttggctctcattctctcttgtctgctgccatgtaagatgtgccttttgccttccaccatggttgtgaggcctccccagccatatggaactgtgagtccattaaacctcttttactttataaattacccagttttgggtatgtctttatcagcagcatgagaacagactaatacaccaattgaggttcctccagagaattaacaaaatgtccakgcactctttcgttgttcccccatacccacagacctgccatccctggccctgcctggatgccggtacctggccactgctgctatattccatgcttttggacaagagcatgttcagtattgyccaggagacccagggagctcaagacagagctgagatccagttcctacagccacagttaacaccccagcccccgacacacacacagacttttcaatgcaaaatcaaaccattcccaaatatccagctacatattgttttacctttgaagagaaaaaagcatcagtggggttatgtgattttcatagatgaacaatttttgcaaatatgttaattgaagagtaattggtgctttyttgaccctcctgagcactgatgcttgccaaagggttatacatttcagactaatgatgatatccattactatatgtgcaattgcttataaactaatatatagtcatattaaaatctctaatctgattgagaarttttcagaaacaaggtacactgattttctyaccacttatttcctgctctcatgacagaatttctggagttctttgaattcacmtggtttttggagctctgtcaagtcaatatttataactgaactagttcaaacagttcaagcattgtctcttcctttctggttgaagttctgtcttagaagactgttgtagtcagctgtgcttgtcataaagttttgtttaaaattattttagaattttcttctttggctttaatttaaatttttgtttgtttacttttttttttttttttccccggctcactgcaagctccacctcccaggttcacaccattctcctgcctcagcctcccaagcagctgggactacaggcgcccgccaccaggcctggctaatttttttgtattttttagtagagacagggtttcaccgtgttagccaggatggtctcgatcttctgacctcatgatccacctgcctcggcctcccaaagtgctgggattagaggtgtgagccaccgtgcccagccttgtttactttttaatttataggattgtaaatgaaactatacttggcctcagtttattctctgggaaataggttcttgctacaggtacagtttataataaggatttatttcataatagggagctttttatagattttaatatcatagttgccatttaaaaaattgtattaaaggccgggcgcagtggcttatatctgcaatcccagcattttgggaggccaaggcgggtagatcacctgagattaggagtttgagatcagcctggccaacatggtgaaaaccccgtctctactaaaaatacaaaaaattagctgggcgtggtggtgtgtgcctgaattcccagctactctggaggctggggcaggagaatcacttgaacctgggaggcagagattgcaatgagctgagattgcgccactgcactgcacagagtgaaactctgtcaaaaaaaaaatgcattaaaaatggtaatgatcaccatttattgcttgcctacagtatgtcagtcattatacaaggtatattttataattataaatattatttattatctgattacaaatatgttataccttgcactgtgtcctgtatgtctgttatgtttatttctgaattttccttcctttttcctctccatgctttgatctggatatttcctattgagagaatacactgaggcccagtgtgatttcattcacaatcctataaattaaaaagcaracaacttctgggtcactggtcgtcttttctgctgtgttcaatctccagtaaaatatgtcagcaccttaaccactgtcctctgcctggtttcttagtctcacagccccgtgctgctgtagaattggcagatgccttgaggacaattgtggcgtacagtaaacatacctcaatatacttatttctgtttgggattttcgcccctcaagtcctcattgygttattagccctgagctcttaagttttgtcttcacagagtcataagacttccagaaattcagcttagaaactcaagaacttagctttttagccactgcttcactttcagtttcatagcctctcatcccacactgcttacaaatctggaaacacctcaagggaaaagtgcccataaatgttggggttacctccacattctttccttctctttgggaccctatactctgaagtcctggctgtcttgatagttagttccctgataactttatatatttttaatttttttaaatgaacctggcatttcaaacataagttccatgataattttaaacaggggtgtgtgtgtgtrtrtgtgtgtgtgtgtgtctgtgtgtgtgtgtgtgtgtgtgtccagcttttcgagttgtccgtgggaggacggtttcagtaagttactctatcattactggaaatgcaaaatcctgttttcttttaaaagagtcttcaagctgatgaaaattttaaagtagcttataacattttaactgtgatcttatttattatgagtatagagataaaggaaaaggcmtcccacttctgaagatttctcgtttctaggagtgtctacaagattatcataggtgaaagtagggttggatgcagagaaatagtaagaaaggatggaggatggaggggataaaaagatcacatgtttggtgaatcctcttttaaaaacacttagaagatttyccctaaactaattatctggcttaatgctaactgcttatttgctgaccttctgctttatttacaaatttaaagtggggccaacccttcctgttttcctttaatttaccccggcagctgctggttagctaaggaagaaaaaaaacccttttttttttttttttttttttaatggagacaagcagcaattaggtaggcttctaggtcaggtggccagttaggggtgccagggttcccaggtccagytttcttcgggtcatagagtgagggtgggaatcaagtcactcagatwtttctcccgaattgaaatgcgtgtcttcctttggctgggcagatgaggtcccctcttctccatctctgctgctgggtcctggtgcaagcccttactctctttccactaaacccatgtggcagcctcctccttagcctgtttctccccagtcctgcacccatcagtccactgccacacggcagctacagggacctttctagaacacagcctcctgctgcctccatgttggcctccctgcccctgtcagagggatttttatttattttatttatttatttttgagacagagtcttgctctgtcacccaggctggagtgcagtagtgtgattgcagctcactgcacctccgcctcctgggttcaagcaattctcctgcctcagcctcctgagtagctgggattataggcgtgctccaccacgcccggctaatttttgtatttttagtagagatggggtttcaccacgttggccaggctggtctcaaacttctgacctcaggtcatccgccttcctcagcctcttaaggtgctgggattacagacgtgagccaccatgcccagccaagagggacttttctataacagcctctaggatcatgctacccccttcccagctctccctagcttttaagatcacataacctgcaaagtgccctgagatctggttctgcatgaatcttctctaccctattgctgcctatcaacttgacttcccacctttgggagtcagatgmagtccgctggacagcccatgscctctccatgtggctataccacccctgccttgcccctgctctctgcctgatgtcctactgtcttttgactgtgcccaggggcatttcctctgggaagcctgccagccctcagtctgaacctttgggtccccaaagcctcccctgtcctggtatgtgttgcactgcgttgtcatctcttgtctgtttcccctgagactcattattccctgaaggtctttcatctctgtttccctgtggcccagcacattgcctggcataaagtaagcacccaataaatttcagatggagcatatgttaagttccctataaaacctcagctgctgcaaattctgccaccagcctgggtgttctcctctgtggggactccttcagttttcagagacaggagactcccatagatttttagcaggaaaaggtagattcttgccttttagtctgtcagaatgacactttattagatgctttagaactgcagaagcttcaattttagaattttcagtttgtagcgttattttttttaagcagtaaaatttcagcgactatggtctgtgccagagccctaagcctctttctccatcctaaggagtttctctgcttaattgcagtgctgagctcagggaagctgcatatccaaaaatgaaaaggaaaccgctaaattgtgctgctacttttcctttgcagctcagataaaacaggcccagtgtgggaagaaggggctgtccttttgggggtgttggcctgtttctaattgctgcaccctcctctgcctccacccatgcctcagtgtggtttgggtcccttctgcccagagctactgggacatgtaataagaagctgcttttcagacttcttaattaaaataggttccggcagccattgccaggaagcagcattcgcacccctacatgtccaaatgcattactcatccaaaataagatatgccacgactcaggtttccctcctyagccaccatggcttgaatggctgcatttagaaacagcccttacttcaagcccctatttcttaattatttgtcacttattcscattcatccttgtgtgtgaaacatttttcccctcaccctatatgctgttatgtaaacaagtaattttttaggatgatgtcagaacctgatgtagttggggtggttttaaaatagtattttatggacagcaagaaaagtagttttgcttctggtttcacttgctagctttgggatggagggacatttatttgagcttctgcacctctgtgatcttgtctataaaacggggggcaatggctggtgctgtggctcacacttttaatcccagcactttgggaagatgaggcagaagaatcacttgaggccaggagttcaagaccaccttgggcaacatagtgagaccccatctctacaaaataaaaaataaataaaagaaataaaagaatgaaagttagctaggcatggtagtatccaactgtagtcccagctactcaggaggctgaggcaggaagattgcttgagcttaagagttcaaggctgcagtgagctatgattgtcccacttctgggaaacagagcaagactctgtctcaaaaaaaaagtggaaggtgggggtcaataatctgccagctcaggtattgtaaggattaagaaagacagtgtctgtgaagagcttggcccagtctctggaacacatttggtagccaggaaatagtaaatgacttctgtttccctacccccatcttcacctcctcccctagaataacaacatcataactgacttatttcatcattaaggatttaaatgcaaaaccttaagatagtcagccttagggaaacactgaagaatttatttttaaacacataaagattgcattcattcatccttctccacaccgcgggcagtcttcaaattctggttagcagagtcagcgggcagggaggatctggatcctggggttgtgtgctttgctcccagaggacatgagtatcaaaggtctgccccgatatctggagttcaagaggcgttttctggaaacaatttgtccaaaggctcccctatcactctcttggagaagtcctgtgttttatttatgctgaatgattgaatctattcccagccgaatgttttcctgaacaccagtaaaaatcatctgccagtcactcgggctcccaccccgggagtcatctgtcccctttgcctggtctcccatgcctcacagctcagcagccacaggcatggccatatctgcctctcttgcccttgccactccacttcatcatggccgtctcctctctggggctgctgcgggagatttccagtctgccctccagtgtctctgcatgcattctactcacctcctctccccccgcagccccgaggaactctgaagaaacacaagcttctgtggccccgtacacgtaggactaccaccgcttacttggaggcagtggcagtaaaaacggaaacaacaaacaaaacagaataaaatcctctttaactttgtttaacttggtgtcccatgcagtctatttaatttcagactcttatttaccccagtcctagggaactgaggttcataggaccaatctgggtgaatgctgctacagtttgtggatgggctgctccccatttgcttgttcaggtagctttgagcccaaacattggtcagcaagggcatccatatagtgacatgctgtatgtcatcaaaaagaaggtgttcctgacatagacaatttccagaatatatgctaagtgactaaagcaaagtgcagcatgagatgccaccatgtgctgcagatgcttggactggatggatacctaagtacccccaaactggcaggcacatctgcctctggggaagggggctgggtgtcggggaggggtgggagcaaattcctccccgtgtgcctcctggggcctttagaacctctacttctttgaacacagtgctactctgctccaaacgcccccaaacttcacacagagagtagtatgaagtcctcatctctgcacttgtggccctgaggttggcctcagcctgcccgcccagcttctcttctcattcttccctgctgccactctcctgtctccccagggactcggctgtttgagccactttcctttgacacgtctcagacttgccctgctccacttggaagtccttggagcagcccacacgcacccccgccgagctcactgtctcagaatgtgggaccacctaccagctttactcctgcgtctaactctaacttgtgagattgtgggggccagagtccccaggaggcagtgacgctgtgtgcagaaaagccaagagctccagggctgaacagatgtgactgaaaatctttaccagccatgtgccctggggaactgagcctttcatttcccctttccttttctgtatawtggaggataacaagccttcactcacagggcgtgggtgtgtttctcatctccttgcagcacctagcacagtacctggcatctcatatgttcagggcatgtttgctctcctcccttcctttcccatcgtgactgtcaatcgactgttcccttggggcttgagattcttggattccaaaggaaagaacacagggccaggagtcagaatttcatccttgcctccgctgatgtctaattctgggataacgctgggccactcagtctttggattccctgccctaacacaaaatccatatttatctcaatgcaaaagagatgtggtcatcgaaacactgaatgcaaagggttagcagagtgagcacagatgttctcccatttgccaactggtttctaagaatatttggaggatgagtaaagtaatgtcttccatatgctcaagagaagatgatttagcaccatgcaaggtagagaaggagagcccccacccatcaacagaatgaccttggacaagacactagctgccctaggcctcaattacctcatttaaaatatgaaagtcataaaaccctacctcacgagggtgattgtgaggattatatgaggcaattcatgtagaaggtctttgtaaactgtgaaatgctctacgactgtcagccaggattagtagttaatgcacgtatttgtttattgtttcagcrgagggtgcaggacgtcatcagcccgatcgtgtttgaagcagcctacagcctcagtgagcatgtgactggagaggaggagagggaactgccgcctctgacaccagttctccgctggaaaaagggacaaaagattgcccaaaagaatcaggtcagaaccttaaagctcatactcagcacccaaggtggcagctgcacasagcagaaataatggcccaaaagttgagagagccgtgggyctggctgctcaggagaccgcagccaggacacacctcctctctgggtctcccttttctgatctgcaaaatgataaaataaacagtcttaggggttacttgtgactactgtgggacttaaacactttcagacaattctcaggctgttagaagttacaatcccctcgagttcgtgaactggctggccacttggtccctgaacttgcctctgttcctagactgttttcagagcttagattggtggatagtaggtgcttaatgaatgttttattggtgggagaatgagtgaggtgaagaagcaagaatggtagcttgctgaattggcagttgagttacagaatgctcaacccaagagtccctggaaaccagagcactggggcaagtacaggtggtccacactcatcagattctgggatgtgcggctgtgtagagaagctttagtgcgatgggtgtatcactcgtatgargtaggagtgagcctgtgcctgattttgtgcagcagcgctggccagctctgaggcgtgcagcactgagtgcggtgcaggaatatgcaaggaatctgcaatcccaagtctgtttcaaatcttttcttgaaacccaagatcaccacagattcagaaccctgtggaagatcaggaaaaactgtgggctaacccagcctcctaggcagggttggggcaaagctgtggaaccacctttcacagtgcttcagaccactgtaagtgtaggggaaaactagcagattgtgacccatgccttgtagattagagttgtagactgaaccacagagaagggtttgggatttgagatatccatccaggtgttcacgtaagtgctgagatttttaccaaggcatcgcattatctcccaaagcctctttcccatcatcctaagtggggttcyctagaagcagagcctgagaaagggaattgggaacacatggtctaatgatgctgtgctcttagggaaaacctgtaaaggaaaggcatgggggctcaaaatggttgtggtctcagataaagtctggctgagggactctggaacaaaaattacaccaaagagttgtcctcaccttgaggcaagaggggcttcccttttgtgccccatatcattcagccattgactggctgtkggggggaagggaagtgtaaccctccttgaaaggagatcccctcagctgaggatggttctctagagaagaatgcagatgtgagccataagcagcctacacacacatcagccaggagatgggccacagttcacwgtgcccactacacatcaaaacacaccctctgggraatgctgccaagaggttttgatttaaaacacgaaccttctttcacaacacaagtgccccaggagagtggcctgtaagtcccactggccattgatacttggaacaggccctgggggagtgagggaggacacgtggtgtctaagcaggtgggcagagtagatgggctggccttactctgaggtgtggagaaggctagagaagagtagaagataaggtgaagaggcagggcaggaagctgatggcttctgccttgactgggaagtacagacctrggtcccctcctgacagggaagtggggagaagaggttggcctggggacacagtaaagcatggtattatggtaacttctacataattggtctctagttctagaattattctgctttctaaggtcaaatcttactggactgataaacttacccatacttgggttacggaagttacccagactcggggtcctgggaagaatttcagggtcctctgtgcttatttgtttctgaattgacccagtgaggtagtcatctaccctgtccagcatcttgctagcctggacatactttccacagtkaacctatctctcattcctgcaagtctgtcagtggcacagatgtggactttctttagtgaaaagcatcttggaacctttactgacatttttagatttaagcagcccaatcaaagccagagatggagggacagattagtattgaaatgatgttcttggtcacttctggttccagatggccaaccaagcacaaatgttgatgtctgtgcctyggtaccccattgcaatgattataaatgagtagatcggaacagggaggacaacactgtgaaagaaagggcatcagctaataataagagtccagtaattttctggtatgagtgaagtaaatggaagagtgttagtgggtgaacttgaactgtacatggaagagctggcttcctgcctacccagggaacagagaagctgcagccacagccaggccaacagttacagagggggccagagtaagaagtgggactgcaagtggtggtggtattgagggaggtcagtgaaatgtgaaggttggtatgaagaagggttagagttgacttttcaccattgtccccacccctacaggcttcaggcatgcagaatagcaagcagccaggcatcgccttctctaaagtgttaartaaactgtttaagatagtgtgggcgrcctcgttctcagagaaaagaaagccttacttctggcatttgaagtcaccaacgtaagagctagctttctctcccacaatccacccaaacactttcacagattttctactcagtccttttaccttagtttgaaatatgaatggacaaccaaggaaacccaagattgaggaatatttggtgcatgaaaggaaaggctaaaataaaccaggagaataactaacttaaaaggaaacaaatgatttagggaatataagagattattttaaaaaattttaaaaatgcaacaccttaatgtctatgcagtagacccaaggagatttaggaatatattccattcttttcattttctaatggatgggattctgttcctttttaaagggaggaatgaaaggcaagggaagtgttcttaaaaattaaaaatatatttgcagcaccaaaaactcagtggaagtattagaagacaatggtaaataatttcccaatggaagtgctaaaagacaagtagaaaagaaagctaaagaataaatttacggggtcctatatctccaagtaataagaatactagaaagtaagaataccagtaataagaaaagagaaagaagggggagaaaattatgtaataatagaatagcatgtttcagagttaaagagggagactattttttaaaattggtgtaaacaacaatttacaatcamaataaaccaaaattatcatagacacatcattttgaaatgtcagtgcttcaaagacaaagggaaaattctaaatgtttcgagggcaaagaatgcaggaatgttgatcatggaggataagtcagcttacaacagaatgagagtcagactgagtagtccattagactttttataagcaagattagaaactaaactatgatgaaataaaggcttcaatgttctgagggaaaatgattttgaaattagaattttgttttcagccacacaatcaaagtatgtggtaaaaataaagtcacttttcagataagcaagaacccagaaagtttacctccctagtaactcttccaaggaaattatcttgtacttcaacaaaacaaaaatgacaaccagaaggagcaagatgtgggatacaagaaactctggaactaactctcaaaagtctaatgacaagaaatcccaggatgataactgcagcaagtctaaaaagcagccaagtctattgagaagaggagatcaattaacttccagaagaatgaagctaagcaatagaatgatgagcaagtggcaaatattcagtatatagtgcagattgaatatgtttcttttatgggtaagaaaaaaataaaagcattcaagacctctcagaaaaatagaaataagataattacctgtacagattctccttgactcacgatggggttatgtcccaataaacccatcatgaattaaaaatattgtcagttgaaaatgtatttaatacacctaacctgctgaatatcattgcctagcctaccttaaatgtgttcagaacacttacattagcctacagttgggcaaaagtcatctaacacaaagcttattttacaataaagtgttgaatatctcatgtaatgtattgracactatactgaaaatgaaaaacaaaatggttktatgggtactcaccattaacacacacagctgaaagcacactggacctaaagaatatttgaactaaaattaactgctggattatggggctactagtgtaacagggtcatccatttctctctcttctgatgagtctcaagaatagctggtagaagccactgcggtattaacactcgttgatggcttagcaggcatggtgttctgtagaaagctatcagttgtttaccctcctaatcctatarctgactgggacctgcagctcactcccactgcccagcatcacaggaagtattgtaccacatattgctaccctgggaaaagcttttgaaataaaaaatttgaaatatggtttctactgaatgcatactaccttcacaccattgtgaagtcaaaaaatcgtaggttgaaccattataagttggagaccgtctctatgtcatggttaaaatataaaacaaattaaaatgtgataaaataaccagttataactatcagatgttttttgtaagcctcatggtaaccacaaggcaaaaacctatagtaatacaaaaataaaaataaaaaagcaaagaaccaaaccataccactagagaaaatcacttgaccacaaaggaagatagcaagaaaggaagaaaggaacaaaggatctacaaaacaactagaaaacaacaaaattgcagtagtaagtccttacttatcaataattatcttaaatgtaaatggattaaactctccaatcaaaagacatggagtggttaaatggatttaaaaaaaaaaaaacaaaaaacaagacctaactatatgctgcttataagagactcacttcacctgtaaggacacacataaaatgaaagcaaagggatgaaaaaaattctatgcaaatggaaaccaacacagagcaggagtagactttaagtcaaaaatagactttaartcaaaaactgtaaaaacagacgaagatcattatacaatgataaagggatcagttcagcaagaggacataacaattgtaaatatatatgcacccaacaccagagaaactaaatatataaagcaaatattaatagatcttatgagagagwtagattgcagtacattaatattagggaatttcagtaccccactttctgcaatggacagatcatccagacagaaaatcaataaggaaacatcagacttaaactacactctagaataaatacgtctaacagacatatacacaacagtccatccaacagcgacagaatacacattcttctcaactgcacatggaacactctccaggatggatcacatagtaggccacaaaataaatcttaataaatttagccttgaaatatcaagtatcttttctgaccacaatggtataaaacttgaaataattaacaggaggaacttcagaaaattcacaaatacgtggaaattaaataacatggtcctgaatgaccattgggttaatgaaataattcaaagggaaatttaagaatttcttaagacaaatgaaaatggaaacacagcatacaaaaacttaaaatgtggtaggattttgagtaagtagaagagtataaagaagaatgttgatcctagaaatattctatctgaagtagaagttgaatattcctggactttaactttgcaactgtagaggaggatgtataatcatgacacttgtcttggctcaactgtgagcaataatcatgaaccataataaaattagcactatttattggttttcaatatttataattaagccaaaatcagagctatggtgatagcataaaatgcaaatgtcattaaacttgattatataaaggtaaaagtagaataagataagttttcttaatatcttaatcttttaaattgatgagtcaagagattgcaaaacttgatgaaacaggaaatcactgttggcttaaaattgcagaggtcatcagtagagcaacacttcctaaagtgtgattcctgaaccagcagcatcaacctctcttgggattttgtgagaaatgaaaattgtttttattttattttattttattttatttttttcctaaatttcttatttccttctctttttttaaagttttattattattatactttaagttttagggtacatgtgcacaacgtgcaggtttgttacatatgtatacatgtgccatgttggtgtgctgcacccattaactagtcatttagcattaggtatatctcctaatgctatcccacccccctcccccaaccccacaaccgtccccggtgtgtgatgttccccttcctgtgtccatgtgttctcattgttcaattcccacctatgagtgagaacatgcrgtgtttggtttttttgtccttgcgatagtttgctgaraatgatggtttccagtttcatccatgtccctacaaaggacacgaagtcatcattttttatggctgcatagtattccatggtgtatatgtgccacattttcttaatccagtctatcgttgttggacatttaggttggttccaagtctttgctattgtgaatagtgctgctataaacatacatgtgcrtgtgtctttatagcagcatgatttataatcctttgggtatatacccagtaatgggatggctgggtcaaatggcatttctggttctagatccctgaggaatcgccatattgacttccacaatggttgaactagttgacagtcccaccaacagtgtaaaagtsttcctatttctccacatcctctccagcacctgttgtttcctgactttttaatgatcaccattctaactggtgtgagatggtatctcattgtggttttgatttgcatttctctgatggccactgatgatgagcatttcttcatgtgttttttggctgcataaatgtcttcttttgagaaatgtctgttcatatccctcacccactttttgatggggttgtttgtttttttcttgtaaatttgtttgagttcattgtagattctggatattagccctttgtcagatgagtaggttgcagaaattttctcccattctgtaggttgcctgttcactctgatggtagtttcttttgctgtgcakaagctctttagtttaattagatcccatttatcaattttggcttatgttgccattgcttttggtgatttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcgttatttctgagggctctgttctgttccattggtctatatctctgttttggtaccagtaccatgctgttttggttactgtagccttgtagtataatttaaagtcaggtagcgtgacgcctccagctttgttcttttggcttaggattgacttggcgatgcgggctcttttttggttccatatgaacttgaaagtagttttttccaattctgtgaagaaagtcattggtagcttgatggggatggcattgaatctataaattaccttgggcagtatggccattttcacgatattgattcttcctacctacgagcatggaatgttcttccgtttgtttgtatcctcttttatttcattgagcagtggtttgtagttctccttgaggaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagagtttgctgaagttgcttatcagcttgaggagatatggggctgagacgaaggggttttctacatatacaatcatgtcatctgcaaagagggacaatttgagaaaattcttgggcccaccccagacccactgaatcagaagctgatggggtgggccccagcaaactatgtttttgtttttgtttttgtttttgtttttgtgttttgagacaaagaatcctctgtcacacaggctggagtgcagtgacaggaactcggcccactgtaacctccacctcccaggttcaagtgattctcctgcctcagcctcctgagtagctaggattacaggtgcacgccactatgcctggccaatttttgtatgtttagtagagacaagttttcactatgttggccaggctggtcttgaactcctgacctcaggtgatctgtccgccttgacctcccaaagtgttgggattacaggtgtgagccaccgtgcccggccagcaatccgtgttttaacaagatggctgggtgattctcatgcagctaaagtatgagaactgatacagtagaggagttaaactartaatttgcccatcaaaattatggaggtgaaggagtggggatcgttatgtgagataaattcctgtctatcatggaaggaatttagtaaaataatgtctagatctgataaatcaacgagtagtagtatcagcatgttttctagagatatggaaataatcatcaaaagaaacataaacggacgtgggtaataatgagtaataatggttgcccctggagaggaggactcagtatggcgaggtatgtggcagggggttattatttttctaaccatgtgattctttggttgaaattaaaataaaagaaaaaattgttcttagattgggaagattgtccaggagcctgagagaagttctgggagagcagttctttcttattgtccttttcctgattatggggaaaaaaaaaaaaaaaaaaaagataatcttccagatgttggctcagtttgaggaggaggaaagattctgagagtgaggcccactgcaggaagcagagctgatctttaacctgtgtatatatacacaacagtttgacacagagcatctcacctctttcataggaaggaataaattcatcagaactctctaggtcatgttgccagataacattagggttccactactttaaatgccttgatctcttcactgagcccatgttggtacccaggactatacagaagggtggatcaaatcatgatgaccttttagagttggggtctgcccccactgatggcctaattaaagtggaatcgctgcacagactgtgtgtgtaacatggagatagtgaccagtacatgttaagtacaggcttactgattaatctgaggctttttgctatgagttaggaatgtgcaggacaggcaggagaccaagccttccctctatagggtacatagtcctgggagaagacgggttccaggatagggctttggcactaggctctggtgagtgaatagtgggattgctgctaatgctgagattggattgggattctgggcgctctggggacggtggagcttgaatgctacaagcctccgtacatacagcctgatgggcacacattgcaccttcaaaatttaaggaaagcaaagacctgcatctgtctcatcagaaagggaggcatatttgatagcaggaaaaagacaacctttttttcattaaccagaggagtattttaaaagactataaagctggaagcaattcaattgtgtgtctactttatgtaagacctcgatgaaaaaataaatcattgctgccttcattggagtcacagacagtccaggaataatttacaaagtgagatttagattagtgtgtaagaatttcactgcagaggccacttctggctgaggagaagatgttctatggagaaarggagaattggccagagccttaaaggtggagtaggatttgggtcctcagggaatggaggggctgatggatgctaaaggtctctcacgtggctgaatatctagtgagggaaaggggagaggccatctggactggagattcagtcatgcagtctgaagccacttgttcactggctgaggagttggatgtgattctacggtggacagaccatggcatattttgcagtttggggagatcgtagatgtgcctcagggagattggtgtgcctgggtatggggaggccagttaagaaagagcttgttgcaggggcctttgcaggtgagtccctggggagtctgtgtgataccccccagagagttgactcctaattaattgctagttggtctcagctgctgaaacagagggtatggaactaaatgaaacaatcatgggaagtcctggctggtcygtgtgctgggaagggagcaatgctgtccttggactggtcacctgaaggtcctttatccctcctcctcagctgagcataccaatggtgatgacagaggccctgtcttcaatccctgtacacagaatagcgctctgaaaattataactcttctcasgcttcatcagcaggcccccaaagagacctggctacagcagggcttccaggtctttcactgcggtaggcagaatggccccccaaagatgtccatgccctaatttctggagcctgtgatttggatacgttacatggcaaaagggactttgcagttgtaattaaggtgatggacttccaaatggggagaggagcctggattttccaggtgggtccaatctagtcacacgagcccttaatagcagcaaacttcctccagctggaggtgggaggaatgaggcggaataggaggtcagagagacttgaagcatgcctttgctgatgttgaagatggagtatgtgatgtgacgagaatgtggacaaccttaaggggctgggagaggcttccaggtgactgtctgcaaggaaacggggcctcagtcctacaaccacacagaaccaggtgcttccaaaaacccgaacaaagctggaagtggattctcccccagggcctctagataatcgtccagaccagctgacaccttgatttcggcctgtagaacctggagcagacccagacaacccaccgacctctgacttacagaactgtgagataatagatttgtgttattttgagcagctgaactccggtaacttrttactgcagcaatagaaaataatagacacacaatacagcccacacctccagaaccccggggcttctttcctccctgggctctctggggaaggagcacaggctgtgcagtgagatcagggccctggcccagagcactcaccctttagagcctgtttcctcacctgtcactgggggtgccatcggctgctctgcctgcctctgggtggtggtgggattacatgagggaaatgtgagaagcccggaaatgatgaggcagcactggatcctgctgttcccttcctgggaagccggcttcctggtgttgtgaggagaggatgaggccgtcatgggagcaggtctgacctgggctctgaggaagcaggtgctctgctgcctttccacatcctttcctctgaggggggtcccgtctctgcaggcccgtgggtgggctccccggtgggacgcaatggcaccatcttaggcaggagtccccaactcctggatcagtaccagtccggccacacagcatgaggtgggcagcgggccagcgagtgttaccgcctgagcgcccctcctgtcagatgagcagaggcattagattctcacaggaacatgaaccctacacatgtgagggatctagattgtgccgaaaccatcccgccccctccaccgyccgttcatggaaaaattatctttcacaaaactggtccctggtgccataaaggttggagaacactggtctaagggttctggcaggctctcagatgaacctctctggatctttagggtgtctggccctcacgtgtcaggcccaaagatgcctgttagtctgtcgcagagggagaagatctggggaggacccatataaccagaactcgggagccagccgcaccaccatgagcccagatagcatgagtcccttctcttttctccatctctgctgccattccctaggccaggccaccatcatttgtcacctagaccaggtcacatccctgcataacctcctcccgctgaggagctcccttccccctcagaagaaaatccggacacatgctaaggcccacgagagcctgtacagtggggctcctgcctcgccagcgccacccgcatactgcattcccaccaccctcaaacttaccaggcctctgcctgcctcaggccctttgcatatgctgatacctcatctagaaagcactttgccatgcttttcccgtggccagctcttcattttttaggtctcagcctaaatgttgcctcctcaaagaaccattctcccactaccctgtatttcctgactcagctgcctttctttgttttgacacagggtctcattctgtcacttaggctggagtgcagtggtgtgatcatggctcactgcagcctcgactttccaggctcaagtgatcctcccacctcagcctcccaagtagctgggaccactggtgtgtgccaccacgcctggctatttaaaaaaaaaaatttttttttctggacacagggtttccccatgttgcccaggctggtcttgaactcctaggctcaaggaatcctcctgcctcagcctccctaagtgctgggattacaggcatgrrccaccgtgcrtggccttagctgcctatttgattccttcgtgacatctaacagaacgtgttatttcgtctacttgttattgtatttacctctctagaatggaagcccagtgagggaagggatctattttatcttatttgctattgatccgcaacacctggcagagaacctggcctatagtggatgcttagtaaatagtaaatagttgaaagagcccttctggaagaacacaaggctagttcctttggcaaaaattgggcatcatatcagagcttcttcactagcagattcagcagagctataaaattaaaagaaatgtgttctgtaatccctctgggaattccccacgggcaagagagcatgatgtgtgatttgcagtgacatatctataccacggtatgtttgtagtgactacttttcaaaagacaagatggaggatatacagctggtgaaagaaaaggtgtcggctttgttgagaagtcttactttgttgtctttcaagtgaaaagtgagctattttagtctaatggtaatttttaactatgttgaagccatacactttgggtctccattgtgctggaaatcgtcactacagctcctcccaccccacacccctcaatgcatgcatataggaatatagctcatgctatggaaatccactgtttgcacagcctggacattaggtaatagtttcccggctgaggtgcccagctggcttaacatgccattatttacagctctaaggtttattttcattattatatttaaacgtctctgcagaaggaatggaaggctaagagggtgggagagtagaagaggagagggagaagagtcactccagacgtcagaaccagacaggctcctgagaccgtgcaaactgggggatttcagattgcacacttggagtcagggcagcagtttggctcagcaggaggggaaaggggtgttagaggaaaaggctcctgccctccaatgttgtttgacccagatcaaccctactcttatgggtatcagcttctgggtaaatactcttttcaaagagggcaccatggcagaacacatgtgaaaaccatctagtttgaagtatgtgtgagaaaaacaactaattcacccttctcactgaccagtggagaagtctggccttatctgtctgtctcaggcttcttctccaaggttaaccccaacgggaaaggagaggggactcatcaaaggttagaccatgtcctgaagtgacctgttgaatttgcaaaacttctttttcagtgttatgttttatttttgcaatttttgtggggggaaaatgcattctaggcttctgaaaccctttttagaagaaaatcatggtttcctcaaactcttcaagcttattgagttttcttctgtattatcctgtcctattgaaaaccttgtgcaaaagtatgtgtggggtgagaggtgtttaaacacacccggtggacagtgtctggctggggaggaaacgttagcctctcttttcttatcttatgagataatttaggaaatcaagtacaaggcccttgctgtgtgcacttatacctggagccttatttaggggatgttcttgcagatagatggggagaagtcttgctgggatcctctctggttttaaggcattttttttctcactcccagttgcctgcccatgtctggtttagcagcttttagaaacgtggctggcatccttttttcttttctctgacagcaccagcccctttatttgaacttcctagctgttttctgcctcttctgactaattaacagcaactaaaaaagaaaaatgaaacatagaacacaaaaaattccagggtgaaaaaggagaatttctagtcctggggtgcaaaagtccctagaagagagttttgagctgaaatgaaaagttgtgattatagagagacatgaaatgtgtcccataaaaggccacctagtcccaggcagatccaggaagagcactgggctgggagtcccatggggccagggcctcaccaagcagtcagccctgctcagttatcacaggggttgaactggattgcctaaatgatgcctttagatggatggaactggagtccattatcttaagtgaaacaactcagacacagaaagacaaataccacatgttctcgtttataagtgggagctaaataatgtgtccacatagaagcagattgtgggatgatggacaatggaggggtggggaagttggagctgggtggatgatgggaggttgcttgttgggtgcaatgtgcattggcccagtgatggatgcaccaaaggccctgactttgccatgacagaatatatcaatgtggcaaaactgcacttgtatcccatgaatatataccatgtttttaaaaatgttgcctttgggcagaggggataattctgcaaactgcagagccrtggagtaaaaaaaacacccaagatagcagaacttgtcatttctagtttttccacaggaccataaagcaaaattggtgccgggtttgtatttaaagggaaaccaagagggtttttttatccttccatggtttcaaaatctggaaggacaatttgtacagaccctgagatagaaggattcctcagctttaatttcatgawcgatttgcctttcattgattcttgaggatatgaatgttttagaaagcaacagtgtatgccttgattttaagaggcaatgagccttttccttccttcgtttaggcatggggctgaatggagctgaaattcctgcactcttataacgtgccacatgaagggcagttttggattctgggaaaacagcccattgaaacagaattgggagggagaaacctcttacactcaggtcatggtatttatatgaatacaaaaaaaaatttaaatactgtgctaggtgctgggggttataaacatgaattacatgattagggcctctggaaacttgtgtggggctatagaaggaacaccagttcagaaatgtcactcctgtcatccagacaggatgcttcaccataggggcagagaccttctgctaagtcataccgcatatcaagaaatatattgctaggccaggcacggtggctcacgcgtgtaatcccagcagtttgggaggctgagacgggcagatcacttgagatcaggaattagagaccagcctggcaacayggggaaaccccatctctactaaaaacacaaaaattagcggggcatggtggtacgtgcctgtaatcctagctactcaggaggctgaggcacgagacttgaacccaggaggtagaggttgcagttagccaagatcgtgccactgcactccagcttgggcgacagaacaagactcatctcaaaaaaaaaatgcattgatcaaatcagcttaaaaatagccttcttgtttgctcttcttggtgtgggattattcagtccaattcttctactttttttaggcctcagcatgggatttggttgtcatatcaaccctataaacagtgttgaatccatgtcaataattgtattttttaaaagcaaatatcaccaagtccaagaaactgatcctcctctgaacatgatagctggactaggctaagaatcctatttcctgttagatcagaagtgaagattttctggtacagatttgggtgggagaaatgagctacccttcccaaggccttagcacctagatgacatcctctctgaagtcaccctcagccaggagcggacactgagctgctatttctgaatcacatgtccccaaagctgccctggccttggtgaccatggcactgtaagagaagcacagccagccccagcgtccttactctgactcagaggaaaatgcaacttgagctggattcattgaawtcttttttttcctggcctgaaggaaatgaagaaacatagccaaatattctaaaacaggattcaacaaacagcccataggccaaatccaccactgcctgtttttgtaaataaagttttattggaacacatctatgcccattcccttatgtattatctatggctgcttttgctctacaacagcagagttgagtagtgtgactgagaccrtatagcctacaagcccaaaacatatactgtctcacccttttcagaaaaagttgccagccttgttctaaaagaagtagagtaaggatttagtgagaagctggagaaaatattttcaaagacaactgtattctccagggaaacctgagatgaagaccaaggtgaggaagragccagcagagaaatygagtccatgaggctgaggaggccactggatgtccagtcttcagctctctgaagcctgagacaggaaacagttgtctcccgagagaaaggtttgaacctcctttaactagggaggaataagagatgatggcttcttagatctgtttacatttgctggaaaaacttcttccagggaaataactagacagggctttgrccaactagcaggtgaagtctggagggaggtggaagagactgcttccaagctgggttccgatttgtctgattgaagcagccaagcttgtgtttgccagaggacttaggaggatgtggataaaatcaggctgaggcctttttttaaaggcccaagctggagctattgggattgtyccctcagaggaaaatcaggagtttgggccattggcttcatggagaacctgtactttgtaccaaggagaagtcatttctacttggtttttgaaactgcattgtcatctagtattccaaggctttagtctgtccaccctcctgctccagagagatgcctttcagttccttaggaaacaaattggccatttgcccaaagagactaatccaggactagaacacaggcactgagtttcaacctcaggctccccagtgygtgactcaggtctcttgattccatggtgtattgtttttttacctattaaacaattgcattcctagcctatggaaggtcttacctaagccaagactttggcagggattggattgtgcagcccatttttgttaayagcattgcccaagttagggaaggccattaggttggctgagtattctggtattctattgctgcataacaaactctgaaatttagtagcttaaaataacatttattttgttcatgaatttgatttcattgttttttaatgtatgtaaggtatataaaatgatgttttgatgtacatttacatagtgaaatggctactatggtcaagcaaatgaacatatccattgcctaacatagkttttttttttttttgatagtaagagcacttggaatctactytattgtcaaatttccagtatataatacaatattgtcaacatagtcatcacgctatacattcaatctctaaattttttcatgctacctaaccaaaactttgtacctttgaccaacatctccccattccctactccctaccccctccccgacccctggtaactatcagagtttcactttctggttctgtgtatttaacttgtttagattccgcaataagtgagatcatacaatatttttctttctttttgtgacttgtttcacttagcataatgtcctccagtttcatccatgttatcaaaaatggcaggatctcctttttaaaggctgaataatattccattgtatgtttatatatgtgtatatatatatatgtgtgtgtgtgtagtatatatacatatatacacaccacaatttctttatccattcacctgttgacaaacacttaggttgattccatgtcttagctgttgtgaataatgctgcaatgaacatggaaatgcaaatatttctatgaggtactgatttcattctctttgagtatatacccagaagaggaattgcagggtcatatagtagttctatttttattttttttgaggaacctccatacttttttcataatggctgtaccaatttacattcctaccaacaatgtataagggttcccttttctccatgccctcactaacactttttatctcttgtcgtttttatagtagccatcctaactgttgtgaggtgatatttcattgtgacttcgatttgaatttccctgatgattagtgatgtggatatttcagcagaaaccttgcaggtcagaagagagtggggtgatatattcaaagtattgatggaaacagtgcctcatacctgtaatcacaacactttgggaggctgaagcaggaagatcacttgagcctaggagtttgagactagcctgggcaacataatgagaccttgtctttacaaaaaataaacagaaaattatccaggcatggtggcatgtggctgtagttccagctacttgggaggctgaggtaggaggatcgcttgagcccaggaggtagaggctgcagtgagccaagatgatgccactgcactgcagcctgggtgacagagtgagaccctgtctctaataaattaataaaataaaatttaaaaaccctactagccaacaatactatacccagtaaacctgtgcttctcaagttgaaatgaaaggacactaaatagcacaagagagcataataaagaaggaaactcgttggtaaaggtaagtatatggacaaaatcagaacactatattactataaaggtgatgagtaaatagcttttatgtctatgaagaaagttaaaagacaaaagtattttaaaaaccattataagtattaactaaattatgttaatgggtacataatataaatagatataaactgaggcatcaatagcatgtaacttggggggagcagagggaaaatcagagtttttatgcaagtaaagttacattgtgracttataacagactgttacaaattatttcgtgtaagctcctggtaaccaccaagraaatacctatggaagttatatatatwaaaaaagaaaggaatcaaaacctatcgatacaaaaaaaaaaaagaaacaaaacaaaagaaaaccgcaagggagaaaaagagggacaaaagaacaagacacatagaaaatagtcaccaaaatggcaatagtaaatctgtctctatatttactttaaatgtaaaaagactaamcttcccaataaaaagatacagcatgactgaatagattattaaaaaaaacaacaacaaccaggatcaaactgtatgctgtctacaagaagctcacttttagattcaaggacacacagagagatggaaaaaggtagtccatgcaaataccaaccaaaagagagcaggagtggttaatacttatatcaacaaaatagactttaattcaaaaactgtctctagagacaaaggtcatttcttaatgacaaagggtcaattcaacaggaagacataacaattataaatgcacccagcatcagagcacctaagtatatacaacactgacagatctgcaaggagaaattgatagcactataataataggagatttcagtaccccactctcaataatggataggacatctagacagaaaatcagtaaagaagcagtagacttgaacaactggacctgtgtaacaaatggacctagctggcatatacagaactgttcagccaacagtggaagaacattcatttttctcaagtagccatggaacattctccaggatagatcacatattaggtcacaaaacaaatcttagcaaatttcagatcgaaatcataccaagtatcttttccaaccacaatggaatgaaactagaaatcagtaacagcaagaaaatgggaaaattgtttgtgaattcatttgtgaatttgcaatttggcagagcttgatcaacacagctctctgttccatataatgtctatcagctggggcaactcaatgggattggaggacatctctgaggttttcactgtcatggtgactcacgtagcctgcaagttgatgtggcagtcagtgtctcctgtgagcctctgcatggacagcttgtgtttcttgcagagtggctaaattctaagaacaaatgccccaagaaaattaggaggaagctctattgctttttatgacctagtctcagaagtcacatagtgtcacttccactgtagccaaaagtccacccagattccaggtaagggagcattagaccccacctctctatgggagtagtttcaaagtcacattgtaaggagtgccatcatcgagatattgttgcattgatttttggaaaataatttacctgcacagaggtaaattcacatcaattctttgtctccttatttcaccatccattaatgtttgtttgtttgtttgttttgagatggagttttgttcttattgcccaggctggagtgcaatggttggtctcggctcactgcaccctctctctcctgggttcaagcaattctcctgcctcagcctcccaagtagctgggattacaggcacccaccaccacacccggctaatttttgcatttttagtagagacagggtttcaccaagttggccaggctggtctcaaactcctgacttcaggtgatcacccgcctcagcctcccaaagtgctgggattacaggtgtgagccaccatgcctggccccaccatccacacccagccccaccatccattaattaagcttcatggtgttcactcagtcacactgttgtcgctctcatttgccaatgttaaatagtgatgcacagtgcctaagacaaaatygctatcactgcaagctcctacccctggctaaatgctaatctggatttatgggacagtgacgagtgctattattttcattttataaatgaggaaactgagtcctggagggaagaaaagtcaattttcttaatgtaatacaattaaaataggattacactttgaatttccttatttcttaactagtattttatctttccatgattgtgcttaattttatcttatcagtacaagcactcatataacctgtagggatatttgtgtacatgtgcatgtgtgcatatacacacacgcactgtgtgtgtgtatatgtcaaactcagtgcttgcctttgttggatggaaattcagcagcactggaggactagacagctagaaaagccagtttcagggacaggaaatagtagagttcaaggaaaagttaggacaaggaaaatgagtctttacaaagcaaccaattcctcgtgagaagtctttgcatctcacatggctaagagacagtactttggttaggggcctggagctttggttttgatgaacagtgtgctggtattggctctaagctggggcatccaccatttggctccccatttgagtggtcactctgtctctcagagcaatgtgtggtctttcggtgttgataaagcagcaactacatgccaggccctaagggcaggcacagaggcaagcaagaccagtacagtgccccctgcaatcctcttgggacatcattttagcaggggagactaccattgaacatgtaatgataaaattgattagttatgattgagatgagcagtaggaggraaaagtgtgtggaactgtgagagctcacgatgggcctgaacttgcccagggactcagagaagtggtctggatttgcttgttgaagggtgagaggacatgtactaggtgaaccagctggaggaatctggggatccacttgtggggaggccctgggtgggaagttgtaaggacaaccagagtgatagctggcatgagaaagccagggtgacagaggtgaggagggcacatgccagatctggcagcctgcatgtcaccagatggatttaggtcacatcctkttcttccgttctcacctctttcacctccatctccacctccacctctaccccttcacctctccatgcctcacaaagttggactgtcttgcctgtgagacaggaaaggcatgtgtgatgaggggactgtacactaggggccagtccaggttttgtgagacctgaggcttatatagtagagggtggggtcttgaaggaaaaaaaaaaaaggtgaaattatgaagacaaagtttgtgcaaggcttccctaggggccatgtcagctggggacctctaagctgaagtttcactagtgtggtggggaagctccctttggcaccttccctctgtcctcaaagctcataaagcccacctttcatcttgcctgagacgttcatgccatccttacacccacttcctcctgttttcttcttagttaagatggcaaagaaagagcaaatatattgaaatctcctggaaatttggctctctccttgaccccagtagtgtccaaaagaacacaggaatttcctctttttkcccaagacttccatgatattttccctgataatcaaggaagggagtgttggctgggacacttttttcttttggaaatgtggcaggggaatatgaatttycataggcgaaattactctgtctggtcgagtctagactgttcgttggccagcacgtttgctggcgcccacactgacactctgaggtgctgcctggacttattctctgggcagggaagaaataacctggaactacattttggggaaaaaactcacgaacatgagcagtgacaaggaagaagtttaataatgagtaaattacaactaaaagttgtcaacaggctcttctctccaaattccactgaaatgagcaaagccatctaacagtagtgaagagtctctgtcatctggaacttggggaagctactgtccatagatctgaaatgtcagagaggttgagacagattgaggggaagactaacaagccctccatggaccgtagaagaaagccctaacccctctccaaatgctgctgctgatctcctggcaagcctccacagatargcccaggcccaggcacagccagcaagctctctggaaatatttgggttttgacatgccaagacttggccccagtaagggctgggtggggctttggctgttgaggcccagtcttggttagagaaaaggcactgtgtccctgttaactgctggctgccccaccaacaaactggaaagaatctcccccagtctgttgtgattccctcagcctgatggcctaattgcctttgccttttcctgttaatactgacaattcaatacagtcccattgctcaggcagaacctatttcatatataaatttcctgcatccccaaggcagagcaaatagggggaaatgaccaaactrtaatytgagagttctttactcaactggattatcattcatctaagagcatctgaaagacagtctcacacaagcaaagactgaaaggacatccaccaccacgtacctctcttgaaaaaactgcttggagaagcacttcagtagactagggaatgaatcaaataagtaatgcactgacaaaatcaaaaccacagttgacttaggcttccttggagcttggaagaaccccttcccacgctggagagctggctttttggaggtgggagtagaagccctgaggggctcaggggaggaattcccactgatttgcaagaaaggaattggccactgtgtactcgtttgccactcaatcctgccctaaccttcctctcctrtctttctcacagactgtttttgaaaggaattgccgttcagaggactgtgccgcagacctgcagcttcrgggtaaactgctgctctccaggtatgtcggtgtttccttcagagcattgttctcaggctcctttttcttgaccccrggtcccaaacctgaatgtgcagatttccccactgaagaggataaacagagttgatgggttacagtaatattctgtggttttaaaaaaatgtatgttacaaaataattataacaaaagctttgttgggaagattgtttaggtttttttgtgtgttgattgcaattccacatatctcacaatgtagcttgtatttctaatttctatgagtatttgaggggtggctattttatgcttgctgattgtattaagttgaatcatatgaaattgccaatatttgaacttttggacaatttcatatgtatgattcatcctattattaaataaaggtttatgccctcctgcctccacacacacacacacacacacacacacacacacacacacacactagtgtatgttttwacaagtwacatttctgtggcaggagagggctgaaggagaggggcaggytgccctgatccaagtgagcagatagtctccttattgtttcagggtttcctcccgcactrcatgaatcccccaaggctaaaggtgaaccgtacagcggccttctgtttcctctttgccaaccttttattttagacttcatttaggatgaaggtgctggtcctgatcatttagcctcatttcacagaatggcttccttttgaaacagttccttctgaaagactgttttagccttggggccagaaacccctctattagttttattaccatttctgaaaaacagtcactagttttggtagttatttttcaaaatgcatagtgtatcccttacttaaaactatgagagttaagtttggatgaaatgacatgaatatactattatgaaccagtgcctacactaggacattttttttattgttatactttaagttccaggatacatgtgcygaacgtgcaggtttgttacataggtatacacatgccatggtggtttgctgcacccatcaacctgtcatctacattaggtatttctcctaatgctatccctcccctaaccccccacccctgacaggccccggtgtgtgatattcccctccctgtgtccctgtgttgtcattgttcaactcccacttatgactaagaacatgcagcatttggttttctgttcttgtgttaatttgctgagaataatggtttacaccttcatccatgtccctgcaaaggacatgaactcatccttttttatggctgcatagtgttctatggtgtatctgtgccacattttctttatccagtctatcattgatgggcatttgggttggttctaagtctttgctattgtaaagagtgctgcaataaacatatgtgtgcatgtgtctttatagtagaatgattcataatcctttgggtatgtatacccagtaatgggatggctgggtcaaatgrtatttctggttctaaatccttgaggaattgccacactgttttccacaatagttgaactaatttacactcccaccaacagtgtaaaagcattcytatttctccacatcctctccagcacctgttgttttcttgactttttaatgattgccattctaactggcgtgacatggtatctcattgtggttttgatttgcatttctgtaatgaccaatgatgatgagcattttttcttatatttgttggccgcataaatgtcttcttttgagaagtgtctgttcatatctttygcctactttttgatggggttgttttttttcttgtaaatttgttttagttctttgtagattctggatattagccctttgtcagatggatagattgcaaaaattttctcccattctgtaggttgcctgttcactctgatgatagtttcttttgctgtgcagaagctctttagtttagttagatcccatttatcaattctggcttttgttgccattgcttttggtgttttagtcatgaagtctttgcccatgcctatrtcctgaatggtattgcctaggttttcttctagagtttttatggttttaggtcttacgtttaactctttaatccatcttgagttaatttttgtataaagtgtaaggaaagggtccagtttcagttttctgcatatggctaaccagttttcccaacaccatttattaagtagggaatcctttccccattgcttgtttttgtcaggtttgtcaaagatcagatgrttgtagatgtgtggtgttatttctaggcctctgttctgttccattggtctatatctctgttttggtaccagtaccatgctgttttggttactgtggccttgtagtatagtttgaagtcaggtagcatgatgcctccagctttgttcttttggcttaggattgccttggctatagggattcttttttggttccatatgaaatttaaagtagttttttctaattccatgaagaaagtcagttatagcttgatggggattgcattgactctataaattactttgagcagtatggccattttcacgatattgattctttgtttccatgagcacagactgttttttcatttgtttgtgtcctcccttatttccttgagcagtggtttgtagttctcttgaagaggtccttcacatctcttgtaagttggattcctaggtattttattctgtttgtagcaattgtgaatgggagttcactcatgatttggctctctgtttgtctrttwttggtgtacaggaatgcttgtgatttttgcacattgattttgtatcctgagactgctgaagttgcttatcagcttaaggagattttgggctgagactatggggttttctaaatatacaatcatgttgtctgcaaacagagacaatttgacttcctcttttcctatttgaataccctttttttccttctcttgcctgattgccctggccagaacttccaatactatgttgaataggagtgatgagcgagggcatccttgtcttgtgccagttttcagagggaatgcttccagcttttgcccattcagtatgatattggctgtgggtttgtcataaacagctcttatttttttgagatatgttccatcaatacctggtttattgagagtttttagcatgaaggggtgttgaattttgttgaagcccttttctgcatctattgagataatcatgtgtttttttttcattggttctgtttatgtgatggattatgtttattgatttgcatatgttgaaccagccttgcatcccagggatgaagccgacttgattgtggtggataaactttttgatgtgcggctggattcagtttgccagtattttattgaggattttagcattgatgttcatcagggatattgacatgaaattttcctttttcgttgtgtctctgccaggttttggtatcagatgatgctggcctcataaaatgagttagggaggagtccctcttgttctattgaatggaatagtttcagaaggaatgataccagatcctctttgtacctctggtagaattcagttgtgaatccgcctggtcctgggctttttttggttggtaggctattaattactacctcaattttagaactcgtttttggtctactcagggattcgacttcttcctggtttagttttgggagggtgtatgtgtccaggaatttatccatttcttctagattttctagtttatttgcatagaagtgtttatagtattctctgatggtagtttgtatttctgtaggattggtggtaatatcccctttatcattttttgttgtttctgtttgattctctgttttcttctttattagtgtggctagtggtctcttttgttgatcttttcaaaaaaaaaaaaaccagctcctggatttgtttattttttttttgaagggtttttcatgtctctatctccttcagttctgttctgatcttaattatytcttgtcttctgctagcttttgaatttgtttgctcttacttctctagttcttttaattatgaagttagggtgtcaattttagatctttcctgctttctcctgtgggcatttagtgctataaattttcctctaaacactgctttaggtgtgtcccagcaattctggtatgttgtgtctttgttctcattggtttcaaagaacttatttatttctgccttaatttcattatttacccagtagtcattcaggaggccattgttcagtttccatgtagttgtgcagttttgagtgagtttcttaatcttgagttctaatttgatttcactgtggtctgagagactgttatgatttctgttcttttgcatttgctgaggagtgttttacttccaattacatggtcaattttagaataagtgtgatgaggtactgagaagaatgtatattctgctgatttggggtggaaagttctgtagatgtctrttaggtctgcttggtccagaactgagttcaagttctgaatatccttgttarttttctgtctcatgatctaatatttgacagtggagtgttaaagtctcccactattattgtgtgggagtctaagtctctttgtaggtctctaagaacttgctttatgaatctgtgtgctcctgtattgggtgcatatatattgatgatagttagctcttcttgttgcatgatcccttcaccattatgtaatgccattctttatgtttttttgatctttgttgatttaaagtctgttttatcagagactaggattgcaacccctactctcttttgctttccatttgcttggtaaatattctaccatccctttattttgagcctataygtgtctttgcacatgaaatgggtctcctgaatacagcacactgatgggtcttgactcttcatccaatttgccagtctgtgtcttttaattgggtcatttagcccatttacatttaaggttaatattgttatgtgtgaatttgaccctttcattatgatgctagccaattattttgcccattaattgatgcagcttcttcatagtgttgatggtctttacaatttggcgtgtttttgcagtggctggtactggtttttcctttccatgtttagtgcttccttcgggagctcttgtaaggcaggcctggtggtgacaaaatctcagagcatttgcttctctgtaaaaaagtttcttcttcgcttatgaagcttagtttggctggatatgaaattctggtttgaaaattcttaaagaatgttgaatattggcccccactctctgctggcttgtagggtttctgcggaaagattcactgttagtctgatgggcttccctttgtgggtaacccaacctttctctctggctgcccttaacattttttccttcatttcaaccttggtgaatctgatgattatgtgtcttgaggttggtcttcctgaggagtatctctgtagtgttctctgtatttcctgaatttgaatgttagcctgtctttctaggttggggaagttctcctggataatatcctgaagagtgttttccaacttggttccattctcctcatcactttcagatacaccaatcaaatgtaggtttggtcttttcacttagtcccattatttcttggaggctttgttcatttcttttcattcttttttctctaatcttgtcctcatgctttatttcattaagttgattttcagtctctgatatcctttcttctgcttgatcgatttggctgttgatacttgtgtatgcttcatgaagttctcgtgctgtgtttgtcagctccattgggtcatttatgttcttctctaaactggttattttagtttgcaatttctgtagcctgttttcaaggttcttagcatccttgaattgggttagaacatgctcctttagctcagaggagtttgttattacccacyttctgaagcttacttctgtcaattcatcagactcattctccatccagttttgttcccttgctggtgaggagttgtgatcctttggaggagaagaggcattctgatttttggaattttcaacctttttgtgctagtttttcctcatcttcatggatttatctacctttggtctttatgttggtgactttcagatggggtttctgtatggacgtacactagtacattttaacttatgatggcacatgatctttcattcatcaaaggaaagtaatactaagattccttttcttcagtttgagtttactggaggaagatgatgtaacacacacacacacacacacacacgcacacacacacacacaaatagtcctccaaaccacttaaatattaattagcattacttttacttagggcaatagtggtagattaaaatagcacacgttttgccaagcttacaaaattacttaaaactcatggcatggatattagaattgtttcacattagtacgaaggacctcctgggattattagaggaactgactttaaagaagtttcataaatttgcagctcattaattttaattttaaataggccttccacaaagtgttttagggaaaaaataacaagaaacaaaaatatatggatttgttttgtcttgaggcagactggaaatgctggaaatttattttgsatcgtagaaaaacttcatgtggtgggaaaatgttcacttgctccaaggtcaggtattaagttagcaaagtcctaatgcttttgctacccattagtggatgatcaaatccatctctattgaattgtgcttttcttatattaagatgtaaaattcaaggctcagtatagcacctggtggctaaagctgcctccactgccccagtctggcctttcaagtgtggtcagagctagttatcctctgtgggcccagtaatcaataatgcttgaacaactagtgtggtggccaggacccagtccccccatatgtatcagctaccaattgccacaaaaaaggctgaataaaaaagtcaccccaaaactcgatgatatgaacagcaatcactgattcccatggattttcaggtcagctggcccaggctggactcagctggaccttggctgatttgtccatgcatctgggttcagcagagggtaggttctaggcttgggtgacaccattcagctctactccctgtgtctttcattttttctttggaaccagtggacaagcctgggcatattctcacagcataacagaggtacaagaaggcatgcagaaatgtgcaatgactcttaaggcctgggctcagaactggtgcacttttcctccagccttattctattggccacagcaagtcacatggccaaacccaaagtcaagggacaggaagttagtgagaggaattacaaagccacacagcaaagggcctgagtataaggaggaggtgaagacttgggacccataatgcaattgactatactatataaacagcaaggtagccctgtctcttatcctgatgccttgttgttatcagggctatttcagtctttattgcaatgccgtctctctggaattcagacatgagatctggagactgggtgagaagattttctgaacctcagaaacaatgcctttggaccgaagctctcagcctcttaggttgggttatttctcagaggacccctggcctctcaaaatagccttttggccgaatcctccattaaagaaaccttcgttgtacttttgggcccatagctgttctcacaggaaccatcagagaaatgttcattgatacttagataacaaacctgtggttcagttatatgggatttatccagacctttggatgttcactcttcagagccagggacaatgtgagggaagatacaatcagttaagtgctagtggaaaccagggtctgaatttggttggcaaaggcatagtggctccaagcagaggtaaactgctttggttatcattgagctctcttgattcattcttstctgggatggaatgtgccctcctttcttgttcaagccaggcaagtgctaggcactgggctgcagaagtgagcagtatgtgagccctgctctcctgctgtgagcagagcaagaggctgggagatagtggtaccacacagtgagtgctaggtgggttactccagggctctggagcagcttccaagaggtggtgttgagaggaatgaggactcacgcattccdagcagagggaaaatgtgagcagaagtatggagaacaggactcccatgaagatctgcaggtgtctggaatgaaggaggcagtcaggagaacacagtgagagacagggaaggagaaagggagagaaaccagattgtggaacacttatgagtctggacttcatcttgaagccagtgggagtacagccaagttgtagtgtaagtgcttttaacctaacaagaatacagccagggggccaggcgcagtggctgtgcctgtaatcccagcactttgggcggctgaggcagatggattgcttgagctcaggagtttgagactagcctgggcaacatgtcaaaactccgtctctaaaaaaacatacaaaaattagccaggcgtggcagcaagcgcctctagtcccagctactcgggaggctgaggtgggaggatcacttgagcctgggaagcagaggttgcaatgagctgagatggcaccactgcactccagcctgggbgaccgggggcaaaaaaataataataataatgcagctgggcacactccaggagccagggtggggaagggagaggagaacattgagatggtataggtcattttaccctctattcctctcagtgaaagtacgttccagcttgagttttgagtttgctcctctctccaaccataacagttcctgcttccctgccttgggtaggtctgtggggcagctgcccttcatctcagtgcaggagcagccttttcagggttggacttatgagagatgttgtgctgatttccaccatggtgcccccctcccagggcttcacaagggcaacttggacacaatttttgctttccgtgatgtctttagaacttagctctcctgttagccgtgaccttactcactgtacgaaaagtcgaagcaaaggggtcacagagaaagatttctctgatgactgtgtagacagttggtccatggtgttgtggctggaggcctctgaatacccaccagactgaggagcctttgtcttaagacagagggaaggacatctgggagtgattgtgtcacccagagtggccagagatcaagccataggaaatgctgtctgtgaccaggattcatggatgtttttattttcctctctggagagcatgaattctggcaggcctgtgatctcttaaaacaatcaactcttcaattagaagttcatgatctttaatgggcttgagtccagttccaaaacaggccattgtcaaaacgtccaggaacagggatgaaacttgtttaaaagtttctattaagcaggactgaaaattccatttgtaaaaggatgcaactatgttttgtctttttgaatactcacagtacctaagaaagcatcacatatgataaagaaaaagactatggcaagtgagctttaaaaaaattctttttttgatgcattccatcagaaatcagtggaacatttcattgctgtctggctagccaactccgataaaataaggacttttaagggagatggaaagacacagcaggatatctgtaaagccagaatcatctggtggcaacatataattgtcctatggttgtaaccttgatagtgctgttaccatgggggttgggtggtggrgcgaagtgcatttcccaaaactgttggctagctgagggatgagagctccatccatgaaaaccagtcttccagaggaggatccccaaacccagagagctatttagagtttgaaacaaattgttctccttctcaaaagtggbagaatggttagaatcatcaactgcacagcctaggtcagaagtgaagtttgtcctgttttatgaagggaaagacacccttgtttagtgagcactgaccaagcactagataccccactgaatactccatatacataaaagcactgaagtatcttaccagctgcataaccttgagcaagttgcttaacatctctgcctgttttctcctctgtgaaatggggaaaataacagcagcaccttataaggttattttgcatattaattaattaatacatatccaagtgcttctaaaagtgcttagcatataaggaaacactcagtagtgaaaactagcattattatttcatttaatcctcaacaacactgagaataaatattcttatactctttttactgaggcggtgcagaggctcaggaaggccaggttacttgctcaaggctcatgttgtatgggaaagttaaagcttggaatgtctgattctacatcgcgctctcctcctgtacattggcttctgttgtctctgggttcagctatcagctggctctagaccagaggtactaaggctagagaccttgggtaaaaagtcttcctctctttgaaagccccaatccagagaggaggtagatgggcaaaaaatccaccagcaaagatagctgccatccctcccctccattctccccatgtgctgtctgacctggaggccttgttcaatagcttttcctcctggagacacaagcaatctgtcctgctgggtcagtggcagtccttgcattgagtcagcacattcttttttttttttttttttttttagacggagtttcgctcttgttgcccaggctggcaatggcacaatctcagctcaccataacctccacctcccgggctcaagcgattctcctgcctcagcctcccgagtagctggtgttacaggcatgcaccaccatgcctggctaattttctatttttagtaaagacagggtttctccatgttggtcaggctggtctcgagcttcccatcttggcctcccaaaatgttgggattacaggcatgaaccaccgcgcctggccgagtcagcacattctttatctatgtaggttgcattttctctccttggagagcctcagattcaatggtgagcttayggctggcatgccagcagtttcctaaaatgtaatatcatcactattattgttattatatgagggaaggtgaataggaactcatcagaaacctggaaaatgttgtcagaacattagccgtgtaatttttttccccttcattgtctgcaccagctctgaagaaaaaatgcagaagtttgttgatttggagtagctggcttttttttttttttttttagatggagttttgctcttgtcacccaggctggagtagagtggtgtgatctcagctcgctgcaaccttctccgcctgggttcaagcgattctcctgcctcagcctcccgagtagctgggattacaggtacccaccatcatgcccagctaatttttgtatttttttagtagagatggggtttcaccatgttgtccaggctagtctcgaactcctgacctcaggtgatccacccaccttggcctcccaaagtgctgggattacaggtgtgagccactgtgcctggcctagctggctttaatggttgctgtttctggaatctctggctataggaatggatttctcaatggtatattcttgaaagaaaggcaaaatgctcaaccaaatggaactttttgaataagagttgacagattgctcatccttgccctcctcagaacaagtgtttgccgtttctctgatgtgggccttctttttttttccgaaaaagtctcactttgttgcccaggctggagtacagtggcgctatcttggctcactacaatttccacctcccaggttccagtgattctcctgcctcactcagcctcctgagtagctgggattataggcgcccaccaccatgcccagctaatttttatattttttagtagagatggggtttcaccatattggccaggcgggtctcgaaatcctgatctcaagcaatccacctgccttggcctcccaaagtgctgggattacaggcgtgagccaccgtgcccagcctgatgtgggctttctaggagggggcagcagatgcctctcctcacatcccagccacgcatcaaggatgaatggacatgtgggtgtcttccgtgggagttacctggcggagggtgggatttaggccccagggaaggtgaggagcagtgtaagggacagtcacactctgggaaagacatcgaagggtgacatgcccttccagagagcccagcttctgttcacctgatgagaggtgacacaatgctacggtgttcattcgtttgacaaatgtggatggagcacttgctatgggtatgccagacctggtggaaatagacacataatgctgcatcacaatgctcccagtctagaaggggagacacacatgaaaacaggtatcactaactatagtcatgatcacgatgggaatatgagggagttccccggaagcacaagggaggcagcactctacatggtctgaggttgagttctcctagaagcagaccatgagacaaggatttgagtgcaaataattgagtgagcagtgcaggaaatgaagaagtaaggaagtacacagggaagcctgcggtgaggatgtgccatagcacttgtatatcagttacttactgctgtaacaaatcaccccagaactccatgacttaaaccagccaccatttgtttagctcctgattctgtggccagctgttgaggctaggctcagctgtttgggtcttctggtctcatttgggccccctcttgcatctgcaggcaacctcgggttggttgggtgcctggctgttggtttgtggttcgctggcgttcctccgcatggtctctcctcctccagcaggctagcccaggattactcttacagtgtggccagggcccaaaatggagagcagcagtgcactagacctcatgaggcctagttccagagcaaatatattctcacttttgctacattctgttgatcaaagcaaatgtcacagggtcgcatggaaataaactctgcttcctgatgggaggagctgcaaagtcacatggcaaagggtgtgatccagagaggctgtcaatcagtgcatcatcccctgctcccacagtggatgattggcactttgtcctgcagggaaacgtacctcttggaatgactatatctgagargtgaaggagctggagtgtttgtaccccaattcctgagattcactggttgagggctactctgggttaggtgggtggggacagttagctccctggcacttgcatccttgtctagctatgggaaaaggcccttagatacaaaaatgcagacactggcagctgaaagtcagcaaaagcattggggtcagggtggggagtgtgggaggggatggcagggacatggatgatatctcctgtacccgctttcttaaagactctcagttgatgaatttattctgaaattccaacaggagtatcatatcaccttttgacatggaggcttcttcccattagcttcctaggaatactttcatttcatgttttgccaaacacccaacattctccagtactatgataactattctctattgcattcgtctggacccttttttccccttcactagcaagcataacaatatattattgcacacatgcagaagggcatttggctttacagcaaacctatgaaccatgtatagggctccaagttttgttcccattcgctgaggacagcagcaaaggcagataagggatgtgtccacagcacgtccacaggcagagaggataagatccctgagccctgcatcatcctgggagtgacgtgggccaagcctagccatgcagcagaactctgtgtttcttaggagccctggctccagcgcagctcaggcgtaagcacaacccatgactctgggatgcccctcaattgtcttacaaagtaactcaggcattgatgtggggtagagacaagcccagcacacaagttcttccaggttgggggattttatgtgtgtacttggagccagagcatttctggtgcagaataggaagctgacagacagggattagagtcacttatctgaggtcaaaaaaattaaatagcagaggcaggagaaacacctggtgggaggctccaaagcctgatattctagcaatttgacccatgggccctcactttaaataaccattgcagcttggggaacctggcctgtctttaggtggaaacaagttttggaaattcctcctattgcagaaagcatttgatttgcaktttcctgaatgcgaggctccaagtgtagggaccgccacccaaggacgtttttctctgttgggcagactcaaagcactgagggragcttttcagggcccaccatacatgagcaacagatagctctccctacagataccatatttcagggacagccccttccctcctgagcagacactggctgagattttccagcttcgactttctagatggtgagaggatggggatgctcagagggacagtgaaggcactgaggcagtaactgtggcaaccatagaagaggctggccacgwgctcatagcggccttcctcctgagacacccgggaaggctgagtctacctcacaggtgtgcctgataaaatttttttgggcagtgttttccttggcttccaaacatagccatccattggaggttttatgtggaagcatctttccagcaggcacaatgacatggctatttcccttgtgactggacgcaaggaaaggatctatgaagagaatgtagccccgaatccctcccttctctcaacttggagcagacagggagccatgtgtggtttccttgctaagatttttgcagtttattctgtgtggctgtgtgtgttggtcccttgccaataatcctagactcacccatcccggcacaggcttktwwctgtgggccaagccaaattctgaagcagcgcagttgtttgttgtctgaactcagtcttccccaacacatacttttcttgttgtcctgcacacaccctctcatcagcacccctcccaagtttgttctgagccacctgatataacctcaggtgaacaagaaggctgccctgtggctcttcacggatgaaaagccaaaggcagctgtggcttcgstttgtccccagtagtcactggccacggtgakacctgggtttaacatgacctgcccataaatcagtttgctgcaattgcagtgagagggaaggtaccttgtagaaaacctctagattttatgagcttgtttccctgactgcattccagagccacgtgtgagacttgggtttaacgtgacctgtccgtaaatcattttgctgaaattgcagtgagagggaaggtaccaggtagagaacctctagattttatgagcttgcttccctgactccattccaggtgatcttgatccamaaatgacgaggctgggtggttgccattggtgtcacacccacatcccttgctgtgcaggtgcactgctcccagctgctgtgctggctgcwagctgctcacagtggcccgtcctttggtctggaaagtcacccttgccctgcctgggagggtgacttgttagccaatggctggctgatttggggtgtggattaactccctggtgcagtttatgctgcacagctccccttggtgtctggttgaggctagattccccctgtgcccacagccttggtccactcctgccctgtccctgccccagcctggttccctggctcgccaacagatccctggawctctgccacaagctctggcttccagggaagggagcctatcctgagatgcggtagaacctcatgttttatttatctgctcttagatctcctgtccgggcaggctgattgctttttaggattccaagtttcaaaaggaaatcaaatccaatgtatttatcagacattagtgggagagaaaaaaaaacagttgctcattggctttttatttgccctcttggaattgcagaggattttgttatttttatatttaaaaaccagacttgtggagtaatgtgtgggagaccccttcaggctggtccaggggactttgtgtctttagagattgctctggacacctcttccactgaggctttgtttttaaagaggactttccagacccaagggaatggaagggggctcccttgagagaaatggctttcatacaaaatgtccttactggtggggaactgaagacaggtacagtccttactgcataaggggacagatgatgttcagttacagtcataagcctttctcaccaggagcactggactctcctttaagaaagttttctgtgataatgagatttgaactggaagaaatgctgttctttcagttaacagttgtgttttttccaagaaaaaaaagaaatacaaatgttaaaacttttttttttttttctggtgctaaagaacaatttcacctcctaagccaagaaggaaaaaattctcatctaaaccgccaggcttaaaggtggctccttgtcagtcctgaggtggtagaattgaggtgaatgaagtcaaccacagtttctaatgtcttcttatatgccttcagaaacaccatgctcacctttcctcctgctgtcctaggctgagcctgccatccctccttccctctgtccatcacagcctccccttagggtcattaactcagtccctaccactcaccttcccataggacaggtgttcttaacctggagtctatgtcctcttgctgatctgtgaacccggataaggaaatgattgcattttgttttcastaacttcacactgaaatttaacatcatattcaattatgaatgtaggaaacagactacagtaatattaccaggacctgtgactctgtcccaaatagaaatcacaggtattgtcaaatcaagttagagttattgcagatatttcaaactaccatttacattcatccctccttcagagttatagcattagatttacctccagatctttttatttaatatgttttttttaaagcatattgctaaactacacatttgtgytctcccctttcccatagggctacctcacctcccaggagaaaagattcaaaatctaggagattcataatttcaatatattccattgcttgtgactatttatggccgtatttggttcctgagctagaaacagaaaagttatggccatgacagaattacttgtcaagggactatgatgrccctgctaacctgggctttcttgagctgtctgccccgctagctttgatgaaatgcacatacactgcttgcattttctgtgcaatggccaagtgtaacaggcagcacacatgtggcagatcgtagcagcgggcccttgccgggtcaagtcatacatcgctgcacaccggggctgtcttaggacattggacctccgagcagcctgcagatcttgggaattcctctgccccctaaagtattctttgtctttaatccagttgttacagtgagtgwacctgatttgttccagatgtcctaagatttagtgattccggaaactactcctaaagtcaaggctgatgaggatttgaattcctctgytagctgggaaccagcagttcttttcacagttaaacagatgaggcaggaggagggagactgagctgccttgagggacagggaggggcccactgactggcttatttgccttgttagaaagaggatggcctttgaagcaaatatcgattctaccactacatggctggggccaaagtcagctgggcagggacatggacgtgctattttttttaaagtaatacatatttaccttaattatctgaatgttgttgctagggaaaccactattttggctcagatcatcttagtaaatgcttttttctctcactttttgagcataaaactggcccaggtgggtacctatgagggaggtggaggtatttctggcttcctataagtgagtttttcaaaccagaaattcagtcccaggaatgatttccctgacccactgtaaattttaattgaggtgcgttacaggggtgcactatgatctctctctggagttaataaccatatggatctgttttgcctgattagaagggatttctaaagcatgatgagatggggaagcacaattcaaactacatggcatagtaactcactcccagaggaagttaaaacatgtatacatacatatagaatgttctgtttaatattattggtttatgcagtatttgaatatataaatatgaayataaagccacgtacagttatggatttaaaacaaaagcagaacttaattaatgttgctgtttggatttttttcaagtgtatttgaatgcagacaagtatccagatagatgctagtggaagtctgggacaagctgtataagggtatcaacccagggttcagctggagctgggccagactactaggttgtgtatttagagaaactagggcaggactgctggagaagaagctgagtggtgccaaggtagggcagtgatatggtttggctgtgtccccacctaaatctcgtcttgaattgtagctcccgtaattcccacatgttgtggcaggaacccggtgggaggtaaataaatcatgggggcgggtctttcctgtgttgttcttgtaatagtgaataagtctcacgagatctgatggttttataaaggggagttcccctgcacacactctcttgcctgccaccatgtaagacgtgactttscttctcattcaccttccgccatggttgtgaggcctccccagccatgtggaactgtgagtcaattaaacctctttcctttataaattacccagtctcaagtatatctttattagcagtatgagaacaggctaatacaggcgggataggcacacctgagaaggaggacagggtcagataaggtggtaagctttgaacagaagaaagcgtatcataggggatgttgagcttgttgggatgaggagcatccaatgggctagagcaggtggtttagggctgaggctgtaaaccacaggggattacctatgtttatctggggcaagttgcaggataaccacaggacaagactagtagttggmcagaaataccaatttttattattctagaatagattaaaatataaaataaaattagattttctctaatatatttagaattgaacctttttgggtacaatattcttttttagtatttcttggtgatttttttttttacaacaamaaatagagcaatacctttcttggttagtaaaataaatccctaaatatttgccacaatctctagaatcttctaaatcaggaaattttaatgattttcacagcagtgaaaattgatattcatattctaaataattccatgtttcactgaaatctgcaggaatcgaaaacaataggcagtcactaactaaaatgggacagcaagacagaaacagtttcctatccctgtaggaaagagaaatctcggagctttcattgcatgaaaaccgactccattttagtacctcgttgcactttaggctttccttgtccagagttctcacacatgacagtgagctccaactacaacctattccaagctgagagtaatggactgagaatctgaaaacatgacacatcaatccattccccacctttcccctgtgagactcaaaaaaacatttcccaggctcccttgcagataagcttcttgggaagttcagccagtggcatcactggtgtgagattggagaaagggaggaggagaaaagtcagggtgtttctcctyaactccactcactttaagcagcatctctggcagtagctacttctcctccaccgtcttagctccctcttggcagtcccagtcccagtyacaatcacaacacctcctccctcagtccctccaactctaagggtgtcagcagttgcttctgatctcagcttttccttatcttaccttgtttgctcttctggttcttttcacacctttgtacctggttccccattttaatcccttctatgaactacctggcatgggttctgctttcctctctggactctgactaatacatagtgggtttgaatcctggtactgccactagttactaaataagttattaagttgtctaccttatttagtcctcaatgtctttgcaaaatgggraggaggttggtctgtaatgaattctgagatcccttgaagctttgaaaatccgtgagtctctaaattttgatctcataatacatattcatgaaatgagtgtatttttctagctccattacagagatagtttttattatttgctttctaggacatggccttagccttcataatactgtttgtttacagatttcatgaaggcatttaccctggcattgtaccactaaaggctgatgttggcggcattattcttaggagacatagaaatgtkgtggttttgagaatgggcttttatattatttggcgtagattattaaagaacagttacctgtgtcatgaaggagaggcccccagactggcactttgaatgcaaattcttctgtgacaaatccaggggaytttggaataactctcagrtatggcagtagacttaactgtaaaagctcccagcccacagaggtgagcagaggctgaggagtaaacaccataccaacattctgggacaaaatagcctgaatgctgttgtaccttggaaatgcaatagcagctgccttcctaggtggggaagctgagagyagcctcttacaggagtgcatgccctatagacagaggctcatgaacttgtgcttgctgacatgtatatcttcttcagttggtccctagtgagtctacccaaagtgaattgcactggggaaattcagaaatatacacccctcagattcaacaagggtggtatcttgtgtgtttcctttaagttataccagtttatggcaggggcaatgttcaaaatagttaagaacctgcacagcatgagcacacctacctttaagaacagttgccagtcatagagaactggtacagctcccctggtgcaacccactgatggtcagtctggggccaggggtgtctttggtcacccacacccacatttggctggactgtgaggcctgggacttgaaccacatcagtagaaattgaggctatggcacctgggatgtctccttgtgacagttacgcaagaaggaaagtgaacagaatgtggatcccaagggttgggtagggtttgtccagagccttgggtcctttccagaaggagcttgggcccctgtaattcagagatattcagattaactgatctggtctcctgccagtgacaggcctcactcactggaccattctcctattcagaaagctgacataggatcctgtagcaggaatgatcagtgctggctgcatcccttttatatttatgtgctatgctggtatgcagctactagtaactatatctctttgccttttctgcctaccaagtatcttgccagaggtactgggagtagatgtgcagccccccgcctttgcagtagccctcaaccaatgactgactagagtggacacgtaaatattccctcatcccacaaatgggataactctgttctgctcatgtgttgcacagtttcccagagctccccagcaagattaagttccaggtgctcagggagctgactggcttgatgttgctgcctttgctggttgcctgtccttctgtgtytcactctaccccttccctactggtgttttatggaaccacctctggaataaacaacttgctttcaaacctgtctccagctctgcatctgggggcrcctgcactgacattctttattccctagatctgtgtggcttgctacttttttctcccaccacatcacaggtaatgaatgaggctcatttgcacaacatacaactttggacatcagattttggtgaaactcaaaattacttggtgagaaagaaaagcacacatatgttacgctttttttttcagcatttcacaatattcactaaagcattttataagcaagtgagttgtaggagctaaatatgatcaatttttaaaaactactttttttttttttttttttgagatggaatcttgctcttttgccagactggagtgcagtggtgtgatctcggctcactgcaatttctgcctcccgggttccagccattctcctgcctcagcctcctaagtagctgggactacaggtgtgyaccaccacacccagctgatttttgtatttttagtagagacagggtttcaccatgttggccaggatggtctcaatctcttgatctcatgatccacccgccttggcctcccaaagtgctgggattacaggcatgagtcatcacgcccggcccaaaactatttactttcatttttacccaaatttatttcccctggacgtctacttcacaagcagtaacataagcaagtatgtatcattaaagatttatcacaaatcaaccatattatatcgtaagtaaagtaaaactggtgaaacaaatttaatgcagtatatcccaaaagtaattatttgagcatgtaatcaatattaaaacaactgtggagatttttacatctttgagtatctgctgtctttgaaaactcatgtgtatgttaaacttaattcagaccagccacattttaagcgctcaaatgccacatgttatctgtagcaaccatatggggcagctctggtctagcacatgaacttcagagttgtcccactcaataggcaagggagctggggtaattatacagcagttcccatcagtcattgagggttgctgcagagcatgtcagaggcttaattcttaggcactttcctggcctgcagaaaaaagccctctgacaaagagatggggatactgactagatagaactgcagtctgtgcaggttacacagtgataagaccccaggtggaaccacttatagctgactacattttttaatatcttcactttggtgttttattattgtcaaattacttgcaataatgtatcttaagttggtcactcaagaaaacttggttaaattcatgggcctagaagatcaacatcaaatctttgtcttcaagacctaagggaatctggatgtgccctacacatatctacttgcctctcgctaatctttctgctaagagtgtccttctcctgcccctttccatgttatttctgcccaccttcatcctctgatcatgtttatttttctctctggctggaatgtactccctgtttttctgcccatcaataggcagagcattttacaagcaagtgagttttaggatcattctttcagatgtggctcaattgctacctgtctctggaagcttcatgtaataacttcagtcaacagtgatatcttttccctgagtttctcttgccccttgatcttcacctgttcctttggcaggtcttatcaacttcatggtttatttcctgggtaattcatttaccagcatgcattcaggaggtgcctgacagtcctcacttattccctgtagcttaattaacaccgtctcttaattcttcatgttataatcaatttatttggtattttttgctcatatctctcatagaaagacaacagatgagcaattttggttttatggtttactcatgtttgtaattttaaactctgaaaattgaaaagctttgatagttgtcaacaaagtacccagaaagaaggttgcccatgagagtggctaaagacatctagagtcatctcaaatgcctccacaaatttcaaagaaaattgtcaagagaaaagttaagcacctcagtagcatttgtaaagagatgacaccttatgttctaaatattctcccagtattctaaaatattctaaatgctaaggaaataaacacaattttatttataatcttatagccaagtatgtttcatatacattgatactatttagttgcatttttatatgctttaggagcaatgggaaaggcaaaggagcactgactggaccaggggttagagctctgcccttgtctgctgagtggccttggggaagtcatttaactgtctgcctttatctgcaaaatggtgacccaaatgggcccccttccagctgtcaaattccatgtctgattttatgatgtctgccctttttaagaatgggaagcattgtttgtgatttcacattgcaggggctatttacatgtatgatttgcatcattgattttatgatacattgttgagagtatctgtgattttttkggaagctgaatccttactgagggcatgctgcccctagttatgatattgctcctaggaagaataaaatctgcttcacaatgtcctttttggtatgatttccatgattgagaaaactggsgattgtatgtgtagtacatctggtttatccacttgtctgtccatggacactktgggttgtgtctacccttggctactgtgaatagtgctgctatgaacatgggggaacaaatgtctctktgagttcctgctttcagtwcaytgggtaataaacccaaaagtataattttygggttatatgacaattctatgtttaattattkkgagaaatgttcatattgttttccaagcagccactcgattttacgtycctmccaacagtgcacaagggtttwaattycyccacattcttgacaatycttgtcttctgtttttttgatagttgccatcctaatagtcatgaagtgggaaaaaatagttttwaaaaagtaacagatggataaacaactaagagaaagaaggaaggagtgaaggatggacggatggacagacttggctgccctatrctattatcctagtcatcattgttaaatatagttgtggttggtagatacaataccgataataataatgatggtgtaatgagaatttttttaatgcaaatatagttggatgcatttgattaacacttgtgctagcctttactcaggctagatttatgatggcagcaaaagaaaaggtcatggtttttatgtctaagacttaaggaaaatctaagtgatccaacagaatattattaagcaccatccaaaaaattatctggatagaagaggaaatttttgctttagttgccttagtgattcagcatatgtggttgatatggaaatgtattgcatttacccaacaaggaactttgaatggtaatcctaatgtacagtgatgaatgaggacagaaaacaagttctacagagattttctggcttgacacagctgccaagatgtcatcagtaacatcttccattgagtatagtgaatgaattggtgctaaacttaagtacaaacccaataacgcagtcaaaaaaaagccagctgctataagatatacttgggtaggatttttaataacaaatgagcaatatattttcagcaggctatatatatgctgtaagataagctttatagaagcagtacactttgtatcttatgttgactactaataatgattttcatwtaaaagcacagcaaagagatccatgtacaaagtaatataacccacttaaaagactgcacaagcaaattaaaataaatggggaaatttctcagggaataaaatttcttgaagattagaaacactgttcctcaataaataagcacccctggaatgtttagcacaaaaactctatgcttgatcgttttactatttcagcaggactgtcagagaggttggtctttgtggagtcctgttcctttcaggtgtttgtaaactttcttgccaaagcccttcccgactgagatggagttgatattagagccatggctgggacaaccttcatgccaaaggaggtgtgctgctagttgcaactcagaccctgcatggcccgggtgacctcagttgggtgggttcccctttctggggctcaacttcttcatctgtaaaatgtgaagggggagctgatgatctgttgtggggatgtcatggatgttcattcattcaagtgttcactgaacacctgctaggagagaccaacctctctgacagtcctgctgaaagatgaaaacaatcaggcacggggtttttatgctgaacattccacggtgcttagttatttattgaagaagaatctttctgatattcaaggaattttattccctgagaaattatgtgccaggcactactctgtcactaggagttcaacgataagcaaagccagagaagggtcctacccctgatgtttagattctagtaggggatagacagtcctcaaccaaaaagccccacaaacaaatgcataaccacaacttcgataagtgccatgaagggttgatggggcacatggkgggtggggggctcataatgggaggatttatttcacctaggsagggagatcaggaaggatcccctggggacatgatagtcagggggctggagaatgtgggttatgttggagaggaatgagttttgaagggataggagttgctgggttctcataccagcacagcgtcttctctctcttcatctcaatttcctcatctctctaatatgggcctaatatcaagaccctttctcagtgttgtgaggtttcagaaggatgacatatttgacaacacccaatatcatgctggcacatcacattttcatttcatttctaaaaataactttggaagcagagatrtgctgttttagtcaaagacttttttagctttggagaaagaatgaaaccccagctttgagactcctctaaaaaaaatctgagttcacattctgccctggaagttgcctggctgcttcccttaatcacagagccttgtttgaatcacttgactttgaaatcccaggaatgactttgctgtgtgattaagtgacagaggcccaaggtttggggattggcagaagtttagatgtccctggcctgatcccttaccctttacatataaggaaaggaagctgatcacatgaacaactaaactggaatgaggaggcagcccctcctccatggtcctgggctcatctatactgtctccctgccaaatattccatggaaaccttggacactgtctgatgtcaggactacttatgaatgcctgtccacttccttctcaagataaagctaggttagcactctctcataactcaagcctgaggtttattcttttaatcttccaaaagcaaacagaagaacagaaataacctatccactgtttaagattaaaatggccaacaataataaataattgccacaatagcttgagatcagggtcttaatttattggaggccgttcaagaatttgcagctcttaagttaatttttcacatcttgtttggatcctcagagcccgtgcttccaaagcaaggccatcatatttctcattgcacatgttattcttgttgatgtgccagacatgcaggagagtgaggtcctctcttcacagatgggtaatgaggattccacccccccagaaattagtatttcaaagtatttttgcctatggagattttgaagagttctcttcttttgcatggtgtattagctgtattaatggttgcaaacaagaaaaacgtatgctggttaatttaagcagaaaaggaatttattaaaaggatgtggggtggttcagagcatagacaagaaggctggggaaccaacacaggcaggaaacagaggaggcaagtcttagtccagggttccacctctgggccctttactcctctgtagctacttcagatgatccctggtgtctctgtgcaaccctcaaaatttgtagccctgggtgggagcatctgttctcacatcgctgccacttgatcacccttagatcacatgatttcacttaggcaagtgcccacaccctagtgatcaagaagaggggaaagagagggtctgccccctttctgctgatgtgccgccccacctatcttgagattcccccaaaacacgaggatgtcaggatgctgagtggccaaaaataacaacygttcattatacaaacccttatatccttaattacgtcttccattaactggttatccgattaaaactggccactcacatggatttattttgttcaaaggtcgcatcacacaataatcatcagtctctcatgcatcttcatccttgtcatcttcagcctcagccttatcaccgttctcatcctagccccgttcactcacccctgtcctgggcccccatttccctccatctcctcacctctcaaacgttcacctctttctcctccaactcccagtctttcaccctacttctatttcactacaaaatagaagcaatcacagaggaattcccgcatgttcctaccacccatctactaatgcatcttcagctcacctccagccaggcgagaacagtcattcatcagaccccagcaattgttgcctgtcgtgttttcattaattgttrcctctctaatggatcattcccattagcttgcaaatatgctatgataattcccatcttrataaaaaagagcaaaaaaactccctggagcccacttcccccaccagctaccatccaatttctctgttctcytttagagaaaaactcctccaaatagttgtctgtcctcattgcttccatttgttctcctcctacatctctgaaactctctccagttaggctttcctcccatcgtgccacttcagcagttcttatcaaggtcaccagtgacctccagaaggctgattccaatggccagttctaattattcccattgttctggcctgtctgccatattggacaaaattgatccttcctttcttgagactgtcctctgtgaccatgtggrtgactcctctctcrattttcctcttccttctctagccatgcttttccagtcttgttggctgacacctcctcatcttcaactcctaaatgtgagtcctcatttctatctatactcatttcctagtgatcgtttctagtctgtcccaaatgtatcctagcccagacccctccttcaactccagactcatgcatccacctgcctcaaaatctcctttaaaacccaataggcatttggattttctctgctgaaccttctcaacccagtctttcccatctcaataaatgacaacttttctcttctagttattgaatccaaaatccttgaagcagtccttgactcctcttttcctaacacccttcatcmagtccatgagraaaatctgttggcatgacctttgaaatgtgtccagaatatgaccccttctcaccccctcagctgccatcaccctggccttcacgttcatcttctcacacctggattgtcacaagagcctcctactcaggccccctgttcctctcctggccactccacagaccgttcacatcatagccaatgcgagcctcctttaaacactaacgtcaagtcacgctgctcctctgctcagagccctgaaggggcttccgagggtcaaaccaaggtccctgtgctggccctcaaggccctgtgggatctgctgccccaactccctcagtccctctgagctcaatccttcctgctctctttatcactcctctccagctgcactgacctccttgctgttacctgcacatgccaggcacacgcccacctcaggacttctcctttgctagtccccacataccgtgtttcttgctccccttctttcttcgggtttgtactgagaagtcacctcatcagtgagacttccctgatcaccttattgtaaattgcaccccacctcccttgtaagtctggcatgttctatcttccttaccctttgtaagttttctccacagttcttaccacaatctgacagacatatttgcttctttctatgtgtgttttctctctccctgaagctaccaggactctgttttctttgctgctacttccctagcacggagtagtggctggcacatggtaggcactcagaaataaccgcatgaattcatgtacaaatgaatcccacgcttaggttgttaagtgccttatagtttttgaagtttgatgtacaagatttcatgtgagcctctaaacagtctagtgagttaggcaaggtagaaccctgtgctttacatgaggaagctgaggccctagagctaactgattgcccaaggrcacatggctagttaatggggctcctggaacttgtagttctgatctcggtttctgccccccaccttcaactaccccctgtgcctcatgttatattagtgtaggcctcagggcattcattgctgtctatttttcgttacagtatggatgagaaaaccctgtatctagctttgggggctgtgaagaacatctccctaaacatctctatctccaacctcggagatgatgcctatgatgccaacgtgtccttcaatgttycccgggagctcytcttcatcaacatgtggcagmaggtaaggagggcatccctgtaaaaagagcagttgttccatctggtgcgcttgctgactttcattattgcctggamtaggcaatgattctacaagcactaatcctttctgtggactatcatttagaatgattagaacttttttcttcctgggcttagaaaacatgttggtatagccaaagaagcagccgtaaatgcccacagagtgccagagaagtgtctgtatttatgtagtctcccatcccttctctcttgtggaatcctctccctatggttttacatctggccccttcttggagatgatacagttgctgtctccagcacacacatgttctagagaattccagttttaggtcagtagttgtgaaagtaagggcagatcactgcttgtcgtgttagttattatgtatgatgtacttgatgtttctagtagagggtcactgctttggcctgtgctttggattatttatttatttattttttgagacaagtctcgctctgtcacccaggctggagtgcagtgccacaatctyggctcactgcracctccacctcctgagttcaagtgatcctcccacctcatcctcccgagtagctgggactacaggtgtgcacctggctaatttttgtattttttggtagagacagggttttgccatgttggccaggctggtctggaaatcctgacctcaagtgatccgcctgcctcagcctcccaaagtgctgggattacaggtgtgacccaccgcccctggccttcctaacatatttgagtgaattgaggtagttaaattatttccacaaattgagtgagtttttttagagtaaattaatttgaatgaagtgaagtttatatagcatgactcaaaggtacagtgctggtattctcccctacccataatcatcccgagtgtaccacctctcagaggaagtgaacaggcttccctgcagacaacaagggggaacaagtggacaaaagtcgactstgctctacccagtgttgctctaactgctgatagctgttcagctgggactgcttgcagctttttaatatttacagcattgaacrgggttgccttgttctttatgttaaaatggraccaaaatcactttctgtggaaaaccttcactctgcccaccgatgagcactgggcatacattgagcaggtcaacggcgtttgttcaggcacatattctgtggcctcaatagtgttgacaggtttgtgccaagcctgcccagcttaggggacagctgaaatgctcagagccaccaacagtagaggcacyccaaaactttccaagaagtcatctcagattccctgctgcttcrtagcttttaggagctccagggttgagggaggccmcaaaagcaatcaaggactgcaggaggggtgtgctttccatccactttctatattctaaaaattaccgctggattaagcccagtcaagagagaaccaagtatctgtatggwycaagtatcgctggccacacacacagtatcttttacagaatcgcatgtgctgtgatgccatctccctgtgcagggtgggttggtaggtgggggaaaggggcttccttggggatttgayctgtggaactcatctctgtggtaactgaaaagatgtarttggcaactggctcattacattacacagatttctctcactcaggacccatgcgagaaatttccttccagcctcatttaagctatttccagacttagaaatagctgtccctttgcctgagaattttggcttgtttttaccttgtgactgactaggcttcattctctttattggctgctagaaagctcagagctgaccccactctgtcagtatataggacttagtcttactattttataaactcactagcctcctgtatcttgctttgctccccctttaccatgcttttctttttagcttggagattgcataatattctaccatatggatatactgtggatttaccttaaaaattcctcttattctgtatttaggttattcccagtttctatattaagtaaaattgtgagaaatgtcttttatggagattagtaccagtaaatgatcatatycttagctctataacttttcagagggtgtgaagtcacatttttgaccacctactatacaccagggactttttgcatctcgtccgcatcccctcttcactgcatgaggcacaatgtgtgtgaattattggaggagcactctcaggagaagaggggcgagggagcagggaggggcaggggatgggctgggagggatgtgctgtygggtcaaagctagccttggtctgatttatgggctgggaagaggtggggaagccctggagcataaatcactctgcagaattgtccccccttgaagctgctggggacagcatcattttctacccctgtatcgtcattggccactggagggacgcaggcgtggtgagtagcctcccaagcatgctggacaaggaggctctaggaagtcaaagacaatgtgcctgggaaggccacaggtacaagccattgrccactgtagctggccatgggaaaaatgggagcacatcattttgatctctttgccattgaattccagcaacctttgaaacctttgtcacaaggaaccctaggtttcagttcgacagaaacttgacaaagcatcaggctcttcgggacgtggtgagtgttagctccagagtggtgatggagcagggaggtatcttgtagctgctgtggaggcagggccagccagaaacgcagatgggcaagacgaccctcagggtggcaggaaaaggaagggaaaagaaacagaaactacccttccaggactccagccacgctgcaaggttgataaacagcggatgtaaatggcatyacccagcmccgggtaggattctgacaggacccagtggctagtgaggggcaccaggagagcccccccaacctgcttaacaacccacaggcctaacaggaccaacatgggcctgtgaaatattctaatgggtaaactaagaaaagcatgactaagatacagagggaaagcataagttttaaaaagattattaatagaaaacaaaagtaaattttacagagcatctactttttgatgaaagtcaaaaaaaatgaacaaagtggaagatcagacagtagaacaatagactgtatgaaaatggaatggactgggaggcaagcaaaaataaatgttatggatgggataaagaaatgttacaatgaaaccaggaaatcagtggcagaattaaaatatgttatagtcaggaaagagcagaatcagcagaacagraaattgatttaatgatgyggaggtgtttttgagargctctgagaattcagagaaaaagaacaaagcaataaaaaaggatgacatgaggactatattgtggaaggtrgaaactggaaaacagcaaagagraaatggttccagaataattggracagaagccattccttagacagcaaaggaggatctccatttcctgaaatgggtgcagcagacaccaggcaaaaatatttaaaacattttaatgtctacaaatagcttcatgaaatttttaattttaaggatatgaaaatgwtactattaacacttagcagaaaacaaagaaaccagtttctacagacttttctgtaacattaatgtccaaaattagaacagtatattccattgtgaattttaaattcaacacacagccaacttgccctccattgtgacgtcaaaataaagatatactcagatatatgagaattcataggctattacctcttccagtttggayttccccaaaagcataccctgatacaatgatacaggtacaggtagtttatttgggggtgggcgatctcagtgktgagtttagacaggaaagagaggaaagacaggaaggcrtgcatttataagcaggttactgccgtaggcaccttgggcttgtcttcctcagaccctccaagagactgtgtgtaacaaacctcacatccacttcactccaggatgaggaagctgctggaggaccgatcccccagctcctgtcattcatcatggagaaccattccctgggcatgaactctctggcacttccagccttctctaagtaggtccacactscctggggccaggaagcaactcaggcagaaagatgtgggaagcctttgacctggaggggcatggcttcaggtgaccagaactgtggctggttctggggaatgtgagcgaggtgctrgccacatstgctatagtaaccatgagagcttcctgaaaagtagttatttactgataaactactcaagaatacaaaagtagttgaataaaaagtgtgccacagccaaataagcatagaatgaagcaaaacaatttttataaatatttacaatagtaagcaaatgtaaaaaaaagtattgccatggtaaatgcataatttaaaagattaataaaaataatcccataatctcagttataccaataacaatttgagaagaaagttgacattgtgactcctctgcttcactttcttcaggaaggagttcagactcctcagctcctcatgagaggccgtcctgagcctggtcctgcctgcctgcctttctccccagacccctggctcaccatgcccccacatactcacttgaatcagtcgccacttaataccaaagctgcctttacccaggaatcacccccaccccccatttttgtttaatgaactactatgtccttaaatctcagcttagggagcccgtgtgcaggctcctcacctggctgcacaggatctgtccacagaatagatrgatggatggatggatgggtgggtgggtggctgaatggttagataggtaggtaggtagatgactggctgggtgactgggtggatgagtgggtggatagttatgtggataggtgagtggggatggctgrctgggtggatgagtgggtatgtgggtggatgggcaggtgagtggatgactggctgggtggatgggtgtgtgagtggatggctggctgggtggatgagtggatgggtgagtggatggctggctgggtggatgggtgggcgggtaggtggatggatgattattcattttgtgcaaagttacagagactcaaggcccaggcctccaaggttacctatcttctctgtcatcacacagtccattagttatgtattagcttctaagactgaatacaaaatatcccctgcaatggatttttctgtcttctaatgcaaaactactttcatagatttattctggattattttttcctttgagggaaggctgcttataaaaacatggggtrcacatggatgaccatctgctggcttttttctctcctaaataaagctaacttgaaaacacattataaaagagggcttaatttgttggtggctactctgctggctggcgtgtgctgtccagccagagcacagggtattatggccagcaactgggtttcctcaggggcaggcccagtgcaycgtgttgcctgccgggcaaggaaccagcaaagcctcactacagagtgacaattcctggggtgccctgtgggagcagtgagagggagntcctggggccgggggrtgctgcatggttaaaaaggagcataaggaagaatagataaccactgcatcacaccagggtcaccattcacactgggttccatgtaaacgacacctccacagaatataatgtgagtggtgtccctggagatgtacagctctatggccctggagtcaaggtaaagcctcattttaatwttttgcccyggagccgtttggcacaaaggactttggctcttcttgcctttgtcaaacagccatgaatttgtttggacagcagttgttgaatgcctgctaaatgctagggactgttccagccacaaggagamacaaagatctagtccctgctcccagggagctcatggcctattggggccaaaggcatgtcagtaagcaattaaagcacaaggtgccagctgctctacagaggtgctgaaacgttgtttgaagcacagatatgacaaggtgaagcaagtcattaccacagtggctagtgccatgttggacagaatccttggataagtgcttaaggtacatggatgagcctccaaaggatctgatgtcagctgattcctacattgcagagctagggtgggtggaatgagtcagtttatttggctggtgaaggaggaacctaggttggagcagggatgagagggtagaagagagcaaaggaggaggggcaggagagaaccyrgtaggatggaaagaggctgcccatgttgaacaaagggccagtaacatttctkgtggcagggagatgtcaggacattttagaaatctgatgcctgctgttacaggcctgtcaggactttaccactcataggttctaagaaatctcccctccccacctcattctgttttgtttttagyccattctggatttctgcactcatgcatgcctcatgtgaccagggataggcagggagaaaaactcaaggggctggggttatgtgtacatcttcatggtattgactgttatggcatgcatggaaacagacctggacatgaaaggataagcttcaagccaggtgcatgagggctcccagctgacttttgggtgcamacaggatgcaacagcttgccacagagtgatagaggaggccatgctaggagagaagggagaacaagcagggcaggcaccctggcccgactcttacacacagtgtgagatgctctcttggtttgggtctcccagatggcgaggaattcagggaaatttctttatttgggagatgcaagaaataatggtagggggttgaagtgatatagtagggaggtgaaacaatggtagggaggtgaagttatataggcaggaggcagtgaatgaaaagtgagctgttaaaccaactactacagtgggcaatgggscttattcctgcagggcaacactaggaagagtaagggagctgggggttttatactcctttccccaagtgtcaagaattgaggtctcctggggctatttatattctccagtactcctgccctcccatatgcatggcaggagagacctacatggttttggaaaaatgctcttgggtgcagagatgccgtaatatagcccctggcagctggaagtgggctggagcaccctgagagtgcaagtaatgtggtcagggctcaccagcctctgccagagaggcccacaggattagaagtatctctaacctgagcacctcactttctagactcctagaagttgtgggttggtctgatagagcctcgctgaggttcttatacaagatctagtagcatacacctcacagtgtgcaggagttgggtgaggcaggtgtggtatgtgggtgaagaggaccagggtggggcaggaggaagcagtgaagacagtgggaagatggagggttccagcttcmcccacagggcagcaggctcacagcagcattcagtggttgccaggtgggagtgaggcccagcacactctattttctaataaaaccgagagatcttatgactttggcagctaattaaaatgttttctgaacatcgtatgagccaaacaaaacatgtccagtgaccacctccagcctgcaggccaccagcctgtgacctccagcctggctgttttccgtatgttctagtccggatctgcatttctggtagaactagtctgtctgcagccttactgtgtttcatgttctccccttggcaacagataaattagtcaaagagatgagagtttggggcttcaagtgtccgagtgtctggggaaggagaggagtggagagggtcaaccggaatgtagtgtccatggaatttttagaactcatgatgttttgaaaactatttgctggctggaatatttgtacttcacagtgattgcaagaagcagctaaactggagtttgaattttagaagctgctagaagtaaaataacaggcaaccagtgtgaaatagagggaaagtgtagctttggtgaccagcagatgcagagttgagattccaactctgtttcttgtggccagtgtggccttggctcaagggtcttctctctgtgcctcagtttctttctctataaagtgggattgtgccaaggattaaatgagtcctacaccatcatgtacagtcccacttgtatatgatgggtactaccatggtagtcccgactctgccacacatgagcttatactttatagctcattcatttactcagaagagatatactgatcacctacttcagaccaagattaaatgctgagggggaagaggaaaataaggcaagaatataaaacatagaatgtatgtcagggggtgataactcttccttttaagccaaaaattatcagtcattgtcttaatgaaggattgagagagagagwgwgtgtgtgtgtgtgtgtgtgtgtgtgtgtgtgtctacatactgtaaaaaaaaatagagacagtgttaaactgacatctcttaatttaatgagttgcttgtacttaagaaaataaaattatatgaaaattaatgtgaagcagtaaatataggtcagtcaataaatgtctgtgttggcttttgtgactcctgattttattaaaataatgcttgttgattttttttttcccatttacttaccattttgcttaagtattggagtttttggtttagggatattgactttttaaaaccaagatatataattgttcaaatatgtgatgcacgtaatacataatagcgaagtttagataatgaggagaataatgccctccaaaaacaatggcagggggctaggtcctgactctttcagactgggcagggaggcatctggcccaaagggctggaggagtgcggtatgggattcagactttttatcaggtaggcagtaagtgaggtcttgactgagagaacagagaacgaagracagaggctagagacatcttagaggaagaacaaagaaacagtgctgacaggccaggaaggtcagagactcagtgttgggactgctggaagaaagacaagtgaggaagaggggtgattgtgaactcagcagggagaacccagatcctctactcctgatcatgctctagcgcacagagcactgtaagctcgtgaggaatgtgcttcgyacctggcatcggttggccataagtcactgaatttggstaataagatgttgcattgtctctgatctccttgagagactgagatagatggataggccctaggtccttatttcctccatgggagggtattgtgggaggggtgatgatgttcgaagggaagctcatttttgctgtttctaaggagtataatttgagttccaaattaaactggtcttccaagttggggtttggaggcagtaaagcaccaggtcaactttcaaggctttcagtggctaattttttatgacagaaggcatcgagggcttgtaagtttgtttttcttatcaagtgattcttcagattatatctacctttaccacagaaagggtggtccctttctttcaggagtggttctctcttcactttcaaggcaaaccgctcaagatggcaccaggtgataaaacagatccacttgctaatctggatagagcaggaaggacttaaacatttatgtgtttgtatacctttatttgagggagtgctttggcctgtttttagacagaaggttccatacagaaactgcatctgggcaggagaacaaagcaaattgtgttacagccgggaaaccaagcattgagcaacagaatggttcttaggcagaagtgagcctcatccctcagtgctgggacagattacagccttccttcactgccgctttcattcagcgcagggactgattttcattgtgttctgctttctctggtgtctcttgtcaagttaatagtagcctcaagtaaaattcaacccttagatgtttatagtcatcttggcctggccattaagatgatgaatgaacttgctgcttgccctggtaagagagccctgagggtggatgccgatacttagaaaataataagtcttttccgcccccttcctgtctttaatccagtgccccaagccccctggtgactttaccttgaacttcctgtataacgccaggtagaaaagcctcaccykgctggaagcccactcgaggctctaacacaacagcaagctctttatcttgctttgttggtcttccccatccgcttatcagatggaaactcggcattcctcagagacccttcagtgtttctcagttgcttctgcaggcccttcccttcctccttgagaggacaagagaaggtggcggggagcaggcacccccagcctgtgtttgtatttcctcacctggattacctgtggcccttgcatcagggagagcccagccttgagtgaaactgcctgggagacaggctgggcgcttcctgcggcagtcggcagtgaggaagtggtggagaaacgcagatgtccatttcaaatcacaaggcggcttcagtattccrccgcggggctcagctttcacgtatatgaaaagcttcatttgtgtattcactgcgtttggaaggaaggctatgttttgctttagaaatgtcaacagagctgtagttacgacaaggatcaattaagaaggacgtttcccagagccgcaagacttgagtgaatctgtggggggaatttagaaaacatgtgttaaacctctagatttctttttttctaactaactgcaaaacagcaatttaataatttcctcttttaaggggaaaggggggagtcttggattttaaatcttcctaaagcagcacagcatctcttgaaaagaaagccatgaaagactactaagctaaggcgaataaaataaaattttcaaaaatcgagaacttcagtgtcctagtctgggtttccctgagcagatcctgagatgagggctcacatgcaagtggttcataaaggatgtgtttccgggggaagacaggtagggagtggagagacgcaggacagggcaggactgaaactcaggcagggtccctcagagcgtggcctcagcctgatgctgcaagggggatcagaggtgtgagttacgccaaggtactgttccatctccagcttaggaagctgagttttgttctcccrtaaacaccagtcattggttaagggccacttagggaggaataagtggtagaaagtggtcctaggcactttccacccaggggtgaagtgtagacagtggggcttcaatagcttaagggcagaagaagacccacggttctggctcttggagccaaacgaagactgaagccacagtgtgcatrtaaagggagtccaaggagcattgggtggggcattgaaattgtttgctacagtcggtttaccttyaactggtttccttcttgttctgaaggatatattacaagcatattgacaaaagtctttgaactcttgaggtgtttgtatgatattctgtgtcagttgcacatgggatgtttctaccagcatctgaattggggaattgacatatacagatgcccgtggaatttaacagagaatgtgaatgtacggctacagtccgtcaccatccagcttgccagggctgtcatttcatccttttgaggccaggcttacagacagtctgggcttccactgcccccatgctctgcctgtgatgtgtggtggcctctggcattgttgtaactcaggcacctgagcataactagtgagcctgtcctgctctcccaagcaagtctgtgtttaaaatcagttaggaatatgttgggctgcatgtaacagaaaagccaccttttttagcagctgatccttgtgagacttttatttttctttggtaataataaaataagaaatgggcatttcagggctagtatgcacctgtgtggtacccacaggaaccccattccttctgtctttcctctmagcctgtcttcataggggttttcatctccatactccaaggctgggctttccctgatggtgctttttggtttccgcttccaacactacagctgcattccaagcaagaaggagaaggacaaagggcaaaaggtctgcctccttttaaagagctttcctaaagctccacttgacattttccacatatatctcattggccagcaccatgccacaaggtggggtggcaaatgaattttctcagctgggcacattgctactctagacagagtcagagttgtgtttattgggaggaagggaagagtggccattgggaagcaccagcagagtcagcagggcagagacctgagagaggtagtttgtgagtgtgtatccctgagatacgtagcagaactggggaaggactgcccagtgagtctactcccttcagtatttgtcagatcytgctcaattataagatgatctttatctgtccgccttatctatcttcactgacgtgtatttcttattttcacaaaatgaagccatttcaacgatgttgtcaatgtgtttggatttctgtccttcaacagaggtgccacagctccatactaggtcaatccatgcaataaagaccaagttccagaacccctgtccttcagaccatttggtatatataatttccaggcccttcttcactgttctgtttatcactccctgtgctgtctctagtttggcatcttcctttttaaaatagaacccaggcttgaactgcaattcaaccagcccagcatagttattattgtcccgagtctaaacatgatatttctgttaatgtggtagccacagcacaattctatttattcttgaggcattccctcttttattttcttggtctttttgtgttatttggaagtgtaatcatgtcatttatacccttgctactcgaatatggtccatgaaccagcatggtgacgtcacctgggagtgtgttagaaatgcagaatctcaggccgcagccctccggggtcaggatatgcattttaacaagatcgttgggtatctgtatgaaaatgaaaaattgaaaccagggcgagatatccagggcctcagaggaaaatctcaaaatggtcagggaggtcccttcttagagatgagaaagtcactcagaggctgccatggcctaagactgagacaaagagaatatgtctgtatacaactaaagaaaaagagaaaaggttcgctgggccagagagtggctagagactcgattgtactcagacttgctgtattaccaacaggtaatgtacaggacagtcatgacctacacctggctaaatccagtagtcatttttcagtcttctttctggacccgtcagcatctattagtacaaataacgactacktctgttattattattattattattattattattattattattattatactttaagttctagggtacatgtgcacaacgtgcaggtttgttacataggtatacatgtgccatgttggtttgctgcacccattaactcatcatttacattagatatttctcctaatgctgtccctccccttgccyccaaccccacgacaggcccccatgtgtgatgttccccttcttgtgtccaagtgttctcattgttcaattcccacctatgagtgagaacatggggtgtttggttttctatccttgtgatagtttgctcagaatgatggtttccagcttcatccatgtccctgcaaaggacatgaactcatccctttttatggctacatagtattccatggtgtatatgtgccacattttcttaatctagtctattattgatggacatttgggttggttccaagtttttgctrttggaaatagtgctgcaataaacatacgtgtgcatgttctttatagcagcatgatttataatcctttgggtatacacccaataatgggatggctgggtcaaatggtgtttctagttctagatccttgaggaatcaccacactgtcttccacaatggttgaactagttgacagtcccaccaacagtgtaaaagcattcctatttctccacatcctctccagcatctgtggtttcctgactttttaatgatygccattctaactggtgtgagatgatatcttattgtggttttgatttgcatttctctgatggccagtgatgatgagcattttttcatgtgtcttttggctgcataaatgtcttcttttgagaagtgtctgttcatatcctttgcccacttttggatggcattgtttgttttttttcttgtacatttgtttaagttctttgtagattctggatattagccctttgtcagatgggtagattgcaaaaattttctcccattttgtaggttgcctgttcactctgatggtagtttcctttgctgtgcagaagctctttagtttaattagatcccatttgtcaattttggcttttgttgccattgcttttggtgttttagacatgaagtccttgcctatgcctatgtcctgaatgatattgyctaggttttmttctagggtttttatggttttaggtctaacatctaagtttttaatctatcttgaattaatttttgtataagrtgtaaggaagagatcccgttttccatcatatgaatatgccacaatatgttttctccattatcctgatgatggacattgaagttgtttctggttttatcttttgtgaataaggatactaagaacatttttataccagttttcgtgtgcatgttttttttcatttattgagtaaatgctagtgagtgtaggtgctggctcaaagggtcactgtttagctttattagaaactgccaaatagcttttcaaagtggttctgccttttacaccctcaccagcaatgtataagagtttgagttggtccccatccttgtatattcagtattgtcagtcattttwattttagccattctggtgtrtaattgtgtttctttgtgatttagagctgcatctcccatatgactaataaacacgttttcacgtgcccctcagccattggracacttattttagcctgttcaagtcttctgcactcccttcttctggggatacttttctyctcctgtgctgtggtacactcctcaccccaattcttctcactcgccactccttttctgcttcctttgttggggtctccttatcttgccaacctttcaacattggagagcctcagggtgcggtcctgagaatgcttttcttctgtgtatacgcattccctggatgaactggtcaagtctcataacttcatatcatggacatgctgacaactcccaaattttcccctccagcccagagctcactcctgaactccagcgttgggtaccaaattgcctgtttggcctctccacttgctgtctaacacatttctcacacttaagatgtccaaaatgagttcctgatcctcctgacacctgttccatttgtaggaaacagtaactccatccttcttggctctcccttttctctcatacaccacatctatttctcaaacaccctgttggctgatcctacagagtatctcataatccagccagttctcaccatcaccattggttccatcttggtccaagtcaccatcgtcttttgcctcattattgattggcaatagccttcttcataattggtttccgtgcttccacctttacctcttacactcctcctcttacactcctttgctcagaagtctccagtggcttctcatctcattgtaaagcttagttttttataatacctctaaggccctagaagatctgaccccgttgctgcctctctgaacatgtgtcctgtcactttcttccttgtagcctcagtggcctccttctgttccttgaaacacactaagcttatccctgcctcagggcgttgacactggctcttcccttaaataggcacatagcccactccccatttccttcttgtctgtgcttaaatgtcacctgattagaaatatcctactactccaaacaccctatctgtcctctttatcttgcttttctctatagaacctatgaccatctggcatactatttttttgttttgttttcttgaaacagagtctccctctgtcacccagactggagtgcagtggcatgatcttggctcactgcaacctccgcctccctggttcaagcaattctcctcctcaacctcccaagtagctgggattataggtgcatgctaccatgctcagctaattttttgtctttttagtagagatggggtttcaccatgttggctaggctggtctcgaattcctggcctcaagtgatcctccctccttggcctcccaaagtgctgggatgacaggtgtgagccactgcacctagccggacatactatttgtttgttgctggttgtcttagtcctcctacyggaattaggttaggtttctacatataatatgcaatgacttttttgagacaaggtctcactctgttgcccaggatagagtgcagtgacatgatcttggctcactgcaacctccacctcccaggctcaagcgatcctcccagcctccggagtagttgggaatacaggcatgcaccaccacacctggstaatttttgtattttctgtagagatgggggttttgccatgttgcccaggctggtcttgaactcytgagctcaagtgatccacccacctcagcctcccaaagtgctggrgattacagagtgagccaccacacccrgcctggaatgactttttattcattgattcatacctagtaactgcagcagtgcctggatgtgtggtaggatctcaatctttgttgaataaactaatggatggtgggcaaataaatggatagaagatgggtatatctatctttctctgtactttatgagcactctttcaattattgttttatattacaccagtaatttttaagtagtgttaaaaactagtaaacaatgtaggggtttggagaaaaatgctaattccttatctcccrgaaaagggaaaccatcaggaatcagaaatggagaaatgcttcccccacctggtgattgcatcttgctgtatgggatcaggcctgaaaagtgagttaagtctgttggtgctggaactcatcactgaggarcagcctatgtctgtgccttcaggggtgacagacagtggaccaaggccatgcctgcatattcctccctggacccctcattcaaagccagaatctctttcctgccagagcagtcctttgtccacrtgggtttctgcagtagcccaagtttgcaggcccttgatagggctggagtgtgagctgtaatcctatgggcttgaaataatctctgctatgggctctttaaaataaccccaagtaacactcatgtcttatttaggtatccccagaagcaaaccctgagataagaattcaagtgtaaagtacctgtagtttgtttgggaggtgaagatagggggatatattaggaagtgagacagagaaaagaaaacaggagaaaaggacagagtgtcaagccagccacaactatgggcagctgggcttactcccactggggaaccctgggtccacagagcaagctccttggggttcttctgcctgcgtggtgaggagtctggggcctttatccacctgctcccagcagctgttgattgagggctgctcctgaaggcattaagatcttgacacttctggcctgttgtttgcaggggcagagcagttttatgacaagaaaaagtcctcaggtgaaaaaatgcaggtgtcagcaggtggagacacagggcaggggatctggaggaacatcagtggggtctgcgacaacctgtgaccacctcacagacaaggtgacttctggcttctcagtgmctcagccacacttctctttttcactcactcttctttctggtcctcactaagacaaaatacagaatacagagcagcagttcacgggctatagcatttraggagattaaatacaggcctccaaccacacaggccatctggaagctttggcctccagatgaggacataacgaggtcatctctgctttcagggagctctcagagtctcaggaacagatgtacatggtccatcagagtgtggctcagggcccagggtgggttggggaaaaggtgagttatttagcattggaggagcctgtttgtagccatggctgccaacatgcatgagccacttagaagggcttagggtggtgagggtacaggtctacctgtgaagctgagtgatagtcacrgtaattacagtcacctactatagcctcacaatgagccattataaaaatgaggaaactggggctccagaaagatttctcagccccaggacggtgcagccaggaaatatcatagctgggatttgagcccagcttgtctggacactgagcctgtgttttgcacactatgcacacacttctcccagatgaagatttgccttcatccaaggggaatgtctgtgtgagacagtggcagcctctgatgggttcctgccgattggcaaggtggttagagctgtgtattgagaggtcttctccaaggtatcagttttyctctgggagggttaaagaaggaccttgcaaagcccatggcctttgaatagagagctctgttctgtttgcagtgactcccctcaaaaggcagaatgcaattctctaaagggaaaaaaaaatgaggtggctgctctctggggttaagcagagaaaaccgtcaggcaggagaggtggggctgtatttgagagggtgggagtggcccaggagacctcacggtacagtcagctgcaggagaggagctgctaaccctcatcttaagaatatcactctcttgacaatcacagttgggaaatgtgtaatctcagggtgcctccttgcccgggcatcttcattataaaagcttagtctttctaaatgcagccaagctctcctctgacaagagatgtgagaattccgttgacactcactgaccacctagaaaccagagacccagaaacccaaaggtgggtcacatggtcgccctgtccctggggaatgcacaggaaaagagctctgcctcccggaaggttccaggtgttggggtaaatagagatcctgctgctgcctctactcccttactggtctccctggggacrtatttgaacatattttactcataaattctcatctcagggtctgtttctaaccagacctaaaacagacaggtcccccccttttttaatcagtaactttggtttattacagcagaaacttcccaaattactgatctgaccaattagatatgttttaatttttttatgaccggaatcttttccttcaaatgaacctgtttggattctcttatctgtgcaatacaacctaatgtaagtctactttgtaagtatttgttctgagattatttgttctgaaggaggcccaatccagttcagttaaatctgaagtttttgatcaattgggttgctgagattacaactttctttttcattaactattagtacttaaaatattgacatgctaagtttttagtcttctcttttttgacctataaaaaaggtcaattatatcttaaaagtttcaccttctatttggctattgtgtatcattctttaaatatctggctgggttcaacttgctaagattttatttagtatatttgtatctatagtcataaacaagatttcyctgtaatttyctttcttgtcaggttttggtgtcagatttctgctagtgtttgcaaaaataagcagraagcttgcacttttctctgttctctgaagrcatacaaccaacatagttgcaacagcaggcagtgagagctgacccttactgagascttgtttatgtgccagaggctgctcaacactttttattaacgtgtttaaccctcacagcaacccagtgaggtatgtgcagttaccatctcagttttcctgatgaggaaaccatggcttagcaagcttaaggaggtgactcaacttccttagtgagtggtggggctgggattcaggcacaggcaggctggtacttaatctctctcctacaaataccagcttccttggtgagtattggggctggggttcaggsacaggcaggctgactccagtgtgctctaatgcatcttctttgcataaagaggcttatttacatgtcttttggggtatgctggctgctcacgtggctttgtagacattaccctctggagtgccaggtgctttgtgaattagatctttcttattacatcacggccagttttttgtggaggggggcaatgggcaaggaagcattgatgaattttctgagacagctgcgatttgtctaaacaaggcttttccttcagtacccaaggattctggcacacagacccagctccccaccagcctcccctggaatgagctttcctgaggtgcccgcgtgtctccactccaggtcctggaaagctggcagcagcctcactcttgggttttcctctctggaattaatttgtccccaagtgaactcaaataaaaggaagagcacctatgagagctttgcctttgactggggctgggaaggtggaaatagcatggtctatcctgttttctcatttgcccgttgagcactgaacgactggaagtagagtatgatgtgaagtcttaccctttgtgagtcagggggcttgggctgtctgcacacactgtctccaactccaccaccaccatccaactcaggcccaatatcactgggaaaaacccagatcccctacagaaatacaacaccggtgacttgctggatgctggtggctttgtgctattggcatggtgggtctgaaactcttgtagacaccaaagaaattggtaggttatggaatgattgattatatcctgtgtcagctggaatcctgcgacatgttctagtttcctagtgtgcagagtacaatgtgggcaatgctgggttgtagaacatctgtgattttcatgggataaaagcccttatttttgttttgttttattttaagtcaaaagcaatttctaccagtaagagactgaatgaataacaggaagccccttgtttgcatggttcagaactaggcattgcaaagataaccatttactctgatttcagaggtctaaaggtgttagttcccctcttagaagtaccaaacttacaaatgggaaagtggatgcttagaatggcatgaatgttggctggcttgatcatgagtgggatcacgatggcattcactctttcattcagcaaagttatgtgttaacaggtattaagtataccgttatcatttttccttactttagaagataagccaaaaaatttgaccttaatgaaaatagaggatttttaatggagatcagaattttcacttataaaagtaccatttacacatttcgtcactgctgacagtcattagctagtggatagatccaagctttaaatctgaatcttgtcayaggaggatggaagctcaagttgttaaaggcctaaaaggttgcatgttacatatagaacaaggccctgggaaaggaaatggtctgttgaaagtcacaaggccaaatggcataccaggtttttggtccttgtttaagaaaaccaaatgtaggttcagaatagtttcttctttcttccacgtctctgaaagtccagcttcgtgtgggagagctctgaggccctctcccagccctcgtttttcagctcggggttaccacgtgtattccgtgaaatgctctacctgctttctgtatcggctttctagccagttgcagtgtacaatattagttttggctttgggaaatgaggtttctttgacttggctggaagtatacagcaaccattttatttttcttgtgcctcatgaattaatagggcagtgagaggaaagagcatgcatactgagcatctgagcttttttaaagcaaygattcacccagctttctagtataaaaaacttcctctggcccaccccgagcaaaccctcattcactgctcagtcctcccatttgttcatctggaaagaaggaatgttctagtggggccaggccccatgtggtatcttccttttctgaagtcatccattcattctcttcctggtggggacttaaggttggaggcagcaaaaagtggaaagactggtagatagtctgtcagctctgtggggtgggtgtgccatttggggggaaatgaaaccagaggaagtttggctttgcagagtgaggacccaggcaagttcattttttacactctggttccatctccttccccctgcacacatgagtcagctcccaggaggaccccgtgtccttgactcttccttgctgtctcttcaagctatcaatatgccctctctctatcttctccctctggaattctccctttccgtctcagttggactatctggactttttgattctgcttcttcccaaagtgctcttttcagtccattgtttttcctgagatgtaatgactcaagggtaaatggtacctgtcagttgcaacgcctgaaaccatagatgcataggtgcaggtggtttatttgagtagcgccccagaaagtaagaaagaaggaagaaaaggagggtatgtctttgaggtcactgccattggtgctaagacttttttgagaagcatatagaaagtcacctagaaatgcttacctataggacaggagactggagcactcacgccccagctccaatcccaggttgttaagggccacctccaaggaatggattgtcctgccctggccaggggtgtcattgagtttgggtgccctcagaatgctactgaagatggtacaaagctgaaatcatcagagttgggccagaaagaagtgacacagaacatctaaggcatatcataaaccatttctgaccctgatctcggaacaggatcccagaacagttcaacctgtaattgctttctgacatttgagcaaaagcatcagtagctcttctcatgaccacaatcagtttactaggatttttccataggctcaaagaaaagacagtctatgttctaagtacagatgaagaagtaaaagtttgtgttctggaggggtggggcttcaatctagaccttgcctctttctgatcactgttcttgacactggatctaaattaagaaaaacattaaatctaaaaatgtctaaaaagttaggacatttaacctatactatacaagaagttatcagctaagcaaataaaatccagactttgaaaaaggtaaataaggaactgatttactttaatcacaagttccttctgcttacaaaatgattcatactgaaatttttaaaaaatttcttaacagagtttagtgcaattcacataaaaaatgtacttcagtaatttgcaaatatttacttaaggatttagtaatttagtaatgtttagtaattttttcaacaagttcttttctgtttaagtgggttctcagaagtggttgcaccttcagcaggcaaggaaaatatttatttgaagacgtttatgaaacacctcccttgtttttattatgtttgtgttcttcttatatttctttttatttgcagtaccctcaagtactttgaaggtttggggacagtaaataaaattgatggccattttttgtcatgcatcttctgaattggtatgtttttctgtgttcagaatgtcattcctcagcccccaggggacataagtacaaagtgaaatgaggcgatgtcaggatcacctgtgcacattctgcttctctccaggccctggcttctcttctttccggtagatgaacttgagcacatgatctcaccacttggagcctagtaaaatccatgctactgttctgcaattgttcttttattytttctctctactaatgttttcacctatggatgtcagttctacttctccttggrgctttaactaaaaaggaagaattgtctgtggcttcttagaaagtggtgtgtggacaggcaagggctgccctgcccttggctggcagcacaggctctgcaaagggggtgggtgagtgaccacatcatcatggctaccccttcccgagtgcttcctgtgggctaggcagggcccaggtagctcaaaggtgttcccatttgttcttcacagcagctctgaattcattagcataacaaaccacccccaaatctagtgggcttaatacagcaatcatttctatttgctcataactctaggggttagctaggcagtttttcagttctgggccaggctcggctgttcttggccaaccttactcatgtgtctgtggttagctgcaggtcagctggaacccaaatgttgtctggaacaaggggagtgatttagctagtggctctcatccccagcaggctggcccaggctcctgtagggttccaaaagagtgagtagaagttccaaggctttttgaaatctaggcctggaacagacagcatcatttctgctgcattctgttggtgagagcaagtcatgatttcagctcaaattcaaggtgggggaataaaatctacctcgtgatgggagtagctgcgaagtcaaaactgcaagggatgtagttaaagggagggttggagagtgggcgtttttgcaaactatctaccccaacctctgagcrgtaggtataattatcccagtggttctcaaccaagggtaattttgtctcctaagacacagttcacaacttttggagaaatttttggtttccacaactagttcagcgctattagcatctagtgggtatgccagggatgctgctaaatacccmacaatgcacaggacagctccccayacaacaargaattatccaacaatgcacaggacagctccccacacaacaaggaattatccaacaatgcacaggacagctccccacacaacaaggaattatccaacaatgcacaggacagctccccacacaacaaggaattatccaacaatgcacaggacagctccccacacaacaaggaattatccaacaatgcacaggacagctccccacacaacaaggaattatccaacaatgcacaggacagctccccacacaacaaggaattatccaacaatgcacaggacagctccccacacaacaaggaattatccaacaatgcacaggacagctccccacacaaccaagaattatccaacaatgcacaggacagctccccacacaacaaggaattatccaacaatgcacaggacagctccccacacaacaaggaattatccaacaatgcacaggacagctccccacacaaccaaggaattatccaacaatgcacaggacagctccccacacaaccaaaaattatccaacaatgcacaggacagctccccacacaacaaggaattatccaacaatgcacaggacagctccccacacaacaaggaattatccaacaatgcacaggacagctccccacacaacaaggaattatccaacaatgcacaggacagctccccacacaacaaggaattatccaacaatgcacaggacagctccccacacaacaaggaattatccaacaatgcacaggacagctccccacacaacaaggaattatccaacaatgcacaggacagctctccacacaacaargaattatccaacaatgcacaggacagctccccayacaacaargaattatccagccccaatgccaacagcattgaggctgagaaaccctggattatccctttttacacatgagatgagggtcttacaggtcttctaagtggtggagcctaggtttaatcccatttccgtactcttcagcactcactgtgctagtatccctctcaggcgtatgaatacgtcaagccacttcagcatgatggcgtttaagttttagcttgtctacaaagcagcacaatacagtggttaagagtagggttttgtcaccagactttctggcttaaatctgctcccatcccagcaccacttaatatgtgttgtaccttgggcaagttcaatgatgtctctgccttggccttagttttcttcttcttttttttaatgctgcctcaattacagaacagatgcctaagttttcttatctgtgagactgagctaagaataatgttgacctyataaatttgttgcaaagattaaattagacattcatgtaaagcacttaggaccatacctgagacatagtagcctttagttatttttgtctaattcttctttccctgatacagtgcccaccataaatccccagtcatggtgctgacctggcatgtgaarctggctgggaggaaagagatttttctctcccagcaaagtagtaaacaggctctctcaagcattcatccatctggggagcttggcacacaggacagatmctttctcttaagtgtcccaaggccaaccctgaaccwtggaagccttcatttaccatcastttttctttcaaaacttctgcaagggcataaaaatgggggactaaatagggaccaaataagtgagtccatgctttggaaatgatgacctgagagtgtgaggaaggggagagccaggagctgagtggcagcattgcgggagggctcttcctcccttggttggcagatgggcgggtgtgactgaggctcaccatgggtggactgagcagacgcctgccctcacacacaaccccatgctttcagaagaaggcgtcagacctccttgtatgggaacatcatcaccttcacgctttgtctttaatttgagaagcttatgtggaaggaaacagcacattcttgtgagaagataggttttggaaagtccggagtagacagcatgaatccagggtttctaaagtataccctctccatgcttgctactcaggaagcagaggcaggagaatcgcttgaacccaagaggcggaagttgcagtgagccaagatagcgccactgcactccagcctgggtgacaagcgcgaaactctgtgaaactttcattctgacagtaggaagaggaaaagactctggctgactccttgtgatagagcaaaccaagttgagtgttgtatttacttttctggatttattttcacaaatattcagctcagaatgtgccagggaggggaggaacacaggagctgtattggccacagccatgtgcgtcatcccaggggacacttatgtgagccctgtggagcaggaattgttattcccatcttacaggggtgacagcttagctcagaaagcttgcagtttgctccacgttacaaagctagtaagtagcagagctgagattggaacccycgtccgtctaatggcaatgcttcctcttttgctattctgcctcacaattaaatggagtaggacctgatccccgacatcgagaaactgacggtgttgtcaagaaataaatatcccccccccacacacataaatagagaacaataaaagataacgtcrgaggatgaacccacgagcgtggtttgtgtgggaggatgtcttgatcctgggctcgcagggctgtccgctgaacatgacagttatcctggcttcacagtaacctttcagaggtgctctgagtcctgaacatcggagatagattctttatctggggagtgactacataatttaaccatttgttattttttattttatcagactgggatcctttaggagctgaaagggacagtatgaataattagccctaggacaacaggcagaaaccgggactgccccaggcagttaagatgcatggtgaccccacttaatggccaaaatacaaggaaggcttggtgtctccgcagcttcctgaagagggaatgaggggcaaggctctggcctcgcagccagctgagggagcgcttctctttccactgtctgattctgggtctctgcttcctcatctggatagcagccctaacacccactgtattagttatctgttgctgtgtcacaaatcacatgtcaaaacctagtagcttaaaacaacattgattagccctcatagygggttggggattccagagtggytctggctcgaggtctcttatgagactgcagycaggatgttggctggggatgcagttgtctgaaggctccactggaggatctgcttcccttgtggcccctcgcttggctggctgttggccacaggccacagagcactcaggaccaaggactggagtggtggaaccctcgtccttcattaacacaagcagggcaggaggatgagggtttgtacctgctgttggcaggggggcctcagttcttcagttcttctccatatgggtccctccaacaggtagctcaagtgttccaccatgtagtgactgactttccccaatgaaaccatccaggagagcaagaactgggcagaagctcgcctttccatgacctctcagaagtcacatagcatcacttctgccacattctgtttttcaaaatcgagccactaagtctggcctacattcaaggggaggagaatcatagctcactgtaaccttgaactcttgggctcaagtaatccttccacctcagcctctggagtagctgggactatagtcacgtgccaccacgtcctgctcattttttaatttttcgtagagatggtgtcttgctgtgttgcccaggctggcctcaaactcctggcctcaagtgaccctcccacctgagcctctcacagtgctaggattataggtgtgagccagtgcaccttgcctaggcttcacctttcaaagggaggagtgtcaaataatttgtgaacatattttaaaaccactgtacttagggtcaatgttctacacttataagttaagtaccatgtgtaaagtgcctgcagcagtacctggcacccattaaaaacagaatcttggccctccagagtccagcagctgcacttctgaatgctggtgggcacggacggggtttgatgtccagtaagcctgagcagccctgcaaatacagatgagcccaagtcacctgtacagttggggcctgaggaagttaggtcagttctgaggctcccccagatgtgggacactcctcacggacaagttcagtgttgtatttacttttctggatttattttcacaaatattcagctyagaatgtgccagggaggggaggaacatacctcctatgcggcaggagctgtattgggcacagccacgagtgtcatcccagggaactcatgtgagccctgtggagcaggctctgagcctcccccagatgtgggacactcctcaagggtttccaggtgaccacagagggtcccacctcagtgtggacatttccatgtgtcctcctgaaaccctctggtgagcatccccacccaccctttggtgtctggagccatggtggctggttgtccttcccacttaggggaaccaggcctcagaactacagctcagaggcctactctgtgggctgtccttttttctagggccttgattaaatttgcttctctgaacactgtgaggtatctgtacttgttttaactcttctagtgacagcaatagaaaacctaaattggtgtaggtaaaagagaatgtagggttttgcaaactgaaagtacctggggttggcttcgaccacagcttctggttggacctctggaagttgtcatagtgtctctttctctctctccatctgtcagcttctcttcctccttttggcttcgttctcaaacaggctctctgtcccttcagggtggcaaaatggttgccaggctacagtaaataaataatctcatttcctaaaagttcttgcaaaaatgtcatagagtctgattggtccaattgagttaagcctgggtcgcatgcccacctcctaacgggttgggagtgaggtggagtggggaggggatggctccccagagggaagggtagatggatgtgggtggcaagaaacatgtctgccatggtattgttatcctcatttaccaatgaagtgttggcactcagagcaggcaagtagcttggccagagtctcacagataatagcaggtgcagaccgtcatcctcctgccccactagtgttgatgaaggacgagggtctcacctttccagtccttggtcctgagtgctctgtggccatcttccacttaaagctctaggacagaccagcagctctggaagtgactggattaaaaccccaccaactgaagacagtggcgtgggatgatggctcgctgatgggagacagaatttctgtctctcctstcagaagccctttgaagaactcagctgtctggacaacaaaagtgggagcttttgttgtctagaagttcatgtgacctttcctttcaccttttagtgctgcctaagtgtaagatttaagcacagcattcttttcccatgtgtcatttttcagcagttaaaaatccatcagctgaggccacacaaagttggcactccctcctccaccaaccctcagctaaaaggttcagtggaagggactgatgctgtctccagatgcagactggggccatggattgagccacagagggaggagggaggagggtctcaaattaaaaagacaagaaacaaacaatctccccaaataagcagaaagtctgagcgtggaactgagctggttggagctggggagsgggtgcgggaggtactttcagcactccctcgtgagatcatggaacagggcaggaaatctgaacctgctgccaaagaaaactcgctttgccttttgtaaaaagcctgtcgagctttcttcacaagggagctgctggtggggactcacaaatgggcatgctgcctgccagcaagggtctcctggccagccctaaaggcccgggctgctctgcttacagccacacggctgtttctragctgaggatgaccctccaggtggctgagattccctccaatcttttwatttctggttgggaaaccctacacagaccagtgtctgtctcacggtttaaaaggctgcatgcaaaacatttcctcccctggtagaaatgctgcattgagccacagccctccctctgcagcctgtgcagtgtcaaggggacagtggctgcatgatgatgtgcctagcagggtgtcccccatcaggacagtcacaggggtggaacaaatgcaggagccatggagccaaactgaactgggttggaatcccagtttcagccacttaatagttacatggatattgscaagtagcctgagttctcagaggcttgatatcctcatctgtaaggtgggaagtataagacctacctcacggtgtcagtgttaaataagacagggcaaaatgatgaaggtactctgtaaatgtatgtccattccttcctcctcctctgggttccttttcagcacttcctcaccacagcaccattcttaagttttctagccycatttattttagaaggggaactggaggcagcttggagggaggtaacatctggatgtcgcagtgacagctggtggctggtgaggagtccacaggtcaggggcaacgggccctgcagacttctcagcatcccctgctcagaaggggctctcagagtccatgggctcagcaggctgattcttcccctctcctatgagaccatcctccatgtgggtcccatccaggaagctgcttccctcccaagggaaggaagccaccagtgtttctagaatctacatcagtgccactcaaagcgtggtctcctgaccactagcatccacaccagctggggcctggtcagaaaaacaaccgtgggctcctccccagacctattgagtcaaactctgggggtagtcccagcagtctgtgttttagcaagcctccatgactcgaatgtgtgccacagttggagagccactgtgctacgggcaggttatcccagagcaaaggaaggaaaacctcctctgcacaatgcactctgaaggccccactgaatacgggcatctgtgaggcagcatgggacctgatcactctaccatatatagctgttgtgtgaccttggaaagttccctcaccctctctgggtctctgtgtcctcatctgcaaaatggaacaatcataatactggattgaggatgagaagcatcaatctgttcatcctagcaaaatgtttagcaaaatgccacgtgttcagagctcaggacaggttagctccatcctgttaatgttgaggcagcccacccaggttaagggtctcattctgagagtggctttggacagcttgagaatctacaactgtaggtgacagagcaaagaaaactcttgaaaagtttctcttagagcctaatagcaataaccattaccatggtggcagccaccagagtaactcattatatcattccagcaacgctgtgggttaggagttactatctgtatttttacagggaggtacttaaggcaccacttgataagtggtagagccaagtcagtttgaaaaaaacataatcattgtgcaatgacaatttgagacattttcagggtcccagttccatcccctaggaatctgtaaagaggagagtggcttcaacctgctgttcagggcctctgccctcattccctggaggctggtttggacagtgtgagaggcatccttcccaaagcagacaaagagaaaacacatgggaatggtaattaaatgagtccatgtttaagggrcacttaagtggattaaaatcaatatgtagtcacataagtctgctaagccatccttaatgtttggcgggtggatttctttgtttaaaaaatcctggtttgcttgaaactggctgccccattgaagcatgagataggacgagagattcccaggacctggaagaccacttgctcagagtctgaaatgtttacactgcctctgactggcatctctataccagaaaggagaagagggggactagatgtttttgtgtgrtagtctctttcctgctatcttaggctgagttccctaaaacaaaatcctgagatgagacatcatgtaaaaataatttgttaggaagtgttctcaggggaatgggaagtagagcttcaaagggaaggaggccaaacaaggatgtgatatcmagcaaagtccccaggagacagaaagaaggtgggtgactttggcaccgtctaaagtataggtcacatctcactgtcccaatcagggacaaaagagcatggctgaggattcccccaaggggatgtgaattctcaagcacttccatctctccatgttcatgcaaagaaggtgccaggagccccgtggccatcctcccacaaaagacacacaggtggtggcatctggggggtcaatgtgcatggttgtgcatggtagagacccctggatggagctccatgatgtgggatttacatcccgcccatactctgctgtgagagagatggtatgcagccagtccagccatctgaagcagaacgraaaaatggtatggaaagcaaggcacctgaaaaaattttcaaagggagaaaaagaatgagcaaaactatcctgtagaggagagagacattgmaaatgacatatacagacacagaaaaggttgctcagtcaacaacttctgcaggctcaaagcatgggaagtaatcagtaaatggccaatttatctctccctcacagccaagccaactcctaacataattggaagtttaatatattccaacaagttcagracaagcatactagatcttaaggcaatctcatggccctgcagctcatcctttttttcaaagaaattaattttcaaaaaatgactctattgagattgaatttagatcttatccattgccataaccaaaagcaacccttactatttgtgtgtgcaagtcgttttaaacagctggcccattaactgaaaaatgtcaaaaacaaatataggagaaaagtaagataatcttggaaggcaaagcctgtctccctatattgttcttaaaaatacaaaagggacacataacttcatcatttaattatattaggaggtccgtcattcagtgctcttgtaaaactgtcttgcccttgttctaattgcgtattgatcaccgaggttcttggcatcgggcttttctttgatgtgtgcatgatcagaacacactaagakacagcctgtgtgctccttcctgtcctcgtgggcatttcctaaagcttcagccctaagctggtatatgtttctctgttacatcaactgccaaggcaattactttacatctgatatttaatggaaaagcttctgaggacagggctatactcacatacctccacacctggcacagtagatgagctcactatctgttgaataagttcgtgacagarcagaagttctactgcagccacaaaggcctattcacagtctttaagcctgatgaagttctgaataagtaaacccttagctacatcaggcagtttatgaatggtgttttttgttactgtcatttgtaatagcttttgacctatgtgtttgtattagtccgttttcacactgctataacgaactacccgagactgggcaatttatgaagaaagaggtttaactgattgacagttccacaggcttcacaggaagcacgactaggaggcctcaggaaacttacaatcacggcagaaggtgaacggaagcaagaaccttcttcacatggtggcaggagagaagggggctggtgggggagtgccacacacttttaaaccttcagatctcatgagaactcactcactatcacaagaacaataaggggaaaatccacctccatgatccagtcaccttccaccagatccctccttaaattcaacatgagatttgggtagggacacaaatccagaccatatcagtgtgcaaatgatgagctaattttcccactaaagtaagcactggtatggtacatagtatgactatggtagtccagtattggattccataatttaaataactagtagactttttagttagttgaaaggtaaaacaatggtaataacaatgagctgtaaaatacgacctgtggggtgggaatggggacagccaatgcttctctggtaaagggaggccagtttcagcccctggtgcaacagcacccccatgcattcatcatgtgagatgataagtgtctttccttgaaccagttcttcttcttcctcctaggctgggaacttctccttggagacagcaggaactgtgttacaaaggcatatggcccaacaaaggacactgaggctactcagtaattattaaatgagagcatgaacaaaggaatgtaagatgtaacagaaaacatacgtgtctcacacatgakaattattgtgtagaagctgtttcccatttgagacaaaataagaaacacttgttgaacgagtagatgggcttcctctgggagcacagcaggtaggcacccatgttggagccagccatggtctgcagagttcatttctctgagtccctgccccagaggcacatgacataggaggctccagacaactgactyaaagacagagaggaccataataccagggttcctcagtcctcaccagcataagaatcccagagaaggcattttttttctyacatactctaggtctcaatctcttaacttyaaaaatggcagtggctacattagctcttgggaccagtgtttcaaaggctagtgtagaacacttgcctcagatgattcaagatccaggtttcctgactctgcttctgctgtaaagaatcccactctggaggctggggcctgcaatctgcatctttaacaagcccaccagagaatttcaatgcagtttcacttttgagggtttttaacttgattgtccatcagaaccacctggggagctttcagcaaatgcatgccgacgccacatgcattrattctgcggccacacagaggggcctgcatctgggtcttttttacaaagcttttcataggattgtcatcgtcacctttccagcactgttatgcaaattggagagactcatgccaaggtgaagggcttggtgagagcagccaggtcttctatgcagtgatcagcctgcacagctgggygtggcatctctggctcccaggtggttccagtgcacacccccagttaagaaccaatgaagaatgttgcttgttaacaacctttgaaggctttttagcaaaaacaaagtgtcatattgggattcatctgtggcagtttgcagaacatatcaggggagagagstgtgtgcaaggcatccaccaggaggccgttttgtgctggtctaggtaagaggagattggagctgacctgttgaagcaacaaagagaaagggaggaaggatcatcctagaagtggataccagttctttaagaagagtcctgagatgtacccaggagtagcaaagtggatgtgccaacccgagggaagagattagtaagctgctgccccctgagacagggctccatgagctgacaggttgatctgtggagatacactctgaaggtgctagactaggaagaggtcctctcaggccccatcccttcatcttcagccaaaggaagttcagcagtagctgcccctggcctctgttctcagtccacagctccaccagcccagttgcttgtgcagagggagaggatgtgggagagatgctgtcaacaccctccatgtcccctccacccaccctggaggccgcctatgacagttcgccataggcgaactgtttctctggttaggaactttctctggctacaggagtgtgctgcacccgagtcaggagggctggaagtgcrggatagttaacgtccccagtacagttttctaccaaggagagaccggtgagatggatagatgccccagctktctcacccgttgatgacacacttcactaccctctcctggagctccctgagatcactgcccatacaaactaattgcaccccaatgcttgtcccaaagtctgctcagataagggccgtgtgaatagacaggtcttcagttccagaaaagtgtatactcacacaggaaatatctctcaaataacatgggcagtgtatatgttatttttctggagggcagagggcatcatgaggaaggtggtcttcgtggggtgaatatcatgtttcctccagggagggctcagtgacatggagcagtgcttctcaaatgtccatgttcrcagaggttagcttctaactcatcaggtctagggtggggcctgagaatctgcatttctaacagtgagcatgtccagggaccacactttgagtagcaagaccttsacagcttcaagttgcaaaccagttttgaatgagcagagtagaagggggtttgyaggtgagaaggaactcttcaccatgagtacatttctatgaagatttctggccaggattttagtaagtacctgagccccttcaaacatttgactccygcataaccttttcatccaaacaccattcatgagttgtttttatgccatgaggttaaattctttcctatcatttcaggggaggtccccacttgttgagttttccgtcagcctataaggcaaaggaaaagagtgatagaaaataaaaataacttgattcattagatggaattcaacttgaattcttagtttgttgactaagaatttgcagcctcygaggaaattttttttaattgaagaaaaactaatttttaaaaatctgaaaataattcgtttgtgactatttaacagaaggaaaaacttcctgagtgagcatcaaatactttaattacttcttaggcttcagaagggatggcttgctagtctttgtactttgggctttctgttacgactggttgacttagatttatttgtttatttagcttcttaatttcatatcctgtggtcctgaagaggacaatcaccaggatttaggggagtgtttttgtctttattcactttggaaaaatgtaaagattagtcctaagcagggttgattcaccgcactacagagggacacgttaggaacgagacagcttattcaagtgcttttgaatttgtattggttttttaaaatgtaagattatttttacttattttaaatctttcaaagcacttttttcctcagggccaagtggactctttgggaggagacctcgccgtctccatttgatcacataattgcttctgatgccagccagtctgcaactgccagtgattggcacagggttatttcatgtgcacttcaatcaaatttcttttcttgcctttttttttttttttttttttttttaagaaaaaatctcactgtggcacccaggctggagtgcagtggtgcaatcatatctcactgcaaccttcaattcctgggcctgtgatcttcccacctcaactcccaagtagctgggaccacaggtgtgtgccaccacctctggctaatttttatttttgttgagacagggtcttactatgttgtctaggctggccttgaactcctggcctcaagtgaacctcctgccttggcctcccaaaatgccgggattacaggtgtgagccatccatacctggcctccaaatttcactacctaacttgggagaggaattttgcattagcagttacatggttcatctgcctcaaacatttgttttgactctagcttttgcttgtttcacttttttaagcttggaaagaacaaacttagaatagtgtaggccttggcttccacatggatgttttgacaaaatttcaaggaagcaactggctttgtagtgctttctttgtcctgcttctccaaattccccaagtgcatgggtaatcacctctggttccctcggagtgttcgtggccagctccttcccagccttgccagcccattgtctgcatttggcatctgcgctggagtcactgtgtgctccagttccttaaggatacttttagtttatctgatctgtgctccacacctcttcagactccatttccatgaatgttttgggagaggtgaggaagaaaccttttctgctcattgttgcgcgttccccaccccaggccccgtctgatctattcttacatcacaactaaaaatattcttaaaaatgtgaatcagatggtatgactcccctgctcagaaccctccaktgccttccctctgtacttggaaccaagtccaaactcctgatgagcagcagggctccgcatggcctggcctttcatctgttgcttcccaaacgtgtggcctctggttggtttctggaactcaccatgcctttccccacacatgctggttcttctgccagggacactcttcactctcccttcatgtgcttagccccttcttagcttgcaggtctcagctaaatggtacctcctcaaaagggccttccctccacctataccaggtataatgctgtttgcctccttcagaatgcctctcacaggctgtgattactttaaacagattcgttgagatatagttcagatgccatgcaattaacccttttaatgtatacaattcagtgggtttgagtatattttcagagttgtgcatctattgccagagtcaattttagaacatttcattacctcaaaaagaaccaccatacttcttagctgtcgtaccccttcccctatttccaccagccaaaggcaaccagaaatctactttctttctctctagatttgcctattctggacattgtgtataagtggaatcatttatatgaaatggagccagtcctttgtgactggcttctgtcacttagcgtaatgttttcagagttcatttgtttgtggcatatgtcatacttcattctttttcatggctgaataatattccattgtatggatataccacattgtgtttattcattcatcagttgctggacattagattgtttccagtttttggctattacaaattatgctgctatcaatatttgtgtacacatttttgtgtgggctcatgtttttatttctcttgggtacatacctaagagtgggattgctgggttacatggtaacttatatttcactgttaagaaactgccaggctgcttttcaaagccactatactattttacattcccatcagtagtatgtaatggttccagtttgtccacatctagtccagcatttgttattgtttgtctttttgattgtagccattctaatgagtaggaagtagcatctytttgtggttttgatttagatttccctgaaggttaatgatgttgagcatcttttcatgtgattattggccatctgtatgtattttttggaaaaactattcagatcctttacccatttgatagttaggttacttatctttttattattgagctgcaagactttttaaaaatgtatcctaaagttcctattagacatatgatttaaaatattctcatcctgtggattttttcactttcttaatggtgtcctttgaaacacatgagttttaaattttgatgatatccagattatccagttttttttgctacttttgtaattattattattatttttattattattatttgaggcagagtctcgatgtgtcacccaggatgaaatgcagtagtgcgatctcggctcactgcaatctccgcctgctgggttcaattgatccttccacctcagcctcccaagtagctggggctacagatgtgtgctactacaactgggctaatttttgtgtttttagtagagacagggttttgttatgttggccaggctggtcacaaactcctggccccaagtgatccacctgccttggcctcccaaggtgctgggattacaggcatgagacactgtgccctgccagttatttttcatttccttttgaattttttgtttttgccatctccccgtgtaggctgcatgtgctgcgacggcagcgctgtgtttgccattgtagccccatcccctagaacagggcgtgatatagggcagcggtcagtgaatagctcttcagtgagttagtaaacaaagtggttctcaaaatgtaaaattcttccttgactcactaagcaaccttctgattgcaactgctttccctttttggsctccaagacaggaattctctggccctgctgacaggagccccatgttgcacagggcaactatgtcactcattggaaattaacatgtctgccctctgacttcagtatttctcccaggagcagaggatggaagttcttcacagctggatctgctgtatcattcagaagctggcttcagagcctgtgtagctggaagcctcgggctcacatcaaggaagggaatgccactcagcctctgggcacacagctgcaacttcccctggtgctgtctctcttggtgctaccctatactagccttgtccygaaacatctaccccattcatttcaccctctctgctactatgtcactgcctctcccatcacagtattccacccaaatgaggcaaattcttatcctttcaagacctaccctagagtcaccttttttgatatatttgcttttttatttactccaccaggcaaagagggtggcaccctgctatgagctcttggaacaatttatttataagttccttatagcctggatcgtattcaaccaatagtttttccccctctattaaaatgcrttaatttggagtctttgcttactaaatgctgtctcctttttttttgagacagagtttcgctcttgttgcccagcctagagtgcaatggtgcaaactcggcttactgcaacctctgcctcctgggtccaagcgattctcctgcctcagcctcccaagtagctgggattacaggcatctgcccaccacgcccagctaattttttgtatttttattagagacggagtttcaccatgttggccaggctggtctcaaacrcctgacctcaggtgatccacccacctcagcctcccaaatkgctgggattacagtcgtgagccactgagcccggtcaaaatcccttcttacctgtcatttgtrttctccccattctgtgtctgacatcttgtaggtgtttgttagatgattggtgagtgaattaatgaatgtacagatggatgatgtataagtcctttcagagggaaactttgagtatgttaagaccccaggaaggcttatacttgatctttgtatccagaatgttgccaacattctggatacaaagaaaagcaccctctctgtgacttctcagatcccatctgcctctgatctttcatgacccctgctggattgactacatgagcctctttcagaagtttgactagcaaatcaacaaaacagttcaccctctgcatctctgctcagggatcaacaggagtgcttgcttatgtggcttcattccagtgggaggttcatattttcttagttatgtatcatgtagtcttccttgattcaagagtaccatgacttgtgtttgttctgactccaggactatccatgagtaaccctcagccaagagtgtatcatcagggcctgagcaagtggcaggagacaaggtatagtgtgaatctagtacatggaagagaatgtcttgacagctggggtctgtaattcatatgctgttcaaatgacaggccttttccccacacctgtgtgtattcaaagcaccatgtcatgttctgtagggagataggcaggggagttgggtcaggagaaggaagttaagattgaaggagaacatgcagaggagctttgggaaggaatgtgcccggctcacatcctggctccatcatttaccaactgggaaaccctgggcaagtgatataacttcacattccagtttcctcctcataaaaatggaaataaagagaaggtgtacatagagtttttagataatggatttaaaacactrcctggcacacagtaaaccattactaagtagaggctatgtactccatcctacacgcatcagcagtggcagtccagcaatactcctataaggcacatgttatgacttcattttactggtaaggaactggaggcttagagaaaggatggttaatttgcctgacaacacattgctggtatatatctgagccaataatcaaaattgggacactaatgccaaaggttttacaatttctatgctgcaggctcaggtgtttttcttcatgggtaggaactttatggctcaagcccgaaggattcccctctgggaatacgactgttctggtaaggttcaagctgactcatcattgagtgctgctaataaagtgtttgctgagaatgttttctgttaactcattgagccaggttattaagaacctgtgctcacctctgacacctcagttgattggggaatttgggatgaagtgcttccaaaatttatttgaattctaaattaactaagtgagttaacgtggaagccgcttttaccagcccacaagggtcacgcttgttgtgtctggaagaaggaaagggtcttagaggaacacaaattgccagactgacagtcagatatggagacaccagggtcatcttcagtttaacaaacacatgtcagaactagaaagttggaagtgagacttcaaactctacctagcattgagcataagcaggtcactgaccacaaagatattctgttcccaaagagcaccatattcgtggtcaagtaaggccagagtctagactgrcatcaaatgcttgtatgattgggaggaaggagcccgaaggccaaagaggctcactaatttcattattcgattcttccaaccactgcacgttacaawcagggctgtagcctgggtctactggccaagcttccggggctgggacaggcaaggtatgtctggatgagagaagktctttsccaagacaagcatctcttgtgccaggcagaccagcaaatgagctgcttcttgcagccccttctttggcatctcccataagccaaggcctattcatttaataaatgcagactcaggagctactaagtgccaggctcggtgccagacactgagaatacggaaatgagtacgcataaatcaagtgtgcttttcatcactgtgtttttaaaaatgttaactgatgatttcctgatcctgagagtaatgtgcagatgctccttgaactatgttggggttatgtcctgataaacccatagttagttgaaaatatcataagttgaaaatgcatttaatacactcagcctacsaaacatcatagcttagcctagcctacttaaacatgcttagaacagttccattaacctacagttgggcagaatcatctggcaacacagccctccatagagtatcgattgtttaccctggtgatgatgtggctgacgaggtgctacagctcgctgcrctggccagcatcttgagagtattgtacagctttctaccactttccactgratacctattgtttttacaccatcagaaagttgaaaaatcttaagtagaaccatcataagtcagggactatctgtatggtagtagaaatttttaaytgaatcttctgtaatcttcagcaagaaaccctgagaatattgaacgtctttgccagacaaggaaaagtgggactggggaaaaggccagttatgtgaatcctcttaaaatagggwctaaaattttataataaaaatgtattttaaaagttttgattgagactttgcctgaaatgtgaaactgaaaattacgaaattaggtttattttatcctgcatttattcagtggcactcaaaacattgtaattataattgtcaaagatatcttagaccaaaggcaaaagattatttgctttattagagtctttaaaataacagtgccctaacttctgaaacaaaagaaggaattgagtgctggataggcagcttttgaatgtgaattttcctactatttcataagataacatcctttgcttcatattttgtctggttttcggtacaatcacaaaaggatcattttaacaatggtcacttttttctaagggcttctcttgatcttttttatttaaatctttgtcttctgaagcatcttaaagtagtatccaggagaattttgactccttcaacagttaactgatctaactctgccagatccagatttatcagtggttttgcagtggttttatccatttttcaacatcactttcattgatttcatgaaagtctgcatcttttagagcaagatttctgcttcactctgtatttgatttgcattgtattgtagtcagataatcagatgtctgcactagcagtcagggacattagatagacagtttgctcactggtccgcgttcccagtcagctaagagtctcataaccatcagccttgataaatgctaatgttaagttctctaagttaaagccagtgtaggcaatgattggaacttggaagcaatcagagcacagaagaagcctggtccctggaatctctcccatatgcatcctggtggataccaagtgcctggcagaagtcataggcaactcccaaccagagygctctccactgacatgttgcttagagctggggacagcttagattagccatatctccccaaaatttgtatttttaattgaattgattttttaaattgaatccattttaaacatgggattttatttttatttaaagaattaccttgtgggtatgtctgtgactcttgggtgcctgcctggctgccaagaagacatgtggctccatgatgactctgctttttaaggttatgccctgggcatgatctgaaaccaggagaacaaagtgggtactggtgttgccttgaatgaagtgctcccctaatgggggaagccttgcaacctttataaactgcagtcaggactgttttctcttccttagtatggatttaaacaagaatcataaacacgtgagctttctcctcatcctccttttgttgcctctccccacctgggagcaaatgcctaggactttccaagtggttctcggtgccagcagcctcataagggaagagtattatctgagttcaggttcatcagaagcagcacccgagatggactctcatgaaggggatttattggggcaagaggagcgaagggagcagaatgaggaggggaagaaaccaaacaggcatgtgggctcagctggagtctgcttcacccagtcctatgggagctctggaacattaattgtacaacagagttggtcttgtcttgaggcaaaggggacatccttgggtacccacatcaatcagaggctacggaatgcttttggggaaggtgtcataacctcccaggcaaagcgactccattcaagctgttgtacttatctagtaaggggttctgagtggagcaccaccagcatccacacaaggagtggtactgcttgccaaagcccatgctctgatacacctctgggcctccttggaaatcacagtagtagaagagaggggtatagaattaaaaacatttggtcagggcagttgacatggccagtataaacagctatgttggtgctgacaggcagcagaagggtaatccatgacatcccttcctgtaacaccatcccggagcacatgagtcatgaaccataagctcagctctcttgttcctagagatgatgtctttggtttactcttttggcctgtcctcaccaagatccaaccagaattttgaaatttttatttgactgagtaaggtggaagagagaccagaaatagttaaataaatgctgatataaatgttacgttctagcatttgggaattaacaaaaataaggtagctgagcagcttttgaatgatcaaaagtactgttgtcttaggtcaaagctaattaaactgaggtttcctcgagttccagagtacatttttgaagacatttatttcacacatgcaaaaactgaagaagtctttggggcaatamatctttttgatttcttttttttttttttttttttttgagacagagtcttgctctrtcaccaggctggagtgcagtggtgcgatctcggctcactgcaacctccacctcccaggttcaagtgattctcctgccgcagccttctgagtagctgggactacaggcatgcaccaccacacccagctaatttttatatttgtagtagaaacagggtttcaccatgttggccaggatggtctcaatttcttgacctcgtgaaccgcctgcctcggcctcccagagtgctgggattacaggcatgagccacagcgcccagccaataaatctttacttcaagaacagacctttgacttaaaattaaagcttctctcctggtttgaaaggaattcccagtgaggtattgggcattacaagagaaactggraacagagttaggtaagcatgtaatatatgtatatgtgtatgtgtgagatacacacacacacatacacttatatatatttgcttatcctgggacactcttgagactaattataccagaatgacagaaatgaaccaggaccgtccccaggaaaccaagagaactaaagtcatccaagactttggcttgctgcctctgatgtccacaggccaattagccaggatttagggtagtgtctacttgggacagttgtgggtgttgcttctggcaggaggaatatgaggaagaagatggtagggaaaggccatctatggtgaatcattaatgccatgcagttcttgagacagcatttgagaaattattctctggttttccttattgaaattgccaatgcctgttctctaggttctaagagcagccctcacacttgccatcacacagctatgtaaacacctatgtctctgctgggaggtccccacctcttctgaactctgagctctacgaggacagcgattaacatctctcagatatgttctctcagtgctgaaatgtggtgtgtgatacgacaactcagctacccagtgcatgctcagggcgcgttctgaatcctgtgccatttgcatgttacatacatgagcttgccatccatgagtgtttggggacaagacagaggaagaaaaccttgggggaagggctaaggaaaggtgctccttgacagtgaggacaacttaaacagaggtgtgaacataagagcaggcagggtgtgtgtagaatagtagcatatacgtgccacggggcaggggtggaagaaccacaacagaacaggatgggccaaaatggaagctgggatcttaagatttgagactttattctgtttgcagtggggacagacatattttaagaagcttcctctggcagccagccaaatggactgaaggggaaggaaagctcatagcagcagctaccaaacatcattatccggcagaatcactaattttatcactcaataattttatgtattaaaaatgctcatcccagaccctgcagtctctgtgtctactcagaaaagactcatgcwgtgcaattagagtgtggcccaggaatctgcattttatttatttatttattttttagacggagtctcgcactctcgcccaggctggagtgcagtggcaccatctctgctcactgcaagctccgcctcccgggttcacgccattctcctgcctcaaccttaaagaggctcccaaggtgatactaacgctggcgatcctgggtctctgtgtgaataacactggctaagagcacagagagatgttagaaaactaatcatcattgagatcagttatatccgagactggatgctgaaaagatatattagagtttagttttatatttatatatctcttatcttttgtttaattgtatttgggcttttaggggttttgtttcattgctattttctaagtaagagtgtattgatgtttaacaaacaaacaaaaatatacaagttattaagttcccagctcaatgaactttcacaaaatgatcaaacctgtgtaacctgcactcagaactgccttccacttattccataattactgtcttgatttctagccccatagattatttaccttttatcacctttatttttggtgcatttgataatgttcataatatattagaataataagatatgtataattggataatttaagtagatatattatggtaaatgctcacatgtttttaccagttggacacaaaataaaaatrtttttcatccacctgtctagatgccttgaaatgttagtctgagctgagatgtgagtcytggaaattggaggacctctgtaccttctcttccaaaatctgtaaayatactgtttccgcttggcagtcttgatttgctttcagtgactctgaraagccctgtggtttgtgaagagcctcttggctttcctttgaccttggttggaagccatgtgcccaggtggaaagacagcagttccctacagcctttctcttctgtttctctcaagtcgctgtgtgcagagtccagcctaagctggctacacttggaaacctctcctcacccttgtaccctccccacaccctggggagacttgctggtggacagcccagccctcactgcttcaggctttaggaagaaaccctctcttttcttggtgtgattttcttagagtttgtctttcctgaaccaccaagatctgaaaaggcaggattagggtgtgggcttaggagaaaggggccaagaagatgacagggttgccttttcatccaaaccttaggaggtctccagctcagccatggcccagcccacctcaccaggactgccctagggtttgaacccaaagcattagttaggaatgaagagtggttttgtcctcttacctgtcttcccagggaacccatgaaaaagtgggcagctggaagggggctggagacggcctggtcagggcatctcgtcccactggtgcctaccgtctgagcactgctctgaaggactcgatygccccgtrgagcctgctcccacacacctgccttttgtgcagcyggcccatctgttggtgctttttytttcaggaggagatgggcatctcctgtgagctgctggaatcggacttcctcaaatgcagcgtgggatttcctttcatgaggtcaaagtcaaaggtaagggacacagaygggacccttcctcagcagcaggyccccagcccttccaccagccactgattccgccrcctccctgaggtgaggagtcctcccaccccctgcytcccatagcagctggggcggccactgaagccctgacatgctcctgtccctggctgtgtacaccggggtatactccggaggggctgcatcatatggtctttctcttcgattcacatgatgtaccccaaatgtgaaagtgaaggacacaccacagcctctgcactttagcacgtgccatttagttgaccttcctaaaataattttttttctgagacattctgtgcctctttgagtcccctagacaacacagaagaagatgtggtctgtcacctatagtcctgtcattcccttgggtgctcacagttttctgaagagaactctcaaaattctcaaaacataaatacctgtatcccacttcatttttaagaagagtaaagaaattaagtcmctttggtattggtatggagacagattttytaagttcaaatagtatactacagcatcttcagacattcatggaacattgtagtatgtgccatcattataaggagatacaaacataggtaaaaagatgtggtgattggaggcaaaactagaatctaaaagaccaagtctgcctttggaaatggaagctattttccctgccatgaacagagtgagactccgtctcacaaaaaaaaaaaaaaaaaaaaaaaaaaaagtgaaagcttcatccttttctcctgcctgggtcatacactcagatcattttaatctccaaggctctttggtcccagtatctagtagctatttgtaaaccaatggtgagaatattctggtgagggagaagacttggtcatttcttagcaaatcacttgaacccataagccccattgaatgcacctcgatcttggactttccagccttcagaactgtgagaaataaatgtttaaaccacccaagctagggtaatttgtgatagaatcccaaactgactagggcaaaaaggtaataactttctcactgttagggtcaatgttgttcagtgctgtgttcacatatcacccaagataatctcatgaaccacctaaaataatcttagtgtaccactcccagtgtgaacatmctgtgatttgggtaacactgccccaaacaaatggtgttcaccatatacatatcaggcacgtgtgggaatgtgggaggaacccctgggtaggggttataggaccaggctctaccacaaactgtgtgatcttggcgaaaccacagtggccaagtggccaagtggcccatgactcctcggatttttttctgcctctcttcctcattctgtccacattcaccccaggaggagggaaacctcaataagtgtctgcccttggaaaatggattacatgtggatggcagagtacaggccaagtcccattagactccaggtagggtgagggtggagataaaggaggacgaccacaatccatggacactattgcctatagtaatgtatgtggcacatctgcacacaaatttaattaaaatcttttgagtaacagataataggcttaactggaaaacttgcaacagtttccatttcattttaaactccagcctatatcacatatcagacctaagatgtgtctttctctctctagtggagtgttamattttgtcaaatttttgtttgtttgagagggagtctctctctgtcgcccaggctggagtgcagtggcgcaatcttggctcactgcaacctccgcctcccaggttcaagggattctcctgcctcagcctccctggtagctgggattacaggtgcccaccaccatgcccagctaattttttgtgtgtttttagtagagacaggtttcactgtgttggccaggctggtcttgaactcctgacctcaagtgatctgcccacctaggtctcccaaagtgctgggattacaggcgtgagccaccgtgcccagccaacatttattagatagagcccacagaagtatgaacattggaatgttggttgttttcccagctggtaatgctaccactttcctcccacatacagatgctgggacctgaagcaagactgactaaacctggggattggggggcatgggagcagagggtgattccctggagaaagcccaacaagtcacccagcagagacggggctccccgtatccgcagcccagcgtgcactcccatgtccttccaaccctgagggtcctcaggctccaggccacatgctaagcctcatggctatactttggcttaccttggatggccatgtatttctctctctcacagcctgcccagtttctgacattctgttcttccaggcctccatccctgattttggcttctcacccaattcttttgcctgtcatctcactgtgctctttaatgtttttaatttaattcagatctcctcccagtgctgactctacaccagtcaagaccctgcctctctcttccttcttgtcctcttcccgccctgtctccatgcctgccccccaccccacwgtaagctgaccagtcccacagcaacagaaatttctgtctagaaagagatgtccatgttcactgtagatgatggtccattgtaatggaccaatgtccgttgctttcaggaaacattcagtagaattcagtgttgcaaatattagaccattgcctagaattcaccataatggaacccaaaggtttagacattgtataagttataggctctcaaaatttgatgaaatttaagaaccgttttgtccaacctcctttttttattgaaatgcaaagacagtatcttagccaagatcacagtcagtttgtggtggaacctggtcctgtgacccctacccaagggttcctcccacattctcacacatgcctgacatgtatatggtgaacaccatttacttagggcagtgccccctactcacaggatgttcaccactaagtggtacactagataattttagatggttcatgaaattatcgtgggtgatacgtggacgcagcactgaacaacattgaccctaacagtgacccttttcaccttagycagttcagtcatctataacaaattaccctgggctgggtggtttaaacaacagacatgtatttctcacagttcttaaggctgagaagttcaaggtcawggtcccggcagattcagttcctggcgagagttctcttcctggttcataaacagaaccttctctatgtgtgcccatctggctttcccttggtgtgtgtgcatggagagagagagatctctttgtcttctcttcttctgagtgcactaattccatcatgaaggcctcaccctcatctaaacctaagtaccttccaaagaccccatctccacataccatcacataggggggttaggccttccacatattaatttgaggagtggcggggggacacaaacattcagcgcataagacttttcaatagtcttccaatcctagccacactcaggagaacgtctccaatcctgctagcacatctttaacacttctctatcaccagcaaatctcccttttcaacaaagatggagtagaccttaggctcagaggcttccaaaggcaacagagttcagcattgctctgtktwcaktgtgttcatttttacaactaccttctctttttggcaagtgatcctggattcccatctatgwcagtgatataaattgttcttttaaaacaatctttaaactaaaagagtaaggcaacaaaaatatgaacaaatatcccaggtgatgtaatttgcagatgtggcagaaattgaaaagatggtatgtgagtgaaacttagaaagtcccggttaaagagtgtaaacgcatcacttcctaaggagagcctcggtggcggaacaggagcagcaggtctctggccagagtatgtgtcaggcttggttttactgttaaagctgtgactttggcctgacagtcagaaagctatacataaaactaaagcttatcatgcaaatgagcttccagaggtcataaactgcagaagatggaagagaacagtttaagtttggaatgcctgctgatgccaaataccacttcctttttcactagtatgaattcagcgtgatctttgatacaagccacctgtctggggaagaggaagttctcagcttcattgttactgctcagaggtaaggsgggggtttaaacacttttttcaaagatgagagatttatgggaccaggaaaggatrtgtcctggttaagctttgatgaatcccaggatgctgaggaggaagaaatggttactcagtgataaagccttgagccgcwaagtggaattggatttcttggggatggtggttgcctagtgctgcttgcatagccgccactgcagattgaactgagaggaactgggcatcagccactcagaggtgatgattctacagctgaggagagacaggcccaggggggtgaggctctagtccaaggtcagttcccacttggctgtgtatttcccagatcagacagatgtcctctgcaaattgtctggctgggcccactgctgcttttggacatggtgctgtatcccttgatggagtgggcaggtcacctgcagcctgagggcctggctgagcctgttggcagaggccccaagagatgctactcaagagagggcttaatttggaagccaagtggatggataggaaaggggatcgtggggtggcagcttctcccctcagtagcatgtgcccgcccctctccaggatagccatgagtgcctgtgggggcttctggggagttacaagatgccttctccagggcagatccagcatgccttgaagcagcatctaggtagcacttggctggcagctccagtggagggaggggcgttcaggtgggtgaacagggagacacaagctttgattggggtggtggttggacacccaaggcaaccttttcattttcacttggaaatgatcttaaacttaacagaagtcttacaagaatagtgcaaggaactcctatataccctttacccagattcacccagtgttaacattttgcctcatctattttatcatcctctttctatataattttttttgttaaccatgtgaaagttgcagaaatcatgcctcttgattcataaatacttcagtgtgcattcccaagaatgaggctgttctcttaakaaactgtagtatagttatcacattcaggaaattgaacattgacactatgctattagctaatccgcagtttatgttctgattatgccagttatcccaataatgtctttttagccgcttctttttactggtccacaagacttggttattttctattgacactattttcragatcacataatttacatcacataaaacatgactgtgatytaatagaagcctatgcaaagcatagatagggtagacttcattcccattgcacaaaatccagaagggcttcagtggggaggtagcatttaaacagaggagtctgttttcaggctgaagcaacatgggcacggcagtgaggctgtccatggggcaagaagccctgttacacctgtgtaggtggtgggcacgagagtgtactggggattcgtgcaccttctcagaagaaggatggggagcacacaagcacagtgggaatggggctgaaagaggagcctgggcgctaaaccatgggggacaaaggtcacctagaaaatctgaactatatcctgatggcactgaggagccactgaaagtttttgaaaaggggagtggcacagtgcaacagcttggccccagagcatgaggttgatgaatttgataaggggcggcagatgcccattcaaacctgaaaattctcattctcttgccatttcttggatccacagaacactcgccattgttgggcagacccatcaatgtgctctcttggtccttccacacctgaggcagcctgtatgcctgggaaggaatgtgacatggaagagatttcccwtgtcaaaatagaagacacttcctgcctccacctaattcagggctaatcataacagtcagagagggcagggaaccagtattgcaattgtgaaaggttcatttgttagaataacatgtccacacagcagcagtgctctggttttggatgcatattagaatcgcctggggagctttcaaaaatatcgatgcctgatctatccccagagaccctgaccctgcctctgcctggggtgagacctgggcaatggagttttcagaagggctcaccaaatgattctaatgagcagccaaggctaagaaccactatttataatcccttactctgtgctgggcacattttcactcagtaaatatttattgtgcaccttatatttaccagttgcagtgctaaatgctgggcacatgagaaaatgacagtaacctactaaattcaagaacaccccctatgtacattaacagtgctgcatagcttcaggaagcmctaggatctgtagcttcaataatataaaaatttctagtttcttaaatcacaratgttaagatgaccatawtatcttctragcacacaccagaatatttcagatgctcatttcttttcaggcattggtgaagatatggtctgactgccccggagggcacccacacacagcgcttgactccctgctatgacggaaagatccttaaagctccttatcttgaaaactacagttaaaatctcaattgttcctttcttccatcaccaccctttgaaggtctctttgcctacttgtagatttagggggacataacattgagactgagcagtttcttgaacctctcctctcagcagccaccagcctggcttttgcagaccactggaaagtatcccagctcattagcttttggaatgacgggaagccttttgatgtttgacgtctttatctcaactcttcaacttagctcattctggagcagtcacacgatgacagatgagacggttgggcctragccggccaaacaaayggcagggcaagacctggcaggatgctggggtgggggcgggagtgggccaggatggtgttaacccatccacaggggagtygcctttggcctgcccacagcagtgatcccaaggcttttgtcaccccttgggaaaggaaggacaaggaagtcaggctgtgtgggcacctgatcctgctgcttttgcaaactgtggatgcccctgagggactgatgtcaccccatgtaggaagacagatgaggagccagggcagagactgtggscctatggggtcagcgtcacacagcaccattgtttcagaacaataggagggagaaggagaggggatgtgagagctatttaagtgctgttgccattcagcacttgytggttgagagaggaaggcagtggggcagggcttggagggggcagagagagggcacagagcagacagggactcagcagatgttcagggaacggcgtggtggggaacagtcaggatgagctgagccagcctcagcaggtctaggggactcttttcttccgcccatgcagggtgaacttgggaaccaactgtgaatgtaggttcaagaacatgtacccaagagccacgcattttcccaaggaataatgatcacaattcctattagaaatttaataaagtaataaagggaaactaggtcttctctctcttcctcctgttccttctcctcccttcttcttttgctcctcttccttctcgctcccaaatctggcatcaggagcaggagtcacagctgagagagccctagtttgaagtctgactgagctggttggaatctcagctctggtttgcaggggggccttgggcagttacctgatttatctgacttgctccttacctgtcaaaggtgggtgctccatctccctctggggttgctctgaggtctcagtgaggccatgctgagaaatgcccggcatagtgcctggcacatagtagccacttaacagcatcaattccctcatgttcacctttccagaatgatctcacaagaatccccgttctgtgctttctcacccggaggccttatgtggatgtattttagaatcacctggggagctttcaaaaatatcgatgcctgatctacccccakagacttgctatagccagggtctatagcgagagcttccatgatgtttatagtggtaggtttggtcagggcctctttcctgggcttggctgtccatggatgatgggtggtcctttcaggtgagacatagctgctgaagtctagcaactccttcctggctgcaataccctaacttcattggtccattgttygtggaacaggcacttacacaagtagcacacacagtaggtgccctgcccataacccctcagccctcacccttcccaatctatccgcaaactgggcagattccggctcccagcaccagccaccctgctgaggctttctctggccagagcccactcacttgcctgacaggcaggtgccagggggttcattccaccccacccccacccccagcagcagcaacagcagctctcaggagtcagtggataaaggcctggctcccatgccctcagctaggaagactgactctgcctcacagagtccccgcgagactgggccctggctgccgacagcacgaccctcctgtatggcatgcctttattgtctccyttcctttgctctctcccttctccactctccagtcctactggcatttcctggggccacctctcgaataaactacttacactcaaatctttgtgtggaacacaaccaagacaatagagtgcccttgatagatatgtacagggaccaaaaacagactgaaggcaatgaggtgccatctgcccttggagaatgtagagattcaactctaaagtggaacagagaaagcccactgctggacagctagtgttggccagcgttcattcattctcctytctctgcacagtggcaacacggagcgctctgaatccctgcatgacaacaccctcgtgctgatggtgccactgatgcacgaggtggacacgtccatcaccgggtgagtagcctggtcctgggttgccacaacacaggagtgccctccagtggaacactgtgcttctcatatttgcatgtgtagccagccaggagccaagggctgtgccacctccacttcctcccagccttgaaaagcaggatgaagctttagctgcagtaactcatacactcctccctccttgttttctcctctgtcccacctacccacccacctggtagataatctgagaagtttgatgacaagtttaagccccataatttctttgaacattccatatacctttatgtgcatatattctcatccgcccctagtccctccagaatgctgtatggtaacaagcagcatggctcctgggattaaaatctcagctggaagttgctgggccagagattatcaccagatgtgtctccagtcctggctcacaggaggaccactttctgattagctccacaggcagtgctggctttgcttgtttctgttaactccctctgcagagccagaggtggcttttcctgatgtctrtaatggtctggaatgggcagggaaccatcccatcggccacactgtctgtctgggtcaagtccacggtcattcagtgccgctggcattgttggaaagcaggaccctgggctgcagtctgtggagacctgaaacaacctgtgtcagttttcaaccaaagccccagcttggaaaaatgagaactccatttctttccagcttcagaaaacagagtgcatacctctttgatagtggaaaaaagatttacacaattagtttagatcaggtgaggacccactgaacccttgacccaaatgcaagctgaactttctggaggttcacagtttctaatttttcggttttcaagtgcttctgggtctcagccttgattagcagtagaaatgttgatcccttgcagggagagccatccctgcactagcccgcactgctgggagccagtggaatgagtctccaagcattcctgctcctgagcttttggcatttttggtcatgttttttaaacatgaggtactgatggaatatatttgcaaattagcatatttttgcctctgttcacagctctatttttaactgtatcatttatttacttgtctcatcaaaggcacagcaagaatatacccagaaccaagccctatccttggggacaaagagaaaacattctccccaccacccccagacacttgatcatgtaatcaktccttagaggaccttgttgggaggtgttaacagcccctgatgaagccatcagttaaacaaatgagtcaacctctgatctctccaggaacctaaaacagctcttgccatttggtaatgctgggaactcactaccttactaaaataatgcactaaacattgaaaatggatgagttgttgtctattcggacttagtctcaaaaatctkccattgttgtgtttaggtgagtgagtggcctccagcatctagaagtcgatatttgtctgggagtgtcagtcagagctttgtttcttctcaggaatgtgttcatataagcaacattgaaagcattgctgcaaactgagcttgaattcttctcacctcttatgtagcctccgaaatccaagggaaaatgctatcaatgaacggattcagctttcaaatgcctaacttctagtcatcttggcagtctgayaaatttaagttttttaagtgaatttgtcatagagtggggtttaggatgccaaatacataactcatttatatttattttttaaaagcttatgatcatcttcttcaacccataaaacatttttcgaatgacaaaacagaaaatgtatacttttataatccagtttttaaaaagtcaaagctatgataatcttgtcatttcagaaaggtaatcccagtgcatatttctccatgcagcttattgacgtaacctaagatgagaagacactactattcatgcctggtcagaaagcacagactggctatgtaacagccccagcaggraagcactgggtgcaagacactggattaaaytgagacaaatgtttgcttctcagaatggcagtgaccatgggtgcttgactgtgggtggggatgacagatttcatgctttcctctttcagaatcatgtctccaacctcctttgtatatggcgagtccgtggacgcagccaacttcattcagctggatgacctggagtgtcactttcagcccatcaatatcacccttcaggtacccactcctggagacctcctctgtccgtgggggctaacggaagggcacatgggatgtctctcctacagagggctaagctcttgtcaggagaaacccttctgtggttggctggtgtggtgtgtgtgtgagatctgtaaccacacacagaatgaatccttttcgatgcctggtactctgctgtgcaggcccctctgctttttcaggatttggaaggacaggtccacgtcatgaatgccagttttccccaagaagccctctgygtggtggaggcctcagccaatgtcccagcccagatgaccccatgaggacccctttctgttctccatcattccccaccttctgggcagggctgcctcagaggatttgctgtgtcccttcctcctgagattttcttgccagctcatccaggagcccactcctcctgcaggggaacagcctttcggaagggcagttttataagaacagaggagtgtgagyccctgtgagcccccacgggaggcacgctgctccctcactgagccatggctggcttgcccaggcacacaggcatcatttccagcaagtccacttggtgtagactgtggacctcatgaaggacactgtttcttctcttagttgggggtsagcaaactttttctgaaaagagccatggggtaatttaggctttgtgggccatttggcctctgcagcatctattcaaccatacttctgtagttcaaaggcagccatagataacacagaaacaaaattttagttccttatagacaatgaaatttgaatttcgtataattttcacatcatgaaatgtaggcccaagcgagaaaggatatcctgaaggtcccagagctgggagaagccgggctggggccaagacctggcggcactggccggaccctgtgtggatgaagtgaaggagatgggcccaactcacccataggacacaacagtccatatctcctcactctctggttctacctcccagaactcttctctgcctcttgcgtccttccccatggagagatggtttcccactctggcattcactgctgtggctaaataataattattttctttccttgtggcctctcctaggtggacttaggggatgacaaataatgacagggtgagggtctagagaatgtggcagtaaaacatttgtgggctctgacaaacaatggtcttcctctccccagagtattctcccagcaacagactgcgaaaccatgatacataacacatgtccccagctcacagaggatgtgccttctgaccaactaagcccctgctgtcacaccctgctcttgatttacaggggagaaagggaaggatggggttagagcttgtttttgagacagtagagtgattgctgtgaacagcacctctgcatttctgaattgcttctcagagttattttmtttttctcctttgcttttcgtaattgggtaggamatagataaagacctgatgggtttatttcatcttagttgtttctactctttcctactcttatagttttgggggtgtcttgcaattaaagatgtagttcagaaaattatttagaagggttcaagtaacacagaccatgtaatgaagagggtatgagtgttgaaagaaggaaaagaagaacaggggttgcacagaakataccaaatgttcttatcaccctctggggaacaaaagaaagaaatctgagggtatgcagcttatccttccagttgtttctctgaaggtaatttttacagtgagtttaaagtttggtattcaggcaaatagttttcttcacatctgacctgaaataggactcaggctagagaatccagccctggggaatgagtgattggcatgtcccttagataaactcctccgtgatccattgcctcaggaagtgcacagcattcaatccagggttgagagagttgggtctgaaagattgatagtgtgtgccattgattagaaggagatccttctgtgctagcaaagcccactttttccttgagaattgtctgactacttatttattggtataatggttgttattgtggttgtcctgcaggaaggtcactaaccagcttggcagtgataatgaccagaaggtgaaaatactgtggaaggaggccaggaatacggagaaaatgtttctatatttccttattccagtaatattgttcctgaaggagaacataagactttccatatgaacagatttttctatgcttttaaaaatcggttattcaacaagctacataattgtttaaaggctccactgccattgtacacaggagaaaggcagaaatactagycttgggcctgctttttacatttcatcatagtttttaaacagacacattaatttctcgacaataagaggcttttttggcatcaaaatttaaagcatttccccacctgaaaaacaatggccaaaaataatgcagatattacacatgaacatttgcagagaatccagtataaagacatttgtkaaaaataaagatggtaatacaagctcwcctgtcctcctggctctgatgagtgaaatagtgcaaatcagcatccttttcttcattgcttaccccattcatgcttgaaatgggatttcccagacatgccaggatgtttctttttaattctgtgcactcatgtttcactkcaaattagttatttcagctatggtcagatattccttccttttctatgtcttcaggttgtttggtgaatattgttcttttttgaatcaggagttggcaacccactcatctgctctrtcagttkttatctatttattctttgaagtggaaccaactattgcagaaaaccaaagacacagttttctagggaagagctagctggagctagatcttcatacatcctgtcatgtgtgaagacctggtaagatttctggctttttgttggctctgcccttctgacctcaacttcagagttgcagattccctggattctctctctagtgcccaggccaccaagcagcatgtcattccttcctctctcctacttatcctttttaaacatttagttttaaattgacaaaacttatatattttatattttactcatctttttaaaaataacacctttattgagatatgattacataccttaaagttcacccatttaaagcatacaattcaattattttaatatgtttacacaattgtgaacctgtcatcatcatctagttgtagaatatttttaaatttttttcattttaatttttgtgagtacatggtaggtgtatatatttataggatacatgagatgttttgatacaggcatgcagtgcataataatcatgtaaaatgggggtatccatcccctcaagaaatcccttgtgtttcagacaatccaattatactcttttagttactttaaaatgtactattaaattattattgactatagtcaccctattgtgctatcaattgctaggtcttattctttcaatttttttaatccattaaccatccccaccaccccccgccacagccatccccccattatccttcccagcctctggttagcatccctctactctctgtctgcatgagttcaattgttttggttttgagttcaattgttttggttcaattttgtttgattttcacaaataagaacatgtgatgtttgtctttctatatctggcttatttctttccttttttttcttttttttttttgttttgttttgttttttgaggcagtgtctcactgtcactcaggctgctggagtgcagtggtgcagtctcagctcattgcagcctcaacctcctgggctcaagcaatcctcccacctcagcctcctgagtagctgggactagagttacacaccaccacgcctasctaattttttttgtggagagggggtcgggttttagatacggggtttcaccacgttgcccagctggtctcaaacatgcctgcctcccaaggcttattttacttagcataatgacctccagttccgtccttgytgttgcaaaattttggaacatttcaatcacccccaaaagaaatttcggccttttggccagaaccaccatcttccagtaattcgccaaaatgtcgaacacaaagggaaagaggaaaggcacctgatatatgttctctaggctttttagaaaacatggagttgtttttttggccacgtgtatgcaaatctataagaaaggtgacattatagacatcaagggaatgggtactgttcaaaaaggaaggccccgcaagtattaccatggctaaactgaaagagtctacggtgttacccagcatgctgttggcattgttataaacacacaagttaagggcaagattcttgccaagaaaattaatgtacgtattgagcacattaagcactctaagagccaagatagcttcctgaaacacgtgaaggaaaatgatcagaaaaagaaggaagctggcggcacagtagctcacgcctgtaatcctaacactttgggaggccgaggcaggcggatcacctgaggtcaggagtttgagaccaacctggccaacatggtgaaatcccgtctctactaaaatacaaaaattagccggggatggtggcagccayctgtaatcccagctactcaggaggctgaggcagggagaattgttcgaatccaggaggtggaagttgcagtgagccgaggttggcccactgcactccagcctgggcgacagagcaagactctgtcttaaaaaaaaaaaaaaaaaaaagaaggaagccaaacagaaagatacctgggtccaactgaagcaccagcctgcaccacccagagaagcacactttgtgagaaccaatgggaaggagcctgagctgctggaacctgttccctatgaattcatggcataataggtgtctaaaaaatgaaagacctctggactgtttaaaaaaaaaaaraaaaaagaaaaatccttaacccattgacatagcttcttgtattaatttcttattgctgctgtaacaaattactacaacatttgtggcttaaaacaacacaaatttgttatcttacagttctgaagaacagaagtccaaaatgggccycgctgggctaaaaccaaagtatcagggcctgtgttcttgccagaggcaccaggggaaaatccacttcttgcctttgccagcctctaagggctgcctgcattctttggctcatggcccccttccatcttcaaagccagcaatggctggtcaagtcttaggatgttctctttctgatctgacttctgcctcttccctatataaggactcttgtgagtacaatgtgctcacctggataattcaagataccctctttattttgaggtcgcttgattagcaaccttaattccccctggccacataacattcacaggttccacagatgaggacatggacatctttggggggcctgtcatgctgcctgtcctactccctattcttcctgctccccagccctaggsaaccgctaatctactttctgtctctagagatctactcactttttttattcctctgcatattctgtttcttcctcgagtttcatgttcagctttttcctctccctccttgctcttactggtctctgygacctccatctttttcctcatttctcaggaaatgrttgacttctgaagacagaaaatggagaaatgctagggaaaacaagagaggcaaagttttatagaaccaaatgctgagacagaagaggggtacagttgtgcaagtgatgagctgcagattgcctggaaaccaaatcagctggctcatgtagtaaaaacagccctttctgtatattcgatcgcttggttttgggatgacccacttggtccttgagggcctcagttacctcaaactggcaaaggaaagaggttggaccagatctgtgggtctcaagtggtggttcctggaccagcagcagcagcatctcctgggaccatgttataaatatgaatctgccagccccaccctagacctactgagtcagaaactcggcatgacccccactccatacccccccaccaaaatgtgttttaacaagcccctcagatggttctgatgttttgctgaaatttgagaaccactggactagattatgatgtctgagttctcaccaagtgtaatagtctatgagtaaattcctatrcatgtaaaaagaaaagttttagcaggaagaagacaaaatgctgaaagagaatatggtartttcaaagtttgagatttttagatgcatgttagaagtgtttctattttgttgaaatttcccgtcattcagtagttcactttacttcaagttgtgaccttccagatccgaaccttagagtttctgtatgtgatttcaaagaatcttagaatatatattgcatgacaggaaatggaggtctgctattttccactgagacttgctgtgtgtgttccacacccacaggtctacaacactggcccaagcacccttccagggtcatctgtcagcatctctttccctaatcgactctcatctggtggtgcagagatgtttcatgtccaggaaatggtggtgagttctccatttgttttcactattgctttcagctttgagccagcccattcaaattttgtattccaccctaccctgacatccaccttgagggtttggaaaattcaactcattctaccctttggagacatatctggagaggccaggggacctgtgatacctgaatttctacattgagaccatttggttaatgctgtaagaagacctctttggagatggggaagagttaattacgaaccagctcctgggatggacttcgctggctctgggaacccccagcagcatctgcagttgcatgcgtctgaatgcattttgctgagtgcattttgcacagggaaagtgcctgcagtccatgttgagaggattgtgaaagcattgctctctataggggcacgtgaaggacattcagccaaagggacagtttttccatagatagcttgaaaatcagggcagcaaggccmhtatggagcaggtgaatatctgagccgagagttgaagaggacacagcccacagggtggaggttcagaaaacattgtgtgatggtgacagtaatttctggcattgctgccctctgggtcatgtggactgaaaaccagacgcatgtgaatgttgaatgtagaacaggtcactcctcccgagatgccagctcagatgttaacatccctcatgatgttccattccagttccatggcatccccttgtctttgggctctgctgacccagcagaagaaagccgccagtgttccgcacctatgatgtactatggttggaacttagcatgaggtgaacaaaccacacaggcttctggctaccctcttaaatattattaaccatgctgaccatgccacatttccccagcatctaggagtgttctcttcctagagcatgctttctgagttgttcacrtgaacatctacartgttgcaggagcctttttttttcctatgggcaaaatcatctattgaccaaaacaagacatttaagtcactcagattctgaaggtaccccaaaaccagggataccccttttcctctttactgatcatcgagccaaggaaaagccactggaagggacttgggctcacacttacaaatagctggcttgcatggaaggcattagaagtggtttcctgaagacctggacaactgcctggctatcgttctggctgagtggaccctcagatacccaagtggtgtgagctggctgcactctgttctttgggctctgagaaacaaatcctttggattttcaaaactatatttagaattttcataaagtctgtaacagacttggccctaggatggccaagtctccatctggatagcccagcctgtgatcaaaggctgtgggcatcttcatcgtatggaaaagtaaattcactggcacatctcactaagcaagtaggaaagctctctgtgttcttataaacgatcaccactgagcccagaatgacaacaagagtagaagcataaaagcgagtgcatgaggtgctgtagtgaagaggcgagagtccccagatacttgtttcagaggcccacagctggcacaccctctgccttaaagccctcggcaagggcctcctgtggctccgcccctcccttgctcagyagggcctgagaatgctcactgggtcaggtgtgattcagagctcatgacggtttccactttggccttatgggactttgaatggagcagggctttcattctggggatttgggtggcttggtgcaagtgaaattcagtcctattaggagaaaccagcactcattctctgtactgcactaggaggtgaccctttggcctggtggcattccctccccacccccactctcagccaccaccattccccaacctccaaaggctactgaacagctgggcaccagctggacatgttaagccaactgaagcagaaacagattataggcatggagggaaggctcatctgtcattcctctccacacccttgggaccctcaaattgtttctccctctctaacagtgcccttggtgtctgtattgcctgtgatcatcatccatagagcataatgaggawkggcttactcgccctatgggccctgggctgtcaccctacctacggacccacgtgtggcacagttttctgacttggttcagaattcatttagaagtctctggggctgcttctggggtccctgggcaggaccaacctgcctctagctttcaccaaagagtcttttgtgtttgcccaaagcatttcttgaggtccagctgtctgtaagtggagagtgtctggcttatatatgggaggtttttacggggagcctaatgaagtgtaaccactccaaactcccagccttggctcgtgatcttctttccttgtagctaatgtctctgagcccctctgctgtgcttgtatttaccttaaaaacagagccacggtggtsgcytgaggaaagactatcaattttcactgcttcccacccacgggggttgtgtggaccctactctgacttcccacagcacagaaaaaaaaggaaacaggtcactgtggacctagtgtctgtccatcaggaagccaggttgtaatgatcatgaaaataatagaggggaagaatgacagacctttctagtctatctgaaatagcaaaattacyagtaacaaatcattcttgatttgttcacaaacactggctcagcaagtacctattacgtgccaggctccaaggagaggaataagtcccacatctgccccagaactcactgtcttgcaggaaacagatacataaaatgccattgtaataccgtataacaaatgcaataatggaggcatgcccagaccccaggatgctacaaaggttcagtgcttcacaaaggaacctcttcaagtcagggcttagaggatgtctagttcaccaagagaacaggtgaagaagagaacattccagatagaggaacagtcaccacttgtgagtgtatgatgagtatctgctgtgctgggagctacacccggttctccattctgttwgcctagctcttatacaaataggcaagagtaagtgttccgtatgccttctgcagatgtacagcagatagatattttggcagaatgacagagagtactgaaccacagtcatttcctctgtcagtttgtaaattaatcactcttcttgggtacatcgtgtgtgtgctgtagacctgaaccttcctacctgctgacttaggcatggagaaggccaagctccctgtttgatactagagtctaactacatgtcatggacattgtcagcaaaccacccttggcctgctgcaatgagcagtagctactgacctccctagcttacttttttccttctattggacagtcattctaaaaaactcacctgatttccaggaataaaatgagtgagccagacagcttatgggaggcaggctgtgtccacttgctccttagagatttctttttgaagtgaagatagatcatcttctcaatttttcagaacagacctgaaaaattgaaccacttcactttattgccattcttctgcagaggcgagccgtgtagcatagcccctgagcacaggtctaagattgcaccaagataacacatctgtcacaagcttcatggcttatgaagggragagggtagtggtctttccaaagttaagttttactcacaatttctgaaggttcaatggaagagatgggagctttatctcagactgcaagcttcacttgatggagttaaaaacctgtatctgtgagcagctttctcacactggaggagaaggctttgggatttggctcttgttaatatgcaagaaggggaaaagtcagaaatgatagctaacagggagtgaagggctagaacttttattccaggtgaaagtactggatttttgaaagaactctagtgttagtccagaagagatataaaataaatatcrtaccattcattcctcctcctgcaaaaccaattgaaaatattggcctctctggcttgttgttttcttgctatggggcagtgattctaaagaactgacctgatttccaggaggtaaaattgtagggatgaatgataattttctaaggagatayatcaatgtctttgccatagggtaccattaggacattgacttcaatatggcatgaataccaacatctgttagaatattccaagttggtgccaggactcatattttagtaaactrtaaaatcttccctccccatgcttgtacagtagacargsctacccatgatgtacgatgggtatcccacaatgagtcagttgatgtgggaacttcaattaatttatagtgggactgctcacatccctatgaagaaaatatgcacctgatacatcactgaccataacaggagcttaaaattagacataaatggaggaatgaattgttttccccaaggatgacctggaggagcttcttaagttggggccatcaaatcagtcgatataatccaaagctaaagagtaaagaaattactcctgaataactgacccccccaaaaaaatgaataccatttattgctgtcccaaggctttartagcctttttcatgtgctgtcaaatttaatccttatggcaccttcataaggtaagatcagcatcccaagttgaggaaccaagcttcaaggatttgcccaacctgacacagctgctaaaaagtagagctgggtttgtaaccaggtctgactccaaagttcacgtggttcccattgtgctgaattgcacactgctcctgaaagtgctgcccactccctaawcaccagaggcaggctcagtcaataggacagacagatgakgagtagacccccaagaatcacccaccagaggaggagcatcaacaccagggcagagaggcagcaaccgcartcaaaagaactaataccagagggtgcagtaacaaggccaacagaaggcttctgaataagcaagactgatgtyttcagagcaatgcaaaaagacagtgtttccatgaaacagaataaactagagatttgtaaattcaagatattgatcattcaaatgaaacttcaatataagccatagagtagaataaatattaaagaataaagtaggggattcgaaacttggattttctgagaatgtattgcagaagaacaaaaaagccagttaaacttattcctttttttaaatagcaatstggaatgaaaatatcagatgakcataatataagagttagaagtcaagagagatggaaatgaaagcaagtcaagattcttgtcttggggggacaagtttatgtaccaattagctcaaggctttggtaaaataaatgtttaaatatgtaaaattttaagggcaacaaaaaacaatgtaggacatccaaaccactaaagaagaagaatttaaaacataattaaattcaaaacaatccaaaaggaaagaatttatgaagaaaaaaataaatgtataataagatggaagtaataaacctaaatatttcaataatcaaaataataattaatggattaaatgccctaaagacactctcagattagaattttaaaaatccaagtaccaaataacttgtaagaaatacaccttcaaagttacccagaatgtaaggcattcaaaaaaaaaaggcaaatattaacccaaagaaataaagtatagcaatattaacagcaaatgaagtataattaaagcccaaaacccacaaacattaaacagagcaaaagaaaatatatttcagagtgttaaagatttagtccactaagaatttgtaacataaatgaaattttatataaccaacaacacagctttaaccatagaaacacaaaaagaaattgacacattcacagtcattgcaagaaaatttattgctttcccctcaaaaatcatcacacaagtaggagtaaaataatgagtatttgaataatgcaactagagttgcgatcatttatatagagaccaagacagaatgagtcagaatgtctgattttcattactgctcccttgtttaccagctatggcaacctataggaagttaccttaactccccaatcttattttcctcatctgtaaaatgaactagtagtagtacctatctcacactgtaaggactgaagaaactaatttatatggagtaattaacagagatcctaacataaataagggaatgcacattcttttcaaatgtgaacatttacaaattattcaacatacaacaacacaaaaataagcatcaatggaatttttaaagtcaaagcagtagaagccacagtctctgaccacaatgcaataaacttggaagctaaaaacaaaaggttaggcaaacaaccaaccaaaaacaaatccacttgggaaattttaaacamcattcaaattaactttttagaaaaaaaagaaatcaaagttgaagggatgaacaaattagaagtgaaagacagtgagcggttgttcatatcaaaaccaatgggatttaracaaaaccaacacagaggaaaatgccactacttacatgtggaaaatagggaagactgaaaataagtgaactaaaytgacaacataaaaactagacaagggacaatgaaataaacccaactcaaagaaagtaaaatgaaggtattattaaagacaaagcatatcctgaaatagaaaaaataataacaacaaaagtattccacattagcaaaatcaaaagctgtttttttgtccaaaaaaatagacaaacctgcagcaagcttcaacaagaaataaagaagagcgatgatgccaaaaaacaacactagaaatactttttaaagaagtaccatacttatatgaagatttaaaatttataacatcttttgagctgggcatggttggctcatgcctgtaatcccaggactttaggaggctaaggcaagaagatccttgagcctaggagttcaagaccagcccagacaaggaagtaagaccttgtctccacaaaaaataaaaaacaaattagccaggcatgtggcataaactacttgggaggctgaggtgggaggatcccttgagtccagaaggtcaaggctgcagtgagccatgttcacaccactgtactcaagccaggatgacagatcctgtctcaaaaaaacaaaaacaaaacaaaaaaatcttttcaattktattcacacaaagataaaatytgaataaaatatgcatgaggttaaaaaaaaagtccaactagactatyttagaaaaaaatgtaaaagtagacaaagacctatatcttaaaaaaaatcaccgacccagatagctatataggcagattytagtaggctttcaaggaatggataattcttatgttaatataagctgttccagagagtagaaaaagataaagmaactcattccagaaaactaacatagccctggtacagaaaccagaaatggagagcgggcacactcacgcaaaaataggaagcagtgagccaaactcactttgaaaacagatacaaaagttytaaataaattgcaaattgagggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagatactsgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaattgcaaattgattcctattagaagaataatatagtctgggtaaaacaggatgtaatccaggaatgctaagttggttctccatgaggaaactgattaatataactcattatatattattattaataataaaaggattaaatgaaaaataaccaaatgataatcttgataagggtttctaaaaagttaaaaattaaattcaacatttatttatgatattttattacatttccagtaaggaaagcatagaagacttcctcaacttgacaaagaccctttgccagaaacctataggaaacttcaagctaagtgaggaacaggcatgagtccctgctagtgtctcttcagtttagttgtgttggaggccttaacaataaaaagaaatgatagcctttattcttaaaaaaaaaagtatcctattgtaaaaattgttattgtctccctaaaaaaatccaagagaatcaactgattggccctgaggacttgtgaatacagaaggtaagagctgaagctgactgtaaactgcctgatcttcaaatgctttccccagagacacacacagacccaccaactgagggtgaaaaccttcctagatcaagatgtttacatacagcctctgaccagtcactggctgatcactaagctgtgctgatccaggacagcccctacaaaaccaggcttaaaaataaaaacaagtgataaatatatatatacatatatatatacccacacacacacacacacacacacatatacccacatacatatatatgcatacatgcaatatatattttgccagcagaaacatcagaggctrcacactccaggaaaaacagactccagagactatgtctaggcaagtcactaaacaaacaaaacaaaaaaaaagtaacaactacccctcaatgggaggggtaagaatccagaattgctacaatatattatctaaaatgtccaatttaaatacacacagacactgtatatatcatatatatttctcatgtgctatacaggaagaaaaaaacagttaataaaaactgaggaacccagatgttggatttaacaaagacttcaaagcagctattacaaatgtttaaagaactaaaatcagtttaaataaagtatgacagcaatgattcatcaaataaagaatatcagtaataatattgatgaataaattaaaataagtggaaattaaataaatgaataataaaatagatggaaattataagaaccaaggggaaattctggaattgaaagtaaaacatgggcygagcatggtggctcatgcctgtaatcccagcactttgggaggctgagttgggcatatcacctgaggtcaggagttggagaccagccaggccaacatggtgaaaccctgtctgtactaaaaatacacaaaamttagccaggtgtcgtgggcaggtgcctgtaatcccagctactcgggaggctgaggcaggagaatcgcttgaacccgggaagcagagattgcagtaagccgagatgtgccactgcactccagcctgaatgacagagcaagactccatctcaaaaaaaaaacaacaaataaataaaagaaagttaaacacctgactgggcacggtggctcatgcctgtaatcccagcactttgggaggctgaggcgggtgtgaggttaggagttcaagaccagcctggccaacatggtgaaaccccatctctaccaaaaatacaaaaaattagctgggagtggtggcagatgcctgtaatcccagctactcaggaggccgaggcaggagagtcgtctgtaatctcagctactcaggaggctgaggcaggagaattgcttgaacccaggaggcggaggttgcggtgagccgagatcacaccactgcacttcagcctgggcaaaagagtgagactctgtctcaatttaattaaaaaaaaaaaaaagcaaaacacctgaaatgaacaattcattagaggggctcaatagcatatttgagctgacacagaatcagtgaacttgaagctggattacagtacagattttccaatctgaagaacagaaggaaaaaagaataaaacacaagcaaaatggttgaagccccagaggcctttggtgtgctttgtgggacaccacaaagtttatcaagatatacacaattggagttgcagagaaagacgatagagaaaagagggcagaaaaaaaaatttgatgaaatatcgttccaaaacagtggcagtgtataaactcttcaataaatgatatgaagacaattggctatccatttgggaagamattagagaaagcctgtacctcacagaaaaaaacaaacaaacaaaaaacaggtgaattaaagttagatgttaaaaaaaatatttgcagaactgaatattttcataatctttagatgggaagctcttcttcctaagcaagccataaaatcctgaaaccataaagaaaaaattaacaaatttaaacctataaaaatgttaaacttttatgtgatcaaaatacatcataagggaaaagatatttgggagaacatatttgcaacatgggtaacaaatagataatatataaattacttctacaaaataatgcagaaaagaccaaaaattataaaaatggttgaagttatatgaacaggaaattcacaaaagaagaaattttaggggctgggtgtggtggctcatgcctgtcatcccagcactttgggaggctgaagcaggaggatcacttgaggccaggagttcaaaaagaaattttaatagcaaataaacatatagaaagatgcctagcctcactggtaatcagagcaatgcaaacttaaaatgaggtttttctcctcattaaactggcaaaaatctaaaaaattgttaagatccattgttggttaagatgaagagaaatgagcactttcaaatactgctggtatgaaaggcaatttgacaataactaccaaaatttaaaatatgaatatcaacaattccacttttaggaacctgtctcaaaattttcacataatatatccaggagaaacttctaattttctgatagtaggtgtatattatcagggttctcagcataaatgttgacttctattttggtgaagcagaatataactttaataatgctcccttaggattctgagagaaagttgttagattcagaccaaaaagtatgaaatcttactaacttattacagataggtatagtgcagagatactgtatcaagtactttacaagaacaaattaatctaatcttcataataatttcttaaggaaattgaggcaaggaagagttagagggaaggccaaggtaaattggtaagtggctaagttgacgttcactcttaacagtggggttcactgtgaaataggagttcagcaggacttgtttctcaagacgcaggtcacagagaccccgctgataaagcaggatgtggtaaagaagccagctgaagacagccagaatcaagatggtgacactaatgataattcaccagcaccatgacaatttacagatgccatggcaactcctagaagttactctgtatgctctaaaaacagaaggaaccctgggttctgagaattcgcagcccctctcctgtaaaactcatgaataatccactccttttttagcatttaatcaagaaataaccattaaaataggcaagcagcagcccttgggyktgtktwacctatggggtaaccaccttttatttctttactttcttaataaacttgctttcactttactctctgggcttcctcttgaattctttcctttaggaagccaamacccaccggccctcccaggccaaaccccaatttgggggttcatcctgccacaactgtacagtgtggggtcaaggggaacccttggtctttttcactgaaaaatcaactcagaaaaggcagattaataggagaaaaggcacacagatttatttaacttgtatacaggggaggcttcagaatgaagacccaatcccctggtaaggtacagaagcttatataccatcttgaggttatagaaagaatgcaggctcagagcatgaccacaaccaggttttaatggcaagacatgtcatgggggagagaaagaaggaggcttggctagcaaaggtggcattgttatgtagatgaagccttccaggtcataactcctagagagaatagatggtgaatttcttttcagacttgtaaaggtgtcagactcaatctgtcctagatctgggaaaggcctggaaagagaagggctggctgcattcaaggagattctctacaggtgcaaaatttccccacaagagacagttttgcaaggccacttctgtctgctggcccagcagcagccatttcaaacgatgtcaaagaaatctattttgggataaaacattttgatttcctttagccacttgcagggtcttgcgccatccttttgtctgggtgcgtagctgtccagcagctctagcactacctggaagttgaggcatggtcatgcagaactaaggccccacccaggcctgctgagtcagagccttcacttcagcaagatccccagggattcctttgtctgttcatatttaagaagccctggtctaaagcatgagacttaaatctctgctctcccattttcttatctgtaaaatggtgatgacagtcctcaccacaagaggctgttgtggggatatttttatacacatgttcattctttcaacaaatactttgcgcccagcatatgctaagcacctagtgcagagaggaaaacagacaaaaagtaatttccagccatcatgtagcttacattctggtggggaaagagtaataagtaaagcatatagtttattacatgatggtaaatgctctggagaaaaatttaaaaagcaagaggatagggattgggaaaggctgtaattttaaacggagtggtcagggacagtttcacggagacctttattcagaagttgcagggaccaaagctatcttacgggagtttgcaatgagaatttctttgcccatgragtccttgccaagtctatgtcttttctgagaattctctcccccttgatttcagccctgtttgatttctgacctttgaaatgccagcccccatgctgccgttgtgtggggttccgactggacatccagaagtctccgtgtgtgttctcattagctttcactctgggggagttttctgccacaatgtgaatcacttattttgctggcagcagcagttgacagtgacactgatttttaaagcctgcacatttcacatcagaaaagtcctggattttatgacttagctatgcttagaggataattgcaacaagaagtctcccctgcagccagcttattggagctgagacttgtataagagccagacctggcactttaaacagcccagcaaataacccaaaacaaaaatgaacaatgcacatttttatctatgctgctcttccccatcatgaacacatgcttctttttttcctcgccttcaccctcaattttttttgtggaaattcaatggttgactgtaccaagccagctctctgggtgagaggttccttctaacaaggattagaaacccctctcatgtaggaagaggtggatttgggggattatatgatccaaccctctacctttggacagaatacaatcgagatgtctccccagtacacagaactgcttttccagcaagttctctttgttaagccattctggtatccctcaaatcccttgttatgactatccacaattctccatgccccatgaccctttcttagctaaaatgaaaaataattgcctagttccctcatgtagagaagttgagctattaccttgacttcccccttctcttccaaaaaagattacaattcctttaattttctttcccatcctagggtgtcctctttgctctctccatattctccaaataaaaattcaaaactgagcagcaaatcctgtgcctcttcatccaacccctcctcatcatgaatcattatcactcaggaagtaaggacctggtttacyatctgagaactttagtcctaataatttctctacaccaacttctagtcctaataatttatccgtataatgctcagaaacactccgagattctcagtaaaaaaaaaaaaaaaaaaaaaaaaaaatcarggaaatcttaatggccaaagccataggtccaaaacccggcgttccctcccamccaactttccaggccattttctccaatagcccctcatccctgaccttgtcttccagcctccctggaccatgaatgctgctgaaggctctcactttgtacttccctgggccccctgcccttgctagtgacttctcctcccctctggctgtggaaagctactcattcttcaagacccagttcatatgtcctctctgtcaaggcttcccagatgccttcacagatggccctgcctcagggcctttgcacctgcctttgctgagaacactgttccctccaatctttgcatagctggctccttcttmttatgcagatctgagcccagagttcactttctcaataagtcttccctgaacactttacctaaagttgcaaacccccattactctctatctcatttgtatgttgttttcttcatagcacttgtcactatgtgaaattactctcttatcatcagtcttcttccacsagattaaaaacaccatgagagtaaagggcaaggtccttattttctgtgtatttgcagcatttggtgccgagaccatagtgagtggtsagacaaatgaaagaaatggctgcttccactctgttagtggcatcctcagacacacagtcaccccttgtatctcctggggattggctccaggacatccccccatctctacttgagatcgcccagtaggaatattttgaacaaattcctttaacccatggcagaggttgccttaatttcaatgtgagaataagaaggtgaaattttgaaataagagattgaattacttatcagaaacgaaagcttcttagagcaaatttaaactctacaaactttggtcagggatttgaacacatatttccttccccctcagtttctctcacacagacactgctgatytcagtaatggccctaaactttcttttctttttcttttgcattttcttctttctgcacatgtatgaatgcaagctgaatagtcaagttcctgaaatgggtcaggattakgtttgccttaaatctttttctcaacagaagccaaacacttaaaagaagggagatggctgattgaattctggaacaaaagttacattcctaggctcttggttaatttgagcttggctagagggagaaagcgtgtgtgtttctgtgcacaagttacactcaacacacaccctctggaaggtgggggtaagcttcagtcccgrctgtccgtacagagtgtggttcagaggctgccctttaacctgtgtggccagagagaataaatcaagccagcagtgctgtctccctgctgactgaaggygcccggccttatcaaggagcccaaatgtcttgtgctcacagctgctgtgacatctggaagcattaacactttgttgccagcatgtaggctagttgaatgccgatgcgtaggtgcctggtgttttctggtctgctacatgaataggcgtcaaaagttggtggtgaggagtttgcttacgttcattccttaaaagcaacatgacacagagccttgccatggcaggggtgatgggttgttaccaaagtcgataacaggaaatctcactgaggataaacagggctcatcggccattgccgagaaacacatggttctcatttaacctgccaaggactaattgtgtatgcttcggaagcgcaaaaacaggaaaacgcttttctgacatacaccccaagtttcttcagaccaaaaagaactgcctcaatgttgttagacgctgagaagtaatgatctccccagctgtcagggagccaacctcacttacttctctttaatctaaacttatgacctaaagcatatttcaggcctcccatgaagtccttgaaacttgagacttaatgaaggacactgaggtttcacttttcactgctctggtgtatgtactctcagaaaagcagtggaagaggttagatagatggtgatgtaggaatcatggcatccagaaaatgagtgtgatttaccctttgataaaagggaactaataaagcaatatatgcaggaaatgcagagacaacccagtgaataggtgtgctgctttagcctttaagggaagatgggtctgagcttcattctttaccttaagatgggtccaagagctagaaccagaatttaaacaagcagatacaattccaaggaccatgttttgtctcatatgggggctattcactcatttattacccaaatcaacagaccattctgcttccaaaatatttcattatctgtggaaggaaaacatttttggtatgcatgtcaagtgctcagataacatatttatgtatcgctttttcactaaagagaatctgacsgcatctggaaattcttttgtgtcactgcctctctcagactacttcccatctgtatcgctttaactccaataaaaggccatccccatgcctgggaaatgggctttgtctggggaacttgtctttctctgattacatgtaaattaattaaagcccatcccgttttacagggcagcctggtggtggtggcctgcactcttgactttccagcatgttggcctgtcacacgcaaaggaagagggaggaggggaggatgcaggggcattgttttagccaaaccctaaagctgatggaaatgaaatccactggcttttatcatgagaagtgaaattgttcatgaaataatggcagcctcatacagaggctgtgcattggattatactcaacctttcctctgaaacgttggtctggaggctttgcccctttattttcagtttcagatttgatctcagtaacaccctgaccttttcagactccataccacttttcacagggatgactgccttaagggatggggaaagggttagagaaagcaagtattttatttagaagacagttttcagttagaaagggagaagacatctagagttaaagttacgatcttttcctttctgtgcttaagtgatactaggtcattctttaacttcttgctccacctgctctatccccagctctgcaggtttggagtggsctgtcatgtgattttgtttacccgtttcggttcaaagacagaactctttatttgaacactgaagctagcagggactgtccaaagccagagcccctcatattagcctagcttatgttgttgtgatcatcagactgtttctgttttttggatttttgtccwtaaataaacaccttggaaccactagctacacagaggggtaaatatcagaaaatccaaatttggtgcactaatgaacacggggtctcttttcacaaagcaaaagaccatcattcttcagaaggatctcccaaagaatgccattgaaaactcctcattaccttcaaatggggtgatgcacacacragtagcatgaaattagscatgttcatattaaggagcaatctaagatcattattgctgtttctctggccttatattaaatagtgtcattgcarttgaaaaattagagtaaatgaacagagcctgtgagcatccaccctttgtaggttatcctgagtctgcattattacagggtcttgaaatgaatggtgatacgtgaaagtatttktcctaggattcattaatattattatatttwagtctttggtcaatatgaagaaatactcaatagtaaatcatagcaacatgatttaacatgagatataatttgaagggctctttaaggctgctaagcaaccatgaatcrtggtttgcatttttctagatggataatatgaagctatcttatttatctttctagaactagacaccttaggtcaggctaatcaaccagctggtatcatttctcagttattgtatgactactatctttatttcaaaccctgaagtcctaaaattaatgtcaccacagccattgtagtatgtgttcagccgcctgtgccggaataggggcttactgtcttttgatgccttggttctcagagtaggcaatgggtaattgaattagcaaagtagacattcaaaacattctctgagttttcaaactcaaggagcgtgtgacttcagagaagcaggcgataagtcagggggtgggtcatgtttacccggttgccgtcagctgcgattggtgtaatatgatatggaaaagtggcccagggatgtaactgagaacataaagtcaatgaataacacagaaacgtgagttaacaggaaacacatgttattctaaaatgaacctaggtcccttttaacccaagccaattcaacaaacatagcttttagatcataccttttaggtttttttttttttacccaaaaaccacactggggatgactccagccgtggctcatggggaacactactgtcattcagtttgttcctctgctaatttaatcttccattttcctttgattggtgatgcacgcattcaaggggcatcaagccatggacactttggtgaccctccctatccttggaaccccagccagctgatggggttcgtactggtaaaatggcaaactggtagaggcatctatgcttctgcctgttaaaaatatactaataggccaggcgtggtggctcacacctgtaatcccagcattttgggaggccgaggtggacggatcatctgaggtcaggagtttgagaccagcctgaccaacatggtgaaaccccatctctactaaaaatacaaaattagccaggcatggtggcacacacccatcatcccagctactcgggaggctgaggcaggagaatcgcttgaacccggaaggcagaggttgtggtgagctgagattgcaccattgcactccagcctgrgcaataagagcaaaactctgtctcaaaaaaaaaaaaaaaaagctaaaaatatcacataccaaagctgcaaattatttctttaattttgagcgacgttaatccacatgatctaaatcatacattctcacacattctcctacttcaaagctttccctggttcctattaccttctgggtaactacctccacccacgccatgtgtaagacttgtcacatgccctcctctgtgtccaggcccatctcccctgcctcagttctggccactgctacccagcattcatccagtgcttgacctgtgttgaactccttggctctctagactccagtctcaagtttgcccctctatgcttttgcacatgctgttctcttcctggaattcctttctccctcctccctttactcctgagaagttttctttatcctttgcgatctacctgcaatgccacttcctctgggtcagatatgagaggggctgacttcctggtggagggagaaatttgtagacaagatttataatctcattaggagctgtgctctgaggggctgcgaatggataaacagtgaggtggtggtcaggtggtgtttgggcttcagtatgtggaatagctactatgcagcctggtgcaaggaagatggagtgggacagagcatcctggtggggattttcgagatgtgcttctcagacatgacaggttacttaacctctctgggcctcagttttctcatctgtaaaaaggggtggaatttaaggagagcagaagttaaagcttatctgtcacatccctgataaatgtctctgtgctgctgttctagctggttgaacctcaaaaatgtcccagtttagacaataaattatatggtcacccttctgagagcagtaccctccacacatgggtgccgtaaggattcagcatatgccgttctctaacatactaatagcacctaatattgtattatttccattgatatctgaactcagtatagagatgggaccataagcgatttcccaggatgatgtgcttggagcatgacacttagaaaaaagatcagaggacttttctgcctcttcagtgttcaaacccaggcacagggactgtgtttggctgctctgtttggggccctgtgggaggaaacctgtgtcctctctcttgctctgagtcaacagacaactcttagaagtgcctgaytgagcctacaacatggaaatgccatttcctccaagccgtttatctgaccacctcagcctggaaagtaacagctcttgacttcccttctccacctgggatcagatgacgacaacatttgaaacaaagggtctgctctctttctcagtatcacacctatggaatcagccctgattcacacttcaaacccactacttcatgaagcaaggtcttgccagatcccctagagtgaacaggggattctttatcctctcacaggcctggcaccgtggtrgcttctgaccatgacagctcctttcactgaggctgacccagactctgccaccaagtgatggccactccttgggctcccacagccagggttcctgacagcttccccagtcaccaccatttcatggtttcagtttgcacaatgtcctctttggggtaaaggggaggacagatgccaacagaaaaccctcagtacctgccttggtagaatacagccttgtcactgtgtcctgcatcctcctktccttgtttgggtgcctggtgaagtccttttgttcaaattctaatagccatggacctctgccagctcccagaggccctgagagataagcagccatgtcatgagaagcatttggactccggtagcctgggaaataaatgaggactgactgggcagagaagagcaagggggcgatggccacagagtccttagccagccaaggaaatgacattgttggtcattggccggggatgcttgggttgtctgcaacacatgaaaaaagcatcaygtccccttgactttgagcaaagagtgcggttaaaaccaagttgtgggaggatggatagtcagtaattgtttatctgtgtgatgagataaggtagtcccctgctgtaatgaaaatgcacagacagttcatgaagtgaggaattagcaactaaggacaacctgagtgactacatgggccaacatcctcatgtgtagatgaggaaactgaggccctggagacccaaactggcacggctgttagcaggcagagctagggctgaagccaggactattgagtattcatcaagagcgtctgtaccacagaacttcactggggcccggacatgaccttggacaagtcgctgaactcggggacctctgtttccttatctgtcagctgaggccacaaggactgcatgatctcgcagctgccttccagaaacaacattccagaatgctctgttccccccttccagcccaagagactgtgcagaataggcctcttctcagtcagcaggcacttttgtctcccatggtctaggcaggagtcatttttttttgctacagtggtggaaatgggtcaggctggagaatgctgaggtttccaggctagtggtttcttcctctgaccacagtaagaggaaaggaagctttccctccacctctactcctctgtgactcctgccccagccccatcctcagcttccacctaagaggtagtgcaggaaagtggtgataagcagatgtctgcagctgtgtgacgtgtgtcccagcccagttctgtggcctgctacctggggagcctctggttgtmattgggcctcctgttgcctctcagcttgcctccmtctgtaaaatggggacagtaggccaggggctgtggctcacacctgtaatctcaacactttgggaggccaaggcaggtggatctcctgaggtcaggagttcaagaccagcctgaccaatatggtgaaaccccatctctactaaaaatccaaaaagcttagccaggcatggtgrcgtgtgcctgtaattccagctactggggaggstgaggcaggagaattacttgaacccaggaggcagaggtttcagtgagccaagatcgcaccactgcactacagcctgggtaacagagcaagactccatctcaaaaaaaaaacaaaaatgtggggacagtaatagcacctgcttcagggaactgctgtgaggactgaatgttaatgtgtggaaagcaccgagagcctggcgtgcagtaagggccatgcaagtgttaggtgccgttgtcatggctgtcacattggtacctgttcaacacacttagaggaccgcctccctccaccttgatgacccttggtaggtactgagttcctgagttttagctgaggactgaaggtgtgactgcaataggattagctggtctgaatcagacttatgtagcaccaggcaaccttcaatctccttttgaaaggggaccaccctgaacctttcagaaaaacgttgctttccccgattgaagtgattcccatgtaaccacagtcgggagcacaactggccaagattttcattcaccgcagactcagtcctcatttcccctttccagatcccaccaggggcagatgaggtgtcacattgcatcacatcacgccatcgccattaccctgttcacaggccaccccagaaactcccggcgggagacagaaactaacttctgagctgtgactctgccccttggggttgacactgaggcttaggctgtttctcactcgcttgccctgcctttcccagctccctgcccctctccgctggcgtcttgtggccagatgacagtgctagctcttcacacctgaagcacattagcaacactggctgggctggagctctgctcccaagcttcctctccctgcctagaaacctgaagcaccgatgtgcagagcaaggaggaactctgctcccacgcctgattttaatgagggatggatgcatcctgcagggctcagaggttctgtttctctaaacccagaccaaatgtgtttgggtggccaggcctcgtaatctcagcagaggaatgtgcatgccacagggctgcagaaaacagtttccagcggtctgtcagcagatgtccactccagaagacagacagggaatttggagacctacaggctttggagtgaaaaagtgatggatattaagagcacaactacacacattcggattctcaaacgcccaataaacataaatattttccatccacaatgtactatatatgcctaaatatagggcaagccccaaatagcacatcctccatttccctaattagataaatttaactctcttttttttttttgccaacttaataggaatcagaactatgattgcctttgaggtggggggagtgggcagtgggaattgactggcaagggactggtgggaactttctggagtgagagacaagttctgtactttcatgggggtggtagttactgggtgacataattcatcaaactgcaccctttagatctgtggattttaatgcctgtaaatttacctcaataaaaagaagtttggagaaatgaagaaataatcaactatctgtgtataatgtttaacttaatcatgtggttgaatgcttaaaattttataagaatgatatattaatctataatactcttcattcttatgtttcacacaataattttatccaagtgtgcatcttctgagattgatgggtttcatttctaagccacatttttagtcagcagtttaccagaatatatcatctacaatttgcctaatttakttgaaatgcagaacttcttgaatccatgttggtgctgaaatttgattggcacacaccaacgcccacttgcgtagcactgcagcagttgttttcctcatttgtcttgcaagtgaatattcatgctgctccccacatcaacagcttacgtattgctttctaaaatgggctttcaaatatttattgcaactttcaacaattgaacccaaggaataattaccaaatcttcattaaagctcattgcctccttcccattgtttccctctcgtgacctctaaaatcgtccaracctgatgttgattgagatcatttcaggctagtgtgttttccccaaatgttgtcgttcaaataaagtaattgaggctgggtgcagtggctcatgcctataatcccagtgctttggaaggccaagacaggcagattgcttgagctaaggagttcgagaccagcctgggtaatgtggcaaaactctatctctaccaaaaaaaaaaaaaagaaaccagcaaaaaacaaaacaaaacaaaaactagccatgtgtggtggcatgtgcctatagtcccagctactcaggaggctgaggaaggaggatcacctgagcccaggaggttgaagctgcagtgagctggactactgtacttcagcctgggagacagagaccctgtctccaaaaaaaaaacaaaaaacaaaaaacaaaatttccaaattaytagacacttaaattttaaaggacagtaagtcccaaactgtgagaaacttttataggcaacatcctcttttctaatagtttaacttgaggatataaaccttcaccttatttattttcagacatatatagtaaatcctggaatgtattcagatcaaagataaaatagagataaatttagcaaattttggtggtcttgttttataattcactattaatagattagcattgttagctttagtttatttgtgtagcaaaaactgaccaatagaatctaattaaactgaagagcttctacacagcaaaagagactatcaacagagtaaacagacaacctacagaatggaagaaaatatttgcaaactatgcatctgacgaaggtctgatctctgtcatctataagggacttaaatttgcaagaataaaacaactccattaaaaggagggcaaaggacatgaacagacacttttctaaagaagacatacctgcagacaacaagcatgtgaaaaactcagtatcactggtcattacagaaatgcaaatcaaaaccacggtgagataccatctcataccagtcagaatggctattattaaaaagtcaaaaattggcctggtgcggtggctcatgcctgtaatcccagcactttgggaggccgaggcgggcggatcatgaggtcaggagatggagaccatcctggctaacacggtgaaccccatatctactaaaaatacaaaaaaaaattagccgggcatggtggcaggtgcctgttgtcccagctactcgggaggctgaggcaggagaatggcttgaacccaggaggcggagcttgcagtgagccaagatcgcgccactgcactccagcctgggcaacagtgagcgactccatctcaaaaaaaaaaaaaagcaaaagtcaaaaatcaacagatgatggagaggttttggagaaaagagaatgcttatacactgttggtgggagtataaatgtgctcaaccattgtggaaagcagtgtggctattcctcaaagagctaaaagcagaactgccaattaacccagcatcccattactgggtatatatatacccaaatgaatataaatcattctaccgtaaagacacatgcacatgaatgttcattgcagcactgttcacaatagcaaagacatggaatcaacctaaatacccatcaaagacagattggataaagaaaatgttgtacagatataccatggaatactatgcagccataaaaaagaatgagatcatgccctttgcaggaacatggatggagctggaggccattatccctagcaaactaacacaggaacagaaaaccaaatatcacatgatctcaatgataagtgggagctaaattatgagaactcatgaacacaaagaagggaacaacagacactggagtctayttgagaatggaggttggaaggagggagaggagtagaaaaaataactattgggtactaggcttagtacctgggtgatgaaataatctgtaccaaaaacctccatgacacaagtttacctatataacacacctgcacatgtactcccaaacataaaataaaagttaaaaaaaaaccaacagcaaaaaaagtttttgttccctaccatgaataaaaagttgaaacattcttgaacaactatattttactcaagggcattatagacagggcaatttaacagatgcctgtggttagccatgggattgtaagcacaattctaaattatgaattactaattattaattttctggtttaacctcacatcctgtccagccttcagctacaaccagtgtgatatggtgatatataaagaagacttcatttttctaacagttcctcaatttaaacatcagaaagagtgctgtycttaaggaaatcatcaagaaagactaagcaccattgttttgtttctgatgttgctgtcactcagcaccgttgccattgctgtcagaagcaaaatcaaatcactcaccaagagctcggcaagcatgcaggtccccgtctggctcagggcagagactggtcagttatttttttggtagcaaaactctggctttagagttggaccatgagcagtcctgcttgctgctcattccctttctctagaaggacccctawggagttttacagcaccgtgggggctttctagaatggttgaaaacctctggcagcagatcatccatcaggcttggtcccaagttccagacctgggttcttgactccatgactgttggccagtgacctaagttcagtctcattttcctcattcagacaagaattgcttgtaaggatgttcttaagtgtgctttcaaaaccatggagtataaggcttattttactccttaagtcttcctrtttcctagtcacatctcatttgcatgttatatgccatctcatcaattattgggggacctaagatccacatttyctattatttggccctgttgatgctacaacttctgcctttcagcttttcagccattgttctccacttcaaaatggacaaggaggaaaggtgaattggggttctaccactcctscctctacaataagaggctccagcatcatgattcattcttgagaatgactcctctgacaggcctcttttcatttgcaggtgggccaagagaagggaaactgctctttccagaaaaacccaactccctgcatcatccctcaagaacaagaaaatatcttccacacaatatttgcttttttcacaaagtctggaagaaaagtcttggtaaggatttgtttagtggttggggtaacacgggtggtcctcactcggaagacaccagttttctatttgatatttattatttcctaaatctggttttaatcaatttgacttacaaaggcacagactgtggtcaactcctaattttcagtctgaggtttcaatcaaaatgttaaatttacattccaaatcctattacctggaaaagggataaatctttgcaacccaccaagcacaaagtaaaatgtttcttccactagaatgagtctaaacaagagtgattattcttgtgcaaacattttgggaaactgtttgataatatctactaaaacaaaacgtgtgtatcctatgacacagccattctactcttgagtatatccccaagaaaaatgagtacttgtgcttcccagaaaagacatgaaaaaggatgctcacagaaatgttaaaatagctgaaagctgagaacaatgcagatatccatcaatwggagaataagtaagcaattgtggtatatccatacactggaatattacacagtaatgaaaaataacaaactactgctaatgaatgaatctcacagacagaatatattgagtggaagaagctagagacaaaagccacatattgtaatatttcacttatacgaagttcagaaatagcaaaaactaatcatgatgatagaggtcaagaaggtggttactttcagaggaatgtggatgggatggggcatgagggagcctgcttagatgctggaaatgtcctacatcctaatcagggtggtagtcctccaggtataaacacatgtaaaaatttttaaagacaggccrggcacggtggctcatgcctgtaataccagcacttagggaggctgagggggtggatcacctgaggtcaggagtttgagaccagcctggccaacatggtgaaaccctgtatytactaaaaatacaaaaattagctggatgtggtagtgggcgcctgtaatcccagctactagggaggctgaggcaggagaatcggttgaatcagggaggcagaggttgcagtgagccaagatcgtgccactgtactccagcctgggcaacagagcaagactctgtctcaaaaaaaaaaaaaaattataaagacacacacttcagatttgttctatttactatatttgttacacctccatttttaaaaagtgcaggtattgaagatggaatgacaatgcttttccaaagcctccttttttttatctttggttacatttctctaagctccttatttcagccctggcacatctcacctttatcatttcctttctcattcttttctcctgttggagaagggtgactgtttgccacttgaaaggttgggtttttttttttttttttttttttacttacatagtgagggtgatattgttgaaagcccttagacttgttagatgtagtgatacctagtgattttatagttacgactctgtctggctgaaaattttgccgtatagatgaaacatcatcaaggtatgtatacgcattttggaacctatcatataaaaamgaaaacttttgtaacttaaatttgggatttatgttttyggytttttgtttgtttgtttgttttgagatggagtcttgctctgtcgcccagggtggagtgcagtggcatgatctcggctcactgcagcttctgcctctcgggttcatgcagttctcccgcctcagmctccccagcagctgggactacaggcggccaccactatgcctggctaacttctgtattttttgtagagacagggtttcaccatgttggccaaactggtcttgaactcctgatctcaggtgacccccctacctcagcctcccgaagtgctgggattacaggcgtgagccactgcgcccagccgagatttacgtctctattgtaacttttgtgttttcttgaggaagtgtcacatgacttcttagccctcttattyacctacctaataaataggcatgaaagtatatttgccactacacaggtggaagtcacataatgtaggaaacgtgtctgtgttcaaaactcataagaatgctttcagaatgcaaaatttaagtttgtgggtttaaaaaaaaaaacaattatttctctttgtgaattcatccaattcttggtaggataaattagtgagctgttttctcccagttgcttgacttaaaggcatgctctggttcccactgggtgggaaatcccttgaatgccctctggtggcgagaaagaacgattgcatcttcttgtggatttcctctgcctggaattgccttagtcaccaagttcatggagcccactactctgtaaattgttgtggatttgtctttgttcttaattccattggaaatttttctgacttttcttctcaggactgtgaaaaaccaggaatttcttgcctaacagcacactgtaactttagtgctcttgctaaagaagaaagtcgtactatagacatttacatgctgctgaacacagaaatactgaaaaaggtaagccctaatgaaccgcacttgtggatgcatttagaagcatttgaattgttgacatctgattttgggtaaaaaaaaggaaaaaggaaagcatytgaattggtgtcctcatgacaatctggctgcccccccttttggctgtctacaagagactgtttttatttttatgtatttagggggtacaagtgcagacttcttatatgaatatattgtatcgtgatgaaatctgggcttttagtgtacccaatagtgaacatggtacccaayaggtaacttttcaaccctcacccccctcccacattttggagtctccaatgtctgttaattccactctttatgcctatgggtacccattacttagctcccacttataagtgagaacatgcagtagttgactacttatgagttatttcacttagggaaatggacttcatttccatccatgttgctgcaaaagacataatttaattcttttttatggctgagtaatattccatggtgtgtgtgtgtgtgtatatatatatataccacattttctataaccagtcatccattcatggacacttaagttgattccctatctttgctgttgtgaatagtgctgcaataaacttaccagtgcaggtatattttttatacaatacttctttccctttgggtatatacccattagtgtgattgctggatggaatggcagttctatttttagttctttgagaaatctcgatactgcttttttgattgtactaatttatcttcccatcaacagtgtataagtgttcccttttctttgcatcctcaccaacatctgttgttgtagttgttgttgttgaactgtttagtaatagtctggctgccccttttgaaacttttccagcaagtgccattggtaattttgctggtagataatgccarggtaaaataccagacccttgctactcaaagtgtggtccgaggaccagcagcatcagcatcacctgagagtttcttagaaatgcagaatcctgggctccaccccagacttaataaatcggcatcttcatttttaacacattccccagggattttgtttggccatttaagtttctcatgctttagcttgcatcagaatcacctggagatcttgttcaaacacagattcctttggggtgcagtctgaggctctccagttgccacaagcacccaggtgatgccagtcctgcagtctagggacctcgctttggatgaaggttggctaaccttttctgtaaagggccagtggtaaatatttcaggctttgcaggccctacagtctcttgcaactgttcaactctgccattgtattgtgaaagcagccatagacaacactcaaataaatgggcatggctgtgatccagtaaaactttataaaaacaggcagagggccagatttgacccatgagtcctagtttaaatgacggtttgttttggtccaacttttgaacctcaggtcactttgctattatgagtttatcacaggtggttcattaaaaaaccacctcaaccagtgcatcggtggctcttgaagaatcatacaaatttcctatgatttattttaaggtgagagctgctgagaggccacttccaacaagttgctgtaaaaataattacatgtgaagataaaactaaatatgcatgttagcctcagagattccaattatttttctttagaaagactaaatgtgttaatctgtacaaacctatccacgtgtgaatgaataaccttagaaaagtcattctgtggttatttttaaataggcacagaggtaacacactgacctgagaggatgcaggcatcaggggatgtttttccattttcaatctgtagccgttacagccctcacacacctgaagagagctgtgcatagttctggtttctctggtttgctctggagggaaactggtttggggcaagttggactcacactgcagtgctttcttctccctttgtacctctccctttataaaggacagtgttggaggaggaccaggcctgacttagagcaccactggccatcctctgattccataagggaggctggaaaaccccacgtctggagaagtaccttcctgaaatgtgtccrcaggccaggctggaggactatgcctctgcatatgtacctgtcctgtttgtattcttcaaaaatggtgctgcagacagttttatngcctgtgccatacttgccactgtccatagagccctggtgacagcactggtggctgtaagccactctgatgtttcctttatcctcaacccagatggctgctgcttgcacttcagttatttgcacttaatcatgcacagctctgcagcctggttcttctgcttttctatcccggcagccagtggtgaccctttgccaaggaacatgtcccagtgactactgtccccatgggccagccaggccagtagagccgcaggcaagagagctgaaagctgtagggtgtcatatgaagccttcaaggctcattctccatgtgccctttcagcagaaaccaggagcacttccaggtgcagagaaaagcttagaacaaagttgacctggaagccagatggggccccagctgctcccagagcttcagttgccctgaagccagctacagcctcccttggggagtggagcccacatggctccaggcctcccgaaggatgtggagcagcgccagccttgtggtttgcctgggcctgcagtcgtgtttattttccttttgacctcaagatctggccccagacaagggaatttgaggttttactgttttgaccttaacaagttttcatttgaaatgtaggatctgatttttaaaatcactgtaggagccgggcgcagtggctcacgcctgtaatcccagcactttgggaggctgaggtgggcatatcacaaggtcaggaattcaagaccagcctggccaacatggtgaaaccccatctctactaaaaaatacaaaaattagcctgrcatggtggtgggcacctgtagtctcagctactcgggaggctgaggcagaagaatcgcttgaacctgggaggtggaggttgcagtgagccaagatcgtgccattgcactccagcctgggcaacagagcgagactctgtctcaaaaaaaaaaaatcaccgtaggattcggatttttttggaagtattcttctttcagtctgtaaggcttttctcactgattctacaaccgtgggggcccatcctgtgccagactcctcgtctgcttggcctgtaacgttggcaattatcatcatcattatcgttattaatatccaagtttatttttattyattttaatgtttttatttaaaaaaatatttttagagacaggatcttgctctgtcacccagatgggagtacagtggctcaatcatagctcactgcagcctcaaactcctgggctcaagtgatcttcctgcctcagctagtcctcagctaggactgcaggcacatgctaccatgacaggtgaatttttttttaatcttttgtagagataggatgtttccccaggctggacttgacctcctagcctcaagtgatcctcccacttcagtctctcaaagtgctgggattacaggcyttaaccatcgtgcctggcccaagattattrttattattcaagattgaaaatacagcatatcctgatacataaaaccccaactttataaaactgttaaattggtaaaagattatttgttgcttaaaattatttcttgcttaaagtgagttaactggagtaactcttttgaatgacaagcttcccaaaagcatttaaaatgtgtcttatggttgttttaagaaaagaatgataattggtgcataactcccaagtcacatatacagaccagggtccctgtgtgccccaggaaggtctttgtggkttctttggcagagatgagcaaagggtacccttggaactgttttctgtggagtcctctaccttcctgtttctttgagggtttaaccaaaggtggcatttaagtgtaagctccttgcatgacaggcaagctgggtagatgtaggtggggacaccacargacaccttgcctgtggagcccctcctgccccacaggtagaatgttgaatgcactagttctctgctatctgtttccacgacagaagccaggctgcccttctgctccacaatcaacctgtaccactggcttgaggttctggcttctccccagaccacagtttttccagtccctgtcttcttccaaattctttctccatccctgttttggcgccattttctggttatctggatcagtgtctttgaatctgagcccacaggaagacctctgcctgcctctggctggggggtgattccagagtcttagctgtgctcccttatacccctgcccctttctccttaattcataagccagatatttaccccttccccatctctccatcaggcatcctctttcaatgtttaatggttttgattccaaaatgacttcatttaagagcaaagaaagagttaaaagcaactcatatgaagggtttgagggttgtggtcaaggcaggaagatgcctataaaatgtagatcagatgccttctgtggaatgccaggcctagatttgctctacacaattaaacagctttatttatcctcaactctttgtgaacatgtcaatatcartatccaaatatctggctctaactgcttggaaaccacagcacacatcttgcgtgtgttgattactggcaaactccatcatttcccaccatccaccatgatctgcaaagaatccttaagagagaccctagtctgtgtttatgtgggtgcctgggatggagaggtatctagttcaatgataaaatttttgtctgggctacatggaatcatggaatttcagttctgcccagtccctctcaaggcccagccattatcatagaaaaatcytcaagtaagttgtgttgtttcttccacaggacagttcgtctgtcatccagttcatgtcccgcgccaaggtgaaggtggatcctgccctaagggtggtggaaatagctcatgggaacccagaagaggtgacggtgagtcagccaccccaggacagccctcctcagagggcaagggaagctgggtgacttggagacctggagctggaatttgagggtcaagacagtctctgagccaagatgttgggtttgtggcagacccaagactatgcctgccttggcttccargccccccctggagaacttctgtggttcgttcttgtgatagcattgtcctttaggatgccatcattatgtgaatgtttcctgctatgattgtccaaagggaaaatggtctggaagtacacccaygtcaacagagttggatttccactgtggagccaggactatttatatctttcttagacctttcctaagacagaccacatctgccttacccgtcacattactccatgggtaaatactgtgttttggtttggtttggtttggtttttaagagacagggtctcactctgtcacccaggctggtgtgcagtcataactccctgtagccttgaatacctggcctcaagggatcctctcaccttagcctccagagtagctaggactacaggcacactaccatgcctaatttttaaattttttaaaatttttttgtcgggatagggttccacgatgttgctcaggctggtctcaaactcctggcttcaagcgatcctcctgcctcagcctcccaaaacactgagattacaggcaaacactgggtgttttaaaaacaagttgtttgaatgacttaaagagattacatccaaattgccaagacctagtaactgctctttaactatttaccaccccmttctcctccataaagtgcagttggcrccaaggcctcagagacacgggagggtgtggcaaaccacgaggctgagagtggaggtgtgggagaggctggagggaagctatggccttggaattttattgccttttattgttgttcttgcaggagcaggggggttgaggggggttcatcctgtatttgaygcccacactcagatcccaggggagtagaggaggagacagcagccgatgcacttcttttgccagtgagctgtgcaatgatgctacctgtctgcttcccttctgtggaatttaccctctcttagaacagtcagtgttgctgtgacacatttacaaaagtgataagtttataatgattttgtgcttagaaactgttgttaatttactctctgacaacagtggagacaccacatgtcaaaatgtcagaatggggttcaaaccaaagactactcttacaagaccctggttgggaaagtttcatatagaaaataaatgctgggcaggcggatcatctgagatcaggagttcaagaccaacatggcgaaacgctgtctctactaaaaaatataaaaattagccagtcgtggtggtaggctcttrtaatcccagctacttgggaactgaggcaggagaatcacttgaaacccggaggcggaggttgcagtgagccaagatcatgccactctgctccagcctgggcaacggagtaagactccgtctcaaaaaaacaaaaaacaaacaaacaamaaaaaaaaaaccaatagtaataatgcttaggacctcaataaaacttcagtcctgtccgtttttggtgagcaagagatgagaacatcagggagtctgggatgaaaatgaattcctgaatgagtgaggggttgggcattccctactcagtgaggagaatgagtgttccatgcagacttttatgctctacccacaagataagttgtccaagcactatttttgtttgtttgtttgtttstttgtttgtttgagacagggtcttgctttgtcacccaggctggagtgcactggtgcaatcatggctcactgcagcctccacctgttggctcaggccaggcactaattttaatgatagaaaccaaatggaatgatgctgggtcatttactacttagggtcagtttttctggcaggtcagatatttggagttggtgtttcccttttcttccctgccttctggccatttaactgctaattcagacctccacctgggaagtgaaaaagaaaagtggttccctgctcattgtcatagttctggtttaaaagttttatagaatgaaatacttgcccaacatgagaggtttagartgttctggtaaaccacagtgttaataagtggaagctaatggaaatagctaacaggttttctacacgtagaatcccttgtgtagatgaaaaaaaaaaatcactgggcatattgccttccattataggactagactgtgggatccaggaaaatgttgcttaacatctcgttgttggattccaagtcatctgtactcccccaaaataccacttccawtaattactgttccattttgagcactatggtgatattttcattatcaagagttcttgggaagaggccgagaggttttttttagcactcctaagaaaaaattaacacacatgggaattccacaatgccccttctccctcctttccatgactttgccttttcagtccatgagctacaatgaagttctacaatctgttgttctcaattttcctggcaggaaaaaaaaaatcttttctgagtaggaaggtttgcctttttagaacaaacacgwtcttccctgcgtgattcttctgaatgcctggccttctgtcaactatcagtctgaaggggaatttccatagagcctcgccaccaaatttaaattaggcaaagtttcaaagattttagattaggcaccaaattgttatggccttggaaggaacaggaaatgtacttgcatttggtatcgagtgggggaggaaaacaatcagatttttaaccacataacgtgtgcacggtggtaaatttaactgatggagaaatcaagcaattttcctgtgatcttttttaataggagttttaaaatgcattttatattgagtagttatttcatgttttcttaaaacaattattgtattgaactaaaaataaactaggtagtttgttcacataacaaatctacattcaaagacatgcaaacaaattttccacttagtccatttttctgttctcagcattactacaaatgcctcattctgttatcacgttgaattcttcagcatcttctatatcatttccagggcatctctgggaagtagtgatgcctgtcttccctcagaagcacactgataaccccaatatacccacaattcacacttttttccttctctgaggtatgctgttttttgkcaaaacagaaaaaacacactamtaggatatgaaaaacttcattctgggcctggttaggtcataaactacagaaccttaggtcatatattctcaccgggcgcttgtttctccactgcaaaaaataattcgtatttgcttggtcctttgtagtactttactgtttataartgtagtacatttatcttcatgatgacccttaaatttaagtaaggtagtattatgctcattttatagaagaaattcaatctcaaagaggatacagtctcccaaagatcccacaagcagtaatatattaggcagagctaaactcacacactgtcactcaatwtcctaatattggtacatgccatgctaataagtgtgctaaaatggatgaagcggcaatttctcaggtcccttccaatgatcctgtcctctgcttctacttgatattttttctctctttcaactagcattaacatccgaaactgtatatcatcaccacatttcatttaccatggttttttaatttaattattctttaaattttyctatttccatgttaaatccagagaaattgttactttttggaaagtttctactgctgcctgcctctgaaggccacgggacttacctgtttgtttgtcaaagcagaaatgcccaacattttgtaaacactaatttttttataactgtaaagatgattattccatacttaaaaccaattcaaaataaaataaatcctcaatactycttattccctggggtagtaattttaattagattctattgattcattattttctcctgtgtgcctttatttgggaaatactgttagtttaccttgctatcgagtctctttccctaacaagaaaatgtcagccttacgagtcaggaaagcttttactttcactatcacatatgaagaatgaactaaacacctaacttggaaagtaaaacttaaatgagggattcaggacatttcccaaggggtcatctgaccaatttaagagttggtatgatgtgcctaaaatagcaaattaactcttctacttataataaaggtgcagatgtactgattagacatgctgacatgtacatataaaatatgcctaaaccaaattaaaagaaaacaaaatatattccatggcaatcttgaaaagtcagggagctcaatatatattaagagtatgcgctcagccaggcgcggtggctcacacctgtaatcctagcactttgggaggccaaggcgggtggrccacaargtcaggagatcgagaccatcctggctaacgtggtgtaaccctgtctctactaaaaaatacmmaaaaaaaaaaaaaatgagctgggtgtggtggcggscgcctgtagtcccagctactcgggaggctgagacaggagaatggygtgaacccagaaggcggagcttgcagtgagctgagatcacgccactgcactccagcctgggtgacagagtgagactccgtctcaaaaaaaaaaaaaaaaaaaaaaaaaaagactatgctctcacaatgagagcattaaacatttggtaattaacataatttaatatgccaaaaatgagaaaatagtcaggatgagggatgaggagtacacataggaaakttttgtgattttcttcattttgattgtattgctttcttgtcttcaggagggaagattttgacttcaaaagtaacaaaatatttaagaagggaattcacatctttctgttctaattggtattcttgcgctattttctcagcagtccatgtttctggataaagtttatgattgttaagaagtgtcagtgcttctacaatggaaattttgcctttgggaatgctcttaatatttatcatatcaaagtgatgacctttcagcaatctgaattcctttggctcttgatgtgtttcagcagcttttacctgcgcggaagacacaagatctttggaatcaacatacacatcttttagaaatggcagcagcttgtcatctttatgagcaatctctcccttaatttctggatagagactaatctgctctcacaggagkctgttggtagaggggtgcctgggagcaggagagggcttcatcttgctgatttcccattctgctcggttctctcggttggaatgcctgatcctgcgagtcactgcagcccccatctcataacatgatgccctcaggtttacgccacttgtgggaacactggcacaggaagcctccagggcgtctggagcatgcacacatgtcctgtgattctttatatcttttatttttatgccatggtacaagttgtgctttacagagcatttgggtgaataactagaaatatrccatagattcttgaggctttgcctggttcactaatgacaggctccagggcgtttctcagggagcrtgttagcatgtttctaggaccagccacatcagccagacctggctctgtacagacccaaacctgagaatgccatgtgagacctgtgtgactgcagaatcaaagtgctggttgcgaggtgccaattacatgttgaatttcatcttcaacccaactctacttacctttcagggagtgatgagtagggggcgagaggggaaaatgcagaaagtgttgyttgaggcccacagaaactataaagatgaagaacaggagaaacstagttaatcatgccctggaaagctggcctgcagaaagaaaaggaatttatctctgagaaggccttcagaaagaaaatgagtaggctccggagacgttcatctgtcttcgtgcagccataaaaagttatcaggtgaggctgaggggtgaaggcgctttctctgatccctgaattggttactgaggcccacagaagaggaaaggacccctgaagccagaaactcccccaaggcaaatcaagactttatggaatcagctctgttactgcaagacatcccctcaaactcccgtctcagtctgtgtgagaascgtgcatgaattcttgctattttcttgatattttcaaatagcagaatacatgataaacttgtaagtccacagatgagtcggtaagctgctgccatatggagcatgcaccagactgaggtctttggtracagctggaaagactggctctgtctcatttcagcagaatcagaatggattcgaaggctatccagtggaagtgctcagaattgcgctggaaggctggagaaccagaccaaaaatcagagggatctggaaacctgagggctataggctgcgtccaggcgcaggaagtctggcatggtgtcctggacactggacacagctatccctggcttctctctacctcgtgctctggagtcaggcagaaacctttctactttctggagttgctgagaaggttcagtgataccagcatgaagctcctagaagaagggctggtgcatagctgctgctcagggtggcacagcccctccacagtcctgcccacatgtgagttgccccttcacaccactccctaacactgccctcaccaaagatgcaagcctggtatctcaaccagagaggcatctttcaacatggcaagcaagattactccaaaaaaatgccacttaccatwcctttggtgtactgcytctagaggcaaagtttacygcttttactgtcatgaaatagactgtgacttgtkatttatcatttatgtgaccaattatagttacaatcatgttccatgtgacaatagaatctttccccccttgaacctcacattatgctgagatgtaggatgaagaggagggttgttgaagggtcatcaccgcccccatcctatgccatcagcagtgggtggtgagtagttctttctcttcacccacctccccacatgtgagaattaagctctgaccatcaagaattgagaaaactctcggtatagttttccaaacacacgagtcatattttctaatggtcatcatttgcttatttgtttgatgaatatttattgagggcttgctaagagccaggcactgtgctaggcactggggactcgatggggaacaaaagagacatgatccgtgccctcccagagctggccgagggggcagcagtcagcaaggasgcaaacaagaattctatttccagttgaggttagtccccagggagtagcctgctttagattgggggtcgaggaatgtttctacaaggaagctgagactggcagatgagaaggaattcgcttgccaagcatgaggaagagtgtctcagttggggaggagagctgtatggagccccaaaargcttggcctcttcaaggcactgaaagaccaggtagcaggaagctggttagcagtgaagagaaccatggtagacctaggcagggtccatgccaggtaacaccactgggcacttacaaaggaaagccattgaaagcttctgtttggagcagggaatggcatgatccagtgtatgttctttaaaaatcgtaggccactgtgtggatggtggattttaggggcaaaggtggaaataaggagctggttagaaggctgcgattttcacctggcaagaggtcagggtggcagaggagacagagcaagtggacagtatgtctatgtcagtgaaggtgcggtgaccggtgccactcacacgtaaggaatgcttatcctggagggctgggagtgatccagtgtcatctcgatgcaaagccccttgcacagcacatccacggtggcactctgttaatagtggctgtcattgcataaagagatggccaaggagatgaaccacatgaaaaatgagcctccttctccccaaatcctcaagtcctggtcagtttactctaaatcaaagtttccagtcgtcatgatgagtatgatcatcatcattattatttttaggcaacagaacccatttctaaattgaaatatgcttcagttgactcaggggtgaggttcctggaactccctcttggtggcttccataccccctcactggacccgtgggctctaaagaagccactgctatggaaagttgtattctcagaaggttgcccagtccatcaaaggctttcactagatgctagttatacccccagtaactatgaacaagatgaaatttttaccctcaagacttccacagccccaaacaggtcaacacacayayacacacacacacacacacacacacacacacacacacacgtgcacacacatcacacccctgcagcactgtatgcatacgtgcccagagtatctgtgctgaagaggtcaagacaggtttcacagaaggagtgacccccgaacaagtattgaaggaatttcccacgtggacaaggaagatcaggcattcaagatgaagtcagatggtgtcttgggctggattctcaagaagcagaccctgagatgagggcatcatgtaagcagtttatttagggagatgctcctaatragacccagaaataaatgggacaggataggaaagaggagaagggaagcaagggtgagatttcagggaccatcttagctccaccctgatcttgacctcggagttggtcctgcctggaagcaggggagctggggtctcacactcctgtatctgccagtcattggttggggctgttccagaggtagtaaccccaagccactttaccctctaaaagtgaggcaggcctctagaagtgaaggcatgacaaacctgggggctgggcaggccaaatcaagagaggggacccaaaaggatctgggcagagaaccgagtcttggccacagatggaaatgttctgcactcagagcttgggtgctgtgctcagtgtgcgtgtccatgtcccattaagatgaatgacctcattgtgtgaggtgtgctcgaatctgctgaattcctgtgaagtgctaggcatgtgctatgattacctcctgtcactctgacatcacccctgtgaactaggcactacaacttccatcttctttggaacagaggctccgggagtgaaggagcctgctggatgccccacagccggtcagtggaagaggaatttctggccacagctctgcctgttggcgagccctgagtctcccttgaccccttacccctctggcctgtgctgtcctgtagcccagagcccacacacagagcaggtgggaggaatcgcattcctgggtggtagacagctgaccctctgtcttaggagtgacccttggctctaatggcctcaggagcacatcatgctcagacttatttggtggtcagttggctttggaactcttcccattgtgtcctggtccttaactagatgcacagatgtgcagtcaaggggagaatgaagactcctcgggattctccatcgcttgaggtaaatgagctccatccctctctctctcaagagcaatgtgaggattatggggagtagtagatagtaaacctctcagcatggtgcctggtgcatagtaagtactctacaaatgtgatccattaccagtaacaggaattagaaagcccagctcattcctctgcaaactctgacagagaaagggattttggaaacatgacacctggcaggcatggggcatgtttgacatctctgttcatcacagcacagacttacagtgccagtcttgccaaatgtacagtttattttctgttcatttatgtcgtctccataagtctccctgtgcctctgaactggcttgccttctaggctgagttctgagagccatctgaggcatggttctgctgaaaacatttattccagccccaaccaccctgtctccctcctccctcccccacacctgcactggctattagatggaatcagaatcgggtggaaatgtcatctcactgtcacagatgttattctctttccacttcttattttatataaattccttccttctattgagacaagtgtgtgatgttgactgcagagagcatcttgcccttgtcattgaccttcagctggcctaggtctggagttgaacctcctcttggatggtattgaccgagctgtccctccgtctctggaagccctccatccagcagaagcctgggtgagatgtactgccattgtgatcatattctcaggccttgtggagacatgggcattgccagctgttacagtaggcatayttgcattgatcagaacataaaagtttccakaaacacagaagtgaatcaaatagtgtggtttaggttcacccactgcctyagactgsaagctggcttctggccactccatgacaccagcttggcaacctcaggtacgttaaattctacagaagcaggcagggtgccagtgtctggacctgtctcaaaggcctgtttgccctcctcaaaggcccccttgagacagatcctcatactccccattttcgtctgttttgttagtcagcgtccagtgtgtgagccctccagccagggtccgcaccaggccatcagccatcccttcactggccagagctcctgccttccccagctcagcctgctacgaccctcacrgccactcccccaaaaccagcagacttctcctcctcctcagtcaatcttctcctttcacaccacctcctttcttactgaaagcgtggatctaacctggggaaaccatttcccccgcagccctctcacgggggctttttccttgtactcccacattcagttatctcttctgacctagattcattttgcagtgtactttgcaaaatgcaaatcacatcactgccctgctcaaaatcctccagtggcttctcattcctcttaaggtaaagcatggagatcttactgcagcctccagctcctgtctctccagcatatcatgaacatcttcccgctgcttcttgttcatcctgttggctccagttcactgtccaatggcagtgtctcacccttgccaagttcactcatgccaaagggggtttgcacatcatgttccctctccttggaatgatcttccctcccttgtttagctggtaaacttctgcttgtcctttcaccttcagctcaaatggctcctcagggaactctgttcactcccatgcctctatcatgaggatcttttatcatcatgaacttctcctttgtagcacttccacagttataatgatgcatttatttttctaattgactagtagtctctagaagctggaagttctgtgaaagcaaagactgcctgttttattcatcaatgaatttccacaatgtctagcacataggagatactgcagacacatttgttggttggttggatggatggatggatggatgratggatggatgaatggatggatggaacgacggacagacggatggacagagcagatggacaggttgattgacagatggataggtggtggatgggcggatggacagatggatggatggccaggactcccccaaaagatataacatttgcaaatatatttttgaaggagagagaaaataatcacactcagagactccacttcaaatcccacatctcttttgttgcaaactgagtcgtgttcatacttcatctgattttatagcagaaatgatgttgaatgtattaatttgtatattcatgaatcatataatgaatcagtgccttggttcaggtgacaggaatgcatgcattcatgtctttattgtatacaaatcacagtttactggagtccgtagacaggaagatttatcattaccttaaagagtgagaaggacctagaactgggactctgaagtatacagctgtggttttaaaactctgttttgttggagccatgggttcccttgagtttgttcagtgcagctgaggtcaggttagggaggaacagggcttagaaagaggggctgggtcaggtgcagtggctcacctgcagaactttgggaggctgaggcatgcagataacttcagcccagaagttcaagaccagcctgggcaacatggcaaaatcctatctctacaaataataataataataattagttggctgtggtggtgtttgcctgtagtcccagctacttgggaggctgaggtgggagaatcacttgagcccacctcaagtgattgaggctatagtataggttgaggctatagtaagccaagattgtaccacttcactccagtctaagcaacagagtgagaccctgtctccaaaaaataaaaacaaatgggggctgagtagtctgggttctagctgcccacctaagaagctccattgtatacactgggatgctataggaggttgaaaatcactatgtttccaagagctcagagaatgattaattctgctgaaaacaggagtaaggcaggcttcttgggaaagcagatattggagcagagtctctcctttaaaaaaataaaatggttttacttgcctttaaaatgctcaatttaaaaaatagtaaaacgtagaaaagagaaataatattcataatatcaaaaaaacacctgtttactttaaagggttcctactgtattgctgcaaagctgaagtcttctacgtattagataatctttttattttttattttttattttatttttttgagactcactgtgtcgctcaggctggagtgcagtggcacaatctcaggtcactgcagccttcacatcctagattcaagtgattacaggtgtgcgccaccacacctggctaatttttgtagagacggggtttcgccatgttggccaggctggcttgagctcctggcctcaagttgatccacccgccttggtctcccaaagtgctggaattacaggtgtgatccaccatacccaacctatttatttwatttwatttwattttggacggggtcttgctctgtmacccaggctggagcgcagtggcacagttacagctcacttcagcctcgatatcccatgctcaaatgatcctcctgcctcagctccccaaatagctgggacgacagttgcatgccaccatgcccagctaatttctgtgtttttgtagagacaaggtctcactatgttacccaggctcatcttgaactcctaggctcaagcaaccctcccaccctggcctcccagagtgctgggattataggcatgagccagcatcttctgattttttaacttagcataataaacatcattttcccacattattactatgttttcaaaagtatctaaaatttggaaatcaggcaaaaagatgattacatatcctttcagtgtcatactggagcatcccctcgcccctttctactcaaagtgtggtccacagaccagcagcatcagcatcatgggggagattatttgaaatctaggctctcaggccccattctagactctaattcagaatctgcattttaatagagttcctcatgtgattcttatacacagtaaaatttgagaagcactggtggaggkcccaaattctgtaaagttacctattaacttacggaaggctgataagttataaatgactcttgccagtaaagataaaaatgatttctgtttgactgaaaatatcccaaaggttagaatttattgccttgtagggtattagccagttttgtatttgatttagtaatctgatttcagtaatttttttcctgtgactacacatttttttctggtctttttaaaactagctttgccaccctgctgacttcctcaataataaattaaataaatctttgccacgtattcactatatatttgtatgagaatcatgtttttaactttttgaaaattatgctttgacaaccagstttctgtcatcatttttaatagttctgtggtattctattttgtgattgaccatagtttacttatctattgccctaatgttagacacttaggatattgctaatttagtaccaatataaataattctgcagtgaacatctttgagcataaaactttttccgtattttatatttatttcctttgagtaagttttcaagtactgaattaatggatcaaagggtatgaacatttttattttattttttaattttttatttttttaagacagagtcttgctctttcacccaggctggaatgcagtggtgccaccttgactcactgcagcctccacctcccgggctcaagtgattctcctgcctcagcctcccaagtagctgggactacagacatacaccatcacacctggctgatttttgtatttttagtagacacgaggtttcaccatgttggccagactggtcaagtatgaacattttcagatgagcaataatgagcttgtcaaatggacaaggatggaagggcatttcaggaggcaagagcagcctgcagagaggctggggaccaccggtctcacagaggagaggcctctaactggctagaatgtaaatatgtgtcctgggagcagctggaaaggcaggaaggagaccagagtatgaaggccctggtgtcctgaattagatgctcagcctaaaggaaagtcatggatactgtaaaccgagaagtgacatgatgagacctgtgccttagaaaaacaactctatcagcaaggaggcctttccaagcctcctgaaatagtgctggtgagagaagacgagatgtgagccaggaggtacctgggatggaaacaagaggatggagagaaaagttgtttagaaaggtgtaggggcttaaccaaggatcacccagctcattggtggtgatgacgggacctgatcatcagtgcttcttgcctctccatgtcgtccatgctgctgttccttccttagagttttgttttttaatctaagatatgacttcctagagctacaggacactcagctcatcactcacagatgagtttgagagttgtgatgtgagagaacaggctctgccaaagcatggagcacgcatccaaggggatgaacagcatccctaaaaataataagagatgaagcccacattccggggaagtgacagggcattcttgtggaacttgacagactaaactgtagctgctactttaacctctgtgtccacaaaaccagacctccaacgtggcgttgctggtatgcagatttcagtgtccctaagaagccatctgggttagcacagggggctgggttttacagctaaccccgctgagctcagtgtctcagtctgattcatagtcaacaataaggtttagcagacttttctcacacccaggtgctttcacagaactgccacatttccctatcagaccgccatttcacagaggaagagaaagttggttgcctacggttgcaccaggaccagattaaagccagcgctcctccctctccatctttcctaacagttcctcacagttcatctgtacaagacaccatgagagattccaaatgcaggaagtgatttgatccacagctttttaagggcaggaacccaaagacatgagtctgtctgcctttaaagatgagagctgctcatttgaactagatagaaaatagtggatttaggatgacagacttcagagcccactctgtcctaccacctcctaccagtaaatgttcttccctgagaattgcctattatctgaaaattgctctttttaataaccccaagctggaaataatctccatgcctatcaataatagcatgaataaataaacagtggtatgtccacacagaggaatactgtacagcagtgagagtggacatgccacagcctggagcaatttcccaaacataacagtgagagaaagaaaccagatgcatgcctgtaatcccagcactttgggaggctgaagcaggtggatcacctgaggccaggagttcgaggccaggagttcgagaccagccaggccaacatggtgaaaccctgtctctatgaaaaatacaaaaatcagccgagtgtggtggcatgcgcctgtaatcccagcttcttgggaggctcagacaggagaattgcttgaacccaggaggcagaggttgcagtgagttgagattgcsccaccgcactgcagcctgagcaacggagcaagactccgtctcawaaaaagaaagaaaagaaaagagaaaagaaatgaaaccaggtactgtagttcatacatcatcattccattcatagcaaggacccaaagaagcaggtgatgctaatccaagctgttagacatccttggtgggggtggggactggaaggaagggggaagggagcttctagggagccggtcaccttctgtttcttgatctgagtgctggttacacacatgcatttagcatttggtatgtgaaaattcagcgagctatacacttaggatacctatacttttctctatgtatattcgacttcaataagtaatttttaaaaagtaaaaagagctgggagtggtggctcatgcctataatgccagcactttgggagctgaggcacaagaattgcttgaacccaggatgcagaggttgcagtgagctgagattgcaccactgcactccacctgggtgacagagagaaactctgtctcaaaaaataaaataaaaactaaaaagtagccagccatgcacaacctcaaaaaaaactccctacaatgatgctaacaggaacactccatttgtcaagggcggactctgtgccagatgctatgctggggactctgtgtgcattaccccttttcaatttctgggaaggcactgttctgctcctgtcttgcggatgagaaaactgaggctcagaaactgtggtggcctgtgtgtccatttgcctcatcccctggcacacgcacacactctcctaccccagctgcgggaatggaggcaatgaagtagaggtggtctcattttctttccttatcaccagggaagagccagtaagtaattcattcagttgacaggtagcctataaagaaggccactgtcaaccaggcactgcagtgtggtgatgacaagctcagatttgggggtttggggttggctaagagctgggttcaaatcgtgactgtgcatttgaactacacaatccagagcaaatatcctctctggacctccatgttcccctctgtaaaatgggtgtggaagacctcatagggctgttgtatgacttagacaagagattgcaaaaaaaagcataaactgacacagacaatattcaataagtgttagagagggatggaagccaggccctaaaaaggttaaataagcagtgctaggcattataacrtcagtattgtgcccagtcactgcttgggcttgagcaaggggctggaccagtgggcttcagcgatcagtgaggcttcttgacagaggatygaactaggtttagaaaagactttcccaaaggggaatggacattccaaagagatggcaaagcttggagaaagacctgtggttggccagcctgtctggagccaaaggagagaatgactgcccagagctgtgatttttttgtcttttgcagtgaggagcttaaatgggacagtggtgtattggggagagttatttggtagcagaagacgcaatagatgctttgaattctgcaaaaccaaactcccctgtgaccagtggggataaagcagagccgaaggggacaatcagaagtgagcactgatacatgtttaacaatcagttctctggcaggagggtaggggtgccctgatttgtttgccaaatactcccaccatagcccatttcaaactgccattgcaatgtcactaggtacrgagttaggaagagatgcacagttgcctctcatgagctgatatgagccagttccacataccactgggtttcaggaaaagttgggaaaacttgcctcattggaacatgggctccaattgctgtggctcccatgggaaactacagtacagcctctcgaacgagtttctccaatgtgctaggscctaccatgagacccaagacagactgtgtcctaactctagtggggtccacagtctactggggaaactggcattaatcaaataattcctctaagtgacacattgagctgaacacttggaaagaagagctgccttacatgcagagcactcccgtgttctttgtttcaaagctgaaacaaaaggtacattgtcgttatctgttctgaatcaagaacatagtgtgtcctctaagtttttcagtacacktttgttcacttcatgatatttaaatcagggttgttgtcattacaaccctttcaagacctagggcttggatttcaagtgccttttcaggtgccagtgaaaaatccatcagtttgcaaccagaaaatcgttcagcggagcttatgtatttatttattagtaacaacagtctggatacttctctgtagttctctccaaatgtcaagcccaggctgggctccatcatgctctgcgcacttctgtttaggaaacgttttcagctggcactgtggctcgtgcctgtaatcccaaaactttgggaggccgaggtgggtggatcacctgaggtcaggagttcgagaccagcctagccaacatggtgaaaccctgtctctactaaaaatacaaaacattagccaggcacctgtaatcccagctacttgggaggctaaggcaggagaatcgcttgaacccaggaggtagaggttgcagtgagccgagattgtgccattgcactccagcctgggtgacagaacaagactctgtctcaaaaaaaaaataaaaaaggaaatgttttcactgttgcgttgcctcctaggtggtcttcgaggccctgcacaatctggagccccgtggctacgtcgtggggtggatcatcgccatcagtttgttggtgggaatcctcatcttcctgctgctggccgtgctgctctggaaggtgagtctggtgattgcaggtccccctggggtccccactcatagatgcccagctctcctgcctttccagggaagamggagtatcctgttagagcttccttcatggcmccggtacagtgaaggacagtgacccttcaggcagggagtggaatcttggctccccttgaggccattcacaactgaggatttggaccacttcagagtgaaggcaaaagtctcagttctctcttctcttaccttcccttagagccctaacataggatggtgagaacctaactccaaaacagaagtctggggagcaactgccagaagggggcgatttcccatttgcttaaaaaagatcagaaggcgaactatagaacaattcttccttcttttcctctaaggaatgtgaggaagatttctgaccagaaaacttgagtaactgagatgggctacagtccagagtagcttcatcataacttctcccaacctcatggtggttcatttggaggtggcccagggtgcagacctgtcctgcctcaagcatcactctctcaaggagaaaggggtgtcctcatccccatgtctaggatgatttgtttgcctcacactctcctttcagagacccggagtccttttccttcagagcctctctattcatcagtaatggtattggaggctttagctgatgaaggtctgtctcttccttgtttccactgtgtccccagctccaaaacagcaccagggaccataactgcaacttcctgacaccaaagtccatacttctctagaattacaaatttcagatgtaggtgaaaacagcctcttagagtattatagatggatattttaaaataagacaactaatttctttgggattacaaaataatatgtatgtattgacctaacataacatatcaattaccaaaaaaagttgtaaaacaccaggagttcacatcccagaaataaccatgatgagcatagtattgcctcattttgacctttttctctgcatatatagatatmgaccaggcattctcataacatcaacttatttttgaatagtgtattagttaaatyttacagtaatatactcagcatattttcaggtgaagtacctctaaatttaaaagcagtgggttcctttttttttttaagtatggggtcttgttctgtcacccaggctggaaggcagtggcacaatcatagctctaactcctgggctcaagctgttttcctgcctcagcctcccaagtagctgggactacaggcatgcacaatgcctggctcatttttttatttttttgtaaacatagggtctcactatgtttctcatactggtcctgaactcctggsctccagctatcctcccacctcagcctcccaaagtgctgggattataggtgtgaaccaacgcacctggcctggatttgatttattaatctgggaaaaacgtatacctatttttccctgaagacagtactgtgaacatctttccatattgttcaaagcacgtttccagcacatcttaaagctgtagagtgtctgcagtctactcatccagtcccctgatactggaatttaggttgcttctgtttcacacttcttttaacagtgccacattaaatatccctggrgccaaatatttgcacaaatctttcattatgtcgttaggttgaaagcctagaaatagaattgccatcaaaaggagtgtatattttaagctttttaaaaattatatttattwttttattttgagatggagttttgctcttgtctcccaggctggagtacagtggagtgayytcagctcactgcaacctccccctcccgggttcaagcaagtctcctgcctcagcctcctgaatagttgggattacaggcgtctgtcaccacaaccagctattttttttttttttttgtatttttagtagagaccaggttttgccatgttggccagggtggtcttgaactcttgacctcaggtgatcctcccgccttagcctcccaaagtgctgggattacaggtgtgagccaccccgcccggcctaagccttttattactattgcagattgccctgtagaaaggtcataccaattcaccctcccacaagcagtgtatcagaaatgtctgtttgccaatagtggatgttaccttttaaaaacaatctgccaatttgttgtttatttaatccacatcgccagatagattcttaattctcctttttctccaactccaactccttcctgctgagacagcctctggtttgtgggtggagaacaaagcctgctcagtgtttggcatctgaaaagacaaggcttcttgctgagttgagggctttggtgcatgagtgtgtgtgggtgtgtgtgtgtgtgcgtgcgcgtgtgtgtgtgtgtatgtgacttccttctgcctttatatgggctcttaaaatgagaggagctgtgtcctttatggctgggtgtgtggaaccagacagggcacagagtggggagtgttgtggccgtgccccacttccccttatagtctgcatgccctccttctggccgccccacctggctctgcctctcaggggtgtcctgtctcctctgcacagcccctgcctcctccagcccaccacctgctttgccttgcttttgctgtgtttgtttaaaaaagcatggttgcaggagatgctgtcatgggtggggagaaccctgaggtcacccagctgtgtgggatccaaagagccaggacctgagaaggcagactctgccctctgccacagactgggagggagagggcagtcacggccgccagggacacaccgtgtgcccagaccagggcttgccgtaactaacgggtggcaggaaagctttgaggaggctgttgaatgaggccacctgggtcacaacagctttgctagtcaacccagagcagtatctcatttcggctcacatttctcgaacgcttactttgccccagtccttgctttgcctggactaggcactgggatgcagcaataactgtgcccttccctgcacttgaccgcstcaccacctagcaatagacctgcaggcataatggagggtggtgagtgctgcgcagtaactgctctggaaactgagaagaaggtgccatgagtccccctcccttgcccccaaggaggasggaggattaaaaggtcacagagaacagygtggtagatgagagcagctttcaggctgacagctgtgggcagcaatsctgactctcacacttgcctgacatgaggccttaagggggctgcttaccttctgtgaccctcastttcttcctctgtaaaaaggagaccatcacctccagtttggtatgtagaggttatgcaaggaaaatgtttagcactgcgcttagcacacagaagccaggggatatttcataaatgaggtgtcattcgagtctgacctttagtgtggtttgagttttccaggcagggaagggtagatgaagattccatccagagggaaggaagaggtgggaaaataagcagggtttgtggagagcagcttgtaaagtttgtcagggcagtcactgacctgcagcaagaccgtctgccacagttgtgaaggccactgctaaccaggacaaagggggagcatgggaggtctgtgagcagagcggtggcatgaccagatctgtgtcgagagagagatctggggctgggtgcagtggctcatgcctgtaatcccagtgctttgggaggccaaggccagaggtttacttgagcctaagaatttgaagttgcagtgagctatgatcataccactgcaccaggtggtagagcaagaccctgtctctaaaaggaaagagagatctagggacagtgtgggggcaagagtagggccattgccatgggtcaaggtaggacaggcagggtttgctgaccagttggacttgagaggtcagggagaaaaaaagaatagctgtctctccttaagataagttcagacaaaggatgggtgcccttaatcagggtggggaaggcaagatgcgaattagtttggcaagaggaggagcttggtgttgggctttctgagtgagtggtgcttagaggaggctaggagacaaggctgggcttgcctcactccctgtcgcccccacccagcagaaggaaggtcaacagaaggaagccccttctctctacttggctacacatccgcatcattctcttcccaccgcagaccagctttctctatgtttccctacacatcgtagggagatagttgcctccagcccctccaaacttgcatctcaaggactactagccacagacgcagaatgatcagccacctctgattcctggtcccacatatctgggagagaggatctgcctggcccagctctagtcaaatgtctactcccatcaactgtggaagggaggaagggagttgggagggagagaatccacctggcccaatgtgggtcatatgtctcccacggaggctagtgggggagaaagatgcaggatggtggtttaggggatactggggaggagactctcagaaaagaaaacaattaggcaggcaccccaaaggagttcgctcytgcaggatttcatcgttgttagtgctgctgctgcctgaattgcaggctgttgtatcataccagctagctatgctgcatacaaactgcccccaaattgartggcttttcacaaccattacatctgacaaatttctgggtcagggayccaggaagggtttggcggggtgattcttccgtcccacatgacattgagtgaggtcacttagtggcatttacctggtggctaagctggtcttcagagttcaagacagcttcattctcatgcctggcaccttggtagggacagctggaaggctggattcagtcaagtccttcttcctctccatgttgactcagggcctctccatgtggttcttccagcagatggtctgactttttatgtggtggcttaggctgaaagagagcgctgccagttgtcttaaatgctagcccacagctggcatagcatcatttattctgttggtaaaagcagtcatatgccagctcaggttcaagagaggggaaatagaccctgcttctcaatgagaggagtggcaaagccttagtggctgtcttttatctgtcacatacatgatgttcgaaatatgggcaaaatcttttctttttttttttttttttgtggcagtcccactctgtcactcaggctggagtgcagtagcatgatcttgactcactgcaacctccacctcttgggttcaagagattctcctacctcagtctcctgagtagctgggattacaggtgcctgccaccaagcctggctaagttttgtattttttgtagagacggggtttcaccatgttggccaggctggtctcgaactccaggcctcaagcgatctgcctgccttggcctcccaaagtgctgggattacaggtgtgagccaccgtgtcttttccctaaaagtcactattacaaacaaaaattcgcctaactagaagttttgttctattttaaagtagatgaaacctcatctctctcccatagtgtcatagataaaatcacagttgaactcctttggggaagaggaggcaaacagaaaatgttggtgcagcatttatgtcagagtgtgcagtctgttgaggcagtgttgtaatgtgataaggggcttggtggaggggatttctttagggaaaaaaatttttttttctcaaaaggctaactatgacttttgagacttataaagtctcaaaagactttataagaggttaaaagggcaattgaaatgtaggattattttaaagacctmcgtatttctagaacttcaactacagacctcttgttaactctgattcccatgtctacaacctaagaatgatacattatgtttagtgaatagtgattcggtatcacactgacagtacggtgcagtaacccaaagacctgttaattgatggtctaaactccagcctcatatttgacttatacgggaggtcttaatgtttccggcttattgccatatyccatatgtaatttcctccattcctttcaaggggaaagccactgagtgttacccagctgccactgctgacyggttgcccacttcactgagggcctttgaagacagcggttggcrgggacagtgttgaagtcctcttccctttacagaaccgtggctcttgaatgtccttctagagtagctcttggcattgctacctatggtcatttgctgctgccttgaggtccggagccaaaagtggttgttcccaaaagtgttgcataaacgtgaatcgtgwcatggtactgaaagctgagcagagcagctggccatgccgccgcattcacagcaccacacaagcctgaaggtctgcatgctttatgcttgcaagatggccagcaccttcactaggcaaagagtagtaggtccctactaggtggcaggccctgggcaaagggacaaagataaataaacaacagccctcacctagtctgtttcttttttttttttgacagagtctcactctgtcacccaggctggagtgcagtggtgcagtcttggctcactgcaacctccgcctcccgggttcaagcaattctcctgcctcagcctcctgtgtagctaggattataggtgtgygccaccatgcctggctaatttttgtatttttagtagagacagggtttcaccatattggccaggctagtcttgagctcctggcctcaagtgatccacccaccttggcctcccaaactactaggattacaggtgtgagccaccatgcctggcctcaacaacagagccctcacctagtcttgaagacctttaggaaaatcagcttcagcaaagccctgaaggtgagcaggacttggcctgtgccaccagcccctggccccacctacgcatgcactgtggtgctactgtttacctaaatcagaaagcccttatcgtgtcagcaagtgtcttttccagagctgagctccaggctccctgctgatgtgctcagccagaccagcccctcatctgcctctgaccctgtgcagctcctggcggccttcaagaaagcccatctgctggcatctcaggcatcttctcatgcttggcggcagcaggccctggctctgacacaaaatccacaatgagggccccaagctaaccagaccgctcttcaaattctgaaatggatcctaatcagctttcccaaagctgagatgttagcagacactgggagccataatttaaactttatgtgcgaggattacagtagccagccaaaccaccatgcaggaagaaaactttgaaatatgaaatgcttttaaaggaagaaaagtccaaatgagtcccctctcctttcctgcagctcctgactgggttggaagatgcctgggcctggcatctcttcaagacaatcataaaggcctgtttaggaggagaaagttaaattgctcagaggtgcaggagggataacaactttgtgtgtgactggcacctttaagaaataccttcagcttatataagccagcctggtttctgtggaaagaatgaagatgatggggtgtttctccttttgaagaaagacaccccccttcccttatttagggctccaagctcttccctccctgtctttctctctgcttccctctcaccctcctcccctccccagctctgtccttgtttgtttgcagtttgccaaaacatacaggccaccactcagtgaaggagagagaccatatcctccctcactgctgtcaaccaaggaccctctctctcccatttgacccttttgcaaaccgagatggtttggagcaaagggaagtgagactgcttggccagccctatggccatgtcttcccaggaggcccaggacctacttgctcaagtggcaaagagacaggctgcagaatgtgtttgccagccctctgaaaagggctgcctcaaaccctctatcagctggggctgttccaagagcctgctgctttaggactggctttgggctcatggtttttatttgagagcattacttctgacctaaggcagaaacacttagaaaacaaatctgtgaaatggctcagagaatgtgtaaggtttggcaacccctccagaggtcactgggttatcaccttcccttcaaactgggctgggagggcatccttgcttctcctccaaagaaaaaaaatgaacagacacatgcccatgtgcttgcacacacacccttcacactgcctcaattagaaccatgtgccaatgacattcagtgggggcttgtttatgcttgggagtaaatattgggctgatgttgcactgtcgacatctcgagacagagacatgctatgtaaatagtcaagtaactgaagagaactataaacatgaagtcttgagttagtccaaaaaaggaatttgtcccaggtcctcagaatcactgtctaggaagcaacccaaaggccgcggagtgggtaggatcccccaagagaccagatgtcatggtgttgtccagctggtccctctcaccctgcagggggctggggaggaagaggctgctgctgcagggtggataccccagaactcagtcaggcctcatgcctcacgcagcacccatctaagtaaggctgtttggggcaatctgttgtttccctaggagttttctggttgcttttggatacatggttatatgaraaaattgtgtatgtctgttacgagggttcagggagctgctctttggagctgcaggaccagcagacacaaaaaccagaaagcacactgttccttcggcttccagccaagcaaagcttggcttgagtcacctcctctagggtttctatgtttcttctgctacagatagaacagttaacagagccgcttgcccctcaaatggtgaagcaagcactggaaggttccagaaaaaatgcagaaaaacattgactccattggcttggaagtgagtgtggggctgctgggcatccagcttagcccatcattaatcatttcccagcaccttcagggtgggctcagctggcaacaaaaacagagatttgcccagtgtttctcaaagctctccccaaggcacccatgcgtgctcacatgagcgggtgtgtatgtctgaaggaggcctacttaaccttgggatgtgctaatttcccaagtgtagggggactttgggtcctggcagtaatggaataggtaggactggctatgaagtactatagcaggctgaaggggctcgtgggtttcctggcatgtgtatgaagagttacagatttagaccatgtatctcttaagcaaaggaactacaggtgctccttgacttatcatattttaagtcagaaatgcatttaataccccaataaacccatcataaagtcaaaaaactgttaagtcgaggtatggtaacttggggattatttgtacttgttagatcatcaaattcagagtcactatctttagtttagtgwwtatctttagtctttagtttttatattttatctttagccattatctttagttgaagtcattatctttacttaaggggatgacaaaaaccttgctaaatttagtttttcacttcctcattcctgattgacattctattagaaaatgttagctaggaagacctgttctttatttattgacttgcatttattgagaactgttgggaataatattgtgcctctagggcatttagaagataacatgcttttttytggttcttgcaaattactttcggtgacttgttctcatgggttgcttattttgagtttttatttttagagaactgatattttttctgttcttgatgaggtaatcaggcagtctctatgttacatgagttaagagtcctagacttacttagyyagtcctcaattctgacacttattataagacatctgatccagagctgcatgttcaactccatcaagccttgcctactttcctcatcggtaaaattgaccttaaaatcccacagttcaaaagactataaaagttaaataagtgaacataactgcatgtgttttgtgaattcaaagacctcataatcttttaaaatattattaaattctgttttatttgtttctttcaaaaattaacagatttttaaaaattgaaaattgaatttycaaaaaatytctcaaaaatctttgagaaaaattgagatgggacaaagactctgtgccttgttcccccttagtgtgagtcctgagtacccagctgtgtggcccacagtctagagccttgaattcactttggggaaaacagaaaaagctgtcatgatgtttcagggctggaagaggtctgagaatcccattgatctcttaggcrgagacgaagacactatggctcgaagccagaaaataaccttcccaggctgggcgcggtggctcacacctgtaatcccagcactttgggaggccaaggcaggcggatcatctgaggtcaggagttcaagatcagcctggccaacatggtgaaaccccatctctaccaaaatataaaaattagccaggcctggtggtgcagacctgtaattccagctacttgggaggctgaggcaggagaatcgcttgaacccgagaggtggaggttgcagtgagccaagatcgtgccactgcactccagcctggcaacagagcgagactccatcccccacccccccaaaaaagaaacaatattagtttgacagagccaccactagactatagggtacctttgtgcaaactataatagtaaatagcaccgcttcctaaagactctttacttccatctgtcagaaaaaattcagaaaactctgattttatgagaacaagacactctactgccatctgttggaaaacagttataataaacttatacacatacatgatatctgtgatgtgagtggtatcccccagccccttaaatrcagtgtagcacctgcactactgtacctacaactccctagccatgagagtgcattatgttttaagaaatggtcttcagactctaaaaaaaggaagacatacatcagtggtagctctgatctcccatccaagagattacgcataggctgtgttaggaacaggactggagaccctgcagtgttagagtggggcatagagcttgcaaggctgtttcagccaggggtgggtgggggtgattttcaggcctaatgctgacaccactccactgagagaaagragcttgcttccgggtgcctgcaagagatgacagtgccttcaccttgttgttagcaagaattgcrtacataaaaacttgagcacatgaaagccacatgtaagagtgagttcaggtgctctaaatcctttccagattgttaacacactgtctatgtcaaatccttacactagcatagtgatgagaaagtgagccagcttttgctcttagagatgaacaagagaagtctggttcaggccgggcgcggtggctcacgcctgtaatcccagcgctttgggaagccaaggcaggcggatcacttgatgtcaggagtttgagaccagcctggccaacaagatgaaaccccgtctctactaaaaatatgaaaattagctgggcagggtggtacacgcctgcagtcccagctactcgagaggctgaggcaggagaatcacttgaacctgggaggcagaggttgcagtgagccgagatggcgccattgcactccagcctgggtgacagagtgagactctgtctcaaaaaaaaaaaaaaaagtgaaaagtccagttcagcaaggcacactaactgatgctgtttaaatctagagccctatcagctgtctgtctgattcattaagtcagcaaaaaaaatattgagtctgtaccagttaacttatgctacttgacaaaccaccccagtattcagcggcttaaaagcaatatccatctatgcaggtcacagttctgtgggttggctatttggactgagctcagtggggcagtttgagctcagcgagacttacatgtgcctctgcgggcagctgggagttggctagtctgggagggcttcaaaaaaaactggtctcttagcaggttagacataggcatttgtgtggaagcagggcagggttctgagaaagtaattggaagtgtgcacagccccttggggactgtgtaacagacacaacatctcctccctctcatccaattgtcaaagctagtctcagtggagaatcaaggctgggaaaatagactccacctcacgatgggaagagctggagagtcacatggtaaagggtgtggagggtatgtgggcatctttgcaatttatcgctggtaccaaggacaggtgagatgctgagtactggggattgaaagcacaaagcctgccttcaaagagtcctaagacaaatgcaggagataataagggggcagactgttaagtttctgcttgatagtgccatggtagggaaatgtgacttctctggaattacaactgagtgacctgggattattgacacattacaacatcagcagccaaaggtatgtgctagagaatcctatttccctgttacatccttccacagtttcatgattacattctccttcatggcatgtgaccagccacatctggccatgttttcttagccaaccacatctttatcgcaaaagaatgacatttcaagcagtagcttcttagatttccattcagtcttggtccgtttttctggccttctgtgggtgtgctgtggggatgatgtctatgactttttcttaattatccagaaaattctggccaagcaccttttcttgcagaggggagaaggtgaagaggtttcaggagagaaaagtatatgtgtgggggcgtcagaacatggcattctgatgaatgtggtcttatgctgggaagaaacctccagggctgaaatcaccaggaactcaatatctgtttacaaaactggccttgaggattgaagctcagaacacaagactcttgccagttgttctaagaaagcttctgctctttcccagtcattcaaactgcaccaccttatcgacttcccctcacrgtgaatgctcaggatctccttggcaacgtgggtgaagatacctgctggctctcttgacagttctcgtctttggcttggccaataawccccctttakggaagtagaaagatggtggcaacagacagctcctcagctccacctgccttcccttcttcaggggagcttatgaccatcagggtggctgtgatgcttccctggatgtttggctcacagtgaagaagcatgaggacaaatacacagacaayaaaaacatttgatgtgcccatgacagctgggtttgcttcacgatttgtgtaggacacgtcttatatgtgcatgcactgttggcagcagactgcagagagtcttaagggttttccartatgacttgggaattgcaagctgatgataccatggtaccacaacctgcagtgtggcaagcctaccagcaccaggtcaagtgtgtgtctctgtttgatttcctctattcaaggggattgaaacaatgatttgagggcaagtcatttatttggaaggtgatctcaggaaaaactgttggagagcagggaaggaagccaataaaagatttgtcatcaagctggttacctctgcaggcaagctccatggggaaactggtagaacgtacacctcagggttatcccacccaaggagagagggagctggggtatttgtacacccgatacagtcagccttgtttaaaggaagatgcagagaggaatgtctgacctcataaacagagcccaccaatgttagtgagccaaggacgagagatgccgagtctctcagagcatgggaggaaaggtaagctttgggctacaaacgttgcttcactgtttggtggtgatgactatgtgagaaaaactagacacttgtcttaccatatgtgaaaagttgtaagaccaaatgtaacatcaaagggcagggtyttttcagaaytaagctagaggaaattgccatcctgggtcaggatgaaacgcccgttytaagtgagaatgtgctgctgactgtggtgcacagacagcacaaattccatgggtttgagagaaagatgtaaatgacagcaaggtagaatgcagacctgcagacgctttaaacagcctctcacgtgagagcagtatttattaaattattccacagatggctaagatctctcaagatactaggtttatcaaaagccaaataagcttggggaatgtcaggtccctggtttttttccccaccggaattaatggtaatggatcctttactttccactgtacattaagactctctaaaaaaaaaaaaaaaaaaaaaaaaaagccacacttcccaaasttatttgaccatgaaaccttttttttttttttttttttttttttgagatggagtctcactctgtcgcccaggctggagtgcagtggtggcacgatctcggytcactgcaacctccgcctcccaggttcaagcgattctcgtgccccagcctcccaagtagctgggattacaggcacacaccaccatgcccagctaatttttgtatttttagtaragacagggtttcaccatgttggccaggctgctctcaaactcctgacctcaagtgatctgcctgtctcagcctcccaaagtgctgggattacaggcgtgagccactgcgcccagccatgaaacctttttttactcccaaacacctttgaacagctctcagtaactggtattccccagcacacagtctggaaaacactacaccagatgcattttagaaggaacaaacagcttacgtaatatcacccgcaggaagtccatgcattttgaaaaatgtctccacaggatgtttttcttgccagtgttttctctaatccgaggggtcctccaagcctccccagccctgtgagtgcaggtcacacctacccagggacagactgccttggggtcacaatggctgattcttcagcacttctaactcagcttctctttctttctgcctttcagatgggcttctttcgccgaaggtacaaagaaattatcgaagctgagaagaaccggaaagagaatgaagacagttgggactgggtccagaaaaaccagtgagctgccacaccagtcacatgacctgatcactagcctgtcatccttggtctttgtatcttccatatttggaagaaaaaaatcttctccagatttttcggaggccccactgatgctgttctcttcttcattctatcaagcccaggtgccagyctgaggcagccacttcggccaggtcacacgaccggggccagcaccacttcctttaaaratgaactctgaactttggagagtgagctacagagccgagcaatatttatggatgcaacacgcatggtcaaccctcaggggaaaactgttacctaaagtatttttataaatataagccttttatactgattatgtcttttatatttgtatcgatgttttattatttctattaaatagttatataattcactcaagcactgatatctggcctaaaatcttggaagtacatgtccatgaatacaaattttaaaggatgaaaatcttaccgtactttggaacttgctgtttaaaaagacagatgaaataagttgaagaaacctcatgtaatgaatccaccaggctggcagtggtgcatataaactgtgggtgtggcaagaccccgaagacatttcacatctttatcgcctcgatcaagtgtggagtcacatgctaatgtgtgctaaagaactgtaagtgttttttcatatgtacttttcattggaagattcccaacaagaatttggatggaaaacctgatccctagcaagaagtctgctctgtatcacctttatatagcagacatgtcaccctgcttctacacagatgatggatgaaagcttggagcaatgccatgtggtcatctggtaaacctcagaatggcgtctcatcctggacatcctgcatcagagttcacacaccacaaggactaaatccttgtcccctaagcaaagaattgggtctgaatgctgtgagggattgcctttttgtggtaattttcattgagagatcttcatttcccctaccaccctggctgtcccagctagtggtgattgcagattccttcccagagaggacatttaaccgttttaaaaaaaatgtcttagattgggttcccaagaagcagtccctgaaacaaggatttgtgtgcaagtaacttattaaggaagtattcccaggggataccagtaagagagtgggggaagcaggacaaggaaggagacaaagccaggcaaatgtttgtcatttcagggagagctccatgaagtttagcctcagcctgatcaggggaactccggaggaaaagttaggcctcagaggtgtcccaacctgaatcaaggggctggctgcacccagaggagatgtaaacgttttattctcaattcctgctggcgtaatggctccagtagctcaggrcagtcctctaaaggacaaccacagatgcatcctcagccaggggagacacagggaaatgatgcaaaagaaatgatgcaaaggatctgagcagaacactgcccctccccaccccctgaatgtgtgagtgctgagttayggccttcagtatccaagctctctgtttgacagtagatatattgtcagatgcactgtgctgcttagttttgagtgcagtgtgattttctgaaagggcaatgagatgatggatgtagcatgctcagcrctgacctggcccatagtgatcactcaataactgttaacagctatggctgctattcctactgatggataaccatctaataagacagaaaacatggggctaagagcagggtctaacggagtcttaatggcttattacagcctgccaaagtgccagctacatacacatggcatccagtgcggatgaaacaatctataaaaccaagggtctttcttatagcaccttttttactggaagctaacacgttgggagtccgtgaacattgtcaaaaagacatcaaactcaacttctgggaagacagatttttaatacacatacttggctaatactcacaaacatatctaaagttttggcaaaattatgagggtgatgggtgggtactaacctggcatggagcaggtgtgtcttttggtttcttatgcagttgactctgctgcagggagattacagatgtaacctcatgcttctcttcctggtgaacatgggaatagaccaaaaaaatcaagggtcaatggcatgaactaagctgatcctggaaatcagggatgttgcatctaactgtgggatggaggcacagaggtagctacagggagcaggaygaggcaaagaaagcagctgtcactcagagttcgcttatgagytttatcaaaagcagcaagaaaagcagtcttgggtgggttttatcacttattaacagccatttatgaggcccctgctgtgtgtcaggcactgtgcaaggtgctggaggttccccagagaacacttcagggacattttgcctcagggtggcaaaatgcagtggcatgtggactttttgaatgggatgccatttgcagctttcctttgatggactcttgttcataatgccatgttttctttaatgaatcatttaggattcttaggtgatatttctggaacagcaccatcaacagctttggccacatgcacttagarcaactaacttgcctcctgccggggtgtaggtgcgttggtgacagtgtagaagggtgattcrcaggcccatgttctgcccaccagcaaagccccactggagaagggtagactcctgtgggcagtctcagagctsggacctatttgcttctgcttgattctgcgtgggtggacccacatgagcagctgtatacccaggaggtcactaagactttataaaggcaggttttaagaaaaccagccttggcatcaccaccagcagatactgaaagcctccccaggaacctgtctggggaaggatgatgcctctgctggtctgatcgtgctgagtagcaggtgggctacggggactggggagttaagcattttgtgcagtgatagagaagtcaagcatatcgttagcgctctctcaacttgggcagttcacaagctccttcccagctcagaagccctctctatgctctcaggggaagcagatggggtggatcagtacatctgtgttacccttccagaatattatttgaaaattctacagtatgttctactttctccccttcctgcttccatggtttcactgtggaatcctataagatattctcctgagcaktattatttcagtttccttcagcttttagttgaatcttcaatgtggttttaaccaactgttcagagaactgaaatggtttttaaatatgaaaaaggacctttgtaaaaatggagtaaaacagtgccccttttttaaaaaaagttttgcttatgcttaatttacataggactcaggagagtttggaacatcctccaagtgggccatagagctgtcacaaagaagaggccatgatgtttagaaacaaggggacactagcaggaggggcagggtccactggcttagtggcaactgacaggcatccattccgaataactcagcactgaggtttcctcaggcagttctttaggaaaactgtcagcatcatgggtactcagaggtatggtagaccttgtagaagatccactaggaagtcctccttcaccaaatcatgtagctactgcccttgagccaaaggcaatgaggtttaaaacaaaaacccaacagcactcctgggaacatcctgttttccatgcggaagcatagcagatccccagacgatccgtgtgctgtatgctacctgttgaaccctagcatggtggctttttaaaaggttatttatgacttttatttttgggtaaggcattatggccaggtgcatgcagttatgtctgggttacgtgtgaaacgtacatctggtgaactgtatacttggctcaaacttctcaaaatttagaggtgctggaaaggattgtcasttggagcctttagtagacaaaaggcagaaagtgagcatcatttcagaaatgctttagtatgcacacttttagctgatattttgatatatagartaataatatacacagtggagaatattcaaagagtggctgaagggagaatacagagccagtagggccaaaatgaaacttctaggatgtcttctgaattttcagcacatggggggaataagtgaacaaatttcccaacatcgtgcaatgctttatagcacaatgatctagatttcagactgtgttaaggttttttctttgttgatgttgttgttttaattctaatgtgcacggtgtgactggcagagtgagtttaaaagctttacgagtgattaattgcttggcaggcacccacgctatctgcatttccagaactttactgatgcatccatgtacatttccactgaggaattttggtgggtggggggaggttgtgctgcctcacaatgtcacgtgtattaaagtctaagcagtcacttytgattcacttgcmctgtttgggaaatgtcaggtttacaaaaacatacatgtttggaataaaaaatggctgcaaacaattcagaagttcaatctgtaatttacttgctaataagaactttttaaagtgttgaagctagggtttcaatgtaatacaacatgagcattaaagagaacatcaaggtccatctaattcacatgaacaacccacctgatgtggctgaactgtctgcagtccttggcctccacacaagaggtaccacctcctctctgcatcaccctgactcccctggcccagggctacacctaggttcttgatcttgagataaatgtgcccaaattaaatggtatggattccttattatcagtagacttctttcacatgtgcctgccagttactaagcatttttccagaagcattttgataacattcttacacatwtacaaatattgtattctcttaggttttcactctccttcatctgtctattaatagttatgttcttgttcatattccacatgctgttcatttatgtgtttttttttccctagacaagactgttaccagataggggttccaatccagacaccaagagcaagttcttggatcttgggctatcaagaattcgaggctagtccctaaactgaaagcaagtttattaagaaagtaaaggaataaaagaatggctattccatagacagaacaggaccagggctgctggttgcccatttttattgttacttcttgattatatgctaaacgaggggtggattatgcatgagttttcagggaaaggagtggacaattcccggaactgagggttcctcccctttctagaccatatacggtaacttcctgacgttgccatggcatctgcaaactgtcaagacaccggtgggagtgtcttttaacatgataatgcattataattagcacataatgagcagtgagggraaccagaagttactcttgtagccatgttggttttggtgggttttggctggcttctttataacagcctgttttaacaaggtttttatgacctgtatcttgtgccamcccsctgtctcatcctgtgacaggatgcctaacctcctgggaatgcagcgcagtagctctcagccttattttacccagcccctattcaagatggagttgctctggttcaaacgcctctgacaagaccaataaagatctatgtattttcttggtgtttttcaagagtaagcctttggctgtaccaatcaagtctactgggttttgctttctatttcgttactgcttttagatttattaaaatttcttctattgcctgatggttaaaattcatacacatagacaccacacagtataaaagagttatgaaaaaatatacaccaatgggttaagaatgattgtctttaggtaagtgagattgtcaggcttttgctttgttttattttgtttttatttgaatattcgttttctacagtgagcatgtattttgtaacaatgaaacatatgcagattacttgtaaataaaattatatctgggagactataaattgctaagccaaaagagatgccacattgtaggtctggaaagagatttgttgcagcaaagagcattgatgagcctgacacttatgacaatggtccagtgagtaatttcaagcattttaattccagtgcttcctggsttaacaaacctgccaccattactaatgctaattaaataggtttctctgaggttgcccaamctgttttcctaagccaggraatggactcgacaaactcaaaagaatcaaaagatacaaatttaagaggaagaraaatcactaattagtgaagkcygcttccyattcaatcaggagttttacagctcaccagattacctctcatccttaaagtctgtctggtcctcaggttactgtttagtaacagaattgatgtaagaattacttagagctcaggctgcactatcagaccgactggcagctatccatcagcaaagccacctgtccctaagakcatgkccgttcactctatgtatacatgcaactaaagtgtgtataatgagatattgccatccctgagctgaaatctaaggctgcctgctgccaaatctctgctttgcytcaaagtccaaattattttatattttattttaaatcagttttttaatcctaaaaattaaacctcaataaagggataactactatcctttgaagacaaccaattggtattttaaaaagttggcatttaaaaaagaatctccaggaaatgtttcttctagaagatgactgattaggaaaaaatgaaattatctccaattccacatctactctgaacccaccttatcaggagaatatttggctccatataatagaaaactccgaattaataaggccttaaacatgataaaagtgtgttcctctctcccaaaaaaagaagcagaagctctggtacagcagctccatgggcatcaggaatccagctcctgtctttctcagcaccctcaaggttgcctcatggtctgagatgactaccagggaactagctatcatgtccacattccaagccaaaaatagaagaggacaaartgacatatgccccctcccttttaactattcttcctagaagtkccatatamcgctggccagaaattaattatgtatgtagatayacccacccactaaggaggctggggaatgcattattaaggaataagaggagggtaagtgttaagagacaactaccagttgccacaccctccactgagaaaatattcagactatagctgccttgagctctaaacttgtacgcttcaaatcctt

SEQ ID NO: 13217 - DNA, 44718 bp, Homo sapiens
tggcatgatgatagctcactgcagccctggactcctgggctgacgtgatctgcctgccccagcctcctgaatggttttttcttttttttgagacggagtttcactcttgttgcccaggctggagtgcagtggcgcgatctcagctcacagcaacctccacctcccaggttcaagccctgaatggctttttaaaaatattttctcagagtcagggtcttgctctgttgcccagactggtctcaaactcctgggttcaagcgatccccctgtcttggcttcccaaagtgctgggattatagatgttagccactgcctcctgtcaatattttttaaattaatagacattccttagagcagtttcaggtttacagaaaaattgagcaggaagcacagagttcccatattattatcccttctyttccctccgcagtttcccckgttattatcttgtacttagtccagwgatattgttttttttttaaactactattgtttttcagtttttagatagtcaaaacaaagttgtagacctatcattatcttgtatgggaatttaaaaaatgtatttcactgggctaatgtattagtccgttctcatggtgctgtaaagaaatgcccaagactgggtaatttataaagaaaagagatttaatggactcacagttccccatggctggcagagcctcaggaaacttacaatcatggaggaaggcacctcttcacatggcggcagaagacagaatgagcacaaggaggggaaatgctagacgataataaaaccatcagatctcatgagactcacagcttggggaaaaccgccttcgtgatgcaattacctccacctgtttctgcccttgacctgtagggattatggggattaaaattaaaggtaagatttgggtggggacacagagccaaaccatatcaactaaatattcaaaaaaagtactgctctaagagagtacttcaatttttaacttggtagccttggttcttgttcatgtgtgtracactaacrtagcttaggaggcagttggaaaaamtttgagtcaggggctctttaaagttcctttcttcatctttgagaaaacagtacgaggctttcccttgcaaagttctttccatctttacttctcttatctgaaacgcaaggaacctatagcttatcaaaggtaaatggactggaccagagtcgtgcaactgacctcagaggagagaaaggaaactttctgacttccaaccccaggctcattccagtagcctgcacattcaccacgggggtgtatttgaagattgatagctggcgatgtgttaggaggctcaaaagaggtagatttaggagcagagaaagaaagttctgtgtcggagaatcagcaaaccaacctragaaactcaactcactccacaaaggaattgattgaaaattagatgtgttcaaaaataacttgaataaactcatggatactccatcataagttattaaggaaaattcctattcttctgacacgcttccatgaacaaccaggtccttccagtgccagagagagagtgttgggctgggcacacccagtgtggagccagtacatctacttttatgaaagtcatttagaagcatcactaaaggaactgaaaaacaattsaccaataatgacagtactccaacacctagttttatcttctaatctctatccatacatctatgtagtgtttatattattattattttttgagatggagtctcactcttgttgcacgatcttggctcactgcaacctccacctcccaggttcaagtgattyycttgcctcagcttcccgagtagcggggattacaggtgcccgccaccatgcctgactaatttttgtgtttttagtagagatggggtttcaccatgttggccaggctggtctcgaactcctgatctcaagtgatttgcctgcctcggtctcccaaagggctgggattatgggtgtgagacaccatgcctgatctacattatttatatcacagctcatgtacaaatttattttctycttcttttgggcaaggcaattttatgatttattttggtatgtcggtataattatgttatcagtcatctcaatggctacacaatattgcagtattctaacatgtcctagtctactaggcccctatgtttygacatytaagttattttcagtatttagacagtcaaaacaatgttgaawacttatcattatcttgtatggggatttaaaaaatgcatgtcagcaggctaaatattcaaaaaattactgctccaagaaaataatccaatttttaacttaatattttgaaataatttcaaacttaccaaagagttgcaagaataaagacctcctcctacagtttggtgaacagctcttaacaagaataagatttgtaagagtccttcccatgccttcagctkgtcctgtttkgatgtttytcattgtttgtgtggaattcacacaactggtgctgttaccaccatgggcgtctagtctggatcagtggtcctcagtcttttttgcaccagggaccarttttgtwaagatagcttttccacggacagarggaggggagatagtttcgggatgattcaagaggattacatttattgtgcactttatttatattactattacattgtattatataatgaaataatggtatgactcagcataatgtagaatcagtgggaaccctgagcttgttttcttataactagatggtcccatctgggggttatgggagacagcgacagatcatcaggcattagattcttataaggagtgcacaacctcaatccctcgcatgtacagttcacaatagggtttgcactcctatgagaatctagtgccactgctgatccaaccggaggtgcagctcaggcagtaatgcgagtgatggggagcggctgtaaacacagatgaagcttcactggctctccagccactcacctcctgctgcgcagcctggttcctaacaggccacggacagayaccagcccatggccccagggccggggattcccagtctagatggagacctagacaaggcgtgcgacaataacaccgattttagatccatcatgacatttaccccatcccctgcaaagccagatggctaccaaaattaaatcttagtttagacacagaatgtccgtcttctggtccaaaacatccttgtcataagtttcttggctgggcgcggtggctcacacctataatcccagcactttgggaggctgaggcaggtggatcacgaggtcgggggtttgagaccagcctgaccaacatggtgaaaccccgtctctactaaaaatacaaaaaaattagctgggcgtggtggcgggcacctgtaatctcagctactcaggaggctgaggcaggagaattgcttgaacctggtggaggttgcagtgagccgagatcacaccactgcactctagcctgggcgacagagcaagactctgtctcaaaaaaaaaaaaaagaaaataaaaaaaaaaaaaacaagtttcttgcccactcttcctttctctgagtttccagagacatcacatcatttcttacccagctgagcagagtcccagcatggctytcgttcgaatacccatcctgccacctgccccagtgagaagggttggagcagcccctgttctctgcccccgccacctccatgactcatgcattctgtrggggaggcgcccactgcagaaacagccaggctggctgggaaaagccctgcagcaattccccgtccagtttctctgtgcccactttgtctccgtgttatctaggcctggatttatttctcttttttgaaaatgaagggctttgatgaaatgttcacaggatgtgaggtcaccaagatttttttcctttttttctgttcttttcttttcctcgaagtgatcccttgactaaaatcaaggctcccattgtcaccttatcagcctgcccatgcctaattctgcaytctcaggcttccccagaatctgtccgagggaaaccaatctcaattcagaaggaacacagaggccccagtttctagggctgcaggatattgctgggtcttaatcattcgggtatatttcagcaaagctcagggcccctgctaatgatctgcaaaccctctyctctcagtctcccgttgtttagcccctatttataagtgagtgcatgtggttgttcactttctgtttctgagttatttcagttaggataatggtctccagtttcatccatgttgctccaaaagacagacttcattgttttttacggytttgtcgtattcctcggtgtatatgtgcattttctttatccagtcctccattgatggacacttaggttaattctgtgcctttgctattgtgaattgtgctgttgtgaattgtgtgtgataaacgtgtgagtgcaggtgtctttttgatgtaatgatttcttyttctttgaatagatactcagtagtgggattgccgggtcaaatggatgttctatttttagtttgggaaatctccatattgttttccatagaggttcaggatccaggatttaagtgcaaccattcagtggaaaaccatcctctcaagagttcaaatgagagtcctcatgaccagcactccctgctgaacggcaatgccccaccccccaaaaaagcctccatcctcaccatcttagaccacattgcaggaaagcagccccatgcccaccagacaggcccacagctgctgctgctcatgggaggtctacctcccgtgctcagcaggcaacccaccccagtgccccttttctacaatgaccatcagcagggctgcagcttcataaaaatgtgaaaaacagtttgaaagcaatgtgaaaagcagttaggtgcctttcaacttcaaactcagcactcatggtttgacaaatatgagtatatttaggatcagaatgtatgaaatctggcctctcctgaatagtcggtcatcccacaatttcctctgccaarcttctcttccctccctgcgttctttctttcacctctctctcatttttacaaggtctggtctcagccagacatgaaccaatgatgatagatgctcctgctgagccctgtgatgtgccagggccctgacatgcgtggcttctctctgatcctcacgtgacctgcagatgcaaaagccagagctcrgcatagttgaaaatcttgattgaggtcatatcccagttactggcacagccggatttaaacctaagactttcccctacacgacagggcttttatttctcagtcatctgaaaaggtgtcagcaagggaaatggcttgtctatttccaggggcattttacaagcaaatactgaaaggcttcggtgggcttaagggctgatggctttgatcgaatttcaggcatgttggccccaaggccctgtgtatattccctgggcccactcaaggggatgctggagycggaaagtycccggaggccacctactgcagccctgcactttacaaagaagagaaagattctccctaaaattacagaacagggccaaagatgcctaccggagcaaacccccatgggggcacctcctaccgcaggtgagcccaaggctggtcctgccttctcagtggctacccccctgagctcccgccaccacacaaagtgttccaatccttgkgcatcctccagtccytttaacctctcrtgtcctgagaggccagagctacagccacagattccagaagacaccccactcccagccccaacctgctgcctttagaattataaacacttcttgtcatcacagggtcctgaaagtcccttttaagcctgggacactaggactctaaaggaagatgattcttaaggtcccatcccacttccaaattcctgcgattcaatgacatcacggctgtgaataatcagcctggcccgaagccaggatgggctgtgctgcttccaccgtraacttcctccccctgctttataaaaacaggccygcctcagctccctcatggccctgtccactgagcatcctcccgccacacagaaacccgcccagccggggccaccgaccccaccccctgcctggaaacttaaaggaggccggmgctgtggggagctcagagctgagatcctacaggagtccagggctggagagaaaacctctgcraggaaagggaaggagcaagccgtggtaggtcgggtttctgtrccttggggtctgtctcctcttctttctcttaaaagtctttccagcaagctgagccagtgaaggaatgctttaaccaagggaccaactttgtaattcaggcaactagaggatccrctagaatccactccagaggggagatgtctgtttgcatttgcatgtgattgggataggctggagtgttttggaggggagaggcagtcggggaaagggagactagggaggttgcattcattggagaagcctctgctgacagagtaaaggggaaagtgaaaagaaygatacagaaaagccccaaatagcctatgggagtacctcaagacgagcaagcaataaaagcaaaatcrgctgccttgggacacgtgcctgtgacagctgggagggccckctgggtcccctagtttcctccctyccccgatgaacccccagaaaggaactgaggctgtggatggggcagagggrgacttacttccagagcactatttgctaggtgctgggagagagaagcaggtggctttcacaccccacattaccccgtgggatagagaaatgcctctgatctccctaggtgccacccctacaagtctccacaggtcagtttggccctctggctttttgcccagggtgcatcagtcawgtgtgcagtcctccttaaaggacattttaattacaggggaaaaaactgacattaatgtcttttattcctaaagcactctgcaggaagcatgtggggttctccagattttcactgttattatctttatyttyttaacytcacagggagggagagaggaagggagggagggaagacsaaaacmcgccgaggtcccaggtaactaatgacaactcaagctcaaagaagtgtggtaacaagratgtgtttggtggccaattgggaataatatggtggtctcctgtagctgcttgatgacagaaaaaatgtcgtgtgtgtgtgtatgcgtgtgcattgcrgtcccgggaaggggtcttgcaaataccattgtcaggtggagtcccctcaaaggtgacttcctagcagtacttgctgtggcaagaacgctcattctgggatctaractcaatccatgacggtcagcatgagctgctgggtgygtgcttcctgtgcaggcagartcrgactccagcactggcagggacactgtgagtattgagatatgaatagctccatcctgcccacccatttattccacctaaaatgttctcaaagatgcaagcctccaagctctggatcaaatgataaagccccagatcaaaatctcaggagcaaatgaaagctgcccttgtctccaaaatgctccttctctgcccgactccccaagaccagcttggtttatttcacaatgactcgcgtcggattctcccagtgtytgcggctccccctgcttcatcacaggcctgggacagtccaggcagccagggaatagctgggaatagcagttcccctttgttggtttttgagttcactgaggctttgatttcccccagggcctgacgttgctgagcagagccagcggccagtagatttcaaaggattccaaaaaacagtcwggcactcctttgtgaacccaaaagtatctgagacaggtctgtcaatttagaaagtttattttgccaatgttaagaacacacatgtgacacggcctctggagatcctgaggacatatgtccaaggtggccaaggtatggcttggtttcatacatttcagggagacatgagacattaatcaatgtatgtaagatgtgcaccggttcggtctggaaaggcaggacaactcsaagtaggggcttccaggtcatargtagataagagaaggcttcattcttctgagtctttgtcagcctttcactgaatacacaatttacatatgagaggggggcagaggaagagtcacttatgccttagttggctcagtgaatctacttttttttttgagacggagtttcactctttttgcccaggctagartgcaatggcatgatcccggctactgcaacctccacctcccaggttcaagtgattctcctgcctcagccttctgagtaactgggattacaggcgcctgccaccacacctggttaatttttgtatttttagtagagacagggtttcaccatgttggccagactggtcttgaactcgtgacctcaggtgatccacccacctcggccccycgaagtgctgggattacaggcatgagccaacatgcctggcctgaatcttcatttttacaaaaacaatagggcagaggaagcaatcagatatgcgtttgtctcaggtgagcagagggatgactttgagttctgtcctttgtcctgtacccatttgcattgccaaggtgaagttcagcagaactgttttagggtaaagatcttgaagtccacaaggagtttccttgtgggtaaattgtgagagaggtatgtagccttttatctttgtagccgtcttatgtaggaataaaatgggaggcaggtttgcctcatgcagttcccagcttggcttttccctttggcttagtgatttgggggtcttgaratttattttcctttcataccttggtagtgtcacttgaagccaccacgcccggctaatttttatatttttagtagagacagggtttcaccatgttgatcaggctggtctcgaactcctgacctcgtgatctgccctcctcctccaaagtgctgggattacaggcatgagccaccatgcccggccaatttttcttttctttttttttttttttaagatggagtctcgctttttcaccaggctggggtgcagtggcacaatcttggctcactgcaacctccacctcccaggttcaagcrattttcctgcctcagsctcccaaatagcttggattacaggcgcccgccaccacacccagctaagttttcaccatgttggccaggctggtcttgaacacctgacctcaagtgatctgcccgccttggcctcgcaaagtattgggattacaggcgtgagccaccatgcccagacaggtttttctttgattatttggcattatgcacctgcagtctcagaataaattttttactttctctgagtgattttcgcttctgctttgatgagattgttgggacggacaataagggaccagtgcattctgctcattccttcttggggccatttcttttgtatatacgggagaaaatgtctgtctatagtgtcaggctataaacctcgtcctagtcaagcagctcacaaaaccatatggtgggtctcacatcaaaccaggtaaaagagtgaggatgatttagactcaaagaaaattagagctagaaataaatttaaagctcatccaccctgctccaaccctaagtcaagccacatggtcttccgatagtggctcagttttctacttacataaaaagacagcacattctcttagcaatatgtgtttgtrtgtgtgtgtgtgtgtgtgtgtgtgtgtgtgtgtgtgtrtatatatatatatatatatataatttagagacaaggtctgactccatcacccaggctggagtgcagcagtgtgatcgtaggtcactgaaccttcaaactcctgggctcaagtgatcctccatctcagcctcccaagtagctaggactacaggggcatgctgccatatccagctaattataaaatttttttgtagaagcagagttttgctttgttgcccaggctagtctcaaactcctggcctcaagcaaycctcttgccatggcctcacaaaatgctgggattacaggcaagagccactgtgcccagtccctcttagtgatattttgcatattatatattcaaaaaatattttctatgtatgccacttgggaaacttctgtagaatgggatagagggacagataaacccaattcttgatccactcaaaaataacacctgtgacagagtgaagatgaaacaggtgctgggcacacagcaagtgttttagaaacatttttgaactcaactttgcctgagttgtggtgctgatcatggctgccaggaaatgctagccagctgttcttcctatacaagtatatgactgggtgtctgcagcagctgcccggctgtgaattgcacacaccaatggccaagacccagcagcgacttggctaacaggcccagccgatgtgcatgggtgaccacgcgatgctcctgacacaygcactggtggcttagggaagtttttttgaggattgatcagaagatctgattccacctggagcctctgaagtgatcacttccaggttaggctgaacccagataccaggagacctgtgtattgagagccttttgttttttttatgtagtcacaactattccattaacatacagctaggcattagagaatccatgctggactcctacaaaggcccctagatccttagaacactcagagattccaaagcacacgtcctcccaggacaccctggcagaagagcccgggggcgactgtcacctttgcctgctgtcgggagctgtgctgatgggtagggggctctgtgcttgctgtggcccagagccaagccgtggggatgtgctctgtytggagcagaccccttcactgtctgcctaactccttcgtgtgttcccggaacagcttctgtgttatgcattccagaaagcctgcctgaccaccccaacctcaacaagcctgggatggacaacctcctccrcrttccactccaagcccacccccgtccccaccctgctgcgtggtatggcgctgctctgctgtaccctgagygtctagttattcatcaggccccttcctaactatgagctctttcaggataagagctgtgtytttgcatcaccagagcctgtgccagggcayggctggtgctccatacacgttgatggtgaatatatagcatgggtagatcattgtctgtgaaygcttaacagagaagcagctcatgtgggtgcttgagggctgggggggcagggtgggggtctggtaggcgctgggaggaggayatccctgcarcttctccrgccccatagatgggactcttgatgtgkgcagtttttatttcagctgagtctccagaaggcaggggacagggactgggaggggatgctaaacccgataacccagtatggatgagctaacagaggccrggcacacagctcctgcctgtaatcccagcactttgggagcccgaggtgggcgggttgcttgagccaaggagtttgaaaccagcccgggtcttgaacatagcgaagactctgtctctacaaaaaaatgaaaaaaaaaaaaaaattagccagacatggtggcacgcacctgtagtcccagctacttgagaagctgaggtgagaggatcacttgagccagggaggttgaaactgcagtgagctgtgatcacgccactgcactccagtctgggtgactgggcgagaccctgtctcaaaacaaataaataagaaagagagactactggtcaacttgatttctgctggttattctctttctgtcatgttcaccaaaaagagaaacccgttgtattttatcttgttgtagcaagagccggtgtctaacacctgggctactgagagaaagcgaagggtttttttctgggaagctccaayttccttatttctctcacatgatgcctctgactttcatagtgtggcttggtcagatgggccttatcaatagagatggcctgatgtctcagctgtgtcatctcagctgctagttctggcttctgctgggartccacagtggcctctgcatgcatgktgtgggaaaggcaaataaaaaagcagattaaaaaccagattaaagacatcaccctgtattcaggaaataatggctcctgttgatactgttctacgaacayagatgaaggcacaaaattctacatcaattgcagagaattggttataggctaacacaggtggtcggatgatctaggaagcaggattcagtattaacggggatccatgaggaccccatgaagcgtggcatctcttctgcatcagcagcttcaagttgttccagggagaagcgggaagcctcagtgcttttgttgaggaaggatgttcatgacagtaggtgcaggtcgctcctgccgtgcaccyaggtgtgggggaagractttcctgcttcttttccarttaccttacaattcagcaagacggaaatgattagcccatgacaaaaacyaggaaacaggctcagagagagtgagttgcccacacagaatgtgtgctgtaaatgcagttagatttccaggttgagaatccagtgaccacgccccttctttgtggcattctgctgtcgtataccatgtggaacacattaagaacgttatggccaggcgtgttggctcacgcctgtaatcctagcactttgggaggccaaggtgkacagatcacctgaggttgggagttcgagaccagcctggccagcatgcygaaaccctgtctctactaaaaatacaaaaattagccaggcatggtggcacacacttgtaatccgagctactcgggaggctgaagaaggagaatcgcttaaacccaggaggcggaggttgcagtgagctgagattgcaccgttgcaatccagcctgggcaacagagtgaaactccatctcagaaaaaaaaaaaaagttacaattgggtgtcacatagacagtgaggagtagtggaaagagtgttagatttggggtaagagaactgtgtytcctgggcttgagtcctgatgccaactctcacaagatgtgtcaccgtacagcacgacgcttatrctttttttttttttttttttgagacaggatcttgctctgtctcragctggagtgcagtggtatgatcacagctcactgcagcctcaaactcccaggctcaggccatcctcccacctcagcctcccaagtagctgggactacaggcatgtaccaccatgcccaaataawtttttgtatttttttgttgagatggggttttgccatgttacccagggaggtctcaaactccaaggatcaagccacccaccctccttggcctcccaaagtgttgggattacagatgtgagccaccacaccttgcaaatttttgtattttttgtacagccgagggtctccctatgttgccgagggtgatcttgaactcctgggctcaaatgatycaccctcctcagcctcccaaagtgttgggattacagacgtgagccacygctctcagccccttacacttttttgaagttcagttctcccatctgtaaaaacgaggtaataatattgcctcaratgacttaatggatgtgaaagggtttagtaaactctgtgcctggaaaggtagaagctactcaaatatctgttgagtgagtggcattcatccatgtgtacatttctcaggcaacaataatgtcactttcacctaaggccagtmaaatgtgggtaaagtcatataatgatacaatgaaagtttctgatcagtatttcctaattcaagtgtgttgaaatgtggagttgggctggagaattgtcaaatcattgcgtatttaattaccttgtggtgatgtttgctttagggagtggaaggaacatgaggaacgaacgaccttcatcacggaagatgacattcatttmgattcactttagatttcagggcttgtttagatgcagactttgcagttaacattttattgcactgactgrtttagttttcaccaggtggtccttgtgtttgcttcagaaggatctaagtgtrttagsacagggtttcttctgttttgattgtgggaggaggcgggatagacttctgttttcctagacccacaaccaaaattccccactcctccaaataaccgggattaccaggcagagggtggagcattgaggagatgacagctggacatgcctgctgtagctttttctgagtttaattccatatagcttagacacaggccatatgcctacatttggaagatgttttggagaaaattctgctctgatgggtggggggcagggtctgccaggaaaatattctattcttttgaagacatggggtcttgctatgttgcctaggctggtcttgaactcctcgcctcaagtgatgctcctgcctcagcctcctgagtagctaggactacaggtgcaaaccaccacacccagctctgagaggatgctatactcttcacttcattggaattggtgaaattagataagaaacagactcttcctctcttctcccctagttataaacagttctgttaagagagggaaaataaccatttagcctatagaaaatcaccttttcgaaaagttaagaattacttatgtgatggtagtttttgaaagtggtttttattctgagatcatggcctctgtactatgcagggcctrgagaagtggratgagagctaccaggctcaaagctcctgtyccgaacaaagggttgctttcgtgggagcasgycaccctttccaaggctagttcctctcccagcatctcacttcagctctcgtcctgctctagaaacgtgcctttgctggtccaaggaatcctggccgtttcttttcttaattgttggcattcatctgggctatggtggttgtggcrggggtggcagtggagagtgtgttgttttaaatccatgagtcattttagggtattggtactcttgaagactgactttctcttgctcaggttttcagagagaccttttgctaagcaacaataacctaagaatctccttgaccaaagataaatgtagcaaactttgcacatggtgcaacatttgataatagtatcmatttacgtttgtctttcccttgcaatttccctcctcctctagcttgctcacgtttctgccttcttcttgctggcaagagtacagactataattctccagttcactaacatctggagcgactgcactgtttgcartttcattgattgactacatgtstacagttcctttattgcaagtcacttttctgtataatcttttttgagacgaagtcctgctctrtcgcccaggctgcagtagcgcaatcttggctcactgcaacttccgcctcccgggttcaagcgattctcctgcctcagcctcctgagtagctgggattataggcgcccgccaccatgcccagctaatttttttgtatttttagtagagatggggtttcactatgttggccaggcttgttttgaactcctgacctcaagagatctgccagccttggcctcccraagtgctgggattacaggtgtgagcyactgtgcctggccatataatctatttttaaaatgtttttatatgaaaataaacagagacagagtctcactgtgttgcccaggctgatctcgaactcctgggttcaagtgatcctcccaccctggcctcccaaagtgctggggttacaggcgtgaaccacctcatgtggcctcgctttcctatataatttaaacaatagaactatagtgccatttgtaagagtttcccagtttatactgcatgtgacactccccatgtcgtatgttstcacaacagaacagaaaccgcaggatgtcagcaccggaggcraccttggagcatccagcccacttggttttgcattgctggcaggagattttatgcctcaaaatatagatgctttttggaaggacagcacattaattatttttcagtcatttttaccttatgygaacaagctgattagttcctttcctaggagctggtttttatggagggaagatggggccggtagaggcagatagagggggatgtaatacacaggcactgagacagcaccccactgactttcccctgtccctcctccagctggcctcctcctttccaggggctgtrcccaatccagaatcagttactcactggtgcccatcgaccatcatttccccatgtggccaccaaagaaatgaacaccacctttctggttggcatgatcatcaatttctcagccaaaacggcatgcatccttggctctgggaaacagtacmtctccyaggaaagtgagcttacagcacggtaccccacttcctggttaccagactattgttccygtttyccccaagaacagtcatcattcacaggttgtttggcagggcccaggaacagagtcactctggttgctacagccaacagaccaaacacggcttccaggcaggaaggtcagagctgctctgcaggatgcacatgcaggttggaagcagacagggctggccgagcacagatatgctggctgtgtcctacacacaggtgcctacacacacatccttcagatccgggctgcactctatcagccaacccayggactctgttttttytaatttgcacagattctttgtcaacctgccatgccctgagactgctgaacttcatccaacagagagggtaccttttgcaaatctgcaaaaatcaactttgtgtgctagggtggcctgacagggctaggccttggggtcttggggaccagcattccacctctcctctcatacagtgattytggattccagcccagcaaaagtcagccaaccttggggccttcctttctttcatcctttcttttttttccttttctatccttctgtgcctcccttcctacccccttccttycttcttctcatttgcctttttttttttcagttctttgatgatcctgagaagctactaaatatagcaaaagggagataacacagaacaaaattagaagtctatttataaaaatgagcctcttccatcccttccgccaatgtcatctctcacccgggtctcgccagarcactcatggacctccctttggtgaggcccaaagtccatcccagccacgccctgcggtcccgagtctgagtccattgttctggctttcactctgctctgcatcccgtcactggccccagacctcgacgcccwcctcttcagcgaaggcgaaacaaggactcatttttcctccctctcttcgctctttcttgttttcagactgcactgtttttctgctggccggatgactcatttctttgtcatctcttaccccacttggccttttcagctgctcgaatcgcctctgtgtgatgcggwcagagctatcgccctgctggggtgagattcacttgcaytgaatcagctcaaggcgcaggaaggtccagggaagccaaggaagagaagagmcaagtctccaactctctcaggagcaaagacaaaaataygctccygctctcytatctcttattcagaccgttcagttgcaaaagggttgaacatgatgcagcgggtggtatgtgtggaccagccctaggtcgtgcttctcctccatctggtccccccacccctagttatccagaaagggggatgttcccaggcaatgccracatgtccatactgcactcttcacattgcagtttcccggcatctgggattgcattccttttggaaggactttgagttcttgaaataaagaagtaacttggtgggcatctggaaaaaacacccaaactgtatcccaggctggggtgcaggagcctatcgagagggctggktggtgtggacagcgtgatgaagaaggtcaagttccttgtactcactcgtttgctgtttcattcacaattcctgtgaggtgggagctctcaccatccttgggtcttgcttaagagtaaggagtggggcaacctagagatacatgaacatcaaggagaaatggggagggagtttcacatgagctatttttacaagattaagtaatgggataaaatttaaaaggggaatttaagaggaattttgggcagttttgagaaacaggaaatttgaggaaagctgagaaagagaagatctggagtaagtytctgtgatgagaagattccaccccgcactcctgttctgggtggccttggctcctgrctccctttcttctgaaactgcctggagccagggagtagcacagctgcttcctcccggggagaaagggacacccaaagagcgcactccagggagaccttgggcactgcgggctcaaaggctggagatkgcacttctgttccctcctgatgggacaggtgcagggargctgagaggatgccacgctggcgagcctccctctgagctgtgttttctcattggaattgctgtacccggagcctcctgcaggtttccctcgccctctccctaagctcctctgcctgacacaggagcccggggagaatctgtcaggcatgaaatgtagcgaggcaaggagggtgatcagcacctcccacgggggagttcgtttcgaagtaacaatcaaagatccagagccggacccaggcagggaggcaaggyctggaagcccctgtgcctccargcccctaggacgctcgggggagggggagggggagggtgggacctgaagttgttgtgaccgaagggaaatgagtcagggaaagaaatgccatgctttaatttttgtggatgaaggagggaacaggccgccagaccacaaaataacacccggccgactaacctacttttagctgccgagggcaggatcacagaggagaggcagatggaaactggggctctggggtccaggaagatctgagtcttccgaccaracatcatttgcctcccctccttcctgcaaatatgcacattgccggatctgctgcagtctatgaaaaaggagacagatgttctggcagagcggtggsgggggtgggcgtggaggttgggttggggggcctctgctttgtggggagaacctcaggcaggggagtaggctccatcctgcgtggaggaacctgagcagtctaaggcaggctggctctatgatgtgctggcaataaaatcccaatggcttccgctgcagaagtccaagaggacatgactgcggctccatctagtcaagcccagggcaggaattcccttccaggaaaccaagccagagcgctgtggtctctgggctgccaagatgtctcagaaatggtctagcccttcagcccacagaaatctctgggcaaaattatctcccagcattgacagacgaatggataaacaaaatgtgttctatcccacagtggagtattattcagctttamaaaggaaggaaaaatgctgggcrcggtggctcayrcctgatcccagcactttgggaggctgaggaaggaggatcatttgtgcccaggagttcgagactagcctggacaacatagagaaaccttgtctctacacacacacacacacacacacacacacacacacacacacwctctctctctctctctctctctctcagccaggcacagtggcacatgcctgaagtcccagctctgggaagctgaggcaggaggatctcttgagcctggtgggtcaaggctgcagtgaaccatgttcatgccactgcactccagtctggatgacagagcgagacctagtctcaaaaaaaaaaaaaaaaaaaaaaaraaaraagwaagaagaaaggaaaaagaraaaaaggcagcggggcgyggtggctcacgcctgtaatcccaccactttgggaggccaaggcgagcggaycacgaggtcaggagatcgagaccatcctggctaacacggtgaaaccccgtctctactaaaaatacaaaaattagccgggcgtggtggcaggcgcctgtagtcccagctactcaggaggctgagacatgagaatggcatgaacccgggaggcggagcttgtagtgagccgagatcacaccactgcactccagcctgggcgacagagcgagactccatcttaaaagaaaaaaaaaaaaaggacatgctacagcatggatgcaccttgaagacatttgcaaagtgaaacaaaccagtcgcaaaagaagaaacactgtctsattccacttctaggatgtatgtagagcagtcaggttcatacagacagaaagtagcagcgtggctgctggggaaaaggggaatggggagttattctttaatggctacagagtttcagttaggggtgatggagaagttctggagatgggcrgtggtgacggccrgccgcacagcratatgacgtgcttaatgccactgaactgtgcactgaacatcgttaaggtggtaaattttgtgttatrtatattttgcaacaataaaaaatatgtagtttctagaatcctcttctagatgcatgtctggcgtttctgcyrcggggctggcactggaggaagccagacaggacaacattgcggcttatcctcctctgttgccatcatggacctctcgcaccccgtgatcaagctgttttttctctccttccagaatttaagggacgctgtgaagcaatcatggatgcaatgaagagagggctctgctgtgtgctgctgctgtgtggagcagtcttcgtttcgcccagccaggttggtgtgcaggatccctgtgtcccgcccctcaaggctgtgatgcttccggaggctccaggggtctgtgtccatctgggccacggaggttggaatgctgtcagggagcagagaggcacagggacgaggggctggcattgctgtggagcacacagcacacactccyttytgtacagcaaactctgtatttgggggcccagtgtgtagctgggccctaggcacttattttgacctgagtaagcggaattaacatgccactccctgcctgtgactgcctttttttgcagctgtttttaaagaatgtattcaaattaatccataaagtacagttgtccctcatatctatggggtatttgttccaggacccccaaggataccaaaatccagggatactcaagttcctcatatagaatggtgtagagtttgcatatcytatgcacaccctcctgtatactttaaatcatctctaaattacttataatacctagtacaatgttaatgctatgtaaatggttgttataaggtattttttaatttgtgttatttttattgttgtattatttatttatatattttttggaaacagggtctcactctgtcacccaggctggagtgcaatggcacaatcatagctcactgcagcaccaaactcctaggcttaagccttggcctcccaaaactctggggttacaggtgtgagccacaagcccagcttatattattattttttatttttctgttttggwtgaatccacagatatggaacctgcagatayacaaagtggactgtatttataaaagacaatgcaggacagggcacagtgactcacacctgtaatctcagcactttgggaggccgaggtgggaggatcgcttgagcccaggagttggagaccagtctgggcaatatagtgagatgctgtctctacaaaaaatttaaaaattagccgggtgtactagtatgcacctgtggtcccagctactcaggaggctgaggcgggaggatcgcttaagttcaggaggttgggacttcagtgagatatgattacgccaatgcactccagcctgggtgacaaactgagatcctgtctcaaaaaaaaaaaaaaaaaaagaaaaaggcaatgcaagtgccatgagccacagcagaggcaaactgccctcatggtgcctactctctagctgagatggaagcgctacacacactctctgaaaatgcctagcaataaagggcctcacggaagtccaaactaaccacacctctccmacaggaccctacagcggggagagccaggtgactgygtggagtagacagycagctgcaactccattgcccaatatggtggycacttaccttgtgcaactgtttaaatttaaaataattaaagttaaaaattgtttctcagtcccactggccacattcaaagcactcggtggccctgtgtggcttctgtcgtggacagcacagacagaaaacatttccaccaagcagaaagctcttctggacagagccagtcaggaaggagaggaagaattggactagaaggcaggagatggactttcacttgggccagttacccgagggggtctctgagcagaggtatctggccggcaggttcacatgggcttctgggttggccgcctttactcttagtacacctggcwtgtgctgwtccttcctccacctctggtttcttcgcaggaaatccatgcccgattcagaagaggagmcagatcttaccaaggtcgggtgaagctgaggggtgcatggggtcatcagggagggaggcagggcggggtgcagggtgcatcacccacccaccacctgccttcttccacccaccacctgcctacggtgtgacagtgccattgcagcatgrttctacagagatgcctgtgtcrgcaccattctcccatcagctgcggccactgggcgggttctgattctgaggggagcagaaacaggtgttcccccvcaaggrgccaggctgtcagggatcacaacctagcggggrctggggggggcrgccactggyccaaggtyctrgttatacagatcaaaaggcagagcccaggagagagcaagtggcttgcccagggtcacacagccrccagcagcacggccagggcagtcacagccgaggccaggcccatgctctgggtctcatcctaggctgtgatcccaccacagtgcaccggcagctttggtaacaacatccctgtgtatccatttccctctgttgatccaaccgggatgtcccaactgggatgtcccacccaggcaacccctcsacatggtggggtctctaagtccacatctagagttgactctagaaggctgaggaatgcgaggcccagcttcaggtccaaaactaccaacttaggccctcgatttccctccttcacgacccagttccttcgagtctggaagactctgcaataccctttgtgaaggtgttaaaaagggtgactcactccccagagcgagtcacacctggactcttaatgccttcgttgttggatggcatcctgcttcctaccrggttatcctggcctcagtgacctcagaagcagcaagggtctgacttacagtgggcacgtgctacttctttaattaattgaaagtaaagttgttgttttttaagttggcattctggcttgaaaacagaaagatggcatgaaaatattaatgggagtacttcaactattttcattatgccaaaaatacttggagaagtagcacattttctgcaaagtctaaaatgtcaattttctttggggccaaaaatgcatcatttctgtgtggtaatacttatgtggataaaaaactctggtagacagttatgcatatatatattttttggtgaattacaatgaraaaaagtccaggtgcaatggctcacatctgtaactccagcactttaggaggcggatccaggaggatggctttagccyaggagttcaagaccagcatgggcaacatagtgagacacctctgcctcccccaccccaccccgcctctacaaaaaaatttaaaaattagctgggtgtggtggtgtgcacctgtagtcccagctacttgggaggttgacgcaggaggactgcttgagcctgggaggcagaggttgcagtgagccaagacagcaccattggactccagcctgggtracagagaccctcgaaaaaaaaaaagaaaaagaaaagaaaagaaaaaattaggctgggcacggtggctcatgcctgtaaccccagcactttgggagaccgaggtgggtggatcacttgagatcaggagttcgagaccagcctgtccaatatggtgaaaccccgtcyctaccaaaaatacaaaaattagccgggcatggtatcgggcacctgtaatcccagctactcgggaggctgaggcaggagaatcacttgaacccaggaggtggaggttgcagtgagccgagattgtgccacttcactccagcctgggcgacagagtgagactttgtttcaaaaataataataataaataaataataaataaataaatcatatgagaagatactcaatggcactcagaaaagaaatgcaaatttattttattttattttgagatggagtcttgctctgtcgcccaggctggagtgcagtggtacaatctcggctcactgcaacccccacttcctgggttcaagcaatactcctgcctcagcctcctgagtagctgggattacaggcacctgccaccatgcctggctcatttttgtatttttagtagagatagggtttcaccatgttggccaggctggtctcgaactcctgagctcaagtgattcacccacctcggccacccaaagtgctgggattaccagcatcagtcaccgtgtttggccagtattcattatcttgttgtcttccagttgtgtctcttcaataagggagtatgcaatggagtctayagaaagcaagtgagggagttttctcagtaggtgcaagggtagtgaggcatttcattttgagtcatactctgatgaggctggcctgtcttttctcatagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagtatgtrctgaggctggraggtggtgcatgcctgtgatcccagcactttaggaggccaaggtgggagggtcgctggagcccgggagttcaagaccaatctgggcaaacatagcaagtcccctgtctctacaaaaaataaaaaaattagccagacctggtakgtagtcccaactacttgggaggttgaggcagaaggatcacttgagcccaggagttggaggctgcagtaatctacgattrtgccactgcatttcaacctcrgtgacagggcaagccctcacctctaaaacaaaacaaaacaacacaaacaaaaacaaaaacacagaaaagcccagtacaaatcgayttcaaactgagacttcragttcaggggtccagtcatgaaccctgtctttcatggtccccggaaagttcaaatcttcaaaaggagcctccaggcctgttcggccttaggcggaggtgaaggtacaagcagaaaagggagcaagaccaagtgaccttgggcaaatgcccrcttgyctcagtttcctcatstrtaaagaggtgggaataacagtacacacttcatggtttgctgtgaggattaaattagctaatttttgtagactgtacaacagcgcctggcacatagagcacattyttaatattttaactcacatcatccttggagctgctttgaaaatacaggggacccttgaacaacacttgtctgacctgcagggtycacttatgtatggatttttttcaaccaaaggcaggatgaaaacagtatttgtaggatgcagaactggtatacrcgtgttccacgctgcaggacttgagtgtgtgtggattgtggtagacagggctcctggaaccatrgcctgagcacacagaaggaggctgtcattaggggcttccttttttatacttgacaggttgcagcgagccaaggtgtttcaacgggggcacctgccagcaggccctgtacttctcaratttcgtgtgccagtgccccgaaggatttgctgggaagtgctgtgaaataggtgagtaggtgagagcacgtgaaacgagctgaaatcccacctctccagtctcccccgcccccggaaggaaaggcagggtgcsatggcagggccaggggtgggggccarggacagggaaggcgcttctgccatgggtcaggaagcacagtgccacacagcaagcagagccyaggtgtgaccctgaatccaggctggcacccttgccacccagcctgtggcttccgagccagcctgcatcaggccygggggaggacggggcagagaggggagcctcctgagggctgaatgaaaggggactcccatgtgaggcatccatgccctgctctctgtcagataccagggccacrtgctacgaggaccagggcatcagctacagsggcacrtggagcacagcggagagtggcrccgagtgcaccaactggaacagcagcgcgttggcccagaagccctacagcgggyggaggccagaygccatcaggctgggcctggggaaccacaactactgcaggtgagggcacatccccaargagggattccccctgtgagaagctgytacagctggggaaagattctgtcagatccgtcagggttctcccaagaaacataaccaatacaggatggatagatggatagatgatagacagataatagatgataggtgatrgatgatagattgatagatgatagatgataggtgatagattagataaatagatgatacatacatgatagatagatgataaatagacggtagatggaygacagatagacagatgataggtgatagatagatgatagattgatagatgattgatagataaatagatgatagatacatagatgatagatggtagatagatgatagatggatagatdatagatgataggtggtagatgatagacagatgattagaaagatagatgatagatacatagatgatagacacatagatgatagacagattgacagatgatagatgattgatagatgattaaatagatgatacatagatdataatgataaatagatgatagatgatagatgataggtgatagatagattgatagatgatagaagattgatagatgatagatacataggtgatagtagatgtaagatgatagatgatagatagatagatgatagacagattgatagatgatagagagatagagatagagaaagaggagagagaaatagagagagagagagaatgtgtgtgaacccaaagtatctgagacaggtctcaatcgatttagaaagttgattttgccaaggttaaggacacccccgtgacacagcctcaggaggtcctgaggacatgtgcccaaggttgtcagggcacagcttgcctttagacgttttagggagtcatgagacatcaatcaacatgtgtgagatgtacatcggtttggtcgggaaagttgggataactcgaagcaagggcttccaggccataggtagataagagacaaaaggctgtattctgagtccttgatcagcttttcactgaacacacaattgagtctggctcagttcatctgcatttttacataaaaaatagggcagaggaagcaatcagatacgcatttgtctcagatgagcagagggatgattttctgtcctgcacctgggaagataagctatccatttacaatgccaaggtgaaagtcaacagaactgttttagggtaaagatctttaggcctgcaaggaatgtccttgtagagaattaaaaaaaaaaaaaaaaaactttgcagctatcttattgaggaataaatgagagkcaggtttgcctgacgtagttcccggcttgacatttcccttggctcatgacgttggggtcctgaratttattttcctttcacactagatagatagacatttatgttaaggaactggctgacaggatcrtgggggctggcaadtcygaaacatcttggtaagccaggctgsaagtgcaggcagaagctgaggctgctctcttaaggcagaatttcttattcaggaaacctcatatttgctcttaaggcctttaagtgattggacgargcccaactacattatctaggacaatttccttttctaaagtcaactggctgtagatattaaccacatctataaaacactttcacaactcctagatgaatgtttggttaactgactgggtgccacagcctggccaagttgacatataagactattccagtccacaccttgtcaatttggcacccatgtgcatctccttaaaccatccttcacctccaagtaaacacagkaacaaaatcatactcctgcctaacatgatagaactaccagtgtacaaccaaaaacgcactcccggctgggcgtggtggctcacgcctgtaatcccagcactttgggaagccaaggcaggtggatcacctgaggtcaggagttcaagaccagcctggccaacatggtgaaaccctgtctctactaaaaatacaaaaattakccaggcatggtggcaggcacctgtaatcccagctactcgggaagctgaggctgaagaattgcccaaatccaggaaacggaggttgcagtgagaggagatgcgccgctgcactccagcctgggataaacagcgagactctgtcaaaaaaaaaagcacccccyattcctccagaaaaggataccaaagtccttgggtcctaaaggagaggcttcacctttgacctaccctggcccttcccttggctgatttttcagaaayccagatcgagactcaaagccctggtgctacgtctttaaggcggggaagtacagctcagagttctgcagcacccctgcctgctctgagggtaagtgrcagccaccccgcctttccctgaatgtccctgggggaggaaagtccaggaggacaggccgatagccctcctgyacctgaggggagaaagggggaggccaggagtgagtcattttggttgcagagggaaraaagacaggacttaggtctgygcctgggctyggcctctgactggctatttgtytgacctggagctgatctcctcacactctgaccctcaatktcctcctctatggaggagaggatggggctgaatcagtggttttcagtccttttgagaatgaatggagattctcccttttttgattaatgggtgaatggggctttgtctctctttcgctccctctcaaactttttaatgcaaaaaaaaaaaaaaaaaaacttccaagattgaaaaaatatatattaagttacaagaccaggcacagtggcttatgcctataaacccagcactctgggaggctgaggygggcggctcacctgaggtcaggagtttgagaccagcctggccaacatggtgaaaccctgtctctactaaaaatacaaaaattagccggatayggtggcaggcacctgtaatcccagctactcaggaggctgaggcaggagaattgcttgaacctgggagatggaggttgcagtgagccgagatcatgccactgcactccagcctgggtgatagaacaaaaaactgtttcaaaaaaaagaaaaaaatgaaatgctaagttacagaaaggtactatgaattcagtggtgcttatacaaatcattacgttacttatcacatttatcacagcactatgaaagattttttttaagttctaaatatatatagggccaggtgcagtggctcgtgtctataatcccagcactttgggaggctgaggcgggagaactgcttgascccaggagtttgagaccagcctgggcaacaaagtgagactccatctctacaaaaaatacaaaaattagtcaggtgtggtggcttgtgcctatggtcccagctgcttgggasgctcaggtgggaggatcgcttgagcccaggaggttgaggccacagtgagcaatgattgtgccactgcactccagcctgggtgacagtgagatcctgcctcaaaataaatacataaatatgtgtgtgggtgtgtgtrtayatatatgtaatacacatatattaaatttatatatgatatatataaacacgcaccagctatatgcattcagcacccaggtccacgggtgatgcctgtgactctgaagactttacagtcactctacaatatcctccccatcccccatggtctggtctaaatgaggactcgcagatctagataatcttgaaaatcccttccatttatggtatttatgtatagaggtatgctttgtcartttcaggtcgggagaaaaaaatggaaaaatgggggaaataaatgaaaacaggcagcactccacggctcataccctcctccttcccaagcccatcatcagatcctcaggacactggcagacacagtcygagaaataacccccaccccagccccactgaagcacgttggttcactgcagcctgttaagtaacacaaggaaacccctactggctttcaaagcagcttcagaaacagcccccactcatggaagtggttcttcctgctgaacctgaagatgtccccagactctctctcaacatagcaatctagggagccacttccggtggagatgaaacccccytgccatctctaagtaaaaggactcaaagagggggaaaaaggctcaggccgggcgtgttggctcacacctgtactcccagcactttgggaggctgaggcgggcagatcacctgatgttaggagttcaagaccagcctggccaacatggtgaaaccctgtctcaactaaaaatacaaaattagcgtagcatggtggcgcatgcctgtaaccccacctactcgggaggctgaggtagaagaatcgcttgaacccaggaggtggagaytgcagtgagccaagatcgcgcattgcactccagcctgggcaacaaaaggggaagtgtgaggtgttacactcttctcagtgccgggctagcggcctccagcttcctcgaccggcagctccgcttcaagccccagccctgacttgcgtgcttcagaatttgtttttgtttcagtttgagaattcttttcttctaggaaacagtgactgctactttgggaatgggtcagcctaccgtggcacgcacagyctcaccgagtcgggtgcctcctgcctcccgtggaattccatgatcctgataggcaaggtttacacagcacagaaccccagtgcccaggcactgggcctgggcaaacataattactgccggtaggtagcacaggggtggggggttcaggtcttggcagaacgtgggattagggtgtgagacgggggaagatccaatgtctcaagttgcatgacagacccagtgcgtgggaagcacccatggatattatctaatccaacctcttcacttgctagaataacacatattgtgaaaagcaaggtytaccagttttccaacctaaatcccaagttaagggtcctggcctgtaaccatttagtcctcagctgttctcctgacatctttattgcaatgatttgtaagagttccrtaacaggacagctcacagttctgtctgacaaccctatgagatyagaacactacattactgactgggtaacaaagttaaagagaagttctcctagggtgggggtgtgctgcaaggtcaagatgaactcggtgtcctccctcccagctcagtggttttcattggttgactgagtctccttctactcttacatggcctgtgatgtggctgaaaatgggattgaaaatcttaaactcctggcctggtgtggtggtgcatgcctgtaatcccagmactttgggaggctgaggcaggaggattgcttgagcccaggagttcaagaccagcctgggcaacatggcaagaccccatctctacwaaaattaaaaaataagaagataaaaaggaaaccttaaactctcttatcatttaggaatcctgatggggatgccaagccctggtgccacgtgctgaagaaccgcaggctgacrtgggagtactgtgatgtgccctcctgctgtaagggctgggccccggctgcctccctgcacctggtctcccttcttcaccatctcctcgccactttctaggccttcatggctgtctggtgcagactgtgtgcctaccaracttccaggctgggtggggagggggcttccatgactgaagccacrgtgggtgggcrggtgtccatgacccatgcatgggggtggtggggaggggcaagaagaaagaaaagaacacagcaacctctctgagaagtcagtaggctctacccggctctctctagacrcctctattggtgttgctgagagtaatggggaatgaggaggaggcctcgcatgcatggctccttagataataaagtgccttcaccacatttgtccaacagcgtggtggaggtggtcttcctacctccagtttactgagtaggaagcagtctcccagacgccaggtggcctgcccaagctcgctgggcaccgggaggtaaagctagggcctgccctcatgccctctgaccccaatggcatgtacttccactgtgagatcttccacgtttcctgttgacctatttcacacaggggagctggctcatgatgtgggtgagagataggagattcaagttggtgcatattgctaaaaaatgaaactttagtttggaaatggccagagagtaggttattaatcacctcctgtgaacacagatcagccagaatgttccccaaggaacacaagtycaactgggacgatgagacacagaccaccagctaactcacacccaagggcattagtgtgagtcctcagtggtccgtgtccctaagctcctcagagctgagcaggtggggacgtcaggaaagctttgcgaggaggcaggattgcacctgggccttgaagcatgggtaaggttggacagatggaaaagaaatgagcagacattccacagaaggaagctgcaattcttcatttcttaggccaggaaatggctgtaggaaaacattagaaggaatgaaggatggcagatccccagttttggagtcaaacatacttgggaactaatccaggtgccattgcaaccttgggcaaaaacgtytccgcctcctgaaacttatcgctgtgggaactaaagagaatgtatggacaacattcggcatgctgatcccaccaagtgaaagttgtggttttacagccatgctgatggcctcctcactctacctacacacgtgcaggaggcctgtgggactgactgcctcctcgtcctttcctccccagccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtaggggctcggaaacccagttggtttttccaccckctaacgcctagaaaccaagccctttaggggaaatcccacagcaaaaawagcattctaaggctgtttctccaccaggtttccgccccaccacctgacggtgatcttgggcagaacataccgggtggtccctggcgaggaggarcagaaatttgaagtvgaaaaatacatygtccataaggaattcgatgatgacacttacgacaatgacattggtaagagctcgtcattcccggctccagttcatacagatcacacaacacacccacatgcactcacctatgtttacacacacgggcctcctcctccagcccctgcccctcctgcgtgttcctcccctcccgrgracgcggccctcacgccagctcactcctcctttctccctcccagcgctgctgcagctgaaatcggattcgtcccgctgtgcccaggagagcagcgtggtccgcactgtgtgccttcccccggcggacytgcagctgccggactggacggagtgtgagctctccggctacggcaagcatgaggcctgtaagtggaaggaagyctcggccccatcctgtctgcgggacagcaggggaggctgcggtccaccagaggaaaatggggtcaggagascgaagttccagccccgggtcaggcactgacgccagtcccgtctccctgtgtcgtgggggcccgtctctgctgtctctgcctcacagggacactgcaggccaggaaaggacacaacagtatgagggcctcgaagtgctgcaggtgttgggaakgttctgagtaggaagtggagtacagtcgctaagcgtgtgggttctgggaagctggagttacaaagacccgakttcaaatcccacttgctgagctgtgtgaccgtggacatggatttttattttgaactgctcccagcctcagtttcctcgttggtaaagtggagatagaactatctccctaattagattaggagggttaaatgagataatattgaacgaatggatgtcagctggggtgattttgtcccccaggaaacgtttggcgaggtctggagacgtttttggttgttacagtttagggtgagggttaacgccggccttcagtgagtgcagccagggatgctgcacactgcagggctcgggactgtccccatcccccacaacagggacctccctggtccgaagcatcagcagtgccactacggagaggctgtgggttcartcccggaatcctgctgtttttgtgggtcaaaacgataaaataccagcagtgtcataggattcgacctaatacatgttgaatcttgatcaatgttagctattattggaaaatttggctttctctttcaaaaacgtttataaataactttccctaaaaccatatgatggttctcccctttcagtgtcycctttcyattcggagcggctgaaggaggctcatgtcagactgtacccatccagccgctgcacatcacaacatttacttaacagaacagtcaccgacaacatgctgtgtgcwggagacactcggagcggcgggccccaggcaaacttgcacgacgcctgccaggtaaccaggagtggcgcgcccatgctgggcacaacccaggggagaatgcccctgggacaacaggttcttcaccaaagaaaaaagttatcaccagagtggagtgatttcctcttagtgatacccctrgggattctagatgagggcctcacagaataaagcaactggaggaagatcaaagtcacctaaacctaagaattctaaactgcaggaaatttccccaggatctgcacaggcaactccacctgtacaggatttcctttcagcccaggcaattgattgactattgaagtgatggagagagccacacaattaagaaacgtttgcctcagcctggtgtggtggttcacgcctgtaatcccagcactttgggaggctgaggtgggaggctcacctgaggtcargagttsgagaccagcctgaccaacatggagaaaccccatctctactaaaaatacaaaattagcctggcatggtggcacatgcctgtaatcccagctactcaggaggctgaggcaggagaatcgcttgaacccgggaggcagaggttgcagtgagccgagatcgcgccattgcgcttcagcctgggcaacaagagcgaaactcgatctcaaaaaaaaaaaaaaaaaraaaagaaagaaatgtttgcctctgttggcactagagaattggagtctgctttgyagaaggagaaggaagaaaggcaacttactgggaagcaggatctagatgatgtgagaaagaagttttcaaaactcacattcagccctaataccctgggaaagcacactatttgaggtcctttgtgtgggcatccttatcagaattagtacttatatttcatgattagccagatactggggtatgggaggacaggccagcctgctggtattaagacctgcacagagccaaggaattgatcttcctcagacatttcagtgcctgcagcgtgcsaagctctcctttaggggctgggggtagaagagatacaaagagaagtgaggccaggctctggtgctgaaggatgtgtgggctttgttttcgcaaggcagtcatatcggcrgtttcccctctgattccctgacaggatttagtttctttttgaatggtttcttcagcaacctcagctgtaccagcttacagtccagaaacaaaaaggttgtaccaaagtgaaaccattatctatctgcaagcttagttaaaagcaaaaccaaatcattttaattcaatataagaacagctaacaattaccaagagttttactagatgtcttccagtgcttttcatgcattcttctactgaatgccataaccactctatgggtagtatgaatattatctctatggtacagataagaaaaccaaagcatggttagtctaaggccatcagctagtaagtgatggagccaagccagggtttttgaggcctgaaacgttkgagtaattaactctactktaccagaatagatacagcctaatcctccatgggaccaagataactgagatacaatctacccactcttcagtaagtctccacttaacagcatgcctggaaaaaataggttcttagaaactgcaactgtaagtgaaatgacgtataacaaaaccaattttaccaycagctaattgatataaacaagagttggtcaggtgcggggctcatgcctgtaatcccagcactttgagaggctgaggaaggcagatcacctgagrtcaggagttcgagaccagcctggccaccatggtgaaaccctgcctctaytaaaaacacaaaaattagccaggtgtggtggtgcgtgcccataagcacgagaattgcttgaaccccggaggtggagggtgcagtgagctgagattgcgccactgcactcyagcctgggtgggtgacagagtgagactctgtctcaaaacaaaaaaacaaaaaaaaacmaaaaaagaagagtgaagttcttgtggcaatatttctagtcataaaaacatcagcaaacttctaaataaagacccaaaacacttctaacattcaatattgaaataaatgtgagctatacaacatttaagaaaggttaataaaaacaaacatggtatttatttacccaatttttggagaataagtgratgatggcggccataatagtggtrggttaattcagggaataaatgtttgcaargcarraatggtaaggaacacctcttactaccatgaagttcaaaaacaatcacaaatagggcaggctccctgactgcctccacasctcacagtttatcatgcattcgtgtatttakcacagactagacagatttttactttataacactttgtattcattcattttccaacstgcttattccggttcagggtcttgggtgggggtggccagagccacctggcagctcagggcgccaggcrggaccagccctggacagacgccaccatcctattgcagagccactaacacccacactcactcagactgggcccacgtagatacatcctcagttggcttratgtgcaagctttgggatgtggaaggaaaccggggtacctggacaaaacccaggcagacagtgtccccagacaggaaytgatttttgttttcctcatcaaagttataatgaaatgacactgaatggaatattattgaagggcctgctgtattttgaagattacgatgttcatgctacacatactgactttctccagatagtctgctttttttgcaaacgccaaacctgctatctcctttgcagggcgattcrggaggccccctggtgtgtctgaacgatggccgcatgactttggtgggcatcatcagctggggcctgggctgtggacagaaggatgtcccgggtgtgtacaccaaggttaccaactacctagactggattcrtgacaacatgygaccgtgaccaggaacacccgactcctcaaaagcaaatgagatcccgcctcttcttcttcagaagacactgcaaaggcgsagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaayagacagtatatttatagtcacaagagcccagcagggcctcaaagttggggcaggctggcyggcccgtcatgttcctcaaaagcacccttgacgtcaagtctccttcccctttccccactcccyggctctcagaaggtattccttttgtgtacagtgtgtaaagtgtaaatcctttttctttataaactttagagtagcatgagagaattgtatcatttgaacaactaggcttmagcatatttatagcaatccatgttagtttttactttctgttgccacaaccctgttttatactgtacttaataaattcagatatatttttcacagtttttccaaaatcagagtggaatggttttgttatagatgctgtatcccactctttattcatgttcacattttaaaatcatttggaattctgcttcactcgcttaacatatacacaacacctgtaacatacaaggcaatgggctargtgctccagaccgggaaaaggagggacaggaatgcttggtctgatgggctaatatggcatttagagaagtaccaaggtacagtggagccggtcacaaaagggcagacttgtagtagaattcagttgcaagagggattggggaatcttaaggaaaaaatagaatcttaaggaaaaaataactgggtgagacgtggactgtggacaggtgtggaaaaggcactctccatggaggtatgartatgtagagggccaagagaggggagtacagggagaaatgmgttgagcttgtctgaagtgaacttcaggaagaggaacataggctggaatttagattatgggggctctgaacaccaaactgagtttggacttaattgacttctgtaggcaacgaggagccatggagattctgctcagggaagtgaggaactgggcatgccttaggaaaattaaccagggggtggctggcaagcaagcagacagcaggaraggaacgctgtggggatagggaggaagaacctcgcatgaccttgctaacacagcaacatcccaaccgttggttcggcctagaagctggtatttgggccatctgtytcccattgtcttaattttctgctcattagaaatygaacccctaaaccagtccacacaagtacgttatctaagtaatgttgcattctgcttctcttagactactttttttttttttttttgagacagagtctcgctctttygcccaggctgaagtgcagtggcgctatctgcaagstctgcctcctgggttcacgccattctcctgcctcagtctcccgagtagctgggactataggtgcccgccaccatgcccggctaatttttcatatttgtagtagagacggggtttcaccgtgttagccaggatggtctcgatctcctgacctcgtgatccgcctgcctyggcctcccaaggtgctgggattacaggcgtgagccactgcacccagccctcttagaytactttctactcgcgagatgcaacccctattcctggctgctgtytggcagcttttgttctcactgacatcctagttccaagaataaatcggatgctgcaatgctgctgttggggatatgctgacacagctcctcagagaggagaaaggtggtcgtctctctggtggagytgtcagaactgctcagtttagaggttcttggaacaaaagtcgtttaaactcacaaaagaaagagattctttaactcccaagagcttgactggggtgrgggaggcagcgggggacatccctgaagtgttgaagtacctaggccagtaaataaatgcaggtcacagagacttaagtcacagatttcttgacttcagactgctcacttgcatgttctacagtttttagacrgatgtgtgtctcagccatttaagaaaaacattgtttgaggccaggaacggtggctcatgcctataatcccagcactttaggaggctgacgtgggtggatcacttgaggctaggagtttgagaccagcctggccaacgtggcaaaaccccatctctactaaaatacaaaagttagctgggtgtggtggtgcacgcctgtggctccagctacttggaacamtgaggcaggagaatcgcttgagcctgggaggcagaggttgcagtgagctgaaattgtgtcactgtaytccaccctgggcaacagagcaagaytytgtcaagaaaaaaaaagaaagaaagaaagaaaaaaaaaaaaacactgaggaccagtgcgaaggaacccccagccactgaatytccggcagaaattcagctggtttcatcccctccccctttgcaggacaagctcttcttcaggattaatgaaatgaactgaggcagtgaggcccctggggatggaaatgggaggtaaaaaggccccagcattcctcccacgcagtcttggaaccacagactagatagagacaattgctcagaagaggcccctgactgagagacggggccccagcccagtgatgcaaattctaaaacacgctcaaagagcaacacatcattaccgggaatgggtgtcaggggaaattaaatatcatctcctcattattcccagctagttaataaaacaagcagatggtaacagtccaggagaacaagatctccaggtacctgtgcaactcttcttactgggtgaaaacctagaggaactctgggatggtgacactgtaccctcccagagccccagtcatgtctgtttatcagaaagtgcataaacttttcactccacttaacttcaaaagccaaagactcatgcaatcctcagtacttaggatcttggaggaagtttcagagtttgaaattaaatttccttttattttattttattttgagatggagtctcactctttttgcccaggctggagtgcagtggtgcgatctcagctcactgcaacctccgcctcccgggttcaagcgattctcctgcctcagcctccccagtagctgggattacaggtgcccgccaccaggcccagctaatttttatatttttcagtagagatgggttttgccatgttggccaggctggtcaaatttccttttaaaaattttaacagggccaggcgcgacggctcacgcctgtaatcccagcactttgggaggccaaggcgggtggatcacgaggtcaggagatcgagaccatcctggctaacacagtgaaaccccatttctactaaaaaaaaaaaaaaaaaaaaaaaaaaattagcggggcacggtggtgggctcctgtagtcccacctactctgaggctgaggcaggagaatggcgtgaacccaggaggcagagcttgcagtgagccgaaatcgcaccactgcactccagcctgggcgacagagtgagactccgcctcaaaaaaaaaaaaaaattctaacagttggccaggcgcaatggctcatgcctgtaatcccagcactttgggaggccgaggcaggcagatctcaagacgagcctggccaacatagtgaaaccctgtctccactaaaaatmcaaaaaaaaaaaaaaaaaaaattagctgggcatggtggtgggcgccctgtaatcctagttactcgggagtctgaggcaggagaatcgcttgaatccaggaggcggagattgcagtgagccaagatcccgccactgcacaccagcccgggcaacagtgcaagactacgtcccccaaaaaaaaaaaaaaaaaaaaatctaaccattaaaataatgagtattgatggcatggagtccccacctaccggccacagagaaaagtacatgtatacaaccaacttcctgtcccaccaccagggtcagagcacccgggagcacaggcgaagagacagttgacgccggctgagagggagaaggggtggagcactagctggcactgaacactcacagtgagtacgcattgagttttaaggttttttgatggccatgagatgtttatagaaaattgttacaggtgtggcgtaacaatcgactcgcagtgccttatcttgtaagaagcctctcctggaataaagacgccagagtactgcgacaccgtttcatgcctaaattaacaagacaagagaagcaggtcaagagaatgcrgaaagccctagactaaatgccggcagcttcaacgatttcgtcttttaaaactctggtgaaaaataactaggtggatctggaccttatgctcacaaccctaaaaatgacattaatatcagcatctgctatcttccagatgtgaccaaagaatcgatcaaaacacatgctttaggtctgctggctagacaggacagaagcagtaagatcctcctgagtcgatgaattccttactcactgcttctactgaggtttgagtggcatagcactgttgttagttctggtaacaaaccacttaggacatagaagactggtgaaactcaactttattaaacttaaacagagaagctacttctgcacatgttaaacacacatggaaccaaacagctcgatggagacaccctgcactgcttatggtgatgctgcaggaatggcggcagygatgcccgctacactccatggcctgctgcacrtgtgacwggacagttatttcatctatgcttacacctgcaggtcccttaccctagaaacactctatatcttcttaggtacttcccttgaaacaggatgagttctagaggmaataaaactgctgcacttacaaacctagaaatattcagggaccaagattagttgttcagtgacctaggaaaccttagaatcctgtaggttcctcaggagaggtgcttccaagtacttgagaatccacaggcagagatgcttccctttccatggtggatgtgtatgtcactccaggacaaactgcggagtcacggagtgtggaacacatctggttgtgtacagtacactatcccagaggaaaatcacaaagcaacacaactctgcagcaaaaactagtcccaaagtcagaagataaaactagcaaaaactttgcacaatatttagagaaaagctctagggtgtggagagtaygggtcttcctttttctccatgcaccaagcagagcacagtatcattccttaagctataaacaaaaacccttttgtataaatatttaaatagtaacagacacactgaactaggacaaaaatgacccactgggaaagaaagcctgaggtatccctttagttgccatgtttcttaaactgggttgcttacacccatgatcaacacagtccatcttcctacagcactgattttattcagagatttaggagaaatgttttgtcttagaatgaaaagggactgrtagatattaatgaatacatgataggagtacaaaagaaaagactgaggaaatgataactttaccaagcagcttcaaggatcaaccacaccctcgatggtaagctttctctttttctagggygacagatggaaaagtttccgaccaacgggaaggttacgatctggtaccagtccagcactgacaaatggagatatgagctcactcactcacagctgtgctcaccttcatgggaagagtcggccctctactccagtacgatgacacacaraccctggctgcactggggattatgggatcggcttctctgaaactctcttactttttaaaaatcctgtagaaggatcaggtaacaggaaaatggccggtgaattctgtaaaaggaagtgagtagaactgttttgggttagaaaagaagcactttaggcagccaccatgggaagaaggcgggtcaccttctcactgaagataagagaccaagtgctgatggacagcaacaggcagtgtctgaaaactagtccgataccatcatggtcttygagggaaaatctgattccactggggtttccatgtcaatagtggactcaaatttaaaaagtctccagtccatttccagaagtacaagtgttttctacatgagtagaggaatcagaaagaaaccaacwcaactctttccttcccatccctccttaaggtagagtccgactgcttttcttgccaatctttcatttaagtgtctcctcctaactcctttacttctttttcctctttcttctccttcatagagcagatccttaagtggcctttccttgactracattcattttcttcccatctttctttctttttaatctttctatcttaaaaaatcaacaaagaagtctttcattggctttagataattaaagccaagcaagctaaacaaatgttggtctttcctatagaaaccacgtttaaaatggttacataagcaccaagcttcctacccccatcacacaccttgtccttgagaactggtgttgctgtgtttcagttctgtccagttctccctggtgaccttttcctcccttgattagttccatggcactgaaggctaaggaaaaaagggagcrggtgggtccaggaggggactgacctaggagacaggctgatatttttttttacttttagacaagtaagaaatgaaaaaatgtgcaagactattccctcagcaaatgctcccttcaggttcgaacttggaacttcccagctttggtcatgtattttatgcccttaaagggtttgtacttttctccatacatatccagacgattcaccttgagtcctagaa

SEQ ID NO: 13218 - DNA, 19864 bp, Homo sapiens
  misc_feature (1)...(19864): n = A,T,C or G, or insertion/deletion polymorphism (see Tables 1-2)
accagcctgggcaacatagtgagacccccccccatctctacaaaaaataaaaaaatcttcccgttgctgtatgtggagcccctctagattgtcagtgatagaaaccacttcaaactggctcagccctaaaatagcgatgattttgtggctcacgtaactgaggattccaatgggcacagctggttgcaggccccgctggacccagctctctgctggccccaggccacttgctggcagcttcccacccactgtcagagcctgtccccccggtggtggtctcacaccatcttcacccctcaactccaggggtgacgcttcctggcccacctgggctcctgygccttccctgaaccaccctcggtgaccagggtgggtgaccagacctggaggtggggttgccctgctggagccctgtgggaggaggggagaaggtggctcccgtgctgggtgggcagggggcgcgtcttgtggagtccagctctgtcctggcatcggtccctgccccacacagccttaaaattccttcccaycctcaaagcccagcttgggtgtcctcgggggcctttctcccgccttccatggggcttcctgctctgccgcaggtaccttttgttgcccttgtcgcaggccgcaagctctgcaggccgtgaacagagagtgtccgagagtggaastagcggaggtgggrgacagacggctgggccggtgaatgctggcctcaaaggctgatggcccagaagccctgtcatctggaaatccccatttgccgtggggtgtgggacgttcctggggcggtgagctgtcagggagcacagcgcaggcagctctgaggaccctccctgaatccgcatgcctgcagcctacaccctggcccgtgtctacggcgtggagagtgacctctcagaagtggctcgccggggctcaggcagcgcctgccggagcctgtatgggggctttgtggagtggcagatgggagagcaggccgacgggaaggacagcatcgctcggcaagtggcccccgagtcacactggcctgaactccgcgtgctcatccttgtggtgagtggggtggggcgggtggagcagcagcccggtggcctctgtccctagtcagggctgctgccgggagcaggagcgaaggcgtccatccaggctttgcttggctcctggggtcagcrggggctgaaggaacagaagcgtggttgagtgctcaggaaccgctcccatgcggcgggygccaccacccgctgggatctggaagttgcccctgcgtcacccctgctgtggccgggaggcctctgtggtcaggcaggtggcactgactcccacccccgctgcctgcattggctgagggagggccgagtgtttgaggctgaggtccttggggctggccccctgcagggtgtggcccaggctgtctctccctcgtgcaggtgagcgctgagaagaagctgacaggcagtaccgtgggcatgcgggccagtgtggagaccagccccctgcttcgggtaaggccaggagcgggtggtcccggggccctgggagtcacgcttgtgcccrgctctgccctcagcctctgtctgggcccgagtgttctcacacctgcggcagccccgccaagaccacgtgcaggagccaaatgcagagatggggctcgagccgggcctccaaccccggagtctctcctcgaaccctctgctgtcgagacccccagcggctccatgggaaacaccctgtgccttgcagttccgggccgagtccgtggtgcccgcgcgcatggcggagatggcccgctgcatccgggagcgagacttccccagcttcgcccagctgaccatgaaggacagcaaccagttccacgccacctgcctcgacaccttcccgcccatctcttacctcmatgccatctcctggcgcatcatccacctggtgcaccgcttcaacgcccaccacggggacaccaaggtgacgcgggccgggagggcagaggctgcgctcgcgctgtagcgcgtgtctaggcttgtgctgccgtgragacggccccggggctcgcgtgcagggcaatctgtgtctgaaagctccaccctgctgtgtgcgaagctcactgaccatctgggttcttctgtttcattttgtttcttgacttgcccgggtcacggccccaccaccttcttyctgggttcacaggcagacgtgtcaagtaccaggcacttggggtcacagctccactccagtgtggccctgagggcctagactgagctcttggagagcccaaggccgcctggcagaccagagggttggggagacaagggtcaggcaccacgtgaatagccagggtgactgctgtgggttccaggtggcgtacacctttgacgcgggccccaatgccgtgatcttcaccctggacgacactgtggctgagtttgtggctgctgtgtkgcacggctttcccccaggctcraatggagacacgtgagtgtggaccccgcccctcctcctttttgggagatggtgccaggaactctggtcggaagagacggaggcacctgaaggctgtggygctgagacagggagtcccagggcaggcagcagtcccccgagtgtgggagccacgggcagggtgtccccatagagccatcccacagcccacgtccacagggaagaaagagaggccgctcacgcgtgtgtgagcaacgcccaggrtctcccacctcctgagtgacagcgtcccctgcagctcgggaccccgcaggctcttattctatagaacagtggcttaggaaacacgcctgcactcccagatgtgtgcgtaagtgtccgacattttgaaggaaaggagtcaaagcccctgatttccttcttactgaagcgagttagagccagtcaaggcggcygggtgttgaccccgccccggcagttgggtgtcttttcttgggtggggtccggcagctgcatcttggygccacagagccsccatgtacgccctcctcggtgcacagcttggccctgaaccgcctcttcccctgcgctgctctgtgggggtgccacagagcccccatgtacgccctcctcggtgcacagcttggcccagcctccttacgccccggggctgttgatttcttccctcccgtgttttcatggtgtcttattctcaatgtgagaggcgcctcccatttaagggtgtctggaagcgtgtggggatgtgcgtctgtcccgggtgggagcaataacaccttctaatggtcaggggcctgccctgtggggtggactcagacccacaccccaggactgcccgcctgggaagcaccaggctcgtggctgctgctccgggtggggcttgcaggcttccgctgttytgcagaacacggtgacgaacgcaccagcttgaattgggcgcttccctgagctgttaccccatggggcttggcagcacccttggccagatgtgggtccagcctgggcatagctgtttaccacataacctaaaatttcctgtcycagccattcgagagcatataatcctgcggtgttgaggacattcacagggtcatgtgagcaccacctcaagccacctccttaactttttcatcamccctaaaagaaacctgtccccacagcagccacctgcygtctccccctccctgagccctgacggccaggaatgcacttcccatctctggacttgcctgttgtasactgttgtagacgcttagagaaacggatgcattcaccgtgcccctgccctgcktttccaggtttctgaaggggctgcaggtgaggccggcccctctctcagctgagcttcaggctgcgctggccatggagccgacccccggtggggtcaaatacatcattgtcactcaggtgaggcctggggctcacccagtaccccggggtttcctttcctgccaggggggcccgcccagcccccagggcccttaaaggcwaagcgcggctccctgtccctaccgtgtctcaggcaggaagccagaacgcctttgtccattcatttgctctcaaagtggacattacaggccactggtgatgctcagagcagcagggctgcgctgagggtgggagggtgagtctgacacaggctcccagggagacaggtggggagtatcagacccttgaatagggagcgcctgggtnnnnnnnnnnnnnnnnnnnnccccaaccaccccagcagaccggggttcctgccctctgacctgctccgagggccaagcttgcatccagtgatcacggccgcccaagccattgccgccaccttcctctcaggggctgcctgttcccaggctctgtggttctctgtcccccctgtgacagaagcagtgcccagggcagggggctcgcagctggcaggggcggctgtgcctgcaggagctgcgtgtgggtgtcaccactcaggcgctttaccttctgaccaggacccacaggaagggcgggggcacaccgctaccctcctgtgtccggccctacagatgctgggcacaggatgaggcgctgccattcctggtgacctgacatggatttctatccccaggtggggccrgggcctcaaatcctggatgacccctgcgcccacctcctgggtcctgacggcctgccgaagccagctgcctgactgcctcagcagggascgcatgcygcttggagaaggggtggcctcgccggagctagggagcggatgtrgtgggctggccggactcctgggacatgtgggtggtggcttgaccccgggcccatgggcagcttgctgtggggcagtgcagggagtcctgcggccgcccaggtgtcaggagaggtccccgccgagtgcttcagctgccctaagctgcaccagcgctttgccaagatgggatggggagggggtatgagaactggcagagcctcggtgcagcagggctgaagggctttctcaccccagctctggctatgcccagttctctgagaaaggagctcagtggggaggtggtccctccagcggaccagggaaggggtcacygtgctgggagcagcctccttgggcctcaggaaaccaccaagtgcctcggatggtggctgcccacggcgcttytgctgagaccctgcccccggcccaggtgtctcggagggtggctgcccacggcctgggtgtggctggaatggtggcaggagtgggcaccagtgcggccccggtggccatggggaataaaccagcattrctgcctccggcctccgccgtttttctgtttcgtaaaccagcatcccggggttcctgctctgagtgaccctggcacctstcagggagtccaggtgtgccccatgagggcctgggggaggggcaggctgggcagagccacagaggggctcccctcaaaccccacattggctcaggtgggaccctcaggagcaaccccaggtctaaagtcttcccatgggcgctgggctcaccacccccacgccagcccctgcctcccgtacccaggccggacgtgacggggccgtccctgcattctgtgctttcccagttgtacacatcctgtcccctccctcgagtctcagtcacagttcagtgacctggtgacgggaggccccctgcagtgtctgacccaggccaygcctgtgccagcccagagccagggggaggaaatgggggctgggcctctggtccccatggggaggccacccttgtccttggtagcatcagggtgcagaggtgttcccgggctgtaggggtgactcccccaccccccaaggctctggagaggccgatttgctcaggaagccgaccttcacaccttgtcctgctattaatagacgcctggttgacacgggaccctcggttgggtccggagcattgggcaggggcacttgtcagtgtttgagagctgaagtttgggaagccctggggaagcgcaggaactccccgcctgggctggggctgccgggcagggcccctcctatgcctcggcgtggctagagagggcgggggcagaaggctccgggacagccctgcaccctacagatgcgggtctccgcccagccgcggtcacctggggggctgggggcggggcctgggcggggcggggttcggccgggagcgcaggggcggcagtgcgcgcctagcagtgtcccagccgggttcgtgtcgccatggggyagatcgagtgggccatgtgggccaacgarcaggcgctggcgtccggcctgagtgagtgcacgtcagggacggtggaggctgcagcctggaggggtgtcccaagaccccagccgggacctcgggctacttacagggtggggaagtggggcgccaggcgggccaggccgggccggggtcaggccaggagggtgcggggaacgggggcgggaccctcaggccgcgggctggaaggaggagttctgagacccccagtaattcccttgcagaccctgcggagcgcggcgcccctcccccattcccttctctcggtcccccgactccgcgaaggaggaagttgcagygcaggggaagaggcggttcagccccggtggtttccggggtcaccgccccgaagcccccgagtgggggctccggcctgggcatcgggagaagctcccctgcccctcggtagccagctggcctggaggtcgctctccctgggcttggggtggggaatgggctcatgccctggggctcagcccttctcatctggagtctgcgctggaggcggtctgagatttcacaaggcgccgaaaccacccagtgacggccctgcccagcccagctgcacaggcactttgctcttggggtgggatggcacagcccccagtcaccctcctgtgcatttgctcagaggttctggtgagggcagcggactccatttggaaatggaccctctcgggaccagggccagggagtgtctggcccagcacgggtgaggctgggctcaggcgaggtctgagggcagaggcaccactgcagcagctccaggaaggacctgcaccgggggaggagtgcctgggaagggcctgggggctgagggtgaggaggaggggcccgcygccaccactcccctggggctctgagcgccctccctgttgtctggagggtgcgtggcagctggagtgggagcagagacctcagggtgggagggctggaggacggggccctgcagcctgtcctgtgcccaggaaagtgacckcctgcttcgagtcagcggccaagaagtcggtgggtcagttcagacagctctycccagagctgccccgtgagactcaccctgcctgccccgcactccctacaggaagtagacggactgagggcacccagctgggagccaggagacctgggctctagtctggcctcctgctgaaaccctccaggggctcctggcccgaagagttagagccagactggacgccctgcactgcccgccctggcctcccggctctccggccccctcctccagctgccgtgcttcctttctgttcctagatctcctgagcgtgccccagggcctcggcacaagctgctgcttctgcagagcctcatggctgtctcatttatttctcaattcaaatgccacctgcctggggaggtccttccagaccgtgcagccccaggaggcagctggcccggagacagcagggccttgacaaagagtcccccctgtacacagcaggtgctctgtaaatgtggctgggtgccagaatacgtcctcagacctccctggtggcaccagcggcagctttgcaccctctttcggatggcaggctcgggaccaggacggtccccaaagatgcatggacaattggctgagtagactcaaggacactgccctcccctcctccgacgcagacagacaaacccagagagttaatgtgtagctgggctcaaaccaaggataggaaatcttccaacaagaccatgtggagacaaaaacagaatggctggcagggcaaggtggctacacctgtaatccyrgcactttgggaggccaaggcgggcggatcacgaggtcaggagatcgagaccrtcctggctaacacagtgaaaccccgtctctactaaaaatacaaaaaattagccgggtrtggtggcaggcgcgcatagtcccagctactcgggaggctgaggcaggagaatcgcttcaacctgggaggtggaggttgtagtgagctgagatcacgccacggaactccagcctgggtgacagggcaagactctgtctccaaaaaaaaaaaaaaaaagaaataaaatagtaggaaggaccaggcgccgtggctcatgcctgtaatcccaacactctgggaggccaaggcgggcggattccctgaggtcaggagttcgagaccagcctggccaatgtggtgaaaaccctgtctctaataaaaatgtaaaaattagctgggcatggtggcgggcgcctgtagtcccagctactcaggaggctgaggcaggagaattgcttgaaccctggaggcggaggtagcagtgagtcgagatcgcgccactgcactccagcctgggtgacagagcaagactccgtctcgaaaaaaaaaaaaaacagtaagggggaatattggacaatacccccccaaaaatgtgcagaaatagccatatcagacgaaaccgaaattaaggcaaaaccgctgacgggttaagaggaactccgtatcggggggaaaaagacactcccccaagaagatgcagaaaccacactcggcctgttagctttcagtgcatcaaacaaagactcatggtgacaagggggtccatttgggggtcccagagcccactggggcytgcaggtcgggctgtccttggccactcctgggacccagagcccgggcatgtccagcaccccctccgccagcccgtgcgccacaggctctgctcttcaccagtgcagaggggtgcctcctgggggtgtccccgaccctgtcactgtgctgtggggatgggtagggggcagctctgggtggcctggtggcccacagtaggtagagaaggggggtggcccaggcccccgggacrggagccccacagtgcctgacccacttctccccgcagtcctcatcaccgggggcatcgtggccrcagctgggcgcttcacccagtggtactttggtgcctactccatgtatccttccacctgaggctggggtgggcggggaacgcccagggcagagctggggagccacttcacagtgagctgtttgcctccgctccccaccaccgcagccaggctgggacacagggtgggctgtgcacgggttgggcagcccaggccccagcagccaggcccctcgccaggaccatgtggcgatcagcggcagacccgccagtctaagtcctggtgagtggtgggcagggggtgtcaccagagggccagggccagcactgaggcctccctgttggactgctgggatcccctctgcccgctcctgtcagtcatcccccttgaccggcccctctacctcctctgccccatctcagccctgccgcccagccggaccttgcgacaaggagcactgggcagggtggtgggagggagggcgtgggcagccccgagtgccagacctgttggaacctcccgtggctgcctcctggctctgtgacctcaggcagtggctgcccccgaccttttttgagacagggtctcgctctgtcccccaggctgcagtgcagtggtgcagctgtgactcatggcagcctccacctgggctcaggccaccctcttacctcagcctctggagtagctgggaccacaggcacacaccactgcacctggcttttaaattttttgtagagatgagggtctcactatgttgcccaggctggtctcaaactcctgggctccagtgatcctcccgcctcagcctcccaaaatgctgggattccaggcatgagccaccgtgctcgggcccctctctgtgttgtcttcagtaaagggagttccctgtggcccctcaggctgagctgggctgttccttaaccacatggcttcagtgtggcgggcgtgtttgtgtgcctgctggagtacccccgggggaagaggamgaagggctccaccatggagcgctggtgagtcycctcctgctctgggktctctccgggggytgcggggcccaggcagggctcacagggttgggtggagcttggtttctcacttggaggctccggaaccaaccctttggtgcttgtgggtaaaccaaggccggtgcctgcccggtgtgttttgtgggaggaaagaggcctgggtgccctggggtggtcagcagggcagcaaaggagtcccgagtgggagaggcccagccgcgccgtctcgccttcctccctcccccaggggacagaagyacatgaccrccgtggtgaagctsttcgggccctttaccaggaattactatgttyrggccgtcctgcrtctcctgtgagtccccgtcccgcaccccctctagggctcaggagggcttggagccgaccctccccactgtcccaccggccgggctgcctggacaggagccacccccacttacctcagtrtttttccaaacaaaaattcgggtccctggctctggcagggcctgtgtctgctgtctagygtgcaggatttgtaaggatccactccaaatccgaggagctccgatccgtcgccagggtctggggtcagcatgcactgctggggggtcttgcctgggcttcctggtagggtggagggttccgtgctgtgtgtctgctggttactgccggctgaggccaggacacccacacgtggctgcttcctcygagcaagtgcaccagagccgctagygkccacatcaaggcygagaacacccaggaccgaaacaagccccggtccrcrcacgtcccctgggtctgcagtctgccttgtcctgagactttgtggccttggcccccagacctggggctccgttcccctttctgagtgcccttctgtgtccctgcctctcacccgctgtcccccaggctctcggtgcccgccggcttcctgctggccaccatccttgggaccgcctgcctggccattgcgagmggcatctacctactggtgagtggcgccctctgaggtcggccccggccacccccatccccagcccctgccctgacaccctcggacacgcatggcccttgaagccggctctgtaggctgagccaaggctgggagcaagtgtgagcctgggcgtgtgctcacagcacggcggggacgcagcggttgctgctgccatttttggcgtgtctagtgtgtcgggtcrtttccttgcatttcctcattaacccgcaccacagccctgggaggggtactggggtccccactttacagacaaagatgcggaggctcagggaggtgctgtgactggcctggggtcacgcagccggccgaagaccgtgcctgcgcttgggtcccattatcaggcttttctcacctaaaccctattcgcgctgattcatgggcggtgccaggacgcagacattttcttaaactgccgacacctgcgtttggtttatgactgctgcaccctgttagaaggctgcccatcccatgggatacagtgatctctctgagaggccagggatgggtgggaggacagggcgcagcctggccaggccttgggtgaaatgccctctgcctgccctgggctccggaacagacggctgcaggccacctctcactgcgggggtctctgggtggacagagccctcagactttgcttatttaaatccttttgtccatagagccaagtccctcctgccmgcagaggcaactgccctccccttgctgtgcgtcttctagtgtgtgtgcgtgggaaaggtgcagcactttctgtgtacgccttccgcgtatggaagtggagttctgtttcaagcctcactgacctgccaccggcagaactctcctttagaaccccttcctgttgccaagtgctcatctgggctgttgctttgttttccgggggccacccgcatcccccccgtctccctgctgccacgcacagctagtggctcctggagacctcgggaggaattccttgtgctaaacccagagaggaattgctgggtcaggcatcagcctctgcaccgttcaccctgccgggctcagctgctccycagcagacaacccaccaccagccatgtggccccatctctcccaccatgcactaggctttctcccacgcttgccagtttcacagcacgagctggccgtgtggagcttggactcgcccttctctgactgtggatttgagctgttggagtttcttctcccttgagttgcctgttcaaatcctttgcccatttttctattgtggtttttgtatttttctttttcttcttttttttttgagatggagtctcgcgccatcgcccaggctggagtgcagtggcgtgatctcggctcactgcaaccttcgcctcctgggttcaagcaattctcctgcctcagcctcccgagtagctgggactacaggcacgtgccaccatgcctggctaatttttggtatttttagtagagacggggtttcaccgcgttagccaggatggtctggatctccttgaccttgtgatccgcccgcctcggcctcccaaagtgctgggattacaggcgtgagccaccgcgcccggcctgattgtctttttcttaagttgcaggaagtccacatatattttagctatttagcctttgtaamctttaracactggggatgccttcatgctttctggtgagggtctgttaacttggcscgtggagtccttcactgcacggaagagcagaggtttccctgttcacctgctctatggtctgtgctttgtgaaaacacctttccctggccctgggtcctgccttcacgttcctgccttttcttctatcagccttctagttttgcttttcagaatggaatgtttccgttttggagtcaggtaggatcacacatgtccagtttctctttctgttcatgacgtatatgatgtgacatatttttccaccagatattatgggatagaagatgaaaagcacacactcccaggtccacttgacctgttgcagtggaacctccgggcatgggcccaggagtctgtatttttagtaaaagccagtggaatcccgtggtcttcaagctctccccccaccacccccatgtgcagaaatgcctgggcacccttggggggctgccggccagcgtgggtgaatggcgcccaccagacggagcagggcctgctactctcctgggccacccctcctgctggacctcgggcctgcctccctgccttccctgcccttggcaccttgagaggagaatttgagtactagaatttgcatctgggagtgtccaccacgggatcttccagaagcccaggggttcgggccccactcctggcatgaagaaatagcttgggctggtgtcaggccgacccaggtcctggctgtgtggcctcgggcgcgtcacttaacctctctgagtggcagtcacaccatcctgygtgggattcagacttgagcctgtcccagggcccctagcggggtgggcctccggggagggagggagggagggagggcgggcgctggggcgcggctcaacccttcagtgccccgcaggyggctgtgcgtggcgagcagtggacgcccatcgagcccaagccccgggagcggccgcagatcggaggcaccatcaagcagccgcccagcaacccccmgccgcrgcccccggccgaggcccgcaagaagcccagcgaggaggaggctgcggyggcggcggggggacccccgggaggtccccaggtcaaccccatcccggtgaccgacgaggtcgtgtgacctcgccccggacctgccctcccrccaggtgcacccacctgcaataaaygcagcgaagccgggagcgcgtgagcctctgcctggggccggtgggcggggctggggtagcgatggttcccgaggcctgggcaggcaccccgtttcctgccagccgggccgcattccagtttcattaacatcagcatcgccttccttctcagcagcacacgaaatcccgggtaccgtatattccacgaaatatagtacctggattccaggtgtgtgcctccctagaaaggtcctcccgggcctggaggaggcagcagagtcctcccttgacagctcctgcaggccctgcaggccctccacacctaacgcctccctaaggggcttggattccagaggaggccgctggcgttaagtgaaaagggaacagggycggagccacgtggtgagcctctaccctgcgcctcttttccgtagaagctggggtgaagctggtggcggatgtggccttgtttgcccccacactgatgctggggggccccccagctgcccaggacgctcaggccaagttgcaggggcttctggccaccccttcccctcacttgtgcggaggctgtggctggctgcacacacacctgcccacaggtcctcaccaccaccccagcccggtgcccccaaagctttgcccggcrtcagccacgtcccccacctttgggctctcgccaaggcacccactcccctgaggccggagaagcccttgcctgctgcttgtccacctgctctcccagcaactcacacttcagagccagggtcctctgttcctgggggccttcagaatccaccccccaccagccaacactcggcaccatacagacgtctcaatccagcctcatctcagccgtccccccaggtcaccaagcttcaggtcacccttgaaacccccacaccccacatccaatcctggcccaaatccagaccccagctacatgggccatccccacccaggccacctgccgcctcccgctctgccctcatcccctgaaaccatcctgatgctgccattgaaacccaaagcctcaccccagtgcctscggctcagaatccgcaggctcagaacccacaggctcagctacctccagtgacagccacaagcttctgatggccccagggcagacatgatctgcacccccagcgccctgccctgcccctgcggtccccctctcacctggcatcagccacgcaggccactctctgacccttggacacacgcagcatgtgtcttctcagrgcctttgcatgggctcttcctgctgcctggagctgttccctgcatggctgcctggctccttcctcctccccttcaggtcttcgaggcctccctgaccctctgcttagaactgcagccccttggccgggcgcggtggctcacgcctgtaatcccagcactttgggaggccgaggcgggcagatcatgaggtcaggagatcgagaccatcctggctaacacggtgaaacccmgtctctactaaaaatacaaaaaattagccgggcgtggtggcgggcgcctgtagtcccagctactcaggaggctgaggcaggagaatggygtgaacccgggaggcggagcttgcagtgagccgagatcgcaccaytgcactccagcctgggccagagcgagactcctcaaaaaaaaaaaaaagaactgcagcccctcccccagagcctctgtcctggactcactcacagactacacaccacttgtttcattagtcaccgtggaggcaggaagggttttcaccattttgttctcggcctgttcccagtgccaggtgcttagtagaaactcatatggctgggtgcggtggctcacgcctgtaatcccagcactctgggaggccgaggtgggaggatcacttgagctcaggagttcgagaccaacctggccaacatggcgaaaccccgcctccactaaaaatacaaatatgagttgggtgtggtggtgcacrcctgtactgggaagctgagctgggaggatcgcttgaactcagaaggtgggggwggcagtgagctgaagtcataccacactgcactccagcctgggcaacagagcgagaccctttttcaagaaagaaaagaaactcaataaatgtgttgaatgaaaattccatctcctggacaagggccaccacctccaggaagtcttccctgaggcctcttgctttgggagtctgagtggagtccttgttcttctgtgcagcacccccacccccatctccaggcacctggacgcagtaggtgggtgagccagggggccaggcaggggaggggctaacaactgcccagcagccccatggcaatgtcagcccttggggccgggggcctagagactgagaccctgagactgtcacaggcctgggccccctttccacgactggggctgctccccccggggccccttaactaaaatctccaacagagcctgggtcccgaagcgtggctagttcaccwtcagggagggcgcttggccttggatgttgatccgaaccacgaaggctgggggccctgccttgagccgacagccctgcagttcatcctcagagacttgccttgggggccgagagggtgcccctaggcgctcacatcattacaaagcatagggctcaaggcactgcttgaggaaggaggctggttcctgttcccaggggtgtcctcaggggagacactgtgtgggcagagcagggacacctgtgacccccccgtgctacagctcagtcccacctgcatgcaytgctcgcggctgcgtagacctttctggaaggacaccccagaattgggtccatggctggcctggaccagggctgaacgggagaatgtcgcattgaatgttggcctctggggatgtgttcatcagtttaataatacacgtacacttaaataattgtttaagaaacaggggtacttccaaggaggttgggaagaggcagcctgcgggggcctgaggccagtgatagggtaagggaagccgggagcaggacagggagccaaggtacaggcagccgtgtgacaccttttctgcagctttaagggctggaagaggtgctgagctccttctacccccaactactgaggctggagatgaggagaacagtggggggctgtcctccaracacggggaatgcccagaccccaagggtagtgttgggggaggcatataaataacaataaatacacataaatagggggtgccctctggggagcacacgtgtccagtctaggggccccayggcctcggcggtcacacygaacggggcagcacgcaggtgcagccgacggggacgtggatgaactcggtgtggaaggcaaaggccccaggtgtggggagccccgagccgtcgcgggagcagggccggcggcgcagcaccagcaggctctggagcagccgcacrgagttgagcgcagctgtctcgcggcccgtccgtgcatcgatacagcctctgcacaggcactcggcgaaggccagcttctgtggatagcggtcctcatccgtgtccacactgcgggacggggtgcacagtgagtctctggccctaccctgtcctcctggaggcccctctcccctcagggcccctctccgtgtactcaggataggacctgaggcagcgagggctgagccacacgggcttggggtgcagtcgggctcacatgtggtggtaatccacgtctccccagggccctccaagagcacagagcagggtccggaggcctctaggagmctcccttccacttcatcacccagccccacttctgcaggagctcaggtgamgggcccagaatttccccaggggaccctggccacctaggacagtggsaggcagggcacggccagccgcaagcagcagctcagcmgtccaggtcaggagggccggagggagggagctcaggtggccacgcccacttgacaggtgagaaccrccaaggcccagagagctctccgggcagtcagggccccgccaggggaggggcagccccacgccacagcggaatccccaggtcctcaccggtatctccagggtgagatggagcgctggtgggtgtctgcctccaacacctcctccggccgcagcaccgggcactgggtcgtagctgagggcctctcgtgcctccccctgtggcttgctgcctccaggctggacaccagggctacaggcaaagcctgcccccacttggcacctcgagccagcaggtgtgggggggcctggccgaggggcagttcctcagccgagtagcagtgtggggtaccgtgactgtgggggtgcccccygagggaggggtcatggtgggccaggcatgtgtgcagccaggtcagaaacaggaggccggggaggagctggtgaaacaggcaggtgggtggttaggaggtgcccagggcaggrggcacctcacttccacctcagctttccttgttcccagcggaaagatggagtacagccctccctctatagatggggaaactgaagcccagagaggctagcccttcagcccaagacacccagcatgccagcgctccgaggatctgcagctgcctcccctacccccagactgaggggtttcccagaccccatcccaacaccctcctcccaggctcagagaaccccagcccttccatgccaggctgcacatccaagcagcatccatccgagcggcatgtggagaggctcaccgtcatggtggcggcagcggggcaggctgggcttggagcggcctgcacacctggcggcaatcccacaggtgcacctggccatgcacctggcagcagccgctcttatacctgaggccacacctgggggaaattccggcaccacttcctcctcgggaagtgcccagctggkgcgcttcttccttctctggtccccgcagcccccgcctgctgtgcatcaggacacagacatgcaaggaggccccgggaggcgctgtcctgttacccccctcccccgagagagactcygcccaacctgagcacctacacagggtgctgccttgtctgacattctcaaactttttttttttttttgagacagggtcttgctgtcacccgagctggagggaaatggtgctgtcccagctcactgcaacctccacatcccaggttcaagcgattctcctgcctcaggcttccgagtagctgggattacaggcaccccccaccatgcctggctaatttttgtatttttagtacagacagggttttgccatatcggccaggctggtctgaggctsctgacctcaagtsatctgctcgccttggcctcmcaaagtgctgggattacaggagtgagccactgcgcccagccttgaacctcctataagagggtttctgcttgygtatccstcagcaccttgctgattcaacttgtaggttttcatctggacctgatggtggcggggcrcttttgcaccctatacagttcttctccgtctgctgctggtgggtgccaagggtggttcagtgttttagctgagatggtcaagatcaggtgaggctcacgtgcccccttcacccaggtgggagaggtcccggagatgggggaggcaggcacgtcttcaggtctctgttgggtttctgkgttgtttttttttttgttgtttttttgaggcggagtctgactctgtcgcccaggcggggrgtacagtggtgcgatctcggctcactacaagctcagcttcctgggttcacgccattctcctgcctcagcctgccgggtagctgggactacaggcgcccgccaccacacctggctaatttttttgtatttttagtagagacggggtttcaccatgttagccaggatggtctcgatctcctgacctcgtgatctgcccacctcggcctcgcaaagtgctgggatcacaggcatgagtcactgcacccggcctgggcttctgtggttttattgagaaaaaagttcaagctaaaaagtctgagttggaggtgtgaggagtgaggtgtgaggtgtgagtgaggcatgaggcgtgaggcgtgaggtgtgaggtgtgaccagcacacacaggaagctttatgt

SEQ ID NO: 13219 - DNA, 26232 bp, Homo sapiens
  misc_feature (1)...(26232): n = A,T,C or G, or insertion/deletion polymorphism (see Tables 1-2)
ttagatgttgtgcagatatataatgcttgtgtcagaattattataatattgataataaactttagatattgcttcagagtgtgtgaaatattttataaatatttgaggtcctcaaaaatttcctcaagtatgttaatacattattctcaaattattttacaaaataagaaaactgaaacaagtatatattatcattccattcattgatttattcagcaagaattaactacctacctactattaattatgtttcagggactgtgctaagaaaagtgagagagatgtataagcgattcatcatatcaacgtaacaaatgcaaaaggatctataagaattgaatattccatttttaatagtagcatcaatttcagactatcatgtttcctaaaactttctataatgccagttatgaaagttttaggaaaatgcaggcatgaaaatgagtgtcttatcttctcagaacacctgctagttgtgctggctatgatagactcttggctcaaacctcatctatacatctttgagatgagractgatctcatactattttttaaccacatttgacagagtcatagacagtraactgtaatatgaagtgtaataaagaattcagagttattccttttaaaaaaattatcttgttgacaacatgtagtattttccagctattacaytgatattttgaatgggcacaagagatataaagacctaagcttagaatgcatttatttattttttgtttatttatttatttttgagacagggtcttgctctgtcacccaggctggtgtacagtggtgcaatcacaactcactgcagcctcaaacccctggcctcaagcaatgccccaccttagcctttcaagtatttgggactacaggcacacaccaccacactcagttattttcttttgtaaaggtggggtcccactacatttcccaggcttgtctcaaactcctgggctcaagtgatcctcctgcctcggcctcccaaagcgctgggattacaggcttgagccaccatgccaccctgcctaagctagaatttaaacaatgagattcatgtttatcttaggttgagattcttcaaaagcaaagcctaagtcaagacattggtgcaattatattttcaggacacagtcccaggaagcaagagtgaggtagcaagaagagtgagtmaaagaatgaggaaaagccaatacaattatgtgttatcaaggtttctgctatgggcaattgaagctcaattccaccaggggcctctgagaagcctgcagaccagcttccagtcgttcacatctccagtgagcaggaggctggaacattcatccttcagtttccattccccattggatgaggatgttccctgagagtgttaacttctttacacttccaggctgtactgtcatgctgacctggaaggcttgatggcatctcaatgctctgggaagaaagcaaaaagacacacagtctgtgcttaaagttgtattaggttggtgcaaaagtaaccacaattacttttgcactttgtcagagcaaagtgagttacacaaaccagtccaccccttgtgcwactaaattaatgctgtgggtatgtggcagaggacatcagaagaatctcctacagctttgttccttggagatttaaatgatgggaaattggatgagctttctctggagtaacttaccagcctcagaaaaaaaagaaattacagataccaacactggagaaatctcagtgtggcagggctgctaatgacctatcttaaccttcagtctacacttcttctgcagtgagactccaatttcatttgaggtagcaatgcgtcatattttgtagccttgcttacagctaggcttacagctggatatggccatgtgtttatttctagccaaaatgtgtaagcagaatgttgtgtggggcttctggaaagggactggaaaattactttttctctgccttcctccttctttctgcctgtaatgcagatgtaatggctagaggttgagaaggcagctgactcatgaggcattgtactgasagagtggtgtagcaaggtagatgttgcctacccttgatgatatggagctgtcaaacaaaccctaggcttccaaatctgggcacttttttttaatgtgaggcaaaaatacatttttatttaactaagcatctgttattttgggtttttgtgttacattcaaccaaatctcatcctgactaatacatcacatgaagggtgtgggaagtgccccacctccctgcagtgaaggtcatcaattcaccatccctgcctctacacatgagagcttccagtctgctttcttgcctctcattcttaagcagattgcacaacacaaagtcaccaaatatttttgaaaagattgcagtgtgaaaaacagagaccaaaggagagactttgaggaactagagacaattgtaggagcaaaagaaaatgtcgaaataaactaaagtatacttaacattaacattctttaaaaataagaagagactgggtacagtggtttgtgcctgtaatcccaacacttttggaaggctgaggcagaaggactgcttgaggctcagcattcaagaccagcctgggcaacatagtgagaccttgtccctacaaaaaaataaaaataaaaatattagctgggcatggtggcatgcaactatagtcccagstactcgggaggctgtggcaggaggatcactmgaacccaggagtttgaggctgcagtgagtcatgactgtgtcaccgcattcnagcttgggtgacagagtaygccttcttttgtttatttaaacaaacaaataaataaatataagaattaaatataagaatataattttggatgtaaaatatgtcttatttatttaataatttcttatttatttagttatgaattatgtattattawttatttagtaatttatttaaataaataaataagacatattttatgtccaaaaacactaatgaaatgcaaaaaaaaagcttaaaaatgtaaaagaatactcagaactggaaagagttcttggaaattaaatgtcttagctgaaattaacaatcggtgggctggaaagttaagttggtagaaaataggatatattagaagcataaagactcaatctaggaggtccaacagatatggaaagaaagaagagaaaatgaatgggtagaaaaggagaaaatgaataggaagaaattataaccaaaactatattggaaagttaccttaaattgaagtttccatgaaaaaaaggtccacttactgtccaaaaatgttaatacaaaagacctacatcaagagcataactataaaatttataaatatctaggtaaagagaagatttccaaaacctttcaaaagaaaaacatcaagaatcagagtawaaaacttttcaacagcagcactagagtctggaaaataatggaatcttcattatccttcaaagttctcaggcaaatttattttagactgaaattctgtatccagtcatacaccaatcaagtgtgaggatgaaataaagrgcattcttaggtatgaaaaaaatcagaatatttattttccttatattctttcttagaaaactcctgagagacatgttgcatcaaaacaagggagtaaatcaagacataggtagaagtgaaacccagtagccagagatctaacacagagacacaatacaagttttctggttaatgagaggatgacagttctacaacagacccagactggagaaggcaagcaaggggtctcagagggatgagttcaagggaaaaaaactgctgctatatttcctgtcatgtttggttattctgagagagtttaagagttctatggaagaatttggtaaagaattagcatataaaaatcaattcaactatcaactgcrgagaaaaaaggctatacaagaaaggagatgtaaggccaggcatggtggctcacacctgtaatcccagcactttgggaggctgaggggggtggatcacctgaggtcaggagttcaagaccagcctggtcaacatggtgaaaccccatctctactaaaaatacaaaaattagccaggcatggtggtgcatgcctgtagtctcagctacatgggaggctgaggcaggagaattgcttgaacccgggaggcaaatgtcgcagtgagccgagattgtgccaatgcactccagcctgggtgacagagcgagagtccgtctcaaaaaaaaagggaaaaaaargaaaaggatatgtaatcatagtatactacgtgattctcttgtgaataatattttcatggtcataattgtatgaacgctgattacgggcttaaacattcctataaccaaattaggaaagcagaaggagtgttaagtccttcttttccataggaagatgttaataataacatttaactttgaaaactcgagaaatagtagcataagcacrttatttacaaatgtggagttaaacataaagataaaaagctataaaaataatttaaagaagttacctttggggagcaggacttgaaggagcgaaaggttagggcagagagatgctttttcrttayaacaagatagcaccatttgacttccctttttctggtaactctrtttttttttwaattttgttctgaaatattttagagtttaaaaaacacaaaagaacaatacaatgagcatacttgtacttagcatacttgtacttaataccattataacacaaatcctgatcatgtctgccttctccccttcatcccattgctccagaggccaattaaacwatttaaactatatacatatattaaaacagtaaataataatatttctgaaacaagatttataactgggatgagctttaaatgcaaaggaagtatgtatctacttagatcctataagttcctcagctatgccatataaattttgtttaggatatggacaaggaagatttagaaaggtgtatcgattgaggagttaacatttgggaagaaagggaagaaaattttaataattggtagaagaaaaggggaggacaagtgagggaggacattgctgtaactaagactgktccttcatctaaaagtagcccaagtaaagaagaatatattgaaattaatccaaaaggctctcactaactatattctcacttctgatgttaattttggccttcatcatccatgacctctatgactcttcatcttcccagtcagctgtcttgtccatgagaccctccatcccatcttccatagctgtctacatatgtattttgttccagtcaggccagatttcctgcagcttatttctgctgtgttacctccttcccatggcctctttgcactcatacttcttcttccttcctctgtaaatccaaattctacacattctccaaaacccagagcaagccctagtgcaagccccagtgcaggctgtatttaacttgcataaaacctcaaggccacactcataagcaatgatctgcctttggcccttcttagtctttacaatctgcactgtgtwtttgcccacttgcctcctttttgtcctacattaatttctgtatgtgtctgaattctccaacaagattgcattcacwggggcaggcaaacagtaggaattcaataaacatttgaagtttatcttagttaataagggtaatctgactcctgattcatttgtctttttatgataacatcctaccaagatattctgagattgccttcaaaagaaaactttgcaaggaaaaaaaaataacttggaggctcacttcccagtatattcaattcagtaataagcactaactgtgtttactaaacaattgcaggccaagattacaaaatcagctcagtcaaaaaaaaaaaaaaaaaaaagcaaatcatgacacactttatggcaagtgtccctttctgttattaattaaatgatgatacaagccaattcatgccacgtctcactattatttkctaaattctgtgctaacagaaccgkcttcagctgaagaaagagaggaatgaagcgccttctgcttctgtttttgttctttataacattttcttctgcatttcccttagtcyggatgayggaaaatgaagaaaatrtgcaactggctcaggtactgtcttaataaatgatatcgatgactattgataaaaagcttattttattgattctcttgggacctaaaaagaaaacacattcctgcaaaagagtcctgaacttttttgtgagaaggaactgcttttcatttgtctatctctgacgatatcaggaaattgtgttggggaggagggctggcacagggagggggaaaggatctgctataacttttagcaatggtcacaaatgaagggatgtttagtgcgaggagaaaggagagagccctgcaaggtatggagatcactataaaagcatttcaagacaaccaggaggacccaatctacaatttggagccctaatccctatatgtatgaaaaaaaatacattgctttacagattccctctaaaaatcagttcagttaactttttatttttggttaaagcaaatacatgtgcaaaatggataatcacttatttatcctagaacttgtttcaaagaaacaccaaaatgaaagtaacagcaaaaatatgtaagataggtcatcattcaacagacagacgaagcttcattctcttctgtggaggtttaagagctgcgtgctttgsctaattctggtcacycataagtcaaccaagtcttggaaattgaaagagcagggtgactcgttattttcctctttgtgtccttcctttcttctttcctccttcactcctcactttctctcattacttcttttttttyccctttcctattgccagaaggaattttaggcaattttgctttatcctgagatggagatttgctctcctgtagtctgtgcctcttttttttttttcttatctttttggtcaggcatatctcaaccagttctactctcttgaaatagaagggaatcatcttgttcaaagcaagaataggagtctcatagatgacaaaattcgggaaatgcaagcattttttggattgacagtgactggaaractggactcaaacacccttgagatcatgaagacacccaggtgtggggtgcctgatgtgggccagtatggctacaccctccctgggtggagaaaatacaacctcacctacaggtaatgcttctgccagcttatttccrcctaatccaaaggaacataaagataatttccaaggaacagaataatattcattcaattgactgagcacttcctgtgtgcacagcacatcwtaggctccatttacggtatcttcccaacaaacctgtgctgtaggctctgctgctaccaccaycttaaatacagagraactgaaacaaaagtttatttaccgtggctgaggttacacagctcttactggctccagcagacatgctctcatctctagcctctgccaccatcatataagctcccaacaaatactgtcatctgactgcagatacttgacagcatgaatgaagggtgcccaagagaaaatggggagaccctggaacacaaccagtttatgtcagagacatgtgtgtgtgagagagagagttgccaaatctcagatgagcccctcagagcaaagtagggtgtttccctcagacatctcaaggaaaagggggcaggctgactcattggcaggaagaggatgaggtatgcctttgatctgagacagagacagtcaccttgaccatcactctacagcctttctgatagttcttctttcatcttactgagtgctaggacttgagataaaaatgaatttagcaagataggcaacataaacgagaaaaawcttttcctgagcaattcttgtggttctcatgtaagattcttaatatatggactgggtgtggtggctcatgcctgtaatcccagcactttgggaggctgaggcagacggatcacctgagttcaggagtttgagaccagcctggcaaacgtggcaaaaccccatctctactaaaaaacacaaaaattagctgggcctggtggcacgcgcctgtagtcccagctactcaggaggctgaggcatgagaatcacttgaacctgggaggcagaggttgcagtgagcygaggtcgcgccactgcactccagcctgggggacagagcgagactctgtctcaaaaaaaaaaaagttcttaatatatggyacatgcacaagactgatttctacaagccattcaaaaaaatgattctcagttctttttaagaatgtctttataatactttcatatacaagccaacacrtacatgagataaatgctgtcttgggatgtgatcttagtraagtcatttaacctctttcagcctcctttgttgaagtgttaatactactgattcatagggaagataaaggaatttaattctatagtatatgtaagagtatttcatttaaataaagtgctaatgcaactgtaagataattgcaccacaccaaagttactgcagcacattattgataagctagaaatgttttttgtarttatgtgtgtatattcatgcatgaataagccagaaattgacatatttttgttaatttttaagaataataaactatactccggatatggcacgagctgctgtggatgaggctatccaagaaggtttagaagtgtggagcaaagtcaytccactaaaattcaccaagatttcaaaggggattgcagacatcatgattgcctttaggactcgaggtaaggttttcaacagagagcaaagctatttttatctcaggagatttgaggaagctgatcttttttcctcgcataaattgtatctcagtccatggtcggtgtcctcgctattttgatggtcccttgggagtkcttggccatgcctttcctcctggtccgggtctgggtggtgacactcattttgatgaggatgaaaactggaccaaggatggagcaggtgagtctaattttctttatgaacaaaatcttrttattctaaagaatccctgaaaagaatagctttgtaactagctgctttttaactvtaaagttcccaatgtccccacaattttccatattccaagatgaccttgatggaagtgttcaatacaccctcataaagtkgctacttctactatgatcagagcagtcttcattatttatacattcattcatrcacccataatgtctgaggggccactgtgtgcccggaactatacaaggtgtcctatggaccccaaagttgtactagaaaagtgtaagccttcagaggttcatgatcctgtgtggtacacaaggccagcccacatacctgccatataaggcagaagatgttttgtgttgtaccagtggcagaagtcatctgttgcttgaggattgaaagaagactctagggaggtggtaattttgagttagcaattaaaggacagtatatggattcatagcccatagaggctctaattcaaagcaygaacttcctcttctaactcttgcccagctgcaaaggaatcagaccttaatccttatatttgacttatttcttcaaaccaagtaagtttattttatttttctcaatgggtctgcctggcattcaaggtgttttactactgttcygacaaaaatatcaaactgtactatattaacaggyagcaatgtaggcctcaaagaaaagagcaagctcaatagatttttgggtcccccattcttttgttctgtcattgsmaatagttaccttgggtctggtgtctagcttccagagtcacaggaaagcacaggttgtagtggtcctgatggatagtatacaaggacacagatcattccygaccatgtatctccagataatcggtctagatcagctttgcactttctgtgaaactaaaagtctgtcacacaaaatggtccatggccactcactgctcagtcagaacaggtgatgcaactgtttttccaagtgccagtgaaaagggcgaaagtcagtactggctgaggttcaggcagcagcaggcaaaatctgggattggctgctgccattgccacatgacttagcatcacaagcagacaagaaattgaaggaggtaagataacattgtcacccaagcaagagaggaaaggaatgaaccatgyctgttgtgtatcttctgctgagacatgtttcaatatttctttggtattagtctgaagacactgcgggtgtgtttcaycaaacagttacaggaaatatcctagcacttgccaaaatcagaatgackccccttgctcagccaggctttactttcatagctagaggcagagatcaaagatttcactatccttttgtctcttaaatccaatgctaagtagcagttmctcttacccatactgctttaagccctctgccaagggggacatgtggggtaagttatttttttttaagtccgatgtatctgggttccacatcggtaaggctcgcttgagcaaggcaagagataaatacagtcctcaaccaagttctgggtgggcaaccaggcagcagttccaaaaaggattgtcttctgaccactttatttcagyccctcagagtagaaattgtgggccctctgtgatccaattgtataactcttagttcactgacattaaaggggaaaataycttcctcttctccaatggaaacataaaatatcaagcaaacgtaatctccaacaaaattgcaatttttaaaaaataggcaattcagcaataacctatatgatcacctctttcattgcaatgtggaggctctgttttatggaagggtggcaaaaatcttggtgtaacttgcttaagagcaacagacacatcatctgccaatgatgctattaagctgcttcctccgggaagaacaggtcatcgcatggggatgtcagaggactttaagcacatacagagattttcctgagagtctctcaaagcaaagccaggtgccaagcctattgtgagtgtgtgtgtggcacacacgtgtgcaccaaacaactgaacaggccttacagactgctacagatgcagtgttgggaaggagaaaaagcaatggtttgtagtttggcagacactggttcctttcagggcttcccattgaccagctgagggacccggggcaagtcaagtaattttcttactctctatttctttgcctgtaaaagagtaatgatgctcttcttttaggagggtgaaataaattacccttaccctaactagrttaataaaggtgaaaacccctttcagagcagttgtccatagtgaacactcagaaagtgcttgacatcaaagattctgttgacaattgttagtattgatgatgataatgataactagggtggaattacattcyaggcataaggaaaaatatttgaaaagctatgaatgtataatgcacaaatttgtctatttagtcacatctccatgagacagagacttttgtcatcttttacctacagcgtcatatggccaataacagtgttgtcacatgagaaatactctacaaatcattggtaaataaagtcactcaatgrtcatktattgaacatccactatgactmaggctctgtcataaaaatgaaatatacccttgtatataggacacagaagctgccctccagggcttcacwgtctaagggacacatagacaattaaatggcaactaaaatcagtaggatcagtactgagatamaggaaactatggcaatgtaataggtcctcacagaagaaagtccaacccagacccacaggtcagcagaggaagctatgtcaagcctgagaactggaggctcagcaggaactaagaagacaaagtagggtgaagagggtgaataggagtgttctgaacagaatagctcaatccaacataaggaatagaattgtagaagacaaggctaaaatggygaataggattcagattacagagggtcttgaaagccagaataaagatctggacttcatttagaaaatctgagcttgaattatttttcccaacagtcatttttccagttccttgtccaaaagcacacacagtgatatagccagccaggcaaggggcagcaacaaaggcaagagcagaaaagtgtcaaagaccatgacataattctttgcccttttacgtttgcttcatgcaaacatcactaggcaaatttccatcagggaagctgaggttttccttaggctccatgcacttagttgcaaagccagggatggactttatgtatgtatgtatgtatktatttatttatttwttgagaccgggtctcactctgtcacccaggctggagtgcagtggtgcgatctcggctcactacaacctatgcctattggactcaagcaattctcctacctcagcctcccrartagcttggactacaggcacaggtcaccttgcctggctaattttttttttctttagtagagacagggtttctccatgttacccaggctgctcttgaactcctgagctcaagatatccacccaccttggtctcccaaagtgctgagattacaagagtgaaccaccacgccaggcccaagagggtggtcttctatacttagagccttacagactagtgggagaggcagacaaagacaaaggcaattctaacatgcctggtaagacttctggaaagggcactatggtcatgtttaggaaacacatctaaccatttttgcattagacaacacttggacatccattaatcattattaagcagtcacaatcactaggaataaaagataattaagacatggttcctgtactcagggtgacagaaacaaacaatgcagtccttacgggctatgacagaatcaagtgctgagtctgtggaagctggagccatgcatttaactcaacctggataagacctggagggataagggaagttacatgaaggaaataactttagaggggagtcctggggaataaataggatagttaagccargagaaagtggaagagatatgttattagcaaagagacaaaggtatgaagacatagagattagaaagaacctgacacagatgaaaaatgccagcgatttaacatagttagcttgcagaatatgaaaataaaatataaggctgaaaataggcagggactagaccatggaaggtcatgtgaakgtgtttggactttatcctatagcaatacagaacctctgaagaatagaagtaggagcaacatgatcacatatactgtagtctagcaacaaccccaaactggtggcttctttttttttttaatattatccatttctgagacaccggtttcaagccattttcttaccctaggctatatttttccatgatgtgactagtaccaattaaagttatgtgccatttaatcatatttkggtcaactatggactatggatatgacagtggtcccattcgattatgatggagctgaaaatttcctatcacctagtgatgtcacagcacaacacattactcacatgtttgtggtgatgttgatataaacaaacttaccgtgctgccagtcatataaaagttcagcacatacaattgtgtgaagtacataatacttgataataagcaaccatgttactggtttatgtatttaatgtactatacctcttatggttattttagaatgtactcctacttgtacaaaaaaaaagaaagaargaaagaataggtaactgtaaaacagcctcaggcaggcccttcaggagggattccagaagaaggcatygttatcctaggagatgacagctccatgcctgttattgcccctgaagactttccagtgggacaagatgtggaggtggaagacagtaatacggatgaccctgatcaaaggaaggaaatatttttgtacagctgtacracaagtttgtgttttaagctaagtcacaataaagtccaaaattttaaaaatttaaaagtttaggccaggtrtggtggctcacacctgtaatcccagcacttcgaaagaccaagccggaggattgctttagccyggagttcaagatcagcctgggcaacatagtgagacccccatctctacaaaaataaataagaaaattagctggacatggtggcatgcwcctgtagtcccagctgcacaggaggctgagggaggaggattgtccaagcctaggagtttgaagctgcagtgagctgtaatcacaccactccagcctgggcaacagagcaagaccctgcctcaaaaaaaaaatttataaagtaaaaaagttacwgtaagcaaaagttaatttattaytgaagaaaaatatttttaatttggtgtagcttaagtgtctagtgtttatayagtctacataatgtactgtaagtcctaggccttcacattcactcaccactcactcactgactcacccagagcaayttccagtcctgcaagctccattcatggtaagtgtcctacatagmtgtactattttttatcttttataccatatttttactgtaccttctccatgttcagatatgtttagatagacaaatgcttaccattgcgctaaataattgcttaccattgtgctacaattrcctataatattcagtacagtaacgtgcaatacaggtttgtagcctgggagcaagaggctataccatgtaaccttggtgtgtagtgggctgtgccatctaggtttgtgtaagtgcaccctataatgtttgctcaatgatgcatttctcagaacatatccatatcattaagcaacacatgacttattagcattgcaatacctcccagataaatggtggtacatatgagaattatctgctgtatagcaagcctttatttcattccccttagttactttctaatctcasatgcagccattctctttttgattaagtcatgtgctcgtgttttccctgttattatcaaggattcaacttgtttcttgtggctgctcatgaatttggtcatgcactggggctctctcactccaatgatcaaacagccttgatgttcccaaattatgtctccctggatcccagaaaatacccactttctcaggatgatatcaatggaatccagtccatctatggtgagcaaaattataaatctcaatatatgtgaactaaataggaagcttttcagaaaggaagttaagaaaatcacttcttgaaatattatcatgaagcaaatatccacttaggtaagacccttgtgtaggcatatttcttcatgccctcttaattcattgtggtattttttttctcatcaaaggaggtctgcctaaggwacctgctaagccaaaggaacccactataccccatgcctgtgaccctgacytgacttttgacgctatcacaactttccgcagagaagtaatgttctttaaaggcaggtaaactcatttmtctaaacacctcaacttcctatgaagatttttcttttcaagagatttgaggataaagaggtagtcatggggctagtgaaaatgtgtgccttttatcttcattttataactgcctatactgtttgaatgctttaccatatgtgtgtmtcttgtagttgtttgataaatttttaaatgtctttaaggaattttaaaaattgccattgcataagaaagggaaatagagtccactttcagtgactttttggccagaagagtccaccaatcccagtggcctactgaagccaacttacactccgttacaggagtctattgttaaattttcaggaattttgcaaaccagttcacatcacataggcagcttgaaattggccatggttggagtatttacatctgaaaatcagcaaatgattaaagtcatgtcttcttcccacctggagagccagttgttaaacatgggtcagcacctcactgaacgtttcttaaagttgcatcaataaagtgttagctgtagtgggaaatcccttctctcactacaatttattgaacttaagttacagcatggtgtgtcagttatgtagaccatgaccatatttttatagcaaaataccaagacatacaccattgacaaagatataggggcaaaaggaaagaatatttgaaattggactcctttcwcccatgaatatatcgygttacaatcacatgttatcaccaccattctctgaccagcagaggccaagagctacccaccatgaatgtcacagaggagtggcctgtatgtggagggaaatggaatataaggacttttcacgtctcattcatagactcagaattttgcagccagaagggaaattctgaagaagtattttcgcatgtcagtgattacatttctttattccagcaagcatctgcttcaaaaagttcctcttaggaatgcttggtgttggcttagaatgttgggtgttgctgctttggcaaaaacaaaaccattgagcactcagaactcagaataagatttccatgatgagtttgccactctacggatccaagagtgggcacaaaggcatgtcctggacttggaagtcccaaactgaactgaactcacaatcacctaaatttactggggaaaattatgctaattatctcaattatttgaggaagataccaaccaattagctaaaaggcaagcytaagattacaaaattctcattgacatggaaataggctgcawgtgtaaagtgttttttgtttaacacaggcacctatkgaggatctattatgatatcacggatgttgagtttgaattaattgcttcattctggccatctctgccagctgatctgcaagctgcataygagaaccccagagataagattctggtttttaaaggtaacctggcccatcccgattcctcttctccctctggctgcctgaactaaccagtggatattttggtgtaagaaataaaatcttcatgcatgagccaaggcgcagggcttttgctctcatcttaggttcctgtcgtaaagaatataaataaccaggattctctgtggctgtgaagataaacacaatcctagttgcacagggactaaaataaacctgtgtgataaaaactaaaaaagtctctttttctgccaaataaaggtaattaatctgtctttaatgttcactttttactaaggttgccagatttggcaaataaaaatataggacactataaatttcagataaacaacaaataattttttggtatatatatatatcccttaaaatattttgtatttatttataccaaaagttagtcattstttacttgaaatcaaatttaactgacattttctgtttaatgatcatgatcttatcagattactagcctttgagagcacttgggggctgaaacttaggagaacatgtccaaacatacttcattttaaaaatttcaattgacataataattgtacatatttatggggtacaatgtgatgtttaaatacatatatgcattgcttacttgattgttttgacagagttagccaattaaaagcaatcaatgcaatgaaaccaattgacaaaggtacgcatactattgacttttacaggtatatattatttgtgtaatataaataatatgagcagctaaagaaagtggtaggaatgaatgtggacataagattattaaatctctaagcactgaagctaaaaggaactaggtatctaatgatttttaaatttcttgasatacctatttctcyctctagaaaataaataatcactcctctyttcctagatgaaaacttctggatgatcagaggatatgctgtcttgccagattatcccaaatccatccatacattaggttttccaggacgtgtgaagaaaatagatgcagccgtctgtgataagaccacaagaaaaacctacttctttgtgggcatttggtgctggaggtaagtttacagacaattgacactttgttttattatggagaaaaatattcacaatagcatmactttgacacagacaaaattaaaatgaatccataatattttttatttttttattttttttgagatggagtcttgctctgtctcccaggctagagtgtagtgctgcaatctctgctcactgcagcctcgacctcctgctttcaagagatcctcctgtctcagcaacccccaagtaactgatactacagkcatgtgccaccacgcctggctaatttttgtactttttgtagagatggagtttcaccatgattctcagtctggtctcgaactcctgggctcaagcgatccacccacctcggcctctcaaagtrctgggattacaggcatgagtcgccacgcccagcccatagtcttcttaaagtgaataatgaaggcagtggatgacatttatcaagccgaaagagatctcaatgagtctaatgactttccttcaatttaaaaaaaaagataagataaartaaaaagttggtgatcccaaccaaattgccaatgacacaaacatatctagtgaaaaattttgaaagctccaagctcagccttcaatctgatrtaacgatttctctgaatagcatcaatctaacatatgttgtgccctttttccctgatcatttcttgtttggaagattctataaatgattcaaccaaacataatctttactgtatttttattattgatccaattagttttcctctactatgcctatgtattccccacatccctgcttgactctaagttgtgcggtagacaaattaagctccccaaaccaaagatccgctggtatcctttcatattcttgtatgcaggtttgatgaaatgacccaaaccatggacaaaggrttcccgcagagagtggtaaaacactttcctggaatcagtatccgtgttgatgctgctttccagtacaaaggtaagcatggatgtctcacttattgggatacttgagagactgtgttgactrtgaaaaaagacagcacaaaaacttaaatgcttttattttaatgyaattttgctaytcttaagtatatacaataataaacattaaccccacaaacattatcacaaactgaatccataaatcctgaattatactctctgttatactatctcaaatctatgtaaaaagtaccaaatccattttactcatcattgataagtaaagacaccccctaaagtgtgcgaagtgactaagcacatgaacaaaacaatgattctcaaactttaatgtatgtaccttaatgtacatagcttggggtttgtgtgtgaaacaaagtatttkaggcagaattgtgagtgatacctaagaatctgcagttttaaaagaacctcaggcaatgtaatgaatacaatccagcaactatatcatccaagacaatgacctagaccatggggtaatctagaaatatctttgagtgacatgatctattattacaatgaaatctaacacagaacctcaaaacctaaaacagatcaaagtagaacggctctaagaaaatgagaatatagagaccaaggccatatccacaggggccttttcctccccctcactgagacactttgttgaagcctagtttgaaaacctctggcatagaccacagtctggctagaaaggtaaaaagtcccttgaaactcaccctttataacactggcttcctccttagggaaataaaaataataggatttcccacatgacagtagaaaactaaaatgtatgtatgtgattccacaaatttcttcgttctccataatrytatttttttccatgtttataaaatttaaaagtatggaagtattatatagttatgaaagataactaatcctgattccctgtctctaggattcttctttttcagccgtggatcaaagcaatttgaatacracattaagacaaagaatattacccgaatcatgagaactaatacttggtttcaatgcaaagaaccaaagaactcctsatttggttttgatrtcaacaaggaaaaagcacattcaggaggcataaagatattgtatcataagagtttaagcttgtttatttttggtattgttcatttgctgaaaaacacttctatttatcaataaattcatagacctaaaataaacctcaacaggtcttttaatataaattctgcttcaaaatagaataaaaccattctttaacaacaagttgctggtcctagttctaaatatccaaattcaatggccattttgagctgcctgattcttttaataggaagttattatgtagaaacaaaaatctctgactgtactttaagcctatttcatgctttgtggacttggagaagacatgtcttataactgaatactgaaacatttattaaaccaatctttagcattctattttgtctggacctttggagtttaagagccccaataaactacagtgctcatccctatgcatgttctgaacccatcaatcaagtaagttactccacctcccaaagagaagggtgacagcctggatagatgcagggtgagttacrttagaggttattctctgacaagtaaggaactagcagaagtaggagagaagtgttcccccagcctcacaaacattgaccaamgccgttaaacattycttarggaatataaaattaagttttctgcacactgatttcagacacaagaaatgtgaggattttcatcctgtgtttgtggtatatgtgcatcatctgagcctatgggtagaaagtttctgtactctttgttccatcatggatttgttgactttctaaatgcttatggcttgattttatcattataccctcaaagttaagtgcttagcaaagctcttaacaaaatttttgacccagaaaatgggagattatcagtggaacttgcttctgatgaggtgatatattgggcattaygtcaactgatagaaaataggcatagaaaatcacacaaattcctacagttggtccccacccccacttccctggagttcagtgttcccagttgcctaaaagaagaggtgcataaaagagttattctatgtttgaaacacaaagtaaattttaagaagtacagcttaacactcagcaggtagtagttagtagtctttgtgaaaaaaatatatagtgctggaataatcaaatatccatatgcatgaaaaaagaatgttgacccctacctcacactattcacaaaaattaataaaaatgtgccatagacctctaaatataagaaataaaattataaaacttgcaaaaaatattttttaaaaaaattttgggactttggactaagcaaagatttcttaggtagaacataaaaactattaaccattaaaaaatsaatgaattaaactttaacatttaaaacctttgctttcaaaaaacaatattgaaagaataaaaagttggctgggcacagtggctcctgcctgtaatcccagcactttgggaggcyaagacaggaagattgcgtgaggccagaagttcaagactagcccagccaacatagcaagaccctatttctatataaaacatataattaaataaaattttttttccaggygtggtggctcacacctgtaatcccagcactttgggaagctgaggtgggcggatcatgaggtcaggagattgcgaccatcctggctaacatggtgaaaccctgtgtctactaaaaatacgaaaattaactgggcttggtggtgcgcgcctgcagtcccagtactcggggggctgaggcaggagaatcgcttgaaccagggaggtggaggttgcagtgagccaagatcgcgtaactgcattccagcctcatgacagagtgagactccatctcaaaaacaaaacaaaacaaaacaaaacaaaacaaaacaaaaaactgctgggctgggcgcagtggctcatgcctgtaatcctagcactttgggaagccaaggcaggtggatcacaaggtcaggagttcaagaccagcctggccaagatggtgaaaccctgtctctactaaaaatgcaaaaaataattagccaggtgtggtggcaggtgcctgtaatcccaactactcgggaggctgaggcaggagaatcgcttgaacccagggggcagaggttgcagtcagctgagatcacgccactgcactccagcctgggcaacagagtgagactccgcctcaaaaagaaaaataaaaatttaaaaggatgaaaagtccagctatacactggggaaaaaatattttcaaaacatatatctgataaaggacttgtatcttaaatatataaagaattcttataactcatagataagacaaacagctcattttttttttttttttttgagacagggtctcactctgttgccaaggctggaatgcagtggtgcagtctcagctcactgcaacatctgcctccgggtctccagcaattctcccacctcagcctcccaagtagctgggattacaggcacacaccaccatgccaggttagtttttgtattttttacagagatggcatttcaccgtgttgcccaggctgggaactcctgggctcaagtgatccgcccacctcagcctccaaagtgctggggttacaagcatgagccaccgcccctgccatcccctyatttttttaaaaamattaatgaatgtttatattttaaattatttatttatttatttttagaaagagtcttattctgttrcccaggctggaatgcagtggtgcgatcttggctcactgcaaccttcgcctcccaggttcaagagattctgccatctcagcctccccagtagctgggattataggcgcccaccaccgctcccagctaatttttgtatttttagtagagacggggtttcaccatgttggccaggctggtctcaaactcctgatctcaagtgatctgtctgccttggcctcccaaagtgctgggattacaggcatgagccaccgtgcccggccttatttatttattttgagacacagtctcactctgcctcccaggctggagtgcagtggtgccatctctgctcaccgcaacctccacctcccaggttcaagtgattcttgtgcctcagcctcttgagtagctggaattacaggtgtacaccaccacrcctaatttttgtattttcagtggagacgaggttttgccatgttggccaggctggtctcgaattcctgacctcaagtgatccactcatctaggcctcccaaagtgctgggactacaggcatgagccactgcacacaacctcagttttttttaatgcccaaaatattcaccatatgagtagtaaattagtacatgaaaagatttttctttttttttttkggagatggagtctctctccgttgcccaggctggaatgcagtggcgcgatctcagctcactgcaacctckgcctcctgggttcaagcaattctcctgtctcagcctcccgagtagctgagactacaggtgcacgccaccacacccagctaattttkgtatttttagtagagacggggtttcaccatgttggtcaagatggtctcratctcttgacctcgtgatctgcccacctcggcctcccaaagtgcttggattacaggtgtgagccaccacacccagcaagatttttcaatatcattagtcattaggtaagtgctaaaccacaaggagatactactgaatacccagtaaaatggtgaacattcaatggagaaagaaacatgctctgataacatattcttaatgtttgctttcaaaggtgtgttgctgtgaaactctgccattcactgaaataaagagtttatgatgcattttaaaataaataaatacataaataagatggttaatatttaaaagctggccaggtgtggttgctcatgcctgtaatcccagcactttgggaggccgaggtgggtggattgcttgaggccaggagttggagaccaacctgagcaacatggtgaaaccccatgtctactaaaaccacaaaaaattagccaggcgtggtggcatgcacctgtaatcccagctacttggaaggctggggcagaagaatctcttgaacccgggaggyggatgttgcagtgagccgagatcatgccactggaatgttaacaagggaaagagagaaagaaagctctctgccacagaaagggttcccaaaaaagggtttccatttcacagttgaayacagagacttttataaggaaccactgagtgttgggtgtctcatttgcataaggagcaaatttctggtcgctccacccagtcctcctagtgtgcatgcaggcccttagcttgagttactccatattgtctttgtttcccttaccgtgcatgtgtcaggggatagcattttccattgcagataagtctgggtaagtctcctgtgtagactttcttatgtatgcagctgtgggcatatcttaggcaagcccccctgtgaaagttcccttatcagtgcttgcatgccgttcttttgtttgaaagaaatcaatggagcatccaccctaactgcctgcctgactggtttcttccttcctcactcagtttggcaatttattataaaattaaacccacacttctcctgtgacccaatgatcctactctaaatgtttacccaagaagaatgaaaacctgcccaaataagtatttgcacataaatgttcatgaaagttttatttatgatagctaaaatctagaaacaacccaaatatctatcagttgatgaatagacaaactggaatgtccatactcaacaacaaaaaggaagaaatgactgacacatgaaacaatatggatgaatcccaaaagcaatatgkaaagtgaatgaaaccagatacaaaagacttcatgatatatgattccatttatatgaaaaattagaggagacaaaactatagtaacagaaagcaggtcactgattgccaaaggtgggaagtgggaggagggattgactacaaaggatcatgagtaaactttctggggtgatagaaatgttctatatcatgattgttgcagtggtgacactagtgtatatatatataggctgtgcaaataaaattagtgaattgtatatgtttactctacttcgataaagtggattttaaaaagtagtatgacttactacttaacatgtagtagattctcaaatgttggtcaagtttgttttctttccttgtccctattcttgttctgtagcacaaatacgtgtgatattacagttaggagagcaccagaaattgcactcatttttgcttatgggcagttactttttcctggatatatattcttaaaaatygacctgtaggagaggacaagattcaactataaaaataatyctatttcaaattcagtggaaaatctaaaaacacagttttcaaagcatatatgttgaatattagaattatattaaagatttataactcaaaaagtaggtgatatcactcatcctttaagatttaaataaacttgayttccaaaatccaaaatcttatggagtttctaatgctccccatcaaacaattagagggaaaaatcttattaatatcctttggcaaacccacctccaaaatcgtctccccacagtgacctccccacagatgccaaccttctgctcttctgtctgacccctcccttctttgacctctgggaggaacccaagttcctgtttctttatctttctttttaaatgtaaactagttatgtaaacctgtttattgtctcatttaaacatgtcattatggcctcccattccttggaaaaacagcttatcaaggtatcttttctcctagaaaagagctttaaaataagatattttgatttccatctgctagcttggaggctgggtaagagtatgagctttcaacccagattagttaggctcattgagcacttcctctatttattcaccatggaacctggggaaagttccttctctgtgctacaatttctccatttgttaaatgaggatgctaacagatccaagctgtagcctgaacaattggcaactggtcacatgcgtcacttacaataagtacttgatgtagttaatgcgcagtaaatgtgagccatcattattataattagatatrctaagcaatttattctaaagtaaaaacaattgggaaaactaaaaattaagctcagagtttctcaaaattggaaaaaaatatgggccaattctttctgtcctatatcatacacttacagaaacagactagctggaacaacaaacataattgacacttggcttgtcccttctggttttcttaagggcctgcgrttacgtctcaaaagaaagaaacagctttaaaaacaagcatgaacaagacagtgctggcaatagttattcattttggagatttgaacagctgaggtggaaaagaaatgaattcacacag

SEQ ID NO: 13220 - DNA, 28037 bp, Homo sapiens
aacgagacaaacaggtcctccttaggtgtaagttcatggccttggccccacccctgaaactcagccatctgagacagttttaggcctgaggcaaccccagactttgggttgttgtttgctgggcacagcctccttttgccaatgttgcaatcctttgtaagagaccacaggttgatcacccgttcctgttactgagcacagagaggtttgtaggccagtctctccaggaattctgacgcactgcaaaatcccatggtctgaatgcttctaccttccctgtgaaagcccctggcctcagaaaaggaagctggtttaagtgaccaacatttggggyggagcttccgagggcccagccaccgtgttacatgcaacamtcaacagagatattctttggctagagttgtttttctgggtataggaccctataattaaaatcagctctccaacttcccttcctccaaaaagtatacaatgtaaggaggaaaatgcaaattgaaaagttgctagyccttcccgccagaatgccaccycaagcctcccctgcaggaagttctggagtccccaactctgccccaagcctgaggcccttgataaggtaaagggatgtgagtgtggaggccggagcccccctcgccctgtaggctgctccccttgcttttccctttgaatgttacagtttagttctgtgacttacttataattgcctgaattccccgcccacgctttctcttactttggggcttctcaccgttcctcttcctccatcttcctcctctgaccccactcccaagcctgaatggggtgttcctcttccgtgctcccacaaaaccctgtgcctctttcatcgttgcatatattatgctgtaatgtagttttctggaggtgtgaagactatgaatcctatgaagacaaatacacacctaccttgctgaccgttgtatcctcagaatctaatactgcacttggcacacagtggttgggagtaaatattcatgaggcaaacacacaggaaggactcttttgttatggttgtttgttgttgttgcaagtaacataaccccaccttgatctagctgactgacggctctaccaccttgtcttttgcagcacaagaggaataggaactgcacctcttccttcagtttcagcttgaataatatcaggaagattcgtatcggtctgagttgggtcacgtacccgacgtgctatagctgaggatggggtaagctgattggagtttgcaacactgttcacatagccaagatatggaaagaacctaaatgtcaactggtggatgaatggataaagaaattgtggtatatacatacactggaatattattcaaccttaaaaagaaggaaatcctaacatttgtgacaacrtggatggacctggagggaattatgctgagtgaaataagacagacacaaaaagacatttcttgcaggagctcacttatatgtggaatctaaaatagtcaagcttaaagaagagagtagactactggttgtcaggagcaggagaaaagtggaaatgaagaggtgatagttaaagggtacaaagtttcagttatacaagataaataagttctggaggtttactattaatatatcacatagtacctataagtaacaatactgtattgtatacttaaaattgctaagagggtatatcttatatgttcttaccaataataataataatggtaataattaaggggcaggaggacacttcaaaaggtgatggatatgttwwtggccttgatggtggtgatggtttcatgagagtatacttatccccaaactaattgagatgtaaatattaaatatgtacagctttttgtatgtcaatcgtacctcagtaaagtagtttaaaaatggttggactgagaaaaggaggagctgctcagcaacatgaggctgggtgctgggcagacaaaacctcacacatgcattactgaacccacggactcatgtctgtgagctttgtggctgtggatgcaccatgccaatgtagtcaaggattcttcaatgtgtaccttactggattagttccctctgtttatttgtattgactcctcagttcccttatgggttgcttgttggctcttgtggaattatttaagtaaggctttggttgcaggagtcagacatgcttaagctggttttggctgtaatggggaatttgtgagatgtgacacagtgacaggaagtgcagccagacgttgtgagaggcagtaactgggaataggaaagttatgagaagttaaggcagtagtaattgtttctctatcgaaggccataatgttatcattcctgcctctatctgtttgcttgttcttctctctcagcagaatggtcttctctgcttctctgtgcacctgcagaaggtgaccaccctaaggcttatggattcaggagtcctcagtttgagagcagttaccaaatgcctcgcccctgtgaactctagtcccagtttcttattcctggtactggcttagtttgaggcagctgcccaccgtaagtccagtgagccatggcctggggacaaggtcaggtacatgtgtaatcagctgggtctrtgagttgtggtggtggcgatggaggtagctcccagaaaaatggattacaggttaagaagagtctatatatcttgaccacatttgatgtgacttggaagtttcaatgtgtgaccacttacaaagttakgatcaggtgtctcatttatttatggtgatgtatgagtccgtgtgtgagtgtgtgtgtgtctgtgtttgtgtgtgtgtgtgagagagagagagagaatgagaatatgagtggtggtttcccatttatttttctatgggccaaatcctgggctatgagctggagatataagagtaaacaaaatagacacggtgcttgctgtgacctgccctgggagacagatattacacggaggatcacataaatgcagagtctgagctgaggtcttaagggtgaggataagtaactagtcagtggagcaggggagggaagggtgttccatgcctgtgtcaaggtcctgaggtgagagaaagaggtgaatttgaggaaccaaaaggagttcagggaacaagaggggctgtttcacaagctgagtctggaagctgagcaggctgagcagattcttaggaactctgcaaaaacttaagggcttgtctatgaccgtaaacaactacggtcgtagataaacaagttggcaaacaactcaaggatttacagtcatcagaattgtaaaactgatcccatgtattttcaaacctcaaatcccttgctctgaccttgtgtgtctaagctagaaggaagcaggatssacctctcccctggctggaatgaagggattcacccaagctctcagtcttctcacggcatccagggcccccctgcttgtgtgtggtctagatttccattcccatagtaggaattcctttgggagccttggggtctctcctgctagagggcttcacctgtgactgtctcaattcaagggaggggttctaataacattaaacctcaatatcttgctcytccattcctgatgcctccctttccttctacccttcccctacctccttctttcctatgccacaggctggcaggttagtgccagagcaagtggccagtcaccatcattggggttgtggatcctcagggttcttcagaasscccttcaccatgatcaagagtctccagtcactcagaattccacggttcccaaatgccagctctcccactactcccagcgttctccatctctgggatgttgggctccaggcttctcagatgcactgagtaccctaggctaagccactgatccatcagaacttcatagcctgagaggagagggagacaggcttgcaaaggagagttctgactagacactggggtgctacagatgcccgtaagttgtccctttaccctcgatgtccccagtgttgggaccacctgggaatgcccagccttgtgtgctgattgacttgtagtcccctggccctgactggaagcctagttttctctctcatgaccagctaggcccctagctccccagggaagaaatccaatctatttcctctgatagtaatggctaatacttaaataatgccaaccayatgccaagcactttacagttgttagcccagtcttcacaagcaccttgtgaggtgggcaagagtcttatcttactctcattttatagatgtggcccaggatcccacagctatagttcatggtgctgggatttgaacctctggccaccagagcccaccttaatgtgtcctcctcctgttgtcataacagaaaagtacaacaccatgatgacacatcaggctatcctggcaggttcccaggctgccccaatgcccaactttctaggtttacaaarttgacatttacgaagtttccaggtttacaaatctagtttctgattctttagtcagcaggaatttctctacaaaagctgcttcgaaaatttccagccaaaccttacayaccttggcattacatcttggtgagccaaggyggaagagaacaggaagtgaaggccccatgggaagtccctgcggtcsggagcacccaggcggggcggsgggtggggggctttcctgtggccggctccctgcccctcccaccccmattcaggccctgtgagttgaatgaagagaccctgggaatgagtccaggtctgcarggttagaggaaattgaaggcccttaccagatccctgttgagaagtttatgaattatgagcccttctgcaaatgagagggttcttccctgtcaggagggacagattgtaggtggcaagattggtggcagccagtaggctggtctgctccttcctctctatttcatatgtgtatgaaggcattacctgcagcaagggcctgtgtaaatgcatgtgatttacagagcattttatgtactgcgtgtcattcatgcttccggtgagccctaagtctaagatagggcagatagcaycaggtccattttgcagctgtcaaaatgaggtctgaagggcagaartggtgtgcccacacacacacaactggttggctgcagacctggggactagacccgggacttcgtcctgcccaggggtctcttgccactgctccccatcaacttggatggctttaagcatttgtgagttgtytgctccctgatggcagaatgcagagacatgaagctacaagcaggttcgctmycaacggcaaaaaggaggaggggtgttcagaacatcaggtgcttctagagaaagcagggagagagtatctggccttgtggacaatgtcacggcagaggycaggtatagggcatgggggtaactggaagcgggatggaccctgttattccctaagacatggcttccacgtagtgctcaaacaaggcctttgcccttgctgttccctccacctggaatattcttccccttccttgacattgctcaggtctccactcttatgtcaccctctcagagasggcttccctggccactttccctaaaatagccacccactcctaggtccctcaaaagcatatcctgctttggattttccctatagcaatatgccctatgaagttattttatttgytaacttgtttcttgtctgttttcctttgttagagcgttggggaccttgtctggcttgttcccaatgcctggaagagtgcctggcacacaggattaagccaacacatatgttttgaatgaatgtgtgcacacatgcmtgagctggcggcagtcggggttggggtaagcacgaaggcccagctcagttctctgcatgtgacctcccatcttacgcagataagaaccagtttggtttctgctagcctgagtcaccctcctggaaactgggcctgcttggcatcaagtcagccatcagccggcccatctcctcatgctggccaaccctctgtgagtgtgtgggaggggagrctgggctcctccttgtactctctgaggtgctctggaaggaggggcagctccaccctgggagggactgtggcccaggtactrcccgggtgctactttatgggcagcagctcagttgagttagagtctggaagacctcrgaagacctcctgtcctatsaggccctccccatggctttaggtaagctccttccactctcatttttycacctgagaaatgagagaggaaaatgtctacaattggtgtttatcaaatgctttcaggctctggtgagcaagcgtccaggaaaatgtcaagcgcatggagctccaggcctgtctgggggatstgggcacggggaggcatccrtgggagaccatgcaggcactctgaggcaggggctgcaagcctagtgcctgctggggcagcaggtgaacagagaggtgtaactgctgtgacagaagtcatggagtccttggagtgtgagrgtcattttccactgttgatagaatagggaaattggtgaaatagccctsttaaatgagagaaagaacagtgtgagctcaatgagaaatactaatagaatgtggcactgagccacaaggtctgagggttgattgataaggaagggwggggactgtggagaattaagggcttggcacwggtcagttccascagttgtcacaagagaatgcaggctcaggtggccagaacttctcgcttttccagaagagtccgatattctgatttcattatrtatagtattctgattaaacmagacaataaagcaagcagataaaatatttaaaktataagctgccagtttgcaacctccggttaggatttgtgtggggcaaagaaaaaaactctcaggatcattggtatgtagactctaattttaagtttctaatttaaaattggcccctgaggctgggcgtggtggctcacacctgtaatcccagcattttgggaggccaaggtgggtggatctcttgaggtcaagagttcaaggcctgcctggycaacatggtgaaaccctgtctctattaaaaatacaaaaattagctgggcatggtggtgcatgyctgcaatctyagctacttgggtagctaaggcaggagaattgctggaacccrggaggtagaggttgcagtgaatggagatcacaccactgcactccagtctgggcaatagagagagacgctctctctaaaaaaaaatatgtaaagataaataaaatgaaataaaataggcctctaatgagcaggccattctcctttctgggtcttactttccttrcactcctttctgggtgttaagargaggtctagaggaagctggacaactcttagcttgtagtaagcacagtggaagtrtcagctcttaatgggtcatggacacgttacaagctaggmgcckygctgagcactttacatggtttatcccactgaaccctctcaataaccctatgaggaagggctattattgctcacattttcagaagaggaaatggatatagagagattagataatttgcccatggccagacagctagtataagaggaggaggtggattgactgcagacattctgtcttcaaaccactacactatgctrtggrggcacagagacttaatgaaatcatggagaggggaattgctttgtcaaccacaagcagttattccgggggcagcagatcctcccctgtcccccagtgggtacaatggtccctggtgggttgtgctacaatgttagcccatggtcttatgtgtttttcaaatgtgtaaagtaggatgctggaaccactcttagaaccagataccratacattgtgaagaaataaatctctgtgcttaaaactggttcatcccaaaatattttgaactgacacacaataggtgctaaataaatgtgtgttaacttgaattggattgaattcgggaaaaaagtgcaataagcttagtgaagacaccatgttccctgggtagaggaaccacattctccatctaakgccaggagtatgggaggtatcaatgtttgcccagcacagaacagggtgccaagaagagaaaagttgacggggtgcatactckgactggaaactggaagggtgagaacagagggtaaaggatagasatggaamcatgtgcatacactttgtgttaccttggacaagtcattcatttctctggacctctgctttctctctacacaatggggtcccaccacttcccttacagctgacttgtatgaagaaggaggtggaggaggaggagaaggtgaagacaatgctgactcaaagggtaaattmtttttaggatccaagtttgaaaacaattttaggctactagatatgaacaacatcttgattatgtagttgaaggaaattaaagatgaatggtttaattaaaaattaatcagaatgaaaacgattgattactaatatatctgcaatggtttattttcctgagtggcagactcactaaggtttttgaatactcctgtgtgattgctctatgtatgtatgtatgtatgtatgtatgcatgtatctatctatctgttgtctaataaaatggatcacatctctgctaataaaaacactacactggcagggtacaattataatcattaactgtgcctggaatttgcagcagcagccaccagaggtaccagtgccctttaagggttcataatttagaataatccaattatctgagtttttcagggactgaggggtttggcaaggtgtagaactttcagtaataaagtcaagaaagtcctggacaaaccaaggtagttggtcactctagtccataaccaggtaaagagctttccctgtaacctgtgtaaggttttagaatcatttctttccttattaccaaaaatcctccccaaattttcaagaaattatgaactaaatagttactctatgagataggagttcagcccaaaagaaacaccataagaacaaatataattcttgcttatgttaaccatgcaatgaagcagagagaaaaagtcagtggcctctttaggaggactgtagtgtgggaagaaataactaaactgggtttcaatcctggcctggccaggatctggagcaagtgagttaatctttctaagccttgagtagtttcttcttcttcttcttcttcttcctcccccttctcctcttcttcttcctcctccttctcctcttcttcytcttcttcttcttcytcytcttcttcttcytcctcctcctcctcctcytcttcttcttcytcttcctcttcctcttcctcttcttcctcttcctcttattcttctrcgtcgtcttcgtcttctttttattttcaaagtgaaagcaagtttattaagaaagtaaaggaataaaagaatggccactccatagacagagtagcctgaaccttgagttcttctataaagtcactatgaatttatactcattttgaaagtgggtgtcaatatgtctgtccactttgcacagctgttatgtggacaaaaggagatctgtgtgaaagtgtaacacagagcctaaactataacaggtaagcaacacagttgtccccttccccatggtgtctgttcttctccatttcctcctgtctgcagggggattataaaactaatcatcaaagccaagaaggcaagagcaagcatgtaccgctgaaaacacaagataactgcataagtaatgactttcagtgcagattcatagctaacccataaactgctggggcaaaaatcatcttggaaggctctgaacctcaraaaggattcacagtaagttaaccatgtagatctgagaggagagtagcttcttgtagataacagttggattatataccatgtcctgatccccttcatcatccaggagagcagagrtggtcaccctgatagcagcaagcctgggggctgcagcttggtgggtagaggtactcaggggtacagatgtctccaaacctgtcctgctgccttagggagcttctaataagttgatggatttggttaaaattaacttggctacttggcaggactgggtcagtgaggaccaacaaaaagaagacatcagattataccctgggggtttgtatttcttgtgtttctttctcttctttgtactaaaatatttacccatgactgggaaagagcaactggagtctttgtagcattatcttagcaaaaatttacaaagtttggaaaacaatattgcccatattgtgtggtgtgtcctgtgacactcaggattcaagtgttggccgaagccactaaatgtgagatgaagccattacaaggcagtgtgcacatctgtccacccaarctggatgccaacatttcacaaatagtgcttgcgtgacacaaatgcagttccaggaggcccaaatgaaaatgtttgtactgaaatttgttaaagcttcccgacaaactagatttatcagtaaggattgttttctgcaagggggatgaaacttgtggggtgagccatttgggctgaggaggagggaggttggagctgagaaatgtggagacaatttccctttagaaggactgaatctccctgcctctctggggtgcggcagccagcaggatccaatggtgtatatrtctccccagctccccattcagtgatatcatgkcagtagcttgaaattatccrtggtgggagtattatgtcatggaaattggcaaatggaaacttttattggagattcaattgttaaacttttaccagcacaacactgccctgccttcagagtcaatgaccctatccaagtttaatccatctgtccactgtctccaacacgatctttataaaacwcwcctgacaacattacccttttattcagttttttwaaagataagtttccagctcatcgggstggctttaaaggccatttctcctctggacctcacccaacttttcaaatcacttttcctacccctacctctaaatgctactcaaactccagccatcctgaataataagacttttgaaaagtagattatgggctgggcacagtggctcacacctgtaatcccagcactttgggaggccaagatgggtggatcacctgaggtcrggagttcgagaccagcctgactaacatagtgaaaccctgtctctactaaaaatacaaaattagttgggggtggtggcacaagcctgtaatcccagctactcaggaggttgaggcaggggaattgcttgaacctgggaggcggaggttgcggtgagcctagattgctccactgcactccagcctgggcaacaagagcgaaactccatctcaaaaaaataaataaataaataaagtagattacatcagatacctctggcctaggttgtttatgaccaactctcctgctgagaataactagaaaagctagacaaaacatatttccaaaagatctctttggaggcatcagagaatggccaaggctgtaaggaactgcctgagcccagagaggtggagcccagcactggtgccctttactcctggggacatgtgctggtttcaaaaacttcagctgagyttttgagcattcatggaacttggtgggggagatgaaatttgtaccttaaatcctgcctacagggagggtccctgataatccccacccaatttggaaatctggktcagccttcacaggtactgaagccctcctctgaatgatctcaagtcctrctagggtagaggttacctgcttttgaaaggctcctggcctacctgtgcagcaggagcaaaagtgaaccatctcagggtacagataacaatcatccagagccttgaatgacctctactgtgcttaatatatagtattcagcagtcagtaaaaaggatttaggcacatgcaagatgacctgtgtatcagggagaaataggcaataaattgagatccagcagggatttgaatcatggatttgaatcaggggcagccttygaaagaactrtggagaatatactcagatttaaaacataagattggaatttttggcagagaactaacaactgtacaaaaaaggaaccaaatggaaatcctagaactgaaagatgcaattaaccgatgttgagaaatagccaacatctattgaacacttcccatgtggacagctgtgctaaacactttacaggcatcaacataagatgtgtccccttacagcagtgcagtgtccctcctaagacatggwcagcctggtttccctatctctctgcttcatcaaaacccctttacgtggggcttagacactcctgttgtctctagtgtctagtagcacagggctcagcacatggaagccactagatacaatttgatgaccaggacctccgatgaaagccatgggtgctgattgggaaggcattgtcttttatgtgctatggtcttaaagcttcatccaggaagcagaactcggggggtgctgaggacccagaaccgagaataagattagtcagagatttcctgtgggcagaaatcataaggacgccaactgtttgggtgagataagacgaaaccaagagtggacttgtggccagaagcgtgaggaagaggragagagcttcccttgtcccctttcttcctctccctaagccacagtgattgacagcccccccsctttggagtcagagcaggcttgagactggactgggaaaggagggtgggtcaggatacagagcaggaaggctgggagtgcagggcaggagcaaggggctggggcattcattgtgcctgatctctcccactttacctggggtaaagaagcatatgcaaaagccacggtgtgagtatttcccaagtgccagggtcagggcatgattcatcacgtgcagcatttcattcaatccttatagtaaccgatgatgtggcttctattattagctctatcagataatgaaactgagaccaagacaggctctgcacattgtgtggggtaatgacacagggggattcagacctagactccataactcctgccccagggaccacccccaycctcaccctgtgcatgtcgacaaaggacagactgggccacttctcaggacacagcrgggaaatgacacagagcagggaggttccaggagccccgagcgtcttttctccaggagaatactctctgaattcagactggggtcagagaaacatttacccaggagccgcagtgtgggyggggctttttacttgaaacgctgtctgaaggcagtggccaggatggaactctccaccctaccttggcaagccacttctcttctgcaatctgtaaggacattgttgagagaattatggtcttccaattccggagggttgaagaaagacaaataggagagaacctatcatagtcaggtgctagctgccttctctttcagagagtgtgagaataaagtgatacacttgattattagcaaatactttggaaattttaaacgctaatattcaacacactctggaagaggcaaataagtagacaggttcatatacatcatctccttcagctagtcctcacaaaaacaaacaaatgaataaacaaaattcttctttggccctcataggaagacactgtttcttgaacgtgtttcaaaaaggatgggtgactcactcaaggtcacactgtttatgaggacagtacaggaatacagacatgccattttgcctgaaaaaatccatcacccagggaggtgacacaattttgcagaaatgttctatttcctctgaaggatacattctttaaacctttgggaaattcattcatagtcttcctcctttgaaggattaactctctggacacaaagtgtttgattctgatttgttggttggaagatgtgttggttgagagaaagattctgatttgttggttgaaaatagactcatcaagatcaactgctgtagtagtaaatattttgacattttgtctgtattcctgtgctgccctcacaagctgcatcaccttgagtgagtcattcatacttttttgtttgtttttgttttggagatggagtcttactctgttgcctaggctggagtgcggtggcgtgatcttggctcactgcgacctccatctcctgggttcaagtgatcctcctgcctcagcctcccgagtagctgggattacaggcacatgccaccatccctgctaatttttgcattttcagtagagacggagtttcaccatgttggtcaggttggtcttgaactcctgacctcaggtgatccgcccacctcagcctccccaagtgctgggattacaggtgtgagccaccgtgcccagcccagccatcrtttttgaaacacgtttgagaaayagtgtcttcctttgagggccaaggagacattttttttgtttatttgtttgtttttgtgaggactagctgaagggggtgatgtatattaacctgcctacttatttgcctcttcccagagtgtgatgaatattagggtttaaagtttctgaagcatttgttaataaagcccggggctggaggtcagaagacctggatttctctgcatacttttgccatcagcaagctgtgtgaccttggacagatcccttttttgtctaaatctttctgagtcttcttgaaaacaatgccaggttgggacaggatgattgccaagctcccgtccagctctaaaacactgcaacgtatgcttctgcaccagcactgtccatcctgtagatcatgcagaaattctcttcaactttttcctacccataaaataggagcatgcttacctttttcctaatgttccaggccccgggtctagaatattgtaagtaaggaagttaatgygtatcasagcccattatgggccagaagttctcctcttccttcctacacctgcttcctccctccctccctccctctttcccttccttccttccatccatttgtgaagaagacatgatcaccctcattctgagagtgaagagacagaggctcaactaatgaaatgatttgttcaaggtcacacgggtggcacaaggcaagtggcagargttgaatttagacccattcctgtccaaatgctgagtttatgtcatcgtcccgagaccataactttaaagatgtaagatagkgggaaaagagttgatttcaaagcacctctcagaaggactcactttacatcaggggtcagcagactcaggccaaatccggtccattccccgcttttgcaaagaaagttgtagtggaacacagctaggcttattgatttatggattgccaacgtccttttgtgaaacagacagctgagctgagtaatcgtggygcacaaaacctaaaatatttactatctcgtcctttacagaatgtttgccaatctatggtccggagtccaaggctgtccatttttcaaagaacacaaagtgacatgagactgtcccakgtgcagggagccctatcattttattatgaaaaaacggcctttctgctcaaatctgttttttaaaaagtcaacaaasagactctgggtacctgtcaggaacagtagggagtttggtttccattgtgctcttcttcccaggaactcaatgaaggggaaatagaaatcttaattttggggaaattgcacaggggaaaaaggggagggaatcagttacaacactccattgcgacacttagtggggttgaaagtgacaacagcaagggtttctctttttggaaatgcgaggagggtatttccgcttctygcagtggggyagggtggcagacgcctagcttgggtragtgactatttctttataaaccacaactctgggcccgcaatggcagtccactgccttgctgcagtcacagaatggaaatctgcagaggcctccgcagtcacctaatcactctcctcctcttcctgttccattcagagacratctgccgaccctctgggagaaaatccagcaagatgcaagccttcaggtaargctaccccaaggaggagaaggtgagggtggatcagctggagactggaaacatatcacagctgccaggggctgccagsccccagagggcctgagaactgggtttgggctggagaggatgtccattattcaagaaagaggctgttacatgcatgggcttcaggacttgtgtttcaaaatatcccagatgtggatagtgcgaccggagggctgtcttactttcccagagactcaggaacccagtgagtaatagatgcatgccaagkagtggractgcgattcaggcctagttgaatgtgctgacagagaagcagagaggggcaccrrgggcacagcccgaaggcccagactgatatgggcaargcctgtctgtgctgacatgtcggagggtcccactctccagggaccttggtttccccgtctgtgacatctgtgacatgagagtcacrataactccttgtgtgccttacagggttgttgtgaaaattaaatgcacagataatagcrtaacagtattccgtgcattgtaaagagcctgaaaaccattatgatttgaaaatggaatcrgctttgtgagaccatcactattgtaaagatgtgatgctgatagaaatgacaggactgcttgtgcatgcyctctgcagtgtgacattccagcagtgaaatcatgttggggtgacttctcccccactctgacctttatgtttgtctgggccgaggctgcaagtcrggctctgtgggtgtatgagtgacaagtctctcccttccagatatggggactgtctgcttccctaggttgcctctccctgctctgatcagctakaagctccaggagatcctcctggaggccccagcaggtgatgtttatccctccagactgaggctaaatctagaaactaggataatcacaaacaggccaatgctgccatatgcaaagcactttggtttgcctggccacccctcgtcgagcatgtgggctcttcagagccacctgatgaggtgggtacagttagccacacttcacaggtgargaggtgaggcacaggtcccaggtcaggctggccrgagctctgtttattacgtctcacagctttgagtcctgctctcaaccagagaggccctttaccaagaagaaaggattgggacccagaatcwggtcactggctgaggtagagaggaagccrggttgttcccaagggtagctgctcctgcaggactctgagcaggtcaccagctaatggaggaaaggctctagggaaagacccttctggtctcagactcagagcgagttagctgcaaggtgttccgtctcttgaaacttctacctaggtgctatggtagccactagtctcaggtggctatttaaatttatacttaaatgaatgaaaatagaagaaaatttaaaatccagacccttggtcacactatccacatttaaagaggtcaatagccacaygtggttagtggccaccctattgggcagtgcagctacagaacatttttgcatcccagaaagttcttttggatgttgctgctctacagcatgctttgctgaaacagaagtgccttccctgggaatctcagatgggaagcaagtaaggaggggagtcaaatgtgggctcactgctcaccagctgtgagggttgggcctgcctcttaaccattgtcagcctcagtcttctcatccatgcatgccgtgggtatactaaaatactatacccctggaagagctggatgcaaatttgacaagttctgggggacacaggaaggtgccaagcacaaggctgggcacatggtggctgtgcactacagctgagtccttttccttttcagaatctgggatgttaaccagaagaccttctatctgaggaacaaccaactagttgcyggatacttgcaaggaccaaatgtcaatttagaaggtgagtggttgccaggaaagycaaygtatstrggcatcacgtcactttgcccstctgtctgcagcagcatggcctgcctgcacaaaccctaggkgcmatgtcctaatmcttgttgggtctttgtattcaagyttraagctgggagggcctggctactraagggcacatatgagggyagcctgaagagggtgtggagaggtagagtctaggtcagagktcagtgcctataggcacagtggtcycagggccacagctgggaagggcaaatmccagaaggcaaggttgaccattcccttcctcaagtgcctattaaggctccatgttcctatgttgttcaaaccctaactcaatcccaaattaatccaccatgtataaggttgagctatgtctcttattcctggacaccatactcagccatattctggtccacrcattaaacaagctggatgaycttgaagaagcttcacccactctgttcctcagctttcccttcagtgggatgatatcaactggacaacaggatgtgcgattcttttagttccagccttccaggatgttttcrrtcccctgtttgttgttgtaggatggtattacctccaccttcccaccttccctatgccctggttctgtctcctgtgcctcgctctgaaagtggatgagacctacaattcctgtcctggtagttctcctaatgaacacactgaagcacgaggaagctgagatttttgttgctacatgagagcatggaggcctcttagggagagaggaggttcagagactcctaggctcctgtggagccccactcatggccttgttcattttccctgcccctcagcaacactcctattgacctggagcacaggtatcctggggaaagtgagggaaatatggammtcacatggaacaacatccaggagactcaggcctctaggagtaactgggtagtgtgcatcctggggaaagtgagggaaatatggacatcacatggaacaacatccaggagactcaggcctctaggagtaactgggtagtgtgcatcctggggaaagtgagggaaatatggacatcacatggaacaacatccaggagactcaggcctctaggagtaactgggtagtgtgcttggtttaatcttctrtttasctgcagaccaggaagatgagacctctctgcccttctgacctcgggattttagttttgtggggaccaggggagatagaaaaatacccrgggtctcttcattattgctgcytcctcttctattaacctgaccctcccctctgttcttccccagaaaagatagatgtggtacccattgagcctcatgctctgttcttgggaatccatggagggaagatgtgcctgtcctgtgtcaagtctggtgatgagaccagactccagctggaggtaaaaacatgctttggakctcaaatcaccccaaaacccagtggcttgaaacaaccaawattttttcttatgattctgtgggttgaccaggattagctgggtagttctgttccatgtggtggaacatgctggggtcactttggaagctgcattcagcagagtgccwggcttgcgcygggcatccaaggtggtccctcatcctccaggctctctttccatgtgatctctcagtgtttaagagttagttggagcttccttacagcatggyggckgacttccaaaagggattattccaaaaagagcctcaacatgcaggcgcttattatracttctgcttgcatcatcctattggccaaagccagtcaygtggctaagtctagccccytgtgagaggagactrcataagagtgtgaacaccaggagacacggtcactgggggccaccactgtaaccatctaccacaggacctgaatctctgtgtgctactcccttgctcaagggcccccctacccacgcagacctgctgtcttctagcaaagcccatcctcaggacctttctcttccaatccttattgactcaaattgattagttggtgctccacccagagccctgtgctcctttatctcatgtaatgttaatgggtttcccagccctgggaaaacatggctttgtctcaggggcttgctggatgcaascttaacctcaatgtgagtggccatactgtggcactgtcmcatccctcaccagggacactgttctggagggtgactgcctgttctgtgaggagtggggatggctaggacatkgcatggaacacaccaccaccccatcttctcagagctcaaaccctgacagaacaccagctccaraggccttggcttctgctgatggtgccrtgtatttaccagacttagtggtccaaggccagagtggccagatttcccaaagtcaaggtgtgacagtgggacagcctctttgtgtctttgctgtcctaagaaacctgggccaggccaggcgcagtggctcacgcctgtaatcccagcactttgagargccaaggtgggcagatcacgaggtcaggagtttgagaccagcctggccaacatggtgaaaccctgtctctattaaaaatagaaaacattagacaggtgtggtggtgcatgcctgtaatcccagctactcaggaggctgaggcaggagaatcgcttgaacccaggaggtggaggttgcagtgagccgagattgtgccactgcactccagcctaggygacagagcaagactccgtctcgggaaaattaattaataaataaataaacctrggtcccagagtcccacagaatggcagacaggagcacctgggggcttttagggtatggcatttcccctgtactaactctgggctgtccagagggccatttcatggcrtggagtggagagggaggcagcacaggacttcctaggcctcagctctcacctgcccatcttttgatttccaggcagttaacatcactgacctgagcgagaacagaaagcaggacaagcgcttcgccttcatccgctcagacagyggccccaccaccagttttgagtctgccgcctgccccggttggttcctctgcacagcgatggaagctgaycagccygtcagcctcaccaatatgcctgacgaaggcgtcatggtcaccaaattctacttccaggaggacgagtartactgcccaggcctgcctgttcccattcttgcatggcaaggactgcagggactgccagtccccctgycccagggstcccggctatgggggcactgaggaccagccattgaggggtggaccctcagaaggcgtcacaasaacctggtcacaggactctgcctyctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctctyrccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccrggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgcctatattgttgactatgtccttggccttgacaggctttggrtatagagtgctgaggaaactgaaagaccaatgtgtcttycttaccccagaggctggcgcctggcctcttctctgagagttcttttcttccttcagcctcactctccctggataacatgagagcaaatctctctgcaaaaaagyyatggggcagcactgtccacaacagcctctrctggaaacaacccaagcacccatcrcagaatgaattmgtacatcatgtatctgcacacaacacartgctccttggcaaagaaaatgaatgaattacagccagctgcacctcacaagacagataatcttacaaacatcatgtgggtacaagaatcacaaaagcatgcatagagtgtgattccatttctacaaagttcaaaacgggcaacatggggctgttgtgtggagggctgtggaaacaggtggtgcagagagaagcaaggccatgctctgtctgaaggcccagtgacacttggcccctgcgagagagagtggcaggcaggagcacctgggggyytttagggtccagacaacattctatttcttggcatggatgcagttaggcggttttctgtatgtatattttatttcacaatacctagaaaataaaaagacttsccccccaacaaccagggtgtaaagaaaggagcatctgggaaattatgagattagtgaatggagtattgaatttgtccccataggtgggagtgcaagaccatgagtgaccacttatcaaacacacctcagtaaacagtcaggagagtgaggagtgtggtcctttcacctgcccaggttgtttctgttagattctgggcttggtctctggagtccaagaggcaggccccagtgaggtcatgcacttgctgtctgattttggccaagtcacctccctttgtgggractgttcctcatttgtttgaggggaatgttgatttggayggggattttccaaacagagctccttggacccttccctctaaggtctctggaaatgggaaaccctgcagaggggaggataaatgggccaggattcatcccttgaaccctgttcccaacagagccctctgtttttctcttctttacaacttggacctcccatgggactttgtttgaaagggagacttcattgctaaaagcaaactaaactaartaggctaaaaggcaacaaactggagaaaatgtttaaggtcttctctagatctaagatcctatgacgttgaggaggtcatccaacatctctgagttttctctttcttgtatataaaatggaagtagctggcagggcagggcatgtgtcgttgatatatttttaatcctrgtaaaaggaggaggttcaaggmagaaaactcatcaaagcttaatgacaacaatagcagctaacatttgtgaggctctaaggtaaaacccaaggctaagactcttcatgcaaactaggtcaagcagcaagctacaggttagaaacaggcaaggcagcaaaacagtcacatgggtgaactctgggactctgcagtcacactctgactctcctgcttgcactgggtgctcataagcaagctagttaacacctcagagccttggttttcccaccactaaatgcaaataataggcaatgctgagttattgcaaagttayttaatctttgcaatagccttctgtggtgagtggcatattcttmttattattrttagtcctagaagagtcagtgctcaaaggaatctgctttagagccttattgctccaagtgtggttcatgcatcagcaacatcagcatacttctggagttaaaatgcagattctcagatctcaggcttgacttactgacttagggtcatcatcttaaccagatctcccatgcacattaaatttgagaagcactgttttaaaatgcattagccgggtgcagtagttcatgcttgtaatctcagcactttgggaggccgaggcaggtggatcacatgaggtcaggagttcgagatcagcctgaccaacatggtgaaacctcatctctattaaaaatataaaattagctgggcatggtggcgcatacctgtaatcctagctactcaggaggctgaggcaggagaatcacttgaacctgggaggtggaggttgcagtgagccgagatcacaccattgcactccaacctgggcaacaagagcaaaactctgtctcaaaataaagaaagaaataagataaaataaaaagcataaatcrcacaatgcataagttttggcatacrcactagcataaagggattctcctacttataaacctagcccatctccttactctctatcacactagcccattgatgacaccaaaaactcccctcttaacactttagctgggcatggtggttcacgcctgtaatcccagcactttgggaggctgaggtgggcagagcacttgaggccaggagttcaagaccagcctgaccaacatggcaaaaccctgtctctactgaaaatgccaaaaaattagccaggcatggtggtacatgyctgtaatcccagctacttgggaggctgaggcatgagaatcactcaaacctggaaggtgacrgttgyggtgagctgagatcatgccactgcatcccagcctgggtgatagtgagaccctgtctcaaacaaacaaaaaaacaaaacacttccttactttggtttaaagtgttccataaaatattcctaagaggaaaaactttaaatcatcatcrtgctgctagaatgtcagctcaacccatgcagatatttttgtctgttttgttctacagtgtatctcaagtgccaaggccattgcttgcgatatactgggtgctaagtgaatatctggccagtgaataaatgaattggccactgatatatcaatatggattaatttattcgacaggtcagcaaatttgagaagactggggacttggatcaggaatattttgaaggaagcttagaagagggaaaaggcccagagtgaaggatttttcagatatttggaggttaagaaaaaagatatgaccacgaggtggcggtagcacacataggctttcgggttgatgctttaacaggtttacactggggaaggtcctttatagcaggaattggtcaaggaggctatagtgtggagatggggtcctactcagaggggaaggagggcaagaggactcctaggaaagaagagaattggaaagggggcttacatggccaggtgaagtcacccagcagcacagcagggaatctctgggtcagagagctcctatgggctgcagtggcttgaggcctttatggcttggggcttatccttggccagcagatattggatacagtttcatggagtatacagagcaggcaggttctaaatggattaccataggcttattggggctatgtttaaagcaagtggatgtgcaaacatttgagtttggcttggtggggtattccaggtctggtctcagcctgcggtgaggaaattaataatcaaggggccagcactttatatagcacaaggcaggggccatggattaggaaakccaggcctggggttcatgcttaagtgaggcttttgttcaactgggaggcggtgcmcaggtgactgggaggtggaggggctgagatgggaragaaaagcacagagagggaagacaagcaagcctcaagaggattgtggcttcttccgtcacttctgggccygatctactacaacactacagaatcaaggacaactgtttgaaaattcaaggctgaattcaggtctttcattggtgagtcagagttttcctacagactcmctggggggcccttggccaagcaacctctcctccctaggcctcagttttcataaaaggagggaattgaactagatatgtgtcttcatcaggctgacctgcaggagctttttacmaaaagtggcctacctcctccatccagaggttctgattcacttgatctgggtgtgggacaaggacatcatgatgccagggctgaggccctgtggaccacatagctcctaagtcagggaccctgaggtcaagtcctcccagctctcccacctggccctggtagtgtctgtcaatacaatggagggagatggtctttaacttcaaagaaaggccacttaccgcatcagcagtacattttgactacatgttaatttgggttgaaggtagaagattttctattttctcaatcacaggctggctaaaacacatttcaagcttcattctggggggaacataaattggccttcaacagggggtgtcaaattggggtaaaattcttgcaaatcttggggaaaccaaataagtttttgttttctcttcacataactatgaaatccctagccacaacagcaaatctcaacatgcttgatattcagcccagttctctccataaaagtttctggagacaatgaaactcatctattgggttcwtagctttaaacctgagaaagcttaaaaacagggaagattagctttgacgtcttgcctctgggtctccttcatgtggagctaaaagagtagttcaggaaatatccaccaggggtcagcattttgtacacacctgactgctctggaaagtgtttttgtttttttttttttaaatagaaacggggtttcaccattttgcccaggctggtgtccaactcccagactcaagcaatccgcccgcctcagcctcccaaagttctagcattaccgtgtgagccaccacacccggcctggaaagaatcttgacaaggcaaataatcagtttggttcatgctctcaaattagtgaaggtctggtttttcaagactctctaggtgtttcactctaaggaaaaatttattttcattcacctatcaatcaagctgaggtggggcctgactcctgacaagtatccaaatgttgcctattgccaatgtctagtctccaaggggtgacacccgagaaattctaagtcttctgtgcctgctttaaagtccacttcctgtcatcctgttatctgttgcagaccttttacctgtatgattgactggtgtgtggaattaacacttccctcctcggccgggggaacacacccacatgttggaactcagcacaggaatcccaacggcgtgcctacaagggaaatgcgtacttttgtgtgttggtgggtagtggacagaactcgtaaaagagatagataaaatacccaggcactcactacagtggggaatggatctgttcaggggccagctatgcctgcattctttcccagggacagttgacacagtcagatgactcaggaaacttgatttgcttggagtcagagcagaggaaagatcttagtgaccagggacctcaagctgccccacctgagcgctccacctccactccaaggggcttcctgccaagagatcagtatgtctgtgtgtagagtcaagacacatcttccttaggccacaatggagtcacactgacatcttcgccttccctccttggcagtatttattataagtcacaggagtttagttttctttcaactcaggcctgtggttggagcacagggagctaggctsgggctagatcttgctaacctagtaggcaatggtaaggattctagtctgtcctaaagcataaataggccttggacactctgaaatttgtcctttcaccaccccatgctctacttctaagtgctctctctccccatctgcaccccctagttcctacaaaaatctcctcaaagcgaggctcttggacaatttgttccatgaagacatcgagcacggtccataccagccctcaataaccccctcttctagactccatgaggacctgtagcccagacccctgatctgcatggcgcctctggggtctttccagaggtgtatgttttaaccatcccctgagcaccttaaagtaaagattcagtgttttgctgtttgtgctccctagagcacctgggcgcttatcggaaactgatgaaaactcactgccaacatattctgaagtatattcat

SEQ ID NO: 13221 - DNA, 14023 bp, Homo sapiens
  misc_feature (1)...(14023): n = A,T,C or G, or insertion/deletion polymorphism (see Tables 1-2)
gactaatatagctgtattaaatgaatttacactaataatggttttaactaacaatgggtttatcaggatataataccatcccaagttgaggagcgtctgcaatttaaaacatctgttcaaacaaacacttgtacaggagcgttcatggcagcactattcacactatccaatcagtaatgtaggggatcaaatgccacctcaaaatatgccactttggcatattgattattttgtgtttaaaggcacttgaaagtagcagatgcaagaagggcacactgaccttcctttttttttcatgaaaggaagagatgaaactctgatgtgaaaggtattatctgtataccaggaagaagaaacacattcttattgccagagatggggagtccaggcttgagggaaagctgcaccaaaaaaccttgttacacaactcttaccttcttagtgacttttccacaattaactctcctagcccaaaccccaatgtcttgttatgttttcacaatttaccatacttttcccaccctagtatgtaagtattcagctgtaattaatcacttgagtcttcgtatttcttatgagggctcccatgtacatgtaaaaaatgccaaataaaattttgtatgcttttcttttgttaatctatcttatttaagtcctagctggagaatctaagaggatagaggacaacatttacctcccctgccatggaaatcatttaatgaactgttcatcaactgatgagtagataaacaaaatgtggcctatttatacaacagaatatttctcgttggtgttgtctcaatgcttaacacagtatacctggcactacccttcaatattttttgaagaatgagcacatgaattatcatgtctccagctaggttcaccagtatgagtaatatgtagtgagtgtctactgtgtgccattttactacctaaactttttatggactctgtcccctagtcttatctaccaatgccattgtcttagttgagatatctgtcatttcttgactggtataatacagcagctttctaattccaatctcagtcctctctgttctattctccacacacaatcctctctgttctattctccacacagcttccagggtgatatttctagaggcaaatcagaccacgtcactcccaagctgaaagaccacagtgggttcagtgtagcctacagggtattctaaaacctgagcatggcataatagaacctccatgtcttggctcctgcctacctctttcccagccacatcaaccactactgctccactggcatcgtactctccagccttaatgaattggttgcaactcccctcctcccaccggtgccttggcttctcatcatgctacagattctttaacacacacattgtcctccaagaagcttgccagatccactcctattctttcaacgaaatgtttattgaccactctttatacactatgaccaaataggatttatcccacaaatgtaaggttggttcaacatgtgaaaatcaatttatataatacaccatattaacagaatgcatggcggagcgggggcgggggagggggctcatggtcatcttaatcatgtacaaaaaggatcatttgacaaaacgcagtaccctttcatgaaaataaattcaacaaaccaggaacagaaagaaacttcttcaacctgatagagggcatccatgaaaaacccagagataatatcatacttaatggtgaaagactggttgatttccccctaagatcaggaatgccacttgtaactcaacatygtactcaaagttctagtcagggcaattagtcaagaaaaagaaataaaaggcatccagattggaarggaacaagtaaaaccatctctattcatagatgcatagatggcatgttcttatatagaggacactaaagagtccaacaaaagaaaaaaaaaaaaactgagacggtttggctctgtgtccccacccaaatctcatgtcgaattgtaatccccacctgttgaaggaagggcctagtgggaggtgattgaatcatgggggcggacttccccyttgctattcttctgatagagcgctcacaagatctgatgattgtttgaaaatgtgcagcgcttccccctttgygtgcgttctctctctcttcctcctgctccaacatgtgaagaaggtgcttgcttccccttcgccttccgccatgattgcacgtttcctgaggcctgcccagaagcagaagccttgtacagcctgcagaaccatgaggcaattaaacctcttttctttaggaattacccattctcaggcagttctttatagcagtgtaggaacggactaatatgccaaccctgtctgagtatgctcagcaaagcatattcggctcagcaaagttgcagtatccaaratcaatctgcaacagtcggttgtatttstacaccctagcaatgaataacatgaaaataagattaaggaaatgattcattttacagtagcatcgaaacaataaaatgtcgaggaataaatttaactaaaggtgtacaagatgtatactctgaaaatttcaagacgttgctaaaataaattaaagaagacctaaataaatcgaaaggcattttgtgttaacggattgggacacttaataytgttaagatgcccataatctccaaggcaatatacagattcatcgtgatgcctgtcagaatccaacctgccttctttgtaaaaactgacaagctgatcctaaaattcataagaaaatgtaaggggctcagatagccaaaacaatctcagaaaagaaaaaagttgaaggactcacacttcccaatttcaaaacgtactacaaaaccgcagtaatccgaaaagggtggtactgccatcgtgatcgatacattaggtcaatgttacagaactcagagtcaggaataaacccatatatttatgtaaagtttattttcagtaagagttccggcacccctcaatgggtggaggggaagaataatcccctcaacaaactgcgctgggacaactggatagccacatgcaaaagaaggcccctggacccctacctcacatcatgtaaagaattaattcaaaatggatcacagatctaaatgtaagggctgaaactataaaactctaagaagaaaacggagatgtaactttgcacgaccttggattaggcaacagctccttcagtatgacaccaaaggcaaagccacagatatcttttcatttggcaagttggactacatccaaatgtaaatcttttgggcaacaaagggctctatccagaaagtgaatgggagaaacatttgcaagtcacatatctgataagagtctattttccagaatatatgaataagttttagaagcccacagccaaaatacaatcaaccgaattaaaaaatgggcaaagggcttgaatagacattcctccaaagcagaggtacagagggccragaagcacatgaaaagatgtcttagtctgttttctgttgccataattgaatacccgacactgaacaatttataaagaaaagaaatttatttcttaccrttctggggactgggaagtgacccggcatctggggacggcagagggtatcacacggcgagagggcaagagcgtgtatgtcgtttcaggcytctcttcctattcttataaagccaccagtcgcatcctgggggtctcaccccgatgaccttatctaatcctaattaccgtctcagaggctgcgcctccaatcaacatgtgaatttggggattaagtttccaagacacacaatttgggggatgcactcaaaccacagcaacatcattagccatttgggaaatacgaatgaaaaccaccatgagatagcacttgacacccagtaggatggctactgtaaacaaaacaaaatgaggcaaacagaaaacaggttttgatgaggctgtgaagaaattgggactctcatgcactactgttgggaatgcgaaagattacagctgctgtggaaatcagtttggtggttcctcaataagttaaacagaattaccacacgagccagcagtttgactgctagaaatagacccaaaagaactgaaaagagatattcaaagaaaaacctgtagagagatggtcatggcagtgccactcacaatagccagaagggggaaataacctgtccatcaactgacgagtgggtaaacaaaatgtggcctcctattcatacaacagaatcgtactcagtcattcaaaggaaggaagtagtgattcatgcctctacatggatgcaccctgatgaaaccattacgctaagtgaaagcagccagacacacacggcctcacatttggtcgtataattccatctataggaaatctccagaacaggctaacctctatggacagaaagcagatggactaggggttgycagggactatcgggaacgtgtgtatgggcgggggcagggggtgtgtgtgggagggtgtgggggctggtagtggtggtgtggaaggaggcgtgcggcaagtgactgcttataggtacaggggtttcggtttcttttcggggtgttgaaaacgttttggaactaggtggtcgtgatggatgtgcaacattgtgaaggcgtggtacccgtcctcccctcgcccacccctttgtctttcccacggtgttcccatccagtagaaagggaaagttcccactggcaaagagagggtcaccagcgcgattccccctgccccgccccaccccacccccacggccctccagccacttctaggcccaggcctgctccctcgaggccaatgggaaagtgatgaggtcacctgacggacgtgtgtcccttgtgaggggccgtcaccacatgcgtgcccgtcgccggatgtgcgtgcccattggtctcggctccctagccaatgaggggctgggccctggtcgctaggatacacagtactggacgcggtaactgtcctcttgagagccatcttgcctagctgggccaagccgagatagcacactcaacgcccagcatgccgaggaggaggagacgccgagggyyctccggtgctggcggccgggggcggacctgctctcgcaccgtccgagcggagctttcgttttcagtgagccaggtggagcgcagtctacgggagggccactacgctcagcgcctgagtcgcacggcgccggtctacctcgctgcggttattgagtacctgacggccaaggtccyggagctggcgggcaacgaggcccagaacagcggagagcggaacatcactcccctgctgctggacatggtggttcacaacgacaggctactgagcaccctttkcaacacgaccaccatctctcaagtggcccctggcgaggactagcttctgacacccggcccctgggacctgacaggtccactcgtccacccacccggccccaaatcccccggcctgaacccccggccttaaacaccctccccccacaacccaggccccaaagtcttgggccttcattaattctgtcaataaaatgtttcaaggaagccatctgcccgcttcagtcactttgccttggggtgggggtgggggggcggtgagatgggttggggggttgtgagacctccacagctggagggatggagaggtggtgggggtctggggttgggtgggagccagggatggcacagaggagcmgtctctccgggtgacagtgcaggggagtggccctgggtgggaaggggacacccccgctggttctgagcaagtcagggcctgcccgggaaagtcctcagcatgatggtgttcgttggggcgggtgggcctcaagaccatgactgcagtgttgsgacaggacggacttctaaggcaaccggggtggggacggagaggtggacccggtgcttggcaaggggccctggaccggaagacggaggactgagtagtcggggcggggggggggggggacaacagtsyagaaatgcgcagacatggaattagggtcacgagtttcctttgggtcatgttcagatggagaggctgtgggatgcctttagcaacctagaccacttgcattgcagccgagctagcagcagctggtgccccgccaggccccgcgtaccttcccagggtcttggatccgcatccccgagaccctcgatttgcatacgccgctcacagcccggccaggccccgcctccgatcccgctctttgcacctcaycagggcaaggggcaggctcgggctggggagccggcgcgggcacggcggcagcccgccgagggggacgcagggcacgtcgccccgccccggcccgcccgccagctgcggcggcgcgtcgggaagtgcttggggcggcgagcatggcggcagcggctgcaggcctgggcggcggcggcgccggcccgggacccgaggccggggacttcctggcccgctaccggctggtatcgaacaagctgaagaagcggttcctgcggaagccgaacgtggcggaggccggcgagcagttcggacagctgggccgggagctgcgcgcccaggagtgtctgccctacgcggcctggtgccagctggcggtggcgcgctgccagcaggcgctcttccacgggcccggggaggcgctggccctcaccgaggccgcccgcctcttcctgcggcaggagcgcgacgcgcgccagcgcctggtctgccccgccgcctacggggagccgctgcaggccgccgccagcgccctgggcgccgcggtgcgtctgcacctcgagctgggccagccggccgccgccgccgccctctgcctcgagctggccgccgccctgcgcgacctgggccagccggccgccgccgccggtcacttccagcgcgccgcccagctccagctgccccagctgcccctggccgcgctgcaggcgcttggcgaggccgcctcctgccmgctgctggcgcgcgactacaccggcgccctggcggtcttcacgcgcatgcagcgcctggcgcgggagcacggcagccacccggtgcagtcactgccgccgcccccgccgccggcaccccagcccgggcccggggcgacgcccgccctaccggcygcgctgcttcctccgaactccggctcggcggcgccctctccygccgccctgggcgccttctcggacgtgctggtccgctgcgaggtgtcccgcgtgctgctgctgctcctcctgcaaccaccgcccgccaagctgctgccggagcacgcccagaccctggagaagtactcctgggaggcttttgacagccacgggcmggagagcagcggccagcttcccgaggagctctttctgctgctccagtctttggtcatggctacccacgaaaaggacacggaagccatcaagtcgctgcaggtggagatgtggccactgttgactgctgagcagaaccacctccttcacctcgttctgcaagaaaccatctccccctcaggacagggagtctgatccatcccattcacccagtgacttctttttgcccaggcckggactttttgcatcagtcacgttaaccagatgactttgcctgttaccaaacctcatgcatccacgtttgcgtctggggaggaataaaaagacatcgttcccgcttctgcgttttgttatycctactgccgccataggaattatttcgttggctgaacgttaccagcaccccgagaacacattttgatagaatcagagtagaggacatggctgtcttctaaaaagccacgacatgaaaatgacaatccctttcgtctccttcctccgctgcttccaccyaacgcagcctcctgcctccgcctttgtttcatagtgaggattttattttgcacggcgccctccctctaaatacctaccctagatgatttcatcctgcccctcacttcttaacatattcctgtgtctttgtaatggccaaatttctccttccactcgtccgcacggtacgtcttcatgggagtcattttattccttacagcttccttgtaaccacagccctaaatccatgataaagctactcttgtactcctcatgtgtggttttggtgtccgtcgtctataaaatgtgactctcttacctacttgtcaggaggccagcagcagaaccagatagctgtttgggctccaggatgtattcgttcctttgaaatttgcgctatgcctcctatgtgggcaacgaacctgcagagatcatctatgatgtgctccgtactcgggtgactgcaatgcagatacatccagtgcagcgggtctggtgccgatgcatcgatttgcattggaattcacggttctggttccattcgcagaggtatatgcagtctggatcacaacagcttttatttgtaatagggatttttttttttttttttttttccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttatacgtgaatagtacaaagacaaagacgtttgagaaccgctacgccggaggaaggtggtcaagactgaaattagcgtgttaggcaagatctggttcctaggtgctgaggattctggtgccaaggattaatgttaaccgtgcaggcatctctaccaccgttagaggagaccagcagcccacagactctttctgtcaagggcgggatagaaatgtgttagtctttacagaccacaggtggtctctgttgcacagtcttctttgtttctttgtatgtttgtctttgcaatcctttcaacgtgtaaaaactattcttaactcacagtccgtacaaaagcaggctatgggccaaattctggggctatagtttgcccacccctgaattagaacccaggacatagtagttgctcagtgactgttcaaggaatgaacctcatgagagtagttaataactgtaagtaatttatccttatcgttaaaatacaaagattgaagaataagtgaactaagcattcacctccagattgtaggaaacaaaccaaaagaaaggaaaatagaatttttaaagttttgaacagagattgatgaactagaaacagctctttcaaaaccacgtttgggtttaaaactgagctgattctttgaaaaattaatagaatagacaaacacttgccaactcttgatacagaagggaaaaaaggagaaaagacatatgtgtgtatacagatatagatgtatggcacaggaagggatatatgactctaatgtgcacatttgcagacattaactcaaggcaacacaaatgagaatagcaataatcatataacgattggaaaatatagcctagtatctctcactaaataaagcacatggctcatatggctttttcatttactctcattaaatactggattcctacattaaataagctattctagagcaatagtcttcatggaaaaaaatggaagctttcccactttatttttcaagtttaatataaccctcatgccaaaacctggtaagtagagctactgaaaaagctaaacccatttcattcatgaatatagatatagaaattataaatgaaatgttggcaaattggatccagctaagttttaaataactaacacactatgactgacgaaagttttcccagaaatggagcacagtagtgctcttgcactggtctgtgagagccaattgtaagtaagcatctcttcccatccctggggccaggcatgatgggagtagtatttatgtcagggaaatctgccaatgctataaatcaaggcctttacttcttaacctcttctcactttgctcccctgtgggttgttaatttcttgtcagcacactattgaatgttaagtataatttgacaacacaaaagagaaatgtgaccatgtcaaagatgctggaaaagcatttgataaaattcagttgccattgcaaataaaatagggataggagaaaactttttaaacatcataaaaagtatttgaaactaacagtgaacattatattaaacagtgaaacacaggttacattctcattaaagtcaagagcaagacaggcttatttgttatgtgtttaccagatcctgtcagcataatgtcatcagtgtaatggacaggcattgtgcttgtgggatgtaaagatgtttgaggtcccttgagtctatattatgatagaaaacaagagagctaacattgccctgatgcatgggcagtaaacttaatactcttgttcctacttggtaaattcaaatgtattctgattttactaatgtatggaaatgaagaaaaaacattctctaggtcaatacttccatatcaggtgcctggggctgtgtaaatttgcttcaacagagatatgatatctggaattgcaattgttttttggcatcaccacctgattaaatttgtgatctgctgtcattttctgtgactcgcctggctttcgtagtgtccaaacagggtctctaaggagaatagtcactggtttgtgaggcacctatctcagttatagccactgaaaggcttttacacaaaagagggatgactgcttcagagactggggagtggttgcctcctcaggcaaaggaggttcaggggaatttggaggtttgcaattctcagcctcatccatgtctgcctaaatgcctccatctcaggcctcagagtttcactccttcccaccggtactcttaccacagcataatagatctggtggagttaagcatttaattgtcactgcagctctgcaacttatgctcagcccctaagtcgtatctgcctacaaccacaggatacggagtattcctcaaaagctctatgcatgcatcctgattttccatgtatgttcatcagtgttcttattttgtatatattcataacatttcatttctttttccatgtgtatgccctctagggctgtaagaagacagaccactctacaatcaggtaatgctacgtttgttgccacagtgactaaatgccactgtcatttaatctccccagtgtcttacttgccatctgcaactcatcccatagtatcactggtgataatctgagaaactataatactaacacatgtcatggattccctaactgctcattttcttccttggcaaatatgttatctctgtgtttcttgaatatattagcaacataaccttagaattgcattttgaaaatctgtttcctggggtttcttctagcaccaattactgtatgaaacaagggatccagcaaggaacagaaaacatggaaattaggataatttgtggaaggtttaataaagatactagttaggagggtgggaacagagtattaccatcctgtaaacccaaaataaaattctaatcccccctcctttcggcaaagggccttccaaagttaacctgaaaaacgttcaggccatgatgggaaagtggggatcaaatatgccttattatacccgcctcccttttggaattcagaaaaatctgaccagcattaacatcaacacagaccttcagactgatagaacagactctttaagtctgataagaaacatttacaatctattctctctgaagcctgctacctggaggcttcatctgcatgacagaaccttggtcttcacaaccccttatcttaaccccgatgttcctctctattgattctaagtctttacacaataacttaactctttcaaccaattgccaatcagaaaatctttgaatctacctacgacctggaagccccgcctcgcttccagttgtcctgcctttccaaactcaatgaatgtacatcttccatctattgatttcggtcttatgtctccctaaaatgcgtaaaaccaagttgtagccagaccaccttgagcacatgttctcaggatctcctgagggctgtgtcacaggccattggtctctcatatttggctcataataaatctcttcaagtattttacagggtttaactttttgtttgttgacaatccctaaacctgaaaggatcagaagagagaaacatcctgaaagagagaattggatagattattgtagtggctttaaaaaatgaccaccaattatttaacatttctcccattaaaaattagggtctatgtctcttccccttgaatctgggtggatatgcgatttgcttataaccaatagaatgtattgaaagtgaggactaaactctgatttttttttatcttgcccaaattcctatctaaggggtctggggagtcatgccctacaaatcataaattctcatcagatgggttttatttaaccttatatgtcatgatttactttccaaccttactctggcataacattatgagacaaggaagaaaatcaaaatattttaccccaaaacatgtttttttgccatattttgaaatggccctgcaaagctgttctttgtggagggaaatttgcaactgtaaagaatctctattaacatagctagatctttttctc

SEQ ID NO: 13222 - DNA, 20773 bp, Homo sapiens
tgaatgaatgcattatgaaaggaattcttttacatgcgagtttgctgatagtcttagctaattctcatgtgtgtaggtgtcttgcctatctgtcagtcttagccttaaaggaaagagtcccatcacctcacttgcggcctcatcatcatggaccgcatgatgatgcggaatgagaatttttattgtttgtactacttcaaaatcattcagtacgtgatcacctgtcatgtatagggctctttatatttctagtttagtcccttttgttttctctaggaaagatgttttagacctgggacaaaagaagaaagagtgtatgctgacatctaggagggaagcacccacctcccctaagctccatctccctgagcactcatttcccaatgaccataccaggttttggycctagagagtttattacaaaataagaaagagaagtctggggaaggttcactcatcatagaattttggcagttcattgcccaagatgactcgatggtccacaccggcagctgtaatagtgaccaggtagatgacacccccgcttgagccatcccggctcatggccagagcaatagctgcagagggtttcaagttggagagagggagagagaggatggcttagcttcaaaaatctttttactccccctccatccatatgcctactaccactttcacctcaaaactcatcttccaggaaggcatatttagtggtgtgctggtaaatcagtttttttacaaaaaggcttccatatgtggcatctgctgatgtccrtggtgtaaatgctcccgctatgatgaattgcaagttacaaatagctaagcagttcacaaatccttgactatttaacagtccgctctcatgagtggtcccaagccagcctcagcacacctcagcacaccactggttctttttttttttttttttctccagacagggtctctctctgtcacctaggctgcagcgcagtggtgcaatcaccgctcactacagccttgatctccccggctcaratgatctttccacctcagcctcctgagtagctgggactacaggtgtgcaccactatgcccagttcatttttttttttacttttttttattgttttttgtggagacagggtttcaccatcttgcctaggctggcctcaaactcctgggctcaagtaatcctcctgcctcagcctcccaaattgttggcattacmggtgtgagccactgtgcttagcacaccactggttctcacagtgactgtgtatcctcatttgatttactcagaacagccctggtttatccgtattgcccaagarccccattgagctttgcatttgtcctgccccttttcactcttaaaagtgtaccaggcccggcattaacttaaatggccacccctgtatttctcttcctgttcctcataatctacttccttcccatgtttcaaagccctccccaggtacccttccacttggctggttaccgtctgtggtgaagcgcctgcactcctcgggagacatgcctggcttataygctgcatccacataaccatagataaaggtgctgccggagccaccaatggcaaaaggctgtcgagtcagcattcctcccagggttccatatacctgggaaagggatcctcaggttaaagawtcatcaagcccttccttcccactgagacattaagtggtctctgcaccctgcaatgaagccctggtatctcatatccccaaagtactatgctttcagaggtagtgtccttggaactcattgctagaatgacataggacttccatcttcctctgcaggagagtggggaagcccagaggagagagtgctttgggagaaactcacctgacctccttcacgttggtcccagccagctaccatgagatgtgcagacaagtcctctcgatatttatagctgatatttctcaccacatttgcagcagccaaaacaagtggaggttcctccagttctatcctgagggaaatattaggaataaaggttgatagaattttaagtctcattctcctatactgttaccatcatccctgctaaacgacccctgaaaactgtaactgcaatagctcaaactgcagcctccctcccacatgtacaggggaaccagagtcccacaccaccaactggtaagaagctttcaattgctcactcttttgctcagccccacccacataactttcttttggctgcaaggaccctgctcttatggggaaaagcagataaggttacttccrtcccaacgaccttgatttctcgtatggtaactgcctgatattatggtgggtcacaatatcaccttcttcctgattatttatatcaggatagtgatttacagcttttaaactgtgttcacatatagaaygtggttctcaaaataaccgtctcatgaggtrctatattatctccactttacagatgcagaaactgacagattcaagtgccagcaagagccgaaacaagacttttccatttcccagtgtccagctcctggaacagcacactgtacagggattcatgcaggttgggggagctctagtgggtggggagtcagaactccagagcttcatacccatggagctccagctggtaggcggccatgtcggccacggcttgggcatcagcagctgaaccagagagtgcacagtagatgygctcgtgcagcggggacagcttgtcaaacactcggttcaccaccgcctcgctgtcaggagggagtcaacagtcaccaagttaaaactcaggtttkyttttttttttttttttttgagacagtctcactctgtcacccaggctggagtgcagtggatcaatcttgggctcactgcaaacttcgcctccctggttcaagtgattctcctgcctcagcctcccgaatagctgggattacaggcacccaccaccaagcccagctaatgtttgtattttcagtagagacaaggtcccaacatgttggccaggctggtctcaaactcctgacctcaaatatctgcccacctcggcatcccaaagtgctgagattatagatgtgagccactgcacccaaccagaactcaggaatttttgagggkgatcattcaatgtctctcaaatttctttgacaagagaatagcatgaagtttaatgcttggattaaagcaggaggcaaataatcatctcagatattattaatcactgcagatgttaatcaaaattaggcttatttttcaggcttagattttataacaaagcaaaaaatgctaaggtaagaaaaatatgcctcatcaattttctttgctattaacaatcttgagagagttatgttctatggaacataatgtcagtaatattgacctaaccccatatactcattttgcatgtgaggaaattggttaggagtgggagaagagacaaaatagttcaatatatggtaaatgagaaaccagrtatctgcttgacagaatcatctttttgatccctaagcacagatggaaagaagaccctcaaaaatctatctcctgtccccctctcagaccctattcctttactcatccctgtacactactgggacaggtcayatacacattcagaccccagatcctcctccacaaattcagagacccaagcacccaccaaatagcttatcatagtggcttttggggaaggtcaactccattcctccaaggctccagtttgccagtcttttcatgaatgggtaaggaaagtgtgtatttgaggccattagcttctttccaaatgcatacatcttcacttttactcaccctgcagacactcgggaatcagaacccatcacaaygcccccgtcaaactccactgccatgatggtggtctgcagagacacagaatatggaatgtcagggcaagaacagccttgatgccctcatgttagagaagaagaaacattcccagagaggcgaagtgactggctcaaagattacacagtaacaggccagagctgactgtcagtacaggctttttttcccttcatctttccactttctctattgcttcatccggctgcaggggaatgccacagcccagctgtgatacaacacagaaagaactgtgtccctaagttccaacttgcctagtggaatcctctccactgtagagaggtggagatgaggctcctacaggtagaagtgaagcagctccgcaagtgaaaattatctccaayggaagggctcatagtatgtgcagatgtggtgtagacccaacacagagtaattgactatgatcttgggaaacaaggtcagtctatttttttttttttggtccacaatcctccactctcaccccccatttcatcagaagtgagctcttccaatttactgaacattggaaaaaatcraggagggcagtggttagcatggccaggggcaaggcaggagagaagcagcaaggaacacatacagatggttgaaaataaaagtttcagttatggaatttccgatcaagaggtaaatacatatctcagcagccagggrggtaaatttgtaccaagagataatttgactgagaagtttaagctgacttttccaggtcaagaaaagaatcaagaagaagtgagggaagataaagctacatttattctactattgagttggaaggagccttaaagatcctcggttcaaatgaggaaaccaagtcacagaaaatgcaaacgacttatgcaaagtcacacagagttaatagtagacctgggactaaaattcaggtctaactcttatcccttgtttccacttctacttcctacttgccactgctcwtttggcagtgaggggagatttcccaaattataagtggtttcactgtgtctttcttaccaggccgtaarttactctggccccaaaggacgctcctctgagtatgctttccgacggacmgacttatcatgaatagagggtcaaagaacagggttaacttcaagttagaggctattcctctctaacaaagccgcccccaagccacgagtggtggcagtagtccagagcagaagccagccagccagtcttggggctgccatctgccccaggcgcccatcytaagcaaagtccccccagtgggcacatgggagtgggcagggaagacacagggaagggagtaaggcagcatctgggccaaggagaggccttcctgggtcaagctagggaagggcatcactagttaacacagaacgcccattatcagtgcttgggctaagagttgcccagtggcaagtttatcaaaagtctgtgtgatgagttggtccttctcaataagtgcctatatttccttctcccaagtgctgttctacttcacccagggcaccatttcctcatctctttgcaccatccccaaccccctttcttgatttaaccagcccccactgtccgggaccagagtgaaagcgaaagcgctttagagtagcttcccgttgacgcttccagctaagagtcaaagcacccsctttttccaccagcctcgcgtgcctgktcccttcacggacactctagacgamccccctcagaaaagaaatactctatgctcattgcgggttgcaagcgctggctgctacmggcgacctccctgcgctcccgttggtctctgcattcacttctccgcgcgcgcttccagggtcccctggccgctgcatctcctccacccctctgccaaccctcaagcccagacccattaccccggtgtggacttctcccgcccggggtaagtccycggttggtgctcccgcccgcagcatccctgcaaggcaccgctctcctcgccgcctggggcactggtttccaacctgggacagcgcacaacgcgcagccgacagccccgccccttcgcggcgccgccaggaggcgcctgggtgctgcggggctgctttgcgcgckgcgctaacktgtgtagggcagatctgccccgagacaagtgacgaggcagccccgccctgaggctggggtgggaaaactggtgcaagtggaaaggcaggaggcagggagaggcgagaagggtgtgcgtgatggagaaaattgggcaccagggctgctcccgagattctcagatctgatttccacgcttgctaccaaaatagtctgggcaggccacttttggaagtaggcgttatctagtgagcaggcggccgctttcgatttcgctttcccctaaatggctgagctkctcgccagcgcaggatcagcctgttcctgggactttccgagagccccgccctcgttccctcccccagccgccagtaggggaggactcggcggtacccggagcttcaggccccaccggggcgcggagagtcccagrcccggccgggaccrggacggcgtccgagtgccaatggctagctctaggtgtcccgctccccgcgggtgccgctgcctccccsgagcttctctcgcatggctggggacagtactgctacttctcgccgactgggtgctgctccggaccgcgctgccccgcatattctccctgctggtgcccaccgcgctgccactgctccgggtctgggcggtgggcctgagccgctgggccgtgctctggctgggggcctgcggggtcctcagggcaacggktggctccaagagcgaaaacgcaggtgcccagggctggctggctgctttgaagccattagctgcggcactgggcttggccctgccgggasttgccttgttccgagagctgatctcatggggagcccccgggtccgcggatagcaccaggctactgcactggggaagtcaccctaccgccttcgttgtcagttatgcagcggcactgcccgcagcagccctgtggcacaaactcgggagcctctgggtgcccggcggtcagggcggctctggaaaccctgtgcgtcggcttctaggctgcctgggctcggagacgcgccgcctctcgctgttcctggtcctggtggtcctctcctctcttggtaaggggaacgcagggcaagaggggaggacacaaggggactgggacaggaatcaaaggtaattgtcagtaaggtagagtagcgtgggttctgggaaatgtggagcrggagaaggactcctagcgtgggtcttggaacaccacttcggtgtagaagaaacggcactggactggcgggggccagaggttctgggctccattgctgaccgggtcttgattctttgggccacgccggaagcggggaaatcctttgctctggggccgaagggcggggcatcctcatctctaacaggaggcttttctacttcatgatctccagccttcctaataaaatcctgaaagttctggtagagcaaccacagggtagtgagttccagggcagcctatttaggttcgggattgagacgtcagtgtttcctttctgctgatgccctccaggataatggtgagggggaggaggcgtggtggggccagtctgactgraactgacctacttagacttaatatttgtgcgtgacctctcttctctttctccaggggagatggccattccattctttacgggccgcctcactgactggattctacaagatggctcagccgataccttcactcgaaacttaactctcatgtccattctcaccatagccaggtctgggggctgaaaatggggcaccctgcaaatgagggagttggaagttggggctgctgtccgaaatgcacttatatggggatacctgggaccttcagtctgttccctgaacacaccctgatcccctttttttccgggttctttatagtgcagtgctggagttcgtgggtgacgggatctataacaacaccatgggccacgtgcacagccacttgcagggagaggtgtttggggctgtcctgcgccaggagacggagtttttccaacagaaccagacaggtttctcctgaaactctttcrttatacgccatgtactgttcatatcctcatacatctgctttgatctcccccctccccgctctctctctctcacacacacatacacacattgttccttctcattcttgatataccctctccctgtctctctctctctgtctctgtctctctctctctctctcwyacacacacacacacacaattgtttttctcattcttgatatacctcaggagcaaaatattgtcctccttaccttaagaaaaacctagagttttcatctagcattttcttataaatctattcctatgtatccttagatagaaaccatagaatttcaaacctggaaattttgagctcatagagaccarctgcctcatctgacagagaaggaaactgaggccaagacyctaaatgctgaaactgcacagttacatatggctagagacacacttggggttagaaccctggtctcttgagtgctccacagacttcggcatgctttctagcagcactagaagctgtacagttacatatggctagagatagacctggggttagaaccctagtcccagtgagtgctccacagactttggcatgcttcctagcagcaccctcctcctccatctctgttatgtgaccagtttaagctcttcctgcctgtgtgtatagcatgggacatacaggttctctagggaacagaaagctttcaggaaaatggaaattcacatgtgcattaatgactttataattaaaatgaaggtcaggcctttcctctttaacactcatcttccctgcactgagatttgcagacctctggagaaccctaaccttgtttcctgcagcctccttagaaccccatgttgacacccctgaccctggcatcctggctcattkttagttcgtctcatcacttggaacctgtctgattcacctcactctcttctccccaaccctgcaggtaacatcatgtctcgggtaacagaggacacgtccaccctgagtgattctctgagtgagaatctgagcttatttctgtggtacctggtgcgaggcctatgtctcttggggatcatgctctggggatcagtgtccctcaccatggtcaccctgrtcaccctgcctctgcttttccttctgcccaagaaggtgggaaaatggtaccaggtatgttcatggagttggcccgctctacacagaccctcatctyccagacttggcagactcagttcctctcacattgctttcagtccagctttcctggcacccttactgattctccatcttcatggaacaccctgtccctgtggtccatgttcccaggttgctcaacattaacctccatactctctgggtcttcttttctagcttctccccacaatctgtctttaagaatttgatccccaacccgttctgagtcattttcctcttcctygtatttctttagcatccaagkgscatagctgtgtctctttctcttttctccttttcctctgtctcttctcacctttaatttccaaataggtaactcaggtattagtgtccctgatggtttgccaacccgtgtgacatctcttgtccatgtatccacagttgctggaagtgcaggtgcgggaatctctggcaaagtccagccaggtggccattgaggytctgtcggccatgcctacagttcgaagctttgccaacgaggagggcgaagcccagaagtttagggaaaagctgcaagaaataaagacactcaaccagaaggaggctgtggcctatgcagtcaactcctggaccactagtgtgagcacctgaagatgaatacccattcccttgtccttaagatgccgtgactccattcccattccyrtgaccctgctcccactcctyctttactgggaaatggttggttcagtattttcgtcctagcaacctgaggctcaatgactctactcagtgtccctagccccctccctctctttaaagatgctaggtggcttcctttcagtatggtacataaaatccacccaaccatgtggattggagagatgcgtgtcttccagtcctagggccttcctttgcctctcaggggaagtgcmgggmgccataaattcttgcacctgggmctgcttcatgctggtaccttgtagatttgttagtgagagtgatgggaatagtggaagccagggatgagggacatctgtgatgcactggaaagagagctacgccagtgatccgaagatcctggcttgatgatgcaatttacttgtcttgtgatcatgacaacaaatttaccttctctgagactgtttcctctttatttatttatttgtttgtttgtttgtttatttttacttattattattatttttgagctggagtctcgctttgtcgcccaggctggagtgcagtggcgcgatctgggctcactgcaagctccgcctcccgggttcacrccgttctcccgcctcagcctcctgagtagctgggactacaggcacccgccaccacgcccggctaattttttttttttttttgtatttttagtagagacgaggtttctccgtgttagccaggatggtctcaatctcctgaccttgtgatccgcccacttcggcctcccaaagtgctggaattgcaggcatgagccactgcgcccgactggttgtttcctcatttttcaaaaatggagtgatataaccttctttataaggctcttcatgtattagctgacatcacatgaatgaaagccttttgtgaagagtaaaaygctccccagacaaggtgatagtggtgatggtggtgaagataactgtgacttgcatgatgtgcattgagtcagactccatggggtctctggttcattctcctgtctgcctattgagcctgccgatgtcacttrggagacagggacttgatatttccttyaggttaatgactryggttctttgtgtcccctccagatttctctacctcagtccctttttttgtggtctctttatagatttcaggtatgctgctgaaagtgggaatcctctacattggtgggcagctggtgaccagtggggctgtaagcagtgggaaccttgtcacatttgttctctaccagatgcagttcacccaggctktggaggtgaggtccctccaccttcactccccagtgtgattccttcctctggcccagcaccatctgtgtgatktccttccattctttacccttcttgcttcacataatgmtggcaagcagactacctcactttcactattcttacctccctctaggtactgctctccatctaccccagagtacagaaggctgtgggctcctcagagaaaatatttgagtacctggaccgcacccctcgctgcccacccagtggtctgttgactcccttacacttggagggccttgtccagttccaagatgtctcctttgcctacccaaaccgcccagatrtcttagtgctacaggtacaacctaccactccctgtattccactggccccaactgcaattctgccatcctaaattttcttcctgccttcagcctgcttactgccaagcatatatcctccctaaccctttaaaggcaatggtaggcatcatctgttccataaatcttccccaaactcaagaacccagtttgggcttccaaagagaatgagagaagaggtttcgaagagagtgctctcacgttccaaggaattgctgcagcaaaatctgtgtcttcggtcttccatctttccttttcctttgtaatttggaatgtgatttttccctttcctggtggtatctgacatcaagtgtgtggcatagtggtgctgggtctctgcccttgtctttgcygcttcttctatctctactccttgggraggcatcacccagaaatctgtgcatgtgggagggtaggagtttctrtatttccctgtttttsttctggggtaagacatcatgctrtgtaacaaggcartgacactctcaaggttagaggccttggtagcctcttatcgtgtgcttctctggcctctaggggctgacattcaccctacgccctggcgaggtgacggcgctggtgggacccaatgggtctgggaagagcacagtggctgccctgctgcagaatctgtaccagcccaccgggggacagctgctgttggatgggaagccccttccccaatatgagcaccgctacctgcacaggcaggtatggaagcaggtggcttgaaggagggcagggagcatcaaatacgaagagcattcttactgagcactctraaagaggggttagggaatgataagagaccttgggtggagatggtggtgtagtcaggagggaggtagtatgattttgtgacatgttctcaataaagattttgagtcttcgatctctagataaccatactcccatgtgccttgttctatgactcttcatcatatttcatctcaggtggctgcagtgggacaagagccacaggtatttggaagaagtcttcaagaaaatattgcctatggcctgacccagaagccaactatggaggaaatcacagctgctgcagtaaagtctggggcccatagtttcatctctggactccctcagggctatgacacaggtactctctccactcatctcaccacccagccatctttacctttgctgaaaccccagtagtcttgcctttatccttcagttcctccttactcatggacatcaatttgaagttgtaagatcatgctcctatggcttcttcatcctgacatcctcaggattctgttcatcttcccagaatctcccctatccagctacaaccgtcagatcttggtgtgtgtgagtgcgtgaatgcatgagtgtgtctgtgtgcatgtacatgcgtgcacacatgtggctataccgttctcatcttggccctttgctctgcagaggtagrcgaggctgggagccagctgtcagggggtcagcracaggcagtggcgttggcccgagcattgatccggaaaccgtgtgtacttatcctggatgatgccaccagtgccctggatgcaaacagccagttacaggtgaggcagtcatcttcttaatggctrtatcccacccaatcttgcttcttttatacatcttctgttagttttactaacatcataattatacaaaccagtccttgcagttctcagttcccaaatccagttccattggatgcctccccaaggagtagagatagaagacgaggcaaagacacctagaaycagttaaaagagactatctacaaactacagactgaatttctttctttctttccttttttttttttaagacagtgtctcactcagttgcccaggctggagcgcagtggcacaatcttggctcactgcagcttcaacctgctgggctcaagcgattctcccctcagcctcccgagtagctgggactacaggtgtacaccactatgcctggttgrcttttatatttttagtagagatgggtttcaccatgttgcccaggctggccttgaattcctgagctcaggtaatctgcccccctcagcctcccaaagggctggggttataggtgtgagccactgcgcccagtcctatagactgaatttctaaagcgaaacataaggaaaagaccatcctcataatatcgtttatttaaaaaaawtattttttgtacagacagcgtcccgctatgttgcccaggctggccttgaactcctgggcccaagtgatcctccctccttgacctcccaaagtgctaggattataggcatgagccacygggcccagcccatcctaatcatattaatattaattaagctagtctgtttacatgcactgtcactcatttattcattaggaatccttctgagctaggcatttatcatcattctacagatgacaaaatggaggttaaaagaggttgaataagctgctcatatagaggtcatatagcttttgagtggcgcagccttgacccaaattcaggtctgcctgacttgaatgctcatctctttactactaagttatatttccttaaaatckaatataaaaatkccaagtccatgggtagagaagaggactattcaatagtctttattcttctgtcacgtgtttcaccctagggttctcatttttatcctacttttgcayccttcatgtaaaacagtccttaatgaaacaaagggtttgcggagaagtactcagaatgggaaacgttggtgtccttggggttgttagcagagccagcagtgatcctgtgaggtcagtcccagccctggaaacacaggtgtctccctgggctgagggtagtccccggctctgacggtccgatgtctttcctcaggtggagcagctcctgtacgaaagccctgagcggtaytcccgctcagtgcttctcatcacccagcacctcagcctggtggagcaggctgaccacatcctctttctggaaggaggcgctatccgggaggggggaacccaccagcagctcatggagaaaaaggggtgctactgggccatggtgcaggctcctgcagatgctccagaatgaaagccttctcagacctgcgcactccatctccctcccttttcttctctctgtggtggagaaccacagctgcagagtakgcagctgcctccaggatgagttacttgaaatttgccttgagtgtgttacctcctttccaagctcytcgtgataatgcagacttcctggagtacaaacacaggatttgtaattccttastgtaacggagtttagagccagggctgatgctttggtgtggccagcactctgaaactgagaaatgttcagaatgtacggaaagatgatcagctattttcaacataactgaaggcatatgctggcccataaacaccctgtaggttcttgatatttataataaaattggtgttttgtactgtggtttcttatgtttccggcacaccaaacggcccactgccttttgcagcgcacttttcagctgcggrtgtctcctcttttatcatcctcaatgttttaccccctaactgcatcaccttttccctyaagctttttaattcctatgaggccccttccacttcccctatccccttaggcccacccccaagaatgtgcaagaccccagccacagggcccatcagggcactagcggccgcagctcagagccgtggcctctccgaagtggcagatggggcgggcgcggccagagcaagtgccaggcgggaacagagggactgggcgcgcctcacaactcaccacctcgcccgctggtccttcctggctcgcctggctctgaagctgcacctggaggggaaacctcararcagtaggcgggattgcctagtaaatatctcccattcagggaggcccaggtcrtgtgacgtcgacagttgctgggtagatgaggccaacacaggttgcaagaagaggcggggtttagaggcgtgaaactccgcagtgctcagccaagcagggagcaacgctaggaagggcgggcagaaagggcacgctcttgtgggtgactacaggttaggagaccgttgaacctggaggggccctaggatggaccccgtggaaagattcagagactgcgccctctccctggcgccgccttcccctacacgcggcgggtatattctgttgcagttggcccaggacctgtttccaagactctgccccctcgcacttccgtccctcctggttttgtaaagtgatgctcataggaacccccaccccgcgtgacactactcccagctcctggctgacttctagtcttctggttgaagctgcgcctttagatgacacgaccctacccacccctgtttccagcggatgcccgggcctggaggtacctcttactgtaacccatcgccaagtgggcttttgaaggcgcctgttcctttctcgctttcttcggaagacccttgacccatcattcccccgacccccataacgggagagcagagaagccggtccccagtgtgatggtcctggtccaggcactaactgtccttttctcggaaaaggcagggggatgtggaaaagagtcttgttccctccccttcgatctgtggctttcgctttcacttcctcctccgagagcggacagatctctgggtgctgggcggtcatggcgctactagatgtatgcggagccccccgagggcagcggccggaatcggctctcccggttgcgggaagcgggcgtcgctcggacccaggacactacagtttctctatgcgatctccagagctcgcyttaccccggggaatgmaggtcggggcagtagggaagcccctagggatgcagggaggcgggcgctgaggagtggagggtcgcctgagaggaggaggcgagagcgggagcgcggggkacagggtcgggggtagccttcagtcccggagagcgccagacccaaagaagaggccacatggggatggggcctgagaggaggaagtgcaagttaggacaaagagttacaggtgaggtgggggctcccaaaggaagacaagagaacttycctgcccttgtccacacacaaatggtggagcctttttcatggggttatcacatgatataggaggtgtgtggtgtcttgggaaacctatgaaatttgcctgctggcctcctctcagcaactcactgttgcgcgacttagaacaagtcacttagtctaggtcccaagcccctcttctgtaaagtgaggatactgttactaaacgtgttttgtgagggttgaatgctttatgcatggaagaaaccctttaagtcactctcaaaattttttagtaatggtaacatgtgcttgctttcatttctgttgtgctggaaaatggaaaaggttgatactggcatgcctcttcttttccttctcccaagccatttccttctagagattggttattaactgtttcatttattgatggttagatcatttctgcatatctcctcaccctcatactccctaaaaccttttcctggagcctcttactacagaatttttcattgcctttctcaacctcttttctcttatcagcccacagaattcttccagtccctgggtggggacggagaaaggaacgttcagattgagatggcccatggcaccaccacgctcgccttcaagttccagcatggagtgattgcagcagtggattctcgggcctcagctgggtcctacattagtgagtgtatacgctccagcaggcagaatctggggagctgggctctcctttccacaggaggccaactctgcaacaaagtggaagtggatattgatttaggacacactgggggatctatggggtcatcccttctctcccaaagctccatcttcttccaggtgccttacgggtgaacaaggtgattgagattaacccttacctgcttggcaccatgtctggctgtgcagcagactgtcagtactgggagcgcctgctggccaaggaatgcaggtaagygaggcctctcatcttcctttcttagcctagtggttaatccctggatctctcagatcattgctccttactcttgtcctatgtggtccatcttagtgctaatagtatatttcacaaaacagctttytggtgataagacccttctcccaaatctcagcctgtgctccactcataagccagatagtacgtcaggtatttagcactgacacatccaccctggcgggacagtatcatttactaggctgcctttgtatgtttcagatactttaaattccaaatctttctctgatctttagatmctacaaaataattcctttccaaygcttatctctttaatcatttcctgccccatcaagttggaaagagctaacctctctttcctcactccaccttgtcctcacccaggctgtactatctgcgaaatggagaacgtatttcagtgtcggcagcctccaagctgctgtccaacatgatgtgccagtaccggggcatgggcctctctatgggcagtatgatctgtggctgggataagaaggtgggtgctctccattcttcatgytcccccaccatgttccctatggatgacagatctgtttcycatcatatactcctactccctccctgacaagatgcatggcatatagagtgcttggttatagaactgtttcagtatatccatggactatttattggcccagatatgaatcattgcatgtgttttgtaagcttgtcccttttgttaaacagttgatttcaagtttgtttttcctttttcatttctaaagttcgatgactttaccaaagtggtttcctaattccaatgttcttgtggtaatattaattcttttgttcactttttatgtmtcatatttgaaccyccatgttaccaacatcttcctctccaatttcagcctgaaatctttcatcttatagggtcctggactctactacgtggatgaacatgggactcggctctcaggaaatatgttctccacgggtagtgggaacacttatgcctacggggtcatggacagtggctatcggcctaatcttagccctgaagaggcctatgaccttggccgcagggctattgcttatgccactcacagagacagctattctggaggcgttgtcaatagtaagagaccaatgctcccaccaccatgcctgggaggagtcggcgggtggtggggggggtgatttaagattgagaaaccagcctkgccaacatggcgaaaccccgtctctactaaaactacaaaaattagccggacgtggtgacgggtgcctgtagtcccagctacttgggaggctgaggcaggagaatcacttgaacctgggaggtggagcttgcagtgagccaagatggygccactgcattccagtctgggccacagagtgagactccttctcaaaagaaaaaaaagaaaatgattgagagactcaaaggagggagagtagtagggaggaaattttcagagtcagaagaagggcattaaaggcccagtcatatggttttaagcttgcgcatgtgtcttgttgctgccttcaacataacatcagtgacaggaacttgctgaggtgaaaggtgactccatgttcttttctcatttgtccacagtgtaccacatgaaggaagatggttgggtgaaagtagaaagtacagatgtcagtgacctgctgcaccagtaccgggaagccaatcaataatggtggtggtggcagctgggcaggtctcctctgggaggtyttggccgactcagggacctaagccacgttaagtccaaggagaagaagaggcctagcctgagccaaagagagagtacgggctcagcagccagaggaggccggtgaagtgcatcttctgcgtgttctctatttgaacaagcatttcccccagggaagtttctgggtgccccactaagtagaataaagaaaaacggttataaatacctctgtcttgtggctgaatggggttgggcctgtggttgttgggtggggcagaaagtaaagagacgctttttctggagaaggggctcagacccctatctaagaaatgtggcctcaccacatagttcttcctggggtttccttccacactcatctctccaagacctcaggaaggctgctcattgctgtccatggacacttgtttgcaatttcacataggttagggtcctttccatagagaggcacctggggactcctgtgtgytccattgttaatggtttgaggaacagggagtagggcacctaggataactgtttttgactttatagagtaggatgaaaaagcttccacttcactttaatatggtaatcatataaacaccataccatttatcccaaataacactttggagatattggatattgaatataaagacagacattaagggtctaatttcatgatgtgtcatgctgaattgcaagatggcaggactataattttagaggaagaagagatcaggaggactcccctaagtgaggagtgtggggaaaatgtaaaagatccaggttagaagaaagagacacacatcatgagattttcggaatcatgctggaactatggaccatgtcactttccagaaaataaaggaaacaaatgcttgaaagtaggagcatgagcttgagcatggagcttttttcattagagagagattcttaaaatgccagaatgaatagagttgtaaaactttagcgagcccctacttaaaatccctcctccccaccaccactattttaaactttaagtgactccttggtagtcacacaggtaacatttcaaaatggtgatctggaatccaagcgacccttcctttggggaatttgtttgtttgtttgtttttagtttgggaggtggtttcaatctgaagagtcctttctggaataaacgaatctttctgttgcataggaaggctctgggwcaggaaggatatttaaaaacctaattactgttctaaacagtgttaaaatagaacaagaaccaaagcycagtacsgggcatttccctcataggctgaaggtgcgcccaacataatttggagtacagactcagaggcacctgaacacgcgccagctcaaggtgctccggctgagaaggacggatgaagatgaacgctcagggcctactaaattcaaagtctgtacgtgaaaatcccctttggcctggtgagattggttggaaccttctatttaggagagcccggctcgctcgcctaaaactggagcttgcatggaagagggcactttttttttttttagacgaagtctcactcttgtcgcccaggctggagtgcaatgacccgatctcggctcactgaaacctctgcctcctgagttcaagcgattcccctgcctcagcctcccgagtagctgggattacaggcgtccgccaccacgccctggctaatttttgtatttttagtagagacagggtttcaccatgttggccaggctg

SEQ ID NO: 13223 - DNA, 18540 bp, Homo sapiens
gtcattgccttgttacatagcatgatgtcttaccccagaagaaaaacagggaaatatagaaactcctaccctcccacatgcacagatttctgggtgatgcctycccaaggagtagagatagaagaagcrgcaaagacaagggcagagacccagcaccactatgccacacacttgatgtcagataccaccaggaaagggaaaaatcacattccaaattacaaaggaaaaggaaagatggaagaccgaagacacagattttgctgcagcaattccttggaacgtgagagcactctcttcgaaacctcttctctcattctctttggaagcccaaactgggttcttgagtttggggaagatttatggaacagatgatgcctaccattgcctttaaagggttagggaggatatatgcttggcagtaagcaggctgaaggcaggaagaaaatttaggatggcagaattgcagttggggccagtggaatacagggagtggtaggttgtacctgtagcactaagayatctgggcggtttgggtaggcaaaggagacatcttggaactggacaaggccctccaagtgtaagggagtcaacagaccactgggtgggcagcgaggggtgcggtccaggtactcaaatattttctctgaggagcccacagccttctgtactctggggtagatggagagcagtacctagagggaggtaagaatagtgaaagtgaggtagtctgcttgccakcattatgtgaagcaagaagggtaaagaatggaaggamatcacacagatggtgctgggccagaggaaggaatcacactggggagtgaaggtggagggacctcacctccamagcctgggtgaactgcatctggtagagaacaaatgtgacaaggttcccactgcttacagccccactggtcaccagctgcccaccaatgtagaggattcccactttcagcagcatacctgaaatctataaagagaccacaaaaaaagggactgaggtagagaaatctggaggggacacaaagaaccryagtcattaacctraaggaaatatcaagtccctgtctccyaagtgacatcggcaggctcaataggcagacaggagaatgaaccagagaccccatggagtctgactcaatgcacatcatgcaagtcacagttatcttcaccaccatcaccactatcaccttgtctggggagcrttttactcttcacaaaaggctttcattcatgtgatgtcagctaatacatgaagagccttataaagaaggttatatcactccatttttgaaaaatgaggaaacaaccagtcgggcgcagtggctcatgcctgcaattccagcactttgggaggccgaagtgggcggatcacaaggtcaggagattgagaccatcctggctaacacggagaaacctcgtctctactaaaaatacaaaaaaaaaaaaaaaattagccgggcgtggtggcgggtgcctgtagtcccagctactcaggaggctgaggcgggagaacggygtgaacccgggaggcggagcttgcagtgagcccagatcgcgccactgcactccagcctgggcgacaaagcgagactccagctcaaaaataataataataagtaaaaataaacaaacaaacaaacaaataaataaataaagaggaaacagtctcagagaaggtaaatttgttgtcatgatcacaagacaagtaaattgcatcatcaagccaggatcttcggatcactggcgtagctctctttccagtgcatcacagatgtccctcatccctggcttccactattcccatcactctcactaacaaatctacaaggtaccagcatgaagcagkcccaggtgcaagaatttatggckccckgcacttcccctgagaggcaaaggaaggccctaggactggaagacacgcatctctccaatccacatggttgggtggattttatgtaccatactgaaaggaagccacctagcatctttaaagagagggagggggctagggacactgagtagagtcattgagcctcaggttgctaggacgaaaatactgaaccaaccatttcccagtaaagraggagtgggagcagggtcayrggaatgggaatggagtcacggcatcttaaggacaagggaatgggtattcatcttcaggtgctcacactagtggtccaggagttgactgcataggccacagcctccttctggttgagtgtctttatttcttgcagcttttccctaaacttctgggcttcgccctcctcgttggcaaagcttcgaactgtaggcatggccgacagarcctcaatggccacctggctggactttgccagagattcccgcacctgcacttccagcaactgtggatacatggacaagagatgtcacacgggttggcaaaccatcagggacactaatacctgagttacctatttggaaattaaaggtgagaagagacagaggaaaaggagaaaagagaaagagacacagctatgscmcttggatgctaaagaaatacraggaagaggaaaatgactcagaacgggttggggatcaaattcttaaagacagattgtggggagaagctagaaaagaagacccagagagtatggaggttaatgttgagcaacctgggaacatggaccacagggacagggtgttccatgaagatggagaatcagtaagggtgccaggaaagctggactgaaagcaatgtgagaggaactgagtctgccaagtctggragatgagggtctgtgtagagcgggccaactccatgaacatacctggtaccattttcccaccttcttgggcagaaggaaaagcagaggcagggtgaycagggtgaccatggtgagggacactgatccccagagcatgatccccaagagacataggcctcgcaccaggtaccacagaaataagctcagattctcactcagagaatcactcagggtggacgtgtcctctgttacccgagacatgatgttacctgcagggttggggagaagagagtgaggtgaatcagacaggttccaagtgatgagacgaactaamaatgagccaggatgccagggtcaggggtgtcaacatggggttctaaggaggctgcaggaaacaaggttagggttctccagaggtctgcaaatctcagtgcagggaagatgagtgttaaagaggaaaggcctgaccttcattttaattataaagtcattaatgcacatgtgaatttccattttcctgaaagctttctgttccctagagaacctgtatgtcccatgctatacacacaggcaggaagagcttaaactggtcacataacagagatggaggaggagggtgctgctaggaagcatgccaaagtctgtggagcactcactgggactagggttctaaccccaggtctatctctagccatatgtaactgtacagcttctagtgctgctagaaagcatgccgaagtctgtggagcactcaagagaccagggttctaaccccaagtgtgtctctagccatatgtaactgtgcagtttcagcatttagrgtcttggcctcagtttccttctctgtcagatgaggcagytggtctctatgagctcaaaatttccaggtttgaaattctatggtttctatctaaggatacataggaatagatttataagaaaatgctagatgaaaactctaggtttttcttaaggtaaggaggacaatattttgctcctgaggtatatcaagaatgagaaaaacaattgtgtgtgtgtgtgtgtrwgagagagagagagagagacagagacagagagagagagacagggagagggtatatcaagaatgagaaggaacaatgtgtgtatgtgtgtgtgagagagagagagcggggaggggggagatcaaagcagatgtatgaggatatgaacagtacatggcgtataaygaaagagtttcaggagaaacctgtctggttctgttggaaaaactccgtctcctggcgcaggacagccccaaacacctctccctgcaagtggctgtgcacgtggcccatggtgttgttatagatcccgtcacccacgaactccagcactgcactataaagaacccggaaaaaaaggggatcagggtgtgttcagggaacagactgaaggtcccaggtatccccatataagtgcatttcggacagcagccccaacttccaactccctcatttgcagggtgccccattttcagcccccagacctggctatggtgagaatggacatgagagttaagtttcgagtgaaggtatcggctgagccatcttgtagaatccagtcagtgaggcggcccgtaaagaatggaatggccatctcccctggagaaagagaagagaggtcacgcacaaatattaagtctaagtaggtcagttycagtcagactggccccaccacgcctcctccccctcaccattatcctggagggcatcagcagaaaggaaacactgacgtctcaatcccgaacctaaataggctgccctggaactcactaccctgtggttgctctaccagaactttcaggattttattaggaaggctggagatcatgaagtagaaaagcctcctgttagagatgaggatgccccgcccttcggccccagagcaaaggatttccccgcttccggcgtggcccaaagaatcaagacccggtcagcaatggagcccagaacctctggcccccgccagtccagtgccgtttcttctacaccgaagtggtgttccaagacccacgctaggagtccttctccygctccacatttcccagaacccacgctactctaccttactgacaattacctttgattcctgtcccagtccccttgtgtcctcccctcttgccctgcgttccccttaccaagagaggagaggaccaccaggaccaggaacagcgagaggcggcgcgtctccgagcccaggcagcctagaagccgacgcacagggtttccagagccgccctgaccgccgggcacccagaggctcccgagtttgtgccacagggctgctgcgggcagtgccgctgcataactgacaacgaaggcggtagggtgacttccccagtgcagtagcctggtgctatccgcggacccgggggctccccatgagatcagctctcggaacaaggcaastcccggcagggccaagcccagtgccgcagctaatggcttcaaagcagccagccagccctgggcacctgcgttttcgctcttggagccamccgttgccctgaggaccccgcaggcccccagccagagcacggcccagcggctcaggcccaccgcccagacccggagcagtggcagcgcggtgggcaccagcagggagaatatgcggggcagcgcggtccggagcagcacccagtcggcgagaagtagcagtactgtccccagccatgcgagagaagctcsggggaggcagcggcacccgcggggagcgggacacctagagctagccattggcactcggacgccgtccyggtcccggccgggyctgggactctccgcgccccggtggggcctgaagctccgggtaccgccgagtcctcccctactggcggctgggggagggaacgagggcggggctctcggaaagtcccaggaacaggctgatcctgcgctggcgagmagctcagccatttaggggaaagcgaaatcgaaagcggccgcctgctcactagataacgcctacttccaaaagtggcctgcccagactattttggtagcaagcgtggaaatcagatctgagaatctcgggagcagccctggtgcccaattttctccatcacgcacacccttctcgcctctccctgcctcctgcctttccacttgcaccagttttcccaccccagcctcagggcggggctgcctcgtcacttgtctcggggcagatctgccctacacamgttagcgcmgcgcgcaaagcagccccgcagcacccaggcgcctcctggcggcgccgcgaaggggcggggctgtcggctgcgcgttgtgcgctgtcccaggttggaaaccagtgccccaggcggcgaggagagcggtgccttgcagggatgctgcgggcgggagcaccaaccgrggacttaccccgggcgggagaagtccacaccggggtaatgggtctgggcttgagggttggcagaggggtggaggagatgcagcggccaggggaccctggaagcgcgcgcggagaagtgaatgcagagaccaacgggagcgcagggaggtcgcckgtagcagccagcgcttgcaacccgcaatgagcatagagtatttcttttctgagggggktcgtctagagtgtccgtgaagggamcaggcacgcgaggctggtggaaaaagsgggtgctttgactcttagctggaagcgtcaacgggaagctactctaaagcgctttcgctttcactctggtcccggacagtgggggctggttaaatcaagaaagggggttggggatggtgcaaagagatgaggaaatggtgccctgggtgaagtagaacagcacttgggagaaggaaatataggcacttattgagaaggaccaactcatcacacagacttttgataaacttgccactgggcaactcttagcccaagcactgataatgggcgttctgtgttaactagtgatgcccttccctagcttgacccaggaaggcctctccttggcccagatgctgccttactcccttccctgtgtcttccctgcccactcccatgtgcccactggggggactttgcttargatgggcgcctggggcagatggcagccccaagactggctggctggcttctgctctggactactgccaccactcgtggcttgggggcggctttgttagagaggaatagcctctaacttgaagttaaccctgttctttgaccctctattcatgataagtckgtccgtcggaaagcatactcagaggagcgtcctttggggccagagtaayttacggcctggtaagaaagacacagtgaaaccacttataatttgggaaatctcccctcactgccaaawgagcagtggcaagtaggaagtagaagtggaaacaagggataagagttagacctgaattttagtcccaggtctactattaactctgtgtgactttgcataagtcgtttgcattttctgtgacttggtttcctcatttgaaccgaggatctttaaggctccttccaactcaatagtagaataaatgtagctttatcttccctcacttcttcttgattcttttcttgacctggaaaagtcagcttaaacttctcagtcaaattatctcttggtacaaatttaccyccctggctgctgagatatgtatttacctcttgatcggaaattccataactgaaacttttattttcaaccatctgtatgtgttccttgctgcttctctcctgccttgcccctggccatgctaaccactgccctcctygattttttccaatgttcagtaaattggaagagctcacttctgatgaaatggggggtgagagtggaggattgtggaccaaaaaaaaaaaaatagactgaccttgtttcccaagatcatagtcaattactctgtgttgggtctacaccacatctgcacatactatgagcccttccrttggagataattttcacttgcggagctgcttcacttctacctgtaggagcctcatctccacctctctacagtggagaggattccactaggcaagttggaacttagggacacagttctttctgtgttgtatcacagctgggctgtggcattcccctgcagccggatgaagcaatagagaaagtggaaagatgaagggaaaaaaagcctgtactgacagtcagctctggcctgttactgtgtaatctttgagccagtcacttcgcctctctgggaatgtttcttcttctctaacatgagggcatcaaggctgttcttgccctgacattccatattctgtgtctctgcagaccaccatcatggcagtggagtttgacgggggcrttgtgatgggttctgattcccgagtgtctgcagggtgagtaaaagtgaagatgtatgcatttggaaagaagctaatggcctcaaatacacactttccttacccattcatgaaaagactggcaaactggagccttggaggaatggagttgaccttccccaaaagccactatgataagctatttggtgggtgcttgggtctctgaatttgtggaggaggatctggggtctgaatgtgtatrtgacctgtcccagtagtgtacagggatgagtaaaggaatagggtctgagagggggacaggagatagatttttgagggtcttctttccatctgtgcttagggatcaaaaagatgattctgtcaagcagatayctggtttctcatttaccatatattgaactattttgtctcttctcccactcctaaccaatttcctcacatgcaaaatgagtatatggggttaggtcaatattactgacattatgttccatagaacataactctctcaagattgttaatagcaaagaaaattgatgaggcatatttttcttaccttagcattttttgctttgttataaaatctaagcctgaaaaataagcctaattttgattaacatctgcagtgattaataatatctgagatgattatttgcctcctgctttaatccaagcattaaacttcatgctattctcttgtcaaagaaatttgagagacattgaatgatcmccctcaaaaattcctgagttctggttgggtgcagtggctcacatctataatctcagcactttgggatgccgaggtgggcagatatttgaggtcaggagtttgagaccagcctggccaacatgttgggaccttgtctctactgaaaatacaaacattagctgggcttggtggtgggtgcctgtaatcccagctattcgggaggctgaggcaggagaatcacttgaaccagggaggcgaagtttgcagtgagcccaagattgatccactgcactccagcctgggtgacagagtgagactgtctcaaaaaaaaaaaaaaaaaarmaaacctgagttttaacttggtgactgttgactccctcctgacagcgaggcggtggtgaaccgagtgtttgacaagctgtccccgctgcacgagcrcatctactgtgcactctctggttcagctgctgatgcccaagccgtggccgacatggccgcctaccagctggagctccatgggtatgaagctctggagttctgactccccacccactagagctcccccaacctgcatgaatccctgtacagtgtgctgttccaggagctggacactgggaaatggaaaagtcttgtttcggctcttgctggcacttgaatctgtcagtttctgcatctgtaaagtggagataatatagyacctcatgagacggttattttgagaaccacrttctatatgtgaacacagtttaaaagctgtaaatcactatcctgatataaataatcaggaagaaggtgatattgtgacccaccataatatcaggcagttaccatacgagaaatcaaggtcgttgggayggaagtaaccttatctgcttttccccataagagcagggtccttgcagccaaaagaaagttatgtgggtggggctgagcaaaagagtgagcaattgaaagcttcttaccagttggtggtgtgggactctggttcccctgtacatgtgggagggaggctgcagtttgagctattgcagttacagttttcaggggtcgtttagcagggatgatggtaacagtataggagaatgagacttaaaattctatcaacctttattcctaatatttccctcaggatagaactggaggaacctccacttgttttggctgctgcaaatgtggtgagaaatatcagctataaatatcgagaggacttgtctgcacatctcatggtagctggctgggaccaacgtgaaggaggtcaggtgagtttctcccaaagcactctctcctctgggcttccccactctcctgcagaggaagatggaagtcctatgtcattctagcaatgagttccaaggacactacctctgaaagcatagtactttggggatatgagataccagggcttcattgcagggtgcagagaccacttaatgtctcagtgggaaggaagggcttgatgawtctttaacctgaggatccctttcccaggtatatggaaccctgggaggaatgctgactcgacagccttttgccattggtggctccggcagcacctttatctatggttatgtggatgcagcrtataagccaggcatgtctcccgaggagtgcaggcgcttcaccacagacggtaaccagccaagtggaagggtacctggggagggctttgaaacatgggaaggaagtagattatgaggaacaggaagagaaatacaggggtggccatttaagttaatgccgggcctggtacacttttaagagtgaaaaggggcaggacaaatgcaaagctcaatggggytcttgggcaatacggataaaccagggctgttctgagtaaatcaaatgaggatacacagtcactgtgagaaccagtggtgtgctaagcacagtggctcacacckgtaatgccaacaatttgggaggctgaggcaggaggattacttgagcccaggagtttgaggccagcctaggcaagatggtgaaaccctgtctccacaaaaaacaataaaaaaaagtaaaaaaaaaaatgaactgggcatagtggtgcacacctgtagtcccagctactcaggaggctgaggtggaaagatcatytgagccggggagatcaaggctgtagtgagcggtgattgcaccactgcgctgcagcctaggtgacagagagagaccctgtctggagaaaaaaaaaaaaaaaaagaaccagtggtgtgctgaggtgtgctgaggctggcttgggaccactcatgagagcggactgttaaatagtcaaggatttgtgaactgcttagctatttgtaacttgcaattcatcatagcgggagcatttacaccayggacatcagcagatgccacatatggaagcctttttgtaaaaaaactgatttaccagcacaccactaaatatgccttcctggaagatgagttttgaggtgaaagtggtagtaggcatatggatggagggggagtaaaaagatttttgaagctaagccatcctctctctccctctctccaacttgaaaccctctgcagctattgctctggccatgagccgggatggctcaagcgggggtgtcatctacctggtcactattacagctgccggtgtggaccatcgagtcatcttgggcaatgaactgccaaaattctatgatgagtgaaccttccccagacttctctttcttattttgtaataaactctctaggrccaaaacctggtatggtcattgggaaatgagtgctcagggagatggagcttaggggaggtgggtgcttccctcctagatgtcagcatacactctttcttcttttgtcccaggtctaaaacatctttcctagagaaaacaaaagggactaaactagaaatataaagagccctatacatgacaggtgatcacgtactgaatgattttgaagtagtacaaacaataaaaattctcattccgcatcatcatgcggtccatgatgatgaggccgcaagtgaggtgatgggactctttcctttaaggctaagactgacagataggcaagacacctacacacatgagaattagctaagactatcagcaaactcgcatgtaaaagaattcctttcataatgcattcattcatattaaagggcaatacatgaaaaatgcttaaatattttggggcacttgtgaatttcaaagaataatgacaataaccaaaagaagctacatttgtggcattggctaaatgttttataaattttatctcttaaaattcaaaccaaaaaaccccctgtaytcacacctgtaatcccagcactttgggaggtcaaggcgggaggattgcttgagcccaggagttagtgaccagcctgggcaacatagtgagaaccccatctctacaaaaaaatttaaaaattagtcgggtgcggtggtgcatgcctgtagtcccagctgcctgggaggctgagtgggaggatcgcttaggcctgggagtttgaggctacagtgagctgtgattgcgccactgcactctagygtgggtgacagagaaagamcctatcttaagaaaaaaaaaagaaaagaaaaagaaaaaacaaacaaaaaaaacacccaaccctatataggtaktattattacttctataggacacatagaggtttggaaagattaaatcacttgaccaaggtcacaaaataagttctgaggctgggatctgggattcagtcttattatatgcccttcctctaccactccctaaaacttctcattccctcaatccccatatatcatcttaaaatctgcaataaatagccccatacattcgttggcacttaggaaactgttaccagatggctgagtaactgtattaaaacaaatttaattctgcttctatctttgccttgcacttcctgagtgacaggagtgaactctcatatccttttctgtcaaaagatggtgctgaatgatttctaaggtagtttacagttccaacattcaatgccattttgctaacaagtgggcagtcaacaggcatattcaacagaaatactagtaggatctcaggctaaacataygaattcaaaactctaaaacaatcacatccccctggagtgtaaagaaaaaaatctaaaattacaaatgcctggagttgtttctagccatgatatttaacttatttgagattttaaatagcccatttttcccactgatcacaagtagaaattctgggcagtatacaaaaagcaagtactcaaggactccaaaaagtaaacaaaagcaggtggattgtgaagagggtcaaaactgggagaggggcccctcctggggagtgggttttcaatgttttccccytttttcctcccagctctgccctgacgtcaggcctcaggtgcagagctgcactgcgtggtagcacaagccctgagttaacaagagaaataccggctttctggccagaggaatgaagaaaaagggcccctgcrggcaggaatgtgtaggggaatctccaaactgagagtacaggcggaaattccctaattctgagtctgaaccctcaggagtaccaggttacccctgagctgcacatgcgtgtgacatgccttaagggcacagcaaagactttgagaactgaatgaagattagatcttttaaaattrgaagacttcggccaggcgcggtggctcrtgcctgtaattccagmactttgggaggccaaggcgggtggttcacctgaggtcaggagttcgtgaccagtctggccaacatggtgaaacctcatctctacttaaaatacaaaaattagctgggcrtggtgcctgtaatcccagctactcgggaggctgaggcagggagaatcgcttgaacccgggaggcaaaggtggcagtgagccaagattgcgccattgcactccacctggrcgacaagagagaaattccatctcaaaaaaaaaaaaaaaaaaaaaattagaagacttcatttttctgtattggccaaataactgttctaatgcccttcattccaataaaaggtttgtagcagcttacagagataatttaaaacaatttttaaaagaagaaaacaacactgggtcaragagaaaatatggttaagaaaagtaagtgaagccaaggagtgaaactaatggaaactaatggacaacgtgaatatcttaaaaaaaaaaaaaagtggtgcgctgtcttatactggctagcaagagcagaytgcaaagtattcaggatttttgaagacagttgttaactattggtaacttgatattgaccactatggaagtatttatactatagaaatcagcaatgctacaagtcagaagcattgtttttcttcagagagccggtttaacaggacacatatttatcagccaactataaatrgataaaaaataattggctccrggccataggatagtgaaagcaaagaaggaaataaaatgaggtacaagattcataaaattcattttttaaaagttgccagaaaaccaaaaattatatataatagttcaagccacacagaacatttactcaaataggacatgcatcattccataaaggtaacgccaataaattccagagtatcggtatcttagaaactatctatattctaggccaggagcagtggctcaygcctgtaatcccaacattttgggaggtcaaggtgggcagatccctagagcccaggagtttgagaccagcctgggcaacatggcaaaaccccgtctctacaaaaaatttagctggatggggtgcacctgtaatcccaactagtcagaaggctagaygggaggatcgcttgaacccaggaggcagaggttgcagtgagctgagattgtgccactgccctccagcctgggcaacagagtaagacactgtcttaaaaaaaaaaaaaraaaaararaaagaaagaaagaaactatattctgcaaccatactgtaataaaattagaacttgataactaaaatatacttaaaattgtaagtgaacaaatatatttatcagtaacatggatttaaaaggcagtcgtggatgggagcatcgctggagtccaraaratggaggctgcagtgaggcatgattgcgtcactgcactccagcctcagcaatagagtgggaccctgtgtcaaataaataaacagcagttataaagaaaattaactcttttagaaccaggtgttaaaaatgttacacataaaatatacatataaaataatattataatttcaaatacatttattagaacaagaaaagttaaaataaaggacctaraaattctactcaaaaatttggaaaaagagaagttgagcaaacctaaagaaatacgaagaaaaggagttataaagataagaatagaaagcaatgaaacagaaatagagaacaaaaaactaggtagtgaaaattaacatacttttgattccaaaagctgcttacttaaaaatatttgtaagatattcagagttacaacaaggccgattatggataaagggagaaaaaatgaataaacaaatacataatgaaaaagggggaacagctacagatatgacacagatataaagcatagagtgttatgaacaagtatatgctaataaatttgaaaacctaggtgagatawgcaaattcctagaaacatttaatctatcaaaattagcacaaaaagaaatacaaaacttgactataccaatgagtattaaagcaatttttaaagttatcaatggcatctaataaaaaaatatatttttgaaaatgcccagatggtttcacagatgagttctatcaaacattcaaggaacatgaaacttctatattatatactttttccagaaaayagaaaaaaactaaacctgattagctaattttatcagccgagtgtaatcttgactccaaattgagttgtggaaaactcaaggaaaaaaaaataatagacccatttcaccttgaacacagatgggagaaaaaaataattatttatgaaccgaattcaacaatattacaaataataatactgggaggccgaggtgggaggatygcctgaggccaggagttcaagaccagcattgtcaacatactgagatcctgtgagatcctgtctctacaaaaaattaaaaaattagccaggtgtgrtggtgagcacctgtagtctcagctactagggaggctgaggcaggaagatcatttgagcccaggagtttgaggctgcagtaagctatgattgcaccactgcatttcggcctgtgcaacagagcaaggccctgtctctaaaaatatgtataataataacaataataataatgattatgctaataatgatacatcaagatcaaatagggaatccttggaatactagggtggttcaatataataaaacatattgttgctataatttaccatattcatagaraagtcatttcctttgctcagtctattaataaaagacatttggtaaagtatatccatttgtgatttttgaaaaacagttaaggaagcaggaatcaaaactttcctattttggcaaaggttataatccaaaaaatctgtaaccactagtatacataacggaaaaaccttgggtatccaagacaagaatgttcactataattactagcttatcatagcactaaarmctatgggcaacataacaagaccccatttaccaaaaataaatttaaaacattttaattagctggcatggtggcatgcacctgtagtcctacctacttgggaggccaaggcaggaagattgcttgagcccaggagtttgagcttaytgtgagctgtgatcacaccactgcactccagcctgggtgacaaaggaagaccgtatttctaaaaaataaaaaatacaaatacaactacaaactagcactagaccaacagtgactatgtaccatgaactgaggaatattattaattccaccatttgcatctgaggttaacaatatgtcaatgacttaaataacatcatatctctgagagtaatttctcctatatttccatgacaaatgttagataattttccattttttccattcaayaaaataaacaggaaatataattaaagagttcaattgaggattgggatttagaaaggaaggcaggaattaagaataatccttagttctcttcctaatttgcacctctctcactgatacayatgtattattttctttttatgtcttttagartctaataaacatgttttatattatataacaaactagaatatatggattatctttggtcttccttaccaagttcttaactctgctggctctggggcactggacataccatgtaagaagaaaaatgttttaactccattgaacttattcagaagcatcggaaattggttcagcaatattcaactttgcccagcaatgtttatgaaagtttcatatatagtatagtataagtatgtgtaatacagaatttatgttctcaaaaatgaagagataaagtatggagattctaaactctgttgacatagaagagggtggatttctcgaagaaacagccttctatagaaagtggcttgtatgagtcgggattctccagagaagcagaaccaataggatgttggcagagagagatttattttaagtaattggctcatactactgtggragctggcacggtcgaaatctgcaggtaggctggagacccrggaagagctgatgttgcggcttgagtctgaaggtggtccagaggcagaattccctcttccttggaggacmtcagtctttgcccctaagaccttcaactgattggaagggccacttacattatggagggtaatctgctttacccaaaatctattgatttaaatgtaaatctcatctaaaaaataccttcactgcaatatctagactggtattcaaatgtctagaaaccatagcctagccaagttaacacataaaattaactatcacttggctcaaggtgaaacttccagatcaatgtggcaggagtgttgaggaaggaagtgaactcggttctaaccaagtaggacagccraatcatcactgaagtgtggcactggcctttcgccaaggtaacatgtggcaaggttttaggttaggataggtaccaggcaaaagctgggtgactcgatggaggcttttgtgccaaccttcaragactggctgcgtcagactgccctcaagagcatacaaaggaaaaaaagacaaattaaaagcctttaatccaaactcaagacatgaatgaaaaactgtaaatgcctctatagcagttttaaaggctatcttttctcctgcaacccagcacagatatggctgagggtcaagcccgggggcttatgataaaggttatgaagttgtagaaatgtttgttgcatcatccaacagcagctgttgtgataaggcaagacccctggttgggatagaccggaccctgagatatgaaatagggacatatgagcagacacagagaagtctgagtgagaactatgaatcaccgcaccccctgagggtccttgctggaagaagcagactcaccgtattagttacctattgccatgtaatgaatgacacccgcttaaaataacagacatttactataaggtgttactgggacaatrggggattttttaatatggattgtgtgtttgataatatggtatcaattttaagtatcttgggggtgatgacagtattagggttttgcaggagaaatgtccttattcttaaattatacatgacaaaatatttaggggtcaagtggcataatttccacagattactctcaaattgtttaacaaaatggttcttcaacagtaaatggataaacaaaacgtagtctattcgtgcaacacagtac

SEQ ID NO: 13224 - DNA, 28786 bp, Homo sapiens
  misc_feature (1)...(28786): n = A,T,C or G, or insertion/deletion polymorphism (see Tables 1-2)
tatgaatataaaaaggaagaaggtaagaggtcaaaggaaggacatatggggaagaagaaggagcaacaccataaaggaaataatacagagcagatgagcagttataaaaagaaaggagcaaagaacaaaatgaaaagtttatcactgataagtcaagctgcttcctggtctttgaaagtctgggcatcctgaccctacacaatagtaatagtaacaatgacagctaacatttgttgagcacttacttgtgccaggcatccttctaaatactttacatatttcastcgctgaattgtcacaataaccctatgaagcaaatacatatcatacattttacaggtaaggaaatgcagggaagttacatattaataacttgctaaggtcatacggctactggcggaactagtagagaggttttctctcccattaagatcttaatttttctatgacacagatgtaaaattgtttttagagtcatgggggtgggggaatggacattttctttttcttattatagaaaaggtagaaaaaaatacaaaattgagaggaagaagaaaatatccttcaaattttagggctcttgacagttttaaagtttctgtcttagtttatgaacatgaaamtgtagaatgtatagctttgttgataatatttttcatttggggcatataaattcaaaagtacagtacagttattttggcatttgttccaaacttttgtttcctttttaaaaatatttcaacatttattttatgttcaggagtacatgtgcaggtttgttgtataggtaaactcatgacttgggggtttagtgtacagattatttcatcacacaggtactaagcattctraacttttcttacatttatattttgatttttgttttagaggccaactagaaattattgctgagtttggaacacctgtaggatttaatttattttgtttcttagtctttattagtttgtaagaattagcaaagataagaggataaaagcaactattatcatgaaagaaaaygatgaatgtgtatgtgaaagtctgggtttagaatgataaatgcatcagagtgagaaggaactacgggactcttctgctctcacctcccaactcacagatttccctgtgagttttcagccctgacatgtggggacccagtctgtgcttggccacttacagtgacaggagaatgactccttgccactgtaattgtaagtgtctagagggtatgacctgtgtcttatttttcactgagaatgactccctgacacagtaagtggccaagcaaagagtggtatttgaaactaaacaaaacaaatcctataggtatttcactaggaaacttagcttgctcctcagtttaaaggactcaaaggactcatcaggaaaaagagggtaaaataaaaagacacaaagtcctctagcagttattggaaactcatcttcttaatacatgaatgtcccttgtactttttaaaatgctttttaaaaaacactttcacaagttctgcagtccaaagatcagccagctatggaacagattatttttcttcaaaatatcatttccattcagacaaaaatatgtattaaaagactactatatgtcaaacactgttagatgctaaatacccaaataaaaataatacatacgtcctgttctgcagacrcgtataagtcacagaaggaaacacaagtgacaggacaacagcaggttcagaaggataagtgcagatacgtrggtatacacaagatgcgaccaarcagcacatcagggaaggcttcctggggaacagatggcttcaatgtaggcattcagaaaacagggcaaaagccacttctctcagggaagacagcctgaccgggagaagatactgagttyactgtggggctattgcacttagaagacctgaaagtcatctaaggagaaataatacatagayatttgtggattatgggtggtctcaggagaggaatttaggccakagaactgagagtcattagtggcaggygcaggttaaataagattttccaggaagagtgccaaaaatcagaattgcygagatctcagggtataatgagagaacatgatagttaagaggtggtttaaaagatgataaggaggatccaggtaaacaggagaaaaataaggacagggtagttcatcagaaagaagtggattatagtgcaaatgttattagtaactcaagtcagaggcactgagaagaacccactgaatttgaccttctgtagaggttcctgatggccaagatgagaggatcctcagggatgtaccagagacaagtcagaagcttagctccacgtgtgaggacacaaagaaagtgtctctgggayaggatgcagactgaaggcaaggttgttttttatcagttgrtttgcacttatgtttttaaggtaaatkacatgtttaaatgttaagagactgggcagggaagccctgaagagacarctgagctcattaggaatttctaccaagaatactaaaaagtatttgcatctatgaagagaagcctattgtggtgtttattataacataacattaraaataactcaggtgaccgcgaacagggcaatagatacttctggttctacccagcctgacctcctctttattctacacatcttaaataaaactgtctgaagccagtgtgcatcttgtacgttatggattctaaccttccccatcactagattttggaatgacagcatcatgcacaggcttgatgtcattctccctgatttcagctacaggaaaaaggagcattcactacggtccatctctggctgagtccttgcagctatcaaaagtctaggcctcccttgcagtcctgratctctcagaacccgaatcacaaggctatcaagaccatgcaaccctgctgtcttgagrgaggaaagcttgtgaccacccacaaagacccaggaagagccctagggtcctagaagagagrgaggatacagaaacactcttygcacttcstctcctaatgcagagtccatagctcggagttcctgtraagcagccacaaaagayagaggctggggatcccagagagataggagggccctgrtagtaggtcactgtgtgcaggaatctggggaaggcagtgtaygaccctcagagctgggtctggacttcaaacttggctcgttgatctgctgtgtaaccttggaaaacttattcatctttttgagcttcagttttttcaaaataatttctaaataaaaggaataatttctaaatgaatggaatattatcttcattgaagrttcctgtgagatgtaaatggggaaagaaamtatgcaggmgtctcataaattctggctrttattgctgttattattatgagggccagagggaacatagactatgaggaccagatagatcaatgagcccctaaaatctstgatycctgaagcarcaattgatgtgaaccaccccatcactcaccccracgctcytgcgtcctcctgascactcacccttgatggccccagctcctcggagactcagcaggaaagccaaggagagggctctcaagatcacagctctgatatggaacattctgtcttcwgggcgcatgytgtrgggtctataattgatgactgtgagcacaggarcagygatraggaactgaggccgagtggaggcagatgagactgaaactgtgggcctctagcactgsaaatgggtggagaggaatcagcatggctgggattcacctatcagagaaatcatagagctgacattctctgttgctgggtaaagaggacgctggaaggtgctggggaagagatgggagaattttaggtaccagcgtggtyaagagagctccagttcacagttcattttcagagttagagaaagagatgtaaaaagataagtyacaccttcttctgacggcaaatgttttccattatgttccttctcccgagccccacccccatcccagacagtcagatgatcttygatgttttttggtcactatattttaaatcatgttttatgttatgttgtcaatattttacaaaaatattctgctgataattaagaatgaatgtgctatctaataaaatatataattaatctttctttcaggtccacctccctgagatacctcctttttatttaatcatttctgcagaagtgttataatttctatttagaggttttaattaacttgaatgaagttgatctttaattgtttatctattcctggttacctttgttagtgaaatttctagataatttttatttttcagatttcttagtatttgatttttcctggtatttaaacagtgtaataacatttttatctttaaattactagtcttgttatttcattttcatataagaatacccaggacagcattacctgtggtaacaatgtgcgcccatattttgatcttgtttttaagaagggtttctctaatgtttttctgttacaggtaatgttaattttttattttatattctctttaccatatttaagaaatacttttctagtctcattttaaatatttcarttttgagctatttatttgatactcatagagaaggtcacaaaacatttactatttaatgtaatgatgaagtacatatrttacgttaatattttatcttatttrtggtagccttacsttgcataaataataattactaacagattaggacatgagagattctgttattagtgctttgcatgcattacctcatttaaacctcatattaaacctgagggaggtattattaatgtctactgtaaaaataaattacctgagacatygaggaagtatttgtctaattatctatggcaggtaaatgacaaggagraaagtcccacccaggcagttactaaaaaaactgagtttttctccacaatcctctcctggccccttaatcctactagacaccttctactacataattattttcttctcttgcattttacatgctagccttctatttacattttaatattgatttaaagaaatgatgccaatttgattttttttgaaattagaattggtggtccaacaggatcacatttataagtgtctaaagtaagaagtaatgttctttgaaagtttgtaaaaatattcactctaaacaaartagaatcagatgctttgaaggaggtggggtctttgatgattttttttcactttcttccttatttaccagtcaatttatattctctatggactttatttttccaaagcaatttcagacctattgatctcatttgatcttaasagctttgctataaggcaggttatatcatccccatattgaagacaaggaatcgaagtccaagagaggcagtgtcgttaaagctgcatatttacatggtagggtaggtggtgtgtccacgctcccagtgtaasgtccctagactgagccctcctgaccctgatgacagtcctgtggaagaacctggtaactcctgcacatcgcaggactcacagacctctgggagaaagtaaatatgaatgggtgctaatcttaaacacacccttggacaaaggcaagacagacagactcagacctcatttgagttctgagatgggtactctaatccctctaagtcatgccactgaatgaccttttacacactaagatagcactttttccacaacagaccatgtcctgtgggtgtgtgaggtgtggcagaattggggaaatgataatccctgtagatgggccagcagaatatttgagatcaccttcagagcaaagaaaacgcataatctcsccaaayatcatgacttatctgactggttaaaatgagtatcactgtctttcctccgtcatcttaagtgcatcacaggctttatattttcagacctttcatactaactttctgcctagtgagcaatgactcatacaaagctcagtgtccattggttcttttctcagactctgtccaatcccagggtcacagaagactacttgggttcatggtctctaatatttcaaacaggagctccctttagcgagtccttcttttcctgactgcagctctttycattttgccatccttttccagctccatgatggttctgcaggtttctgcggccccccggacagtggctctgacggcgttactgatggtgctgctcacatctgtggtccagggcagggccactccaggtaagagccgarctgccattcttggagggtctrgctcagggaacaattcctaggggacgttatctttaagggatcaaattctgagacaggctgcgggggctcctgccctaaggcagtgtcctctcttcccagctagagaaagaggttcatcccctataggatagcttgctaccctactggcctattctctctccaaggacatgggtacagtaaacagagagaggtgcccagtggtcagtgcttgtctttggggaaaatgggaccaagaggtccwggataaccttggacagacaaggtttgcasagagagaagttggcaagtgcaggctcctgggcgtgttcayrtctgcatccagcctggaggggactcaggcagagagccctaagctggagtgtccaggctctgaggatcactgaggattcagtgctcacgaagaatgcctcttattccccagggtggagcaggagcccacaycccttggacaattaaggagagaagggagggagggggataggttttagcccctgaaggcattctcattaaaggtacttctcccagcctccccagaacttggttagggtactagagtgggttgcgacttgtaggaagaatgagatgaggttgtgtgggtgcatgacagggattgagtgtaggttatcagacagccaaggaagcagtaaccaagtgaaaaatctcttcttcctgctgcctccctgtggctggtgtaatattatggcatctatgatccattgtttttctctcaggatactctcaggatatttctttttatatatatatatactttaagttctagggtacatgtgcacaacgtgcaggtttgttacatatgtatacatgtgccatgttggtgtgctgcacccattaactcgtcatttacattaggtatatttcctaatgctatccctcccccctccccccaccccacaacaggccccggtgtatgatgttccccttcctgtgtccatgtgttctcattgttcagttcccacctatgagtgagaacatgtggtctttggttttytgtccttgcaatagtttgctgtgaatgatgrtttccagcttcctccatgtccctacaaaggacatgaactcatccttttttatgrctgcacagtattccatggtgtatatgtgtgcattttcttaatccagtctatcactgatggacagttgggttggttccaagtctttgctattgtgaatagtgccgcwataaacayatgtgtgcatgtgtctttatagcagcatgatttataatcctttgggtatatayccagtaatgggatggctgggtcaaatggtatttctagttctagatcyttgaggaattgccacamtgtcttgagataccatctcacaccagttaaaatggcgatcattaaaaagtcaggaaacaacaggtgctggagaggatgtggagaaataggaacacttttactctgttggtgggactgtaaactagttcaaccattgtactctcaggacatttctagtccaaatttacaccaacactctgagaggaaggactgcaaagtaggtaccttagttttccactgacttccacytttcctgcttacacccttcctcctagacctctccacacccctcctaggacacacctaraaggtactgacatcatgtcacctcctcatctttcagggtagcaaggttggaatctcctgaatacagcccctcaagccctaaaacctcttatctattacctygggttcattgtccaggaaggggaggagaacttgaacttrtagtcacagaagggtgctgagaactaaccagcaggacggctcagccctgggaactgcagaggggtgaggctggggagagaggaggctggagcagcactggtgacactgaacagtgtcaggaggargtgacggatgcrgcryccccatcccataggcagagctgtcatgtgggatgagggacagtgttgggagycaccaaggaaacccagaggtgggggagcagagagcagaagggrgcatgtgatgctggrcagtgaaagggaggacrggcaaaggctgggttgaggtttgtagggggaatgagatgaggcagtggagccatgtgacagggactgagggtagattactggagctccctgcgtagaatgaatgttcaatcaaaayytgctggagggagagctggagccataggggagtgggtaaagtgggcagggctgattccacaattccctgcatgctcccccaactccacacacatccccaacctcaaacagggcacaagaccaaagggctgaggagccaggctatagcttaaagaggctgggggagaaaagcttggctgagacaacccatagggagctagaggtttttaatatatcctattctgaataagagacgaattcattcagatcagtggtttcaaaccgtgctctgggcaactcaattgctaagggttccacaaacaggataaagtttcttatatacaaaaaaaaatgaaggtttcaaattacaccataaaacccctcattgcttatgtctacttggcaggtaaaattccatttcaaaagttaaatgtacttaaaaaattacctaagactgggtaaattaaaaaaattaaatgttgcaaagaaaaaattcaaaattcttattcttgaatgaaaaacgttctcttactggtgattgaggaggagaaacaaagactaacaaatgaaaatgggagaatccacactcagagtggggcaaytgaacaggcaggggcggatggatggcagaggaggaggaatctggactcaaggagctrgggggcyctgggcctggaatttyagggtctggsgcccaasgcaccaggagaagaggcaggtcaggatatctgagtcaagacctgggatcttgccttagcaatgacactggagactaaaggtggactccatggtgcccttgagcccagccctaccccatctccactatcctctgccaccagctgtgcaacttctgcwaggggtgaggttaataaactggagaagttaatttgtggagcatgaaacagatgagcagaacaatcacagcaccttaatttccccagtgtgcccaagaacagagcaggcctgaagayactcaaacagaaacaaacatgtgccgtgtcactgataattctgtgtagacacacacctgccagacactgctcatggcactccctaggaagaacagcatgtgggaaaggctgccaaaattgttcatgtaaaaattacatcaatgctgtcttcctcggtgctgyctatgcagctggcagccatctcttcctccacatcatggcctccctcagactcctcatgaaggataagatcctcaaaaagaggaccaacaagttcatgaggcaccaatcagactgaaatgtcaaaattaagcataactggcggaaacccagaggtcttaacagtagggttcgtagaaggtccaagggccagatcttgatgcccaacattgcttatgggagcaacaacaacaacaaaaaamacatgctgcccagtggcttccagaagtttctggyccacagcctcaaggagctgaaagtgctgctgatgtgcaacaaatcttactgtgctgagatcgctcacaaaatttcctccagaactgcaaagtcatcatggaaagagtcacccagccggccatcagagtcaccaaccccagtaccasggtgcacagctaagaaaatgagtagaaagttcatgtccacgttttgtgtgtaaataaaaccataaaaactgccaaaaaaaattacatsaatgcctctaaacccaaaggactctacccccacaggtccctggttgttgtggtgattttcattgtgtaaaatacttyccacatcttttgacaccaagtctttctgcagccatgtttgaaaattaactttcaggctacagagtctttcttataccaaagttgaagaaagttttaagaaatatatttctacatytcctamatgcaaaacaacaggagcaagttgaggaattctcaagaaactggtcgagaagagagagcgcttagctatggaaaagagaragaaggaagggagggcttcctggaggaggtggcatttgaaccaggactgacatcaggatggaaatgtcagtcagggagttaagtagggggagsagctccgccctccacgtccccagctcctccygcccctgttttttctcccagtgaccccamgtgaaacgtctccgcctcctccagccaccagcagaagggactgccttcccctcagtgctcgcccctccctagtgatcactcagtgcccctgagctcattcttttcagtaaattctctctctgcrtggtgagaaaacaggcctggagaggctctgcgacccgcttaggaccacagaactcgrtactaggaaaactcctattttaaaatcyagccctgrgtgggwagatttgggaagaatcsttaatattragagagagagggagaaagaggattagatgagagtggcgcctccgctcatgtccgccccctccccgcagagaattamstkbwccagkkackgcaggaatgctacscgtttaatgggacacagcgcttcctggagagakacatctacaacmggsargagywygygcgcttcgacagcgacgtgkgrgagttccgggcggtgacggagctggggcggcctgmbgmggwstactggaacagccagaagsachwcctgkaggagrrgygkgcaktkcyggacagrrtrtgcagacacaactacgagctggdcgrgscsrtgaccctrcagcrycgaggtgagtgagggctttgggccggsggtcccagggcagccccgygggcccgtgcccagggcgcaggagcagccgggttggcctaagggaccttagtgccgggcggaaaggggactttgggttggggattcatggggggagcccatctggagcttgtcaggggagcgagcgcggggacctggactgggctgagcatggagtgaggaggacgrgagcagagagaccccsgggacttcatcaggcctggcagctgactgcatgtggggtgaaaaaaggaagccacaggacagcgcacaagggtatggtgtggagatggaggtggagatggcacagcaggccacacagagaagaaacctacagggaggtagctgggtttgaggtgcttgaggggcagatgggtggtctgatgggcaggtagacagaagggtctgcagccggggaggagactgrgatacatgagaccatccagggagagrggacccagggggaagagcaaaggacyggatcctgggaactggacagttgtgatttggccaagacagaaaagcctgtgaaagagaccaawaaaacccaagtgcagtgtgaggagaggcccgcagrgaagagtcttggaagctgaggggaggtgacctcagcagcacagtggacagcggtgccagtgacttgggaaggtcrgaaaacagaagatggaaagtgggtttggaaaccagggagacctggggagagcaggttggccgcagcggcaggagctggaatgggagggggtgcatgaggctgagtgtggcgcatcctcctcggggctgagatggattttacttgtcttgggttccccayggctgkcacagggcagtgtctsagttcattcrtctttttccttcaggaagtckgggtgtaaagggayggagagaggtgaggtgtgtgcagtaagaggatttctcaaggatgggacaggarggccttggagctttggcttcctcctgtgaayttgtggggtggggagcctggtgcaccaacctkwgggacytgagggagtagtatcaggatgtgggattgagccctggaccttttttctagaaagaggaaaaaaatgaagggaggaggaggaggaagctggggagatcacacctttgattttcttgttcctggaaagtgaaaggaagttcacctgctatgagtgagaaggtggacacactgggtggggatgaggtgagtgacatgagcttaggaaagttgctgaggtaattggttgagagaggtgttcaaataaaartaaygcaattggcaaaaactgttactaagactttgtagaggcacmaatcagtgacayggcagcatyttctttcacagtaatcaactgccagattgcagrsagccytgatrccagcctaaggagtgtgrgtttctcctcyaggcccrcaggtccccaacctcactyctcygaagactctyctggagatcmtctgtgatgcrcagatmyccagactcastgccccsagactcagattccctgggtrgggaggtckggggatctctgcttgtaatcagctccctagaggttcccatgtagccrgataagtattgtcagaacactgaagatttttgaaaaatgaaaaagmgaaggttggagatgtgtcttcagaagactactaagggtgctggstagaggagggaccagaggcagggaratgaggtaggaaactgctattatttgtcagggaaattgcaatcaagrmatgagttagaacagggaaaasacagaggcargggagaggtggaagggggaggaaagragtagtgacaattccagggtgkatgyycacccaaatctagaagtaattgagcaaatgttttctgggcattagagaaggcaactagaacaaacaggaatccttgccttggtgaaatgtatttgaactgggtcagaaatgaggccattgggtatcargccttaactccagcgcmccctggaggtcrctgatgtggctccaggctgacctgctcctgtcaaagaatattgagcaagatgcctctcrtggaatgttctgggaccttaaaacagatacccaagtattccccctgatttcatggttcccagaagctctatggggaagaaattgtasgtaattcacaactgagatttagacataagttgaatagtgtaatggacrttgagttaaccgaggtaatgaagtagtgagacacaggtgcccctgaaataaactcacattgagggaagaggctgacaatgtggatcagtctgwaaacaaggcaaaaatacaatagggagtaagggttgtgtgtcagttcaagactgtacttttacctggcccagcgccatgttrgggtatttgtgttctccaggaagtagaaaggaaagaactgagtgattagggacctagaagactaatttgagacattcctcttgatgarctgttctctagggtagtcctctgaaagagctgttctctagtggatctccctgaatgaactgttctctaggagcacttgacccttttctgtgtttgttttttgttttgtgtttgtgtttgtttttgagacaggttctcrctytgtctcccaggctggagtgctgtggcrccatcatgrctcactgcagcctcaacctcctgggctcaagtgatcctcctgcctcagcctcccatgtagctagaactacagatacaygtaccaccatgtctggctaatttatttttctttttagagatgggttctcactatgttgcccaggcyggtctcraaaccctgggctcaagtgatcctcaygcctcarcctcccaaagtgctaagattataggcatgaccaccatgcctggccttttctgcyttcygagraggaaaaaggtactggtggcagagatccaaaagaaaagttgccagtggcagtgtggaaattsacctgagaacaacagracaagctggggcacaaatgcaaagatgcagagggaggcaacayctggtyatctgtgagaccttcatgggacctgaagacrcakcacwkaggaggaacttgraaaaggaygggatttctactactcaagcatgtaggrgctcaggatattmtgtaaatatgaagattttgagtttttgtargtgaggtaaaaaaatacmtaggttwtttacagaataagacatgtmaagctctcttcattttctttgtattttcatgaarttattagattmacaggccaccataatgccattgtctgtatatcttaatttcaagatattatttgagtaawttttgcwtcctttgtatcaagatagaactttgaaaagryaggtaatttcacagttgatyaaatattctttgcccaaattacttttggttaaaatttctcctawatgtgctacagagtgcaaactctgtctccctgccattccgctatatacttactaaytattattttattcaagatcatgcatgctctacttgaaggtctatttctatcttttcartgctacccttacccactagcctaatcacattatwyctattttcaacatctaggaatcaattacrtagtgaacatgcctaagaaataataatctgggcagatgcagtggctcaggccygtaatcccagcmctwtgagaggcygagcgggtggatcacttgaggtcaggmgttggtcaagtgctcctagagaaccagsctgaccaacatggagaaaccttgtctctactrataatacaaaaattagccaggtgargtggcaggcacctataatcccagctattcgggaggctgaggaaggagaattgsttgaascccdgaggtggaggttgcagtgagccaatattgcgccactgcattccagacttggcaacagagygacactccayctcaacaaaaagaaagaatgaaagaaagaaagagcgagattaygtctcaaaaaaaaggaaggaaggaaggaaggaaggaaggaaggaaggaaggaaggaaggaaagaaggacaatctcaaatkctatttcattattttycttccmcrctcstagtccagcctarggtgaaygtttccccctccaagaaggrgcccytgcagcaccacaacctgcttgtctrccacgtgacrgatttctacccagrcagcattcaagtccgatgsttcctgaatggacaggaggaaacagctggggtcgtgtccaccaacctgatccgtaatggagactggaccttccagatcctggwgatgctggaaatgaccccccagcagggagaygtctacayctgccaagtggagcacaccagcmtggayagtcctgtcaccgtggagtggagtgagtctctgatgaccvtctagaccccacctctgaagagcaggggactctctggctctggggtccactcatcttatcttctgcatctataccctggggccatgtccaaaccccatctttcttctataccagctcctgagcatagtttgaagccagggmaatggagacttcctgaccttggcttrggggttcctgaagattcatagttctcccccttgtcagagaatctagggacactgrctgrtctcgaaaccctcacacwyaggaactgacctcacacataggaacagttctcttcyttcagcattttagcctcttctcaggcattttgagaggcaacttccagaatcagcatttgccaccttgttgaggtcacacccctgttccagatatgagggtggctctttctgaatttcctcttagcaagctttttccgctgcactgtcctcatcccgatatgctgcatcaggctccagaatctcagacaggacatgagtagggatgcagctggtggaggtgacactaaacctgggtctgtccttcccagaggcacagtctgattctgcccggagtaagacattgacgggagctgggggcttcgtgctggggctcatcatctgtggagtgggcatcttcatgcacaggaggagcaagaaaggtgagaaaagcctgcagggtgagcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggtcatgagaatagcagaaagtcttcaaatcgagatcattatgaaatcctcagacccagagcacataaatcctaccctcagagtcactgagcagttaacattacaaattacaaaccatatccartcagagtcattctctttcctgcttgtckcctgtactcatgttacaggttagggcagtaccccgagtggagtgaacaatctctggactaacacttgtcaggatcagaagctgaggtatctgcacccacattacaggaacaggatatgtgctcctagggaactgagggtgtcaggagatgaggaawgtccctggagtcacagaaagaaggtatcagatgtgtctcactctgacatatgcaggtgtttatgaaactctgggatttctaaggaaggatgcagtgcagagacaggtcccagaggagacargagctgagaraccatccaaactgggaccacyttgtcactagacttcaaattttcaatattkatagagtgttttctaagagtcaggccctttgctgagtgctatgtgcagcaggatcaaaggcagccaggaggtagaggagtcttgaggtacatcagtcattggagttgaagagcagagattcaaaggaaagytggaactggagctttaaaggagatgtgaagtgggtgactcaacctctgactcagaaaaattgatacctgcagaagaaaaaaccyggcgggcttaggactcccagctgagtgttgtatcctccatcccyttccacctggtcccttyattttctacccctcacagtyccctaasgagaaggtggyccacccaacagayrayrctgcctcagatggttatcaagrggtaccctaagaagaaatcatctcaccctctctttgtccccatttgtcaagyagcagtgaggccgagccaggggatggtgaaagtggaaggaggtgggagttgggcatygggtgtgaagatgctcttkaaaggggttttaataaccacttgctaccaggccagtgaacacttaycatagttgatgccttttgagcatgttgyattgtaaactgtccctgaaattmctgtgcacttggcttatgggatgaaacatcctcctagttctyttgtctctcagcttctctgaagtctcattgagcaccttctcttcaatttcttttacacagtaagaataggatcagctgtgctaaactaacaaatacccagatatccaggtttggctcatgytacacgtccaaagtaagtcatscaggaagctctgctyatcatcgtactcaggaagycaggctgacagkctttctcctgcacatctgctcccagaacctccccagcagaatgaagggaacctaagaatttattcactggcttttaatgatccctcctagaaagaacacacttctyrcatttcattttmcaatgtaaatcatatggctgcaactaacttcaaataagtgggaatacttgaaggtggaaaacatttaagaagtacayactaaataaataataaaatacttctacaagagatatttatggaggacctactgtgtaccaggagcaatgctaggcattatggatatcagcagcctttggctcctgaaaagcttacacactacctcctggcctaaggaggggcacagggatgctggcaacagtctatttcttcacccgggtactagttacatgggtrcttgyggtgataacyattcaacrtacattctattggtttgtgtgtttcttccaaatgtcccctagttcacaataraaagggcttaaatagagaagtaaaggagaatttgggaatttgaagcaaaagcaagaagccactgaatcaagcacaaatattgagctttgataaagattggaataagaaacataataaatgagayaagaaataggacttttgcaactgaagtgtaattaataaacaaaaagccaaactgagaaactgtcccaaggacaatatgatcgagtaaacaatagaaaatgtaaaggacaagtgaagagaaatgaaggatagaaacagacatctgacatcttaataattagacgtctagaaagtcagggaaatagtggaggaagaggaaataactgaaaacataatagatgtttagtctttatagaaagatgaaataagttcattcaaaatgctgcatagaatgtcagaytgttaaacaattttgttagagtaaaatgactgtaaacaaatgagctaattatgtgaattaagaggatggaaaagcagaaaaacagcaaaaagaaaatacatgtaaataataaggacaaaagctgaattcaatgaaatataaaaatagagaagayaaaatcaaattttgaggcartgaaaactttaatgagacctctggcaagactcctaaggaaaatacaggagattcagaacgaaaagggtaaatgacatttatacacattttaaaatgcaaaatcttacgaccaaytctatacatataaatttgaaaatttagrtaaaamggatacgtttctagaaagatataaaggtcaaaactacaggaagaaatagaaaactaaaatagagtagagaatatcaaagaaattgtcatgggaagcaaagaatcgccttccaaagggccctgtcctgatcttattgcagatgagggygtcctcccacatttccaggagcagatcatgcctcttacacrtgtgattctagaacatagaatggaacagaatttttgagatcattttatgaggttggttcatttrtatttccagagccrgctaagaatagtacargagaacaggattgtggactaattttagccatgtcactgaatccaacagtacattayaaaaacaatacgttttgaccaattttagatttattctaggaatgcaatgattcttcagtgtcagaaaatatataatgtggttaacacattagtggactcygcaaaattcatattaatttaaactgaattcagctcaagacatagacagaatttaatcaatttcatgacatgttaaagrtagtgaaccaaaaatctatagcatatatatttcaaagaaatgaggtggattgcctttgagattgtgcaaaagataggatgtccttcgttgctggaaatgtttaacatagcattggaagttctgaacatcactctgcgggcagaagaaaattaaggctgtgtaaaatgtaggaagacagatagtgactgcagatgaaataatctaaatactggacaagactgcagccactgcaggcccaaagcctgggtttaaatccaagctttgcactttgaagctgtgtggtcttcacctctcccggtgtctgattccygctctgtaacatgaaataaataagaaccaacctccagatgtaaataagtgaacacatgagaagcacttagaatmgtgcctagaacatagtaagcaactcaatgaatgtcatttctcattacatttgttaatnnnnnnnnnnnnnnnnnnnnccttggcttaggggttcctgaagattcatagttctcccccttgtcagagaatctagggacactgactggtctcgaaaccctcacacttaggaactgacctcacacataggaacagttctcttccttcagcattttagcctcttctcaggcattttgagaggcaacttccagaatcagcatttgccaccttgttgaggtcacacccctgttccagatatgagggtggctctttctgaatttcctcttagcaagctttttccgctgcactgtcctcatcccgatatgctgcatcaggctccagaatctcagacaggacatgagtagggatgcagctggtggaggtgacactaaacctgggtctgtccttcccagaggcacagtctgattctgcccggagtaagacattgacgggagctgggggcttcgtgctggggctcatcatctgtggagtgggcatcttcatgcacaggaggagcaagaaaggtgagaaagcctgcagggtgagcgggacttaccttcccctggcatattcacacttattccacgatgaggggtttgacagaaaagaaatgtcagaaagctctagaggccactgawatcagatartcggggaacaaacatgacctatrgcgagagrgggatcccaggctgggatcttaatgcagccagatgcatgaggtcccargtrctcagrctcctgcggrgcrtccattgagtgrtggkcaatggaatttggtgggatggaaatgtttctctaaytatctgaggtggtttcaatggctgawtayataacctttcstctttcatttcagttcaacgaggatctgcataaacaggtaatattcctgctttgatttccttgkggggtgggttrcaggaggatatgastcytttctgtgcattgtaayactgaggctcctccaggaagggaatctcaggcatgaacccctctttcaaystcrgcyytcrggyragtggggaaaragcattgcwyggctccattgctgaaggaagcagagatcarytctgttmtttatcagcctragaygcakcctctcaccataatttttctctcctggacttamaggaaggaggcyrgcaacctgggataacttgtcytttacccccacagggttcctgasctcacygaaaagactawtgtgccttagramaagcatttgctgtgtttygttarcayctggytccaggacagaccytcarcttccmaakwggatactgctgccaagaagttgctctgaagtcagtttctatcrttctgctctttgattcaaagcactgtttctctcactgggcctccaaccatgttcccttcttcttagcaccacaaataatcaaaacccaacatrastgtttgytttcctttaaaaatatgcaycaaatcrtctctcatyacttttctctgagggttttagtaracagtaggagttaataaagaagttcattttggtttamacrtaggaaagaagagaascatgaaartggrgatatgttaactattgtataatgkggcctgttayacatgacactcttctgaattgactgtatttcagtgagctgcccccaaatcaagtttagtgccctcatccatttatgtctcagaccrctattcttaactattcaatggtgagcagactgcaaatctgcctgataggacccrtattcccacagcactaattcaacatataycttactgagagcatgttttatcattaccattaakaagttaaatgaacatcagaatttaaaatcataaatataatctaatacactttaaccattttctttgtgtgccatcacaaatactmcttaaccaaatacggcttggacttttgaatgcatccartagacgtcatttgtcgtctaagtctgcattcrtccaccagcctaggcctcytgtcttaattttcrtacagacagaratgactccccactggggaaagagcaaagcaatacrtgtagcactctttttcaaacactggtctttttttttttcttaacaatccaacattgttatgtgttttgcgtctcatattgacacctttyggtcaaggtagaggacatgtttgttgtaagctttctttttcgtgtaraggatggattcttyactcctgatacacayaatcagtgcacagcagctctctkatacatccrgttgrtgccttmagtctccctggcttcttacaagyatcttctgggccttgtgtgtccctgggcrcctgtccctggtcaattcccgaaagctactgtgctcctcttgcccatctccccttgcaaataatatcytccatckggggacyggcttcctccaattycaggagaggtggggctgaaggyacagacttgggcrtcactggcacagatataagtaaatacagctggagtctgcagagaggctggactragtcagggagtcaggaaagagaagccacacacaaggacaaccaatcatgtttctcataatcttcttaacctagggaataggacacaatcattttttctttttaaaacatctttatccctgatcagcctcatttcctcaaaaactataaaggaaaatgctgctgacttgtttttgygtagtaatttcagctgtcacataataagctaaggaagrcagtatatagtaaataaggaccctttatctgtcttattttcccttttggcttcacaggaaacttgtgagaaacctatgcarcataaaattaatatgatttcaatccagggattcaacgatggaaggargtcatgagaatagcagaaagtcttcaaatcgagatcattatgaaatcctcagacccagagcacataaatcctaccctcagagtcactgagcagttaacattacaaattacaaaccatatccagtcagagtcattctctttcctgcttgtctcctgtactcatgttacaggttagggcagtaccccgagtggagtgaacaatctctggactaacacttgtcaggatcagaagctgaggtatctgcacccacattacaggaacaggatatgtgctcctagggaactgagggtgtcaggagatgaggaatgtccctggagtcacagaaagaaggtatcagatgtgtctcactctgacatatgcaggtgtttatgaaactctgggatttctaaggaaggatgcagtgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtaatgctcaaagagcccctggtgaagtgtttctctttcccactcttcacccctaacttgttacctcgtcttttccactctgtccctaatacacctataggatgactcataggagcccctggacccggggatgctgtcagatcgcttggtctttgagacaatggtgccattaaggaccccygccaggcccaccagcaggccsagggcacagaccagcatctccatggtctcaggcacctggattakttcatggacctctggggcaccaagggaagacagagttataaggtacagagagcaggggctggccttggatgtgggaggtgttgggtattcgaaaccatgagatggtgaaatttggataaagtgaccrtaaaacatgggattgaggaaggcaggtgctgaggggcgatgggcccaggaaataaaggtggtgccaaggccgtgagggcagagggagggcgctccataccccagtgcctgaggagaggctggtgcaggccccagtgctccccctggaggtcacaggtgtcctcggccatgggaacgagggtcagatagtggaacctgtgkaatctgagtttcttgctgggcaggaagatggtctctgcaataccctcaatgactggctccccattgcrcagccacgtgatgttcagcactggtgggaagaacttgtcaacatggcagacgarggtgttgggctggcccagatccacaggctccttgggaaagacgcttacctcggtgggggctccaaaaggggatagaacccaaggagcctactgccattggctgattcttaaaggttccaccaccccaagtcctatattcaccagattaggggccacctctcccaggcccatcctcctgctcccctagggctcctggacagggtcacagcttctcgtgctcctgacctggccccctcagcccagcctttctcttgagtaagaagaaaatgcctcctcctctgctgtcctaagaacccagctgtgtggaccyaagatttctcgctctcagggaaggggctcattcatgagtgggcatcatggcctctagttctatgtgtggcagagaggccctcccatccctccagctggactctagaggaacaggcagctataggcagtgccatttgtggcccaagtctgtttggaccattgatccgggtgttcaagtgcttccttgccatgacgatgccagcaatacccctctgagaggaacaggcagctataggcagtgccatttgtggcccaagtctgtttggaccattgatcygggtgttcaagtgcttccttgccatgacgatgccagcaatacccctctgagcaccaaagtcaaargtgtgaataaactctggtagaggccagaccatctccttctcatccaggttcacgtagaactgctcctcctcatcaaattcaaacatatactccccagaggktctgtgcgtctgcacaaactcygcatatgttgacacatggtctgctgcatgaaggagaagatggagaatgggtgaataygtaggatgctacacagaatgcaggaagcaaacaggtaacaggaaggttattgggaacatgaaggaataacacagaaaatgagaaatgcaaatgaaagaaaagaaaaggagtgagaagaaacaaagacagaaatgacccatggacgatayaggttgtttcccttgtccctgaagacttaacatccgtctatgataatggtaatgctgaatacagtaagataatatttattgggcacttactatrtgctaaacttactcattgaatcttcacacccccatgyagaagaacttattttccatagtagggaactgaccccagaggtaaagtaacttgtccaagtcacacaactcctggtagaaacaatattgagtagtcctcctacctcattcctgtaggatctcagaaaccctacaggacaatacattaaaaattactgatatagccataaagcaaggcagggaagtggaaggatggaataaatatttcagagtggaacaaaatcgtgaaggacatgaaaatacctccagagtcttagtgacatttatagacttcaagttacattcttacttttagaagaaaaatgataccttctataattttatccacaacacttacattttaggcagagtaaatttaaaagtattatcattcacataacattcacaaaattgtcttgwggagtgtagttttcaagtgtagtttcacctggaaatacaagttgttggcatttgaaagacctaygggatagtatcttagctttacctgatacataagaagcagcaactggttgataacaaaaagtgaattattattacagtgaattacagagagtttagggttcggcctggaagaggaagtgaagccaaatgacactgcatggttggtggtccctaagtgaggatttyccctcccagcccagcayggggagaaccagtcctctacttagatgcatagtgtgacagcaggttcagtgcygcacayggatggtgagggtcccycactgagtttagggtctagaggattactcacctacagaaatgaatcccaaaggaaaaagaaaaatacayggtgtatagactgggctacacagmtgtaattggttcagcttakgtyactttgtatttattatatttacaaaatctgaaaactaaaggttggcacattttgaagcaaattccacacttcaaatgttaattttcattcagttaataaatgctttttgtgaactttcactctctaggtaataaggatgaaactctaaagatgggaactttgtccttaatctacttgaaattcaagaataaaacagacaaagaaaagatgattgctacatgtgtggtttgatcaccactgagtatcacaaggtatacacaagagctactcaggagcaaaattaaaatacgatttaggaaaggttcctagggacagtgttcacctgcagatagcaaaacagagaaaggggaaatggcatttccagcaggagaagcaggctcaggagcagagaggcatgaagttgcaaggagaactgcagttcttcagtgtgactgaagccaggggagatgtgggccaggcagcactgtaacctgccttgtgtgctgatggcargtgttygcattttatcccacaggacayaggaarttgtgaagtatcttaagcaggagagtaacacggtcagatttgtgtttggatggggcacctgtaggaaggatgggctggaggaggckggactcaaggcaagaccagtagcacttttaagccctctggtrggaagtaatgaaggcgtaggccagggcaggaacatggggtgaggaggacagcagatggatttgatggcagtaatgacatgagaggccacaggaatcactaaatcacrtgccagaagtagggatatgaagaagtcgagaataaccacgcaacgtggagaattgtggcatccgtgcctgcaaaggtgataattaagtgattgagagaaggt

SEQ ID NO: 13225 - DNA, 16822 bp, Homo sapiens
  misc_feature (1)...(16822): n = A,T,C or G, or insertion/deletion polymorphism (see Tables 1-2)
ggttcctgccctcagtgcgtatactgctccccactttcgttgatgtggtagtggtgatgactgagccaaccacctaatgtggaaatgagaggacagcaagattgtgggtatggaatggggcaaagcaataagggaaaattagtgtggcagggttcagtacagcagcctgggttcccatttccccccatattcaaatgctgacactctcttctcctcccaggtccagcctgtggtgtccacaatgccccaggcctctgagcaccgcctgggccgtacccgagagccacctgttaatatccagccccgagtgggatccaagctaccatttgcccccagggcccgcagcaaggagcgcagaaacccagcctctgggccaaaccccatgttacgacctctgcctccccggccaggtctgcctgatgaacggctcaagaaactggagctgggacggggacggacctcaggccctcgtcccagaggcccccttcgagcagatcatggggttcccctgyctggctcaccacccccaacagtggctttgcctctcccatctcggaccaacttagcccgttccaagtctgtgagcagtggggacttgcgtccaatggggattgccttgggagggcaccrtggcaccggagagcttggggctgcactgagccgcttggccctccggcctgagccacccactttgagacgtagcacttctctccgccgcctagggggctttcctggaccccctaccctgttcagcatacggacagagccccctgcttcccatggctccttccacatgatatccgcccggtcctctgagcctttctactctgatgacaagatggtgaggacttgccacacacatggccttcatgcccatgttcctctgtgctttcctgccatcctctgccttttctgtcccccatttccctgaagttcctttctcagcccttcattacagcagtttggacatgcctctcccttgcttaaatacccttgagcctcctagacccttttttgggttgttggtgactcttcagcatggtgtgccatttcggtccccaggggattaccccaactatttagaattcttctttgggtccccaggcccttcctttcccttgcttgcaccttctctactgggactctgcctaggcctaattaatctctggagctaaagagaggcaggcacagaacatcttagcaaacgtggttgcacattttctgagctaagtaagctaggctgattgcaattggagccagcaggagaagggcaagaaggggccacgggggcaggagggggttttgggggcagaaaggtgggagtggtgagcagctgggcaaccatgccggtgctgggggagttgccccaggagctgcaacgtcarctagctgagcagaggagtaagtgggcaacaggtgggacagccatggctgagtcygtggtacattcagctgtgatgggcttactgctcatgaccagtgaggtagggagactagaatacctagtgaggggaatagggtagagtttggggatgaaacatgcatgggatgggggaggcagtgggcagcatgctgttgaaaggttaaagtgccaggtaggatatataggaacttgccgattgtactctgaccttccaggctcatcacacactccttctgggctctggtcatgttggccttcgaaacctgggaaacacggtgagagctattctcctatctttcctctctaaaaggaatgtgaaatggtgctgggggtggggaaaacccacgagcttggggaaggcatgtggaaggagagctctgaagctcttctaaggcttcctgggcagtggtctggagagataacagcagtgtccctactgctccccagtgcttcctgaatgctgtgctgcagtgtctgagcagcactcgacctcttcgggacttctgtctgagaagggacttccggcaagaggtgcctggaggaggccgagcccaagagctcactgaaggtggggcaacaactcctgctccctctgttcaagtccctttttccccaaccacttgcaggtccatctgccactggtggtggcccccaacccttaaatctggcagttgtatctacttttcccagtgcctactttcctaaaggttattttctaccctctgagccaccttttgcttgcctcttccagacattaacctttgtttgccttccccactcccatcccaacagcctttgcagatgtgattggtgccctctggcaccctgactcctgcgaagctgtgaatcctactcgattccgagctgtcttccagaaatatgttccctccttctctggatacaggtgggagagctggaggctatgggatttctctctggccatgtctgggggtagggccaagcaagggccctggcagcattgttctgagccttgagatgttcttcatccaggaagtggggaccaatatctgggcagggaatagtgtctgtggactaggagaggagtcagttgcccatactctttgtctggctgtagccagcaggatgcccaagagttcctgaagctcctcatggagcggctacaccttgaaatcaaccgccgagrccgccgggctccaccgatacttgccaatggtccagttccctctmcaccccgccgaggaggggctctgctagaagaacctgagttaaggtaagggtcgttccctctacctcctttccccgtagtttatcagcatcattcacacttcatagaactaaactagtaaagattgaagatgtagggtccagggaaaccctttagtatagaaaatagtatgagaagcaacatagaagtagaaggaaggaaggaagagggggagtctaagggagcagatggaggcagaagatcatgctagggatgtcaccaaattgaagaaggggataattcatttacaggtagaggaagacagcatattcttcccttatgtacattcctttcttttcctctcacctcggatttccctagaaagttcattgaggcattattcttttgacttttccttgaaatttagggaaggagcaggggtgtggatggggagtagggctctgtaggttgtttcagtgggtgttgggggtgcccagtgttcctgctgtctcatgggtgctccccacttcctttgatctgtggtagtgatgatgaccgagccaacctaatgtggaaacgttacctggagcgagaggacagcaagattgtgggtatggaatggggcaaagcaatgagggaaaattagtgtgtgaggggggtacaggcttggggggaaaaatcgatactatcaaggggtatgggaacaagactggatgatgcaaatgtgaagctgtgtgaagagttgattaggagtgttggtagtgggaaaggaagggtcaagcaaaggggcaggaagagatggaaatccaagaaatcatctcataacatccaacaatgaccttttctcctgtccctgtgcttctgtctagacctgtttgtgggccagttgaaaagttgtctcaagtgccaggcctgtgggtatcgctccacgaccttcgaggttttttgtgacctgtccctgcccatccccaaggtgggattccagaggattccggggtggacaggacaggggctctgtgacccaagcctacccacccccagagtgtgggcgggaaccctgtgggtttctggagcagaactgaagcctggattgattgagaagagttggaaaaggaaattcagaacatgttgacctttcttccccttttcccccagaaaggatttgctgggggcaaggtgtctctgcgggattgtttcaaccttttcactaaggaagaagagctagagtcggagaatgccccagtatgtggaggttcacargggatacagtaagggtgggagacctggggggactccatgtggataaaagggattgcatgatgtcttcatatggggaataatatttatgtatctgggtttgtgttggagtctcagatctgttctagtactcctagagcaaaggggagaagccaagaggatccagctgtaatgaagagcatactaaatttgtatgtggatcggggtgtcagaaaagccaattgaggttaggagcatattaacctaacactgtttgccatttattcaggtgtgtgaccgatgtcggcagaaaactcgaagtaccaaaaagttgacagtacaaagattccctcgaatcctcgtgctccatatcctaatcttcagattcttacttctcttaggatacctcccatacattctctttcctccatgtttccagagaattgaattttccttaggaaaaktctgccacccacttttccacaagatgctcccagtgtgtcgggagtggggagaggacagctttcaggatagaagaagttcccctcagaggcccactgcctcccaaatgctccttaaccagggcttagatctgaatcgattttctgcctcccgaggctccatcaaaaaaagttcagtaggtgtagactttccactgcagcgactgagcctaggggactttgccagtgacaaagccggtgagtctggtggggaaagtcctaaggagccaaaggagtgggggcacagctctgattatagaacttgatcatctccaaccccgcaggaagtcctgtataccagctgtatgccctttgcaaccactcaggcagcgtccactatggccactacacagccctgtgccggtgccagactggttggcatgtctacaatgactctcggtgagaatagcctcctatttacatcctgccccattcccactcagccctgacaccctccccttctatgaagctccaggagagcagagtgccaggtgaaaggagaggtggaggtcttgcctgatcatttcctggatgctctgaggttcggtcttgtagggagaagggagtaaacaggaatgaccacaaccctttcccgatctccttttttcctagtgtctcccctgtcagtgaaaaccagktggcatccagcgagggctacgtgctgttctaccaaytgatgcaggagccaccccggtgcctgtgacacctytaagctctggcacctgtgaagccctttaaacacccttaagccccaggctccccgtttacctcagagacgtctatttttgtgtctttttaatcggggaggggggarggggtggttgtagctccattattttttttattaaaaaatacccttccacctggaggctcccttgtctcccagycccatgtacaaagctcaccaagcccctgcccatgtacagcccccagaccctctgcaatatcactttttgtgaataaatttattaagaaaaaatgatgtgcttatttgtatttttgcttagggggtgatagagaactgrgccaaattggagtcttcttgggacccaagttccctctctaacaggtgggggcgctctcagagccgagggggaaggtttcggggatggtgctggacccggacctgtgtcccccagcagtgaaggttatgtactgggaggaaaagaggaaaggcatacttgagtgaggctgcgtgcaggytctggggcgactggtttggtcggcgatgggggagtgccactgttgacaaacacygggtacgttgccgggcggccctagctcccgtaggcccggtctgttgctaacatcaaggagctgtttatggagccgcctccccgtggactggccttaagtgtccctatctattctccctacgaccaaagctcctgcggccttccctctagggttgtcaccctagctggacctggtaagcttgtgctggggaacgctaactccagcattaagcgctcgccgcctcggtcctgaggagggcagtgacgggtacggccgctcactcccagctcggcgctaacacggttaacctccagctcttacagctgccgtcgctccgcctctgccagttcaatgttttattggtgaacgtgatccggggccttccaagtcccgccaatccagatgtaggagaggtagggttaggcgcgtgccgcgagaacagagtggacggagmgtaggagagaccgaaaaggctgggggtgggagtagcggatttgaagcacttgttggcctacagaggtgtggcaagcagagcacctcagaactcaggcgtactgcccgccgcccgagccstgcgagggccgatagcgagggtgtggcccttatctgcacccagcagagcgccggcggggtacggtcttaggacctcgatctccttctccctcattttctctcatccctacctattgtgggtgagtcctggcccctggacggggacctcgctgttccaccagcccatccgtgcacacttagtttcccctaaagcagtgagtggccgggatagaactcaaaaccggcggggcttctggagcgcaggttgtccccggtctgcctgtccatatcgccccctttcccccaggtttccgcanvggccggaccgtggtcgtgctgggcggargcaycagcggcttsgccgccagttaccacctgagccgggccccctgcccccctaaggtgagtgctccacttgtgccagagggagcttcatttaatgctcttcccatttccatcaaaagctagatggatcctggccctctgaatatgcctcttcccctcccctcctgacctctcgscggcggctacaggcggtgctgcagtgtctctccctcttgtcgccaggtggtcctagtggagagcagtgagcgtctgggaggctggattcgctccgttcgaggccctaatggtgctatctttgagcttggacctyggggaattaggccagcgggagccctaggggcccggaccttgcycctggtgagaggcttgtgggatgtctaggagaggttgtggagggggcttccattggggaatagagtttaggggaggaagtatgtttggtgggtcagatcttcccttagtttctcctcttctgagggcatgtggagagcaggtttctgagcttggcttggattcagaagtgctgcctgtccggggagaccacccagctgcccagaacaggttcctctacgtgggcggtgccctgcmtgccctacccactggcctcaggtaacaccagcacctccgctccttttactgtgccctcatcctcatatgccttccatttctttcttcttttctttttttttttttttttttttttttttgagacggagtatcgctctcgcccaggatggagtgcaatggcgcgatcttggctcactgcaacttccrcctttcgggttcaagcrattctcctgcctcagcctcccgagtagctgggactacaggtgcctaccaccacgtctggctagtttttgtatttttagtagagatggggtttcaccatattggccaggctggtcttgaactcctgaccttgtgatccgcccgcctcggcctgccaaagtgctgggattacaggcgtgagccaccacgcccgacctgccttccatttcttcatctccctgtcagccttcccagcaaaaggaagccaaatgagtggaaatgaccccagygcctggagctggggaggyatgtcaggagcttccccctcactatgcctttctccatgcagggggctactccgcccttcaccccccttctccaaacctctgttttgrgctgggctgaggkagctgaccaagccccsgggcaaagagcctgwtgagactgtgcacagttttgccyagygccgccytggacctgaggtgacacttgcccagaggccccaaacctcttccctcctaaaccagctgcagagctccctgttcaaatctaccacctaggggctcttctgtatcatttggggatgccctcttctcttcataccccaccccctcataattcccaaaactcattattgggagtgaaggccttcatttccatccgtcacagtgggaatgtcccccaayccaaaccctatccyaccctcattccctaccaaataggggctgtggaaatcagtcagtgtagattattttttcgctccttagtcctagtctcacccttaagvtggcgtctctagccatggacagtctctgccgtggagtgtttgyaggcaacagccgtgagstcagcatcaggtcctgctttcccagtctcttcyaagctkagcaaacccatcgttccatatkactgggcctgctgctgggggyaggtgaggggggattgattcagagggtgaaaatattaagtactgccaaagtgagggagtggggacaaggggtgctattcaatgattctttttttcttttttgagacggagtcttgctctgctgcctaggctggagtgcagtggtgcaatctcagatcggctcgctgcaacctccgcctcccagattcaagcaattctcctgcctcagcctcttaagtagctgggattacaaacatgtgccaccactcccagctaatctttgtatttttttgtagagatgcagtttcactatgttggccaggctggtctcaaactcctgacctcaagtgatccacccgcctcggcctcctaaagtgctgggattacaggtgtgagccactgcatccagcctcaatgattcttctttgcttcctctgcagggcggaccccacagccagactcagcactcattcgccaggccttggctgagcgctgragccagtggtcacttcgtggasgtctaragatgtygcctcaggcccttgaaacccacctgactagtaggggggtcagtgttctcagaggccagcsggtctgtgggctcagcctccaggcagaagggcgctrgaaggtaggggaacccctggagtgtaatgaacctgtcagtgtttccatctttatccaagtggcttaactaggccagggccgataggactggagttcctcattgtttttgtgccttagaagctacttagacatgggctaccccagaatcctaggccctatttgtgaaccttcctcaaagagcctatgcaagtctgtggatagaagtagtacttataagtggcttagagataggggaaagaacccagcttcactgaacatttcagaacagccacactggcctgtctggtccacttcctggagtacacagaggaatgattttttgtgaagtctacatagtcacccaatctcttcatcctgggtcagtacacagtctccccggccacatgggtgcctgggaaactgagagtgaggcaccagaagtctcttttcactcatcaaattctcattttctgggtctctcaaatgttttcatgctctcaggtatctctaagggacagcagtctggaggctgaccacgttawtaktgccattccagcttcargtaatggaatagccaccttccccttccccaacccctaccagtgagaagcaaaagctataccttcctgggtcagcaggaccacaccatgcccctgaactggtcatctctatgggagtctaatcccaaagaggactgacaactgtaatgggaatgccttctgagtcaggcctctgcctgatctctagtgctcagtgagctgcyccctgctgaggctgcccctctggctcrtgccctgagtgccatcactgcagtgtctgtagctgtggtgaatctgcagtaccaaggagcccatctgcctgtccaggtatgataaagggacggagaggctgggcatggtggctcacacctgtaatcccagcattttgggaggccgaggtgggcagataacaaggtcaggagttcgagaccagcctggccaacatggtgaaaccccatctctaygaaaaatacaaaaattagccaggtgtggtggcttgcacctgtaatctcagctactcgggaggctaaggcaggagaatcgcttgaacccaggaggtggaggttgcagtgagctgagatctcgccattacactccagcctgggtgacagagtgagactctgtcccccccacccccccaaaaaaatgggaaggagagacagcctcagctagagccctttccttctgacgcatgaatgtccttctctccagsgatttggacatttggkgccatcttcagaagatccaggagtcctgggaatcgtgtrtgmcycagttgctttccctgagcaggacgggagcccccctggcctcagagtgactgtgaggaggaggaaactttgcctagtggcatttccagagggctcctctgtgctccattgtaggcaaggccagactgatcagtgctatattccctccttaggtgatgctgggaggttcctgrttayagacactggaggctagtggctgtgtcttatctcaggagctgtttcaacagcgggcccaggaagcagctgctacacaattmggactgaaggagatgccgagccactgcttggtccatctacacaaggtaagttgggataaacttccctcagctctccactgaaggccttgaagacagagactggaacatttgtcactgtatgtcagccaaggcctaggacatcaataataaacttttccctgcatcctctcctctcttctcagaactgcattccccagtatacactaggtcactggcaaaaactaggtaagttgggaaaacagctgggctgaggagggccaaggacatcagacccccagctaaaacattcctttcatcctttccttccagagtcasctaggyaattcctgactgctcacaggttgcccctgactctggctrgagccycctatgagrkagttgctgttaatgactgtatagagagtgggcgccaggcagcagtcagtgtcctgggcacagaacctaacagctgatccccaactctcattcatgaaaataaaaattgctggagcttggcttggtctggctgttctatcacctataggcataagaatgcggggcagcaaagaggcaaagtgtgcctgggatgcagraagcaggagcagatgcgagacaaagtcctttattagaaaatatatcaaaatcccagccccctgagccaggaccagaagagggagctattccagcataggcagaaaatgcccagggaggggcttccttcaccaaacaacttcccgggaaccataaatagaataaatattcacagaggtccgaggagaagccagatcactcttctctccatggaagagggaggggcttggggtccagccctgctcctactctaggggcagggactcctaggaatcgtcacataaaatcatgacatcaaggattcrcagtcataagccctacaggagaccctagagagagggacccctsaggtctacaggagcccagctccagtccagcagtgagggagaggcccctaccccctagcacggcaccagagttcagttccctcacatccctctgagaacagtgaggagctgagggtggggagaatacaaccccatgaattcggtttcatgattaaggtagacaggaaggaggagtcagtgtgaacctcggagggctgtgtggttggcagtagatagaggcccaggcctggctgggggccggcgttgcagcatctcttgacggaaggcttgggaggaaccaggtgggtaacgtggcccagaaggagcccgaggaccccgagggtcagtcccaatgtctgctgtgatgttggtataaagaggccccagctctcgagccagcaactggtatgtcagtgagttcatcccatcttgcgtccaggaattctgggtacggaccaggaggtcaaatctgagggttagaggttggagactaagacccagaaaggaacagccagaaatctagggacctttaggattttcctggctaggggtacagaaccstgaggatccagtaacaattcccaggcagtccttccttcttcctacctgtggggattttcctcattgcccttatctcctcggtgcttcaccatcttatagtgtcctacagatgtggggggccgagagatcttcatcccagccaggcgcaccctatgggaaaagtgagggtatcatgggggatccagagtagagaaaagcaaggaagggattaaatgtttctgtacacacaaaaaaacaactattacttagtaggcaaaagaaaaaaaaagcccaggacagaagtcaaacagaaagaaggaaatggctgaagagaatataaaagctggatgtatccaaatcctcagggcccagtgccagtcaccctagggcctttaaacagttggcaacctattcccttggcttcctaaagggctcctaggagctgcccttgcagtctaggaaggacgcagagagaggccattctgtcaaaagaataagagaagactgggagttgctgagaatcttadaatagtgactgagctaccccagcttctctcccacatcccccatgttaagaaaaaggtaggccaggtgcagtggctcacacctgcaatcctagcacttttggatgccaaggcagaaggatcacttgaggccaggagttcaagaccagcctgggaaaataatgggaccttgtctctagagaaaaagaaaaaaaaaaaaaacgaaagaaagaaaagaaaagggtagaaccaggtaatcaggaccttaaaagaaacaaactccacttctgacacacagaagcatggagtgcagatggcctgggaaggaactagaagaatacttatgtatatttacaattcactgggtatttcacacacatacagaggatgagaattcacagagatgtcatcacagaggacacagggggaatggaggcaattggtcctgcataccaagcccaaatattcataccacagacatgaaattgggtcagctgaggctgaaggtcagaatgtttcacatgctaaaaatgagttggccctgtgccaatggcacaggccttttacaaagcgattctgggaacatggagcagagcccctctctcctaaccccataggaagtggcctggctggaaccccagcagaaggcaagactaagctgtctctgggcccctttccagttctggaatccgacgatactatttcctattgatcttatgtcctctcccaagaacaaactaaccaggagactgaaggatgacacaatgggcagtagcatgcaagcctgacctgggtrtcctaaaaagactaagggaaaggaatgggctcagtgcaggaccagggagctaaaggttagtgytgaagggctatggtcaaaggtggtcttagaggacagggatccagactggggtcaggagggaggaagtggcaggaagtctgacctggtagcaatgtcgtcatcctcaccaccccagccccagtattcattggggaagccattcatcttcaggtactggtcaggagtaagtgctgagactcctccgaagtactgggggtacgggaggctagggagagaaagatccttgcataccccgagtcttctggggacacatccccaaccacaatccgcttggctctcctccttccacaggatagtaggcttycctgtttcccagtacccttccatgccctctacctgtatccaaacttgttcatagcaacggcaacatggcggggtccccgggggtcacacacatacagattgtggtcattttctggcaagaggtccacatcgtgcaagaacaggcagtcccactcttcatcacgcagggcctctcgcaccccaacrttcaacagttttgccctgttaaatgttccatttccagcctggaagataatggaggggaaccagactatgtctgtaggtggcacggagaaaagggggctaaagaataaaagtgaaggccgggcgcggtggcttacgcctgtaatcccagtactttgggaggccaaggcrggcagatcacaaggtcaggagattgagaccaccctggctaacacggtaaaaccccatctctactaaaaatacaaaaarttagctgggcatggtggtacacgcctgtagtcccagctactcaggaggctgaggcaggagaatggcgtaaaacccgggaggtggagcttgcagtcagccgagatcgtgccactgcactccagcctgggggacagagtgagatctcaaaaaaaaaaaaaaagaaaaaaaagaataaaagtgaaaagagggaaatcaaagtggggtggagggcaaggagaatgaaaaagaaagactatctttttcatttttccacttagtcatttgacaaatcttgcttgtgtattggtatggacctgatacttaagatgctgctgtctaacatttaatcctgacaattggcaaccaacaatggtgtggtgtggaacagatggtatattagttatcttatgctctttcctcatgttagatgtttaagtatcttgctcagagtcatacatgtaacaagtgacggaactagaattttagccctattgtgtccaattccaactctgcacaagccattcaataaagaaaaaatcacaggagagtgtaggacagtgggaataacctaagcagattaaggaaaagtatgggactaacaaagttggaagagcagtgccgggtgcttctccacactctaacagtctggccttcttaaaattattctagggacccatttagatgaaagtgaagtggcatgtgcttgaggcttccttagaagaaagtcagtcaaaatgaggtggagattgggggtacctggtggatgacatagatgccataagcaagctgctggcgctgcaagaaggggtgcaggtggtagagcagcaggcgcaggtggtgctcccgggcacgatgaggcacaatgatggctgttcgggagcggggctcacaacctgcagggcggtaccggccccctggttctacccggggattccgctccacaatctctgccagtgatggcactgggctaaaggacacygacacaggacccactgttgggaaggaatggcaagtagagggatcagaggggcaaagagaaaagaatcaaactagggtttgggaatacctctgacactggcagtctggttctggggcttarttctcagggctcactcagaaatctcgcatgccttggattacctatcactgggacagctctacaaaggctggaaggtgcaggatccttacctagccttctcttcttattttagggttgcctaactttctcctgtcttacagggttggaagctatagttgaaggctggagagacttgcaactaattaaaccagggctcatctacaaggaaaacaattcctagcctggggcaggaagagcccataaagggacaagcagtagaaagtggaaacccaatagtctaatctaaactcccaattcagagtctactctatctcaacctcagccctctatctcaacctcagcctacctgcagcctcagcctacctatcctcttctaagttccacttctgccactccatgcctccctatccccaagcctccctgtctccgcaccttgtccttcctttcaccacctccttcctcctgcacttacctaagagaggagatcgttctggacagtagggcagaccttgaggagctggaggaccccctggggccccaggcaggtgactgaggttactgtagacatcacgagggtgagaatagtcaaatgtcggtccctgatctcggccaaatagggcactgagacttcggaagccccccagtgacaggtacatcatgacagccagctgggagcccacaagcagggccagcgtgcaaggccgctccagcagcctccgcaacatcctgggggtgagatctagggagggagaggggaattctgggggtaggcaggaagagagcaagccagcagagaggtcagtaggtagggttgaaggtgatgccaggggtaaagaggaaaaagcagaaaacaaagtcacagaagggagcacacaggtgcacagtcacgcaaggaaacagaatgtaaccaccagtaaccctaccacctgtcacttcagcccaagtttcgctctcctctacctccccccaaaccactcccaccatctactgtcagtcctcacccccaaaaatgtttacatcattcaaatctcatgttcatttcagaaagtctctagagaaccccctcttccaattttagaagggaagagatagactcacctaggttcaagctgtcttcttagggatcatgggggctccagggggtcccggggggacagagatgtgaggcattatctaaaattggaaatgtcacagagggcagagaaaggctccatccagcactccagcagcgaatctgggaccagctggaacagaagtggtaaaggataactagctacctgcaccgccagagatcaggatcagggtgaagctggtttcccagcaggcgaagtgaaggaaagtggttggaaaggaagaggaggagcaggagatggtaggtccctcgcctatctcccgtgctaccctggaatgataagtgtcaggttcatacttaaccacccccgtacccccaccccaacaggacagattggggagtggggacaggacagctaatggaaacattgttttcccccagaccaagaaccagttgaagtggcgacagagtcatgacaggaccgtggagtggcctaaggagtacccagggcgaagtaggaaacaggctccttctattcttcatgtgcctgggtgccaactcctcaggtgcagggaccgtgaccacctgggggctgtaagcgaacagccccggagctcggcggagagtagggtgggggwggcgtcctctaccttttctacctttcccctcttctagcgggggtggggaggagggttactgctgaagagaaagggagagggagagcaggggcagagacagtcaggggtggctggaagggctcacctagaggggcgtggtccgcgctgtggagggggttaaaacccagctctttcgg

SEQ ID NO: 13226 - DNA, 14172 bp, Homo sapiens
  misc_feature (1)...(14172): n = A,T,C or G, or insertion/deletion polymorphism (see Tables 1-2)
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaccccgtcttgactaaaaatacaaaaaattagctgggcattgtggcacgggcctgtagtcccagctactcaggaaggctgaggcaggagaatcgcttgaacccaggaggcggaggttgcagtaagcgaagatcacgccactgcactccagcctgggcaacagagcgagactctgtctcataaataaataaataaataaataaataaataaataaagtgctgggattacaggcatgagccaccgcgcccggctgaaagagttacgtctttgtttagttctggaaatgtctccatcttactccttccagcagtgcttctctgcttgtccattgtcgtctggaactcccactgggctgtggcctgcttccccccaagtgtgctctctgtgttgccgcagggtggtctcgtcgtcactgtctcccagtccccagtctctcttctgctgtgtctggccacttaaaagtttattccattcatttgagggattttttttccaatggctatatttttaacttgcaatatttggtttttkkttttttttattttcctacaaagttgaccctggtaatagttttcatggagtgcaacatgtaactttatattagaaaatggaatgtcacatctttaccatgggacagagacacaggaagatgtcaaagtctgaaatagcaagtgaagctgaatgtagcttatgatagggagggagggctctgctggrcagggacagtctctgagcaggtgaactgctgatctcacagaggtcagcaatcggcggattttcaccgtgtaagtagactgawgtcatcygtagaagcacagacgtactggactgtcacatctactagaaaataaagcatctgccacctggggggtggggagggtccagtttagcccaatgggggacaacccagcacatccacctttggaacccaccagttaaaggtattgtcagagtatcctgtttgggaagaattcccatttcaggcaccctcgatgaagagccaggccaggaacatgggatgagagagcraaatggtggaaaaaggggagataggctaattccagaggcacctgcccagccaacactcagccctggctgcgcgcactgagtcctgtgtctgctgcaggtatcgggctttccgggatgacgatggacattattcccagacctactggaatcttcttgccatccgcctggccttcgtcattgtgtttgaggtagccgaggcacctgctggttctcccatccatggcatgasgccccgaccctgtgctttgcctaattcgagcacgtggtgaggggtcggtgccgtcacttcctgctgtgtcatcttggtcaartcagagctcttctctgcacctgcgttttccctgcctggcctcatccctgggttgtggtgtggacattgtgggtgtctccacaggagccccagggccacgaaagctggggtggcctctgccccttctggggttccttttcctgcacagctgctttctgactccacccacagctgggagcaggtgccggagccccggcctgcctggccctgtgaaggccactctgggcgtttgggtgggcgtgagtgccttcctctgctcccagcatgtggttttctccgttggccgcctcctggacctcctggtgcctgacatcccagagtctgtggagatcaaagtgaagcgggagtactacctggctaagcaggcactggctgagaatgaggtgaactgtacagcccagtctcggccctccccscagccctctccctatccttgtcagtggctgctctacctccggacactgagtcacatccctcttcctcttgctgcccttttttggggacaggttctttttggaacgaacggaacaaaggatgagcagcccragggctcagaggcaagtctgggagcagccaggcccctgccccgtgcactccctgaggtcacagggccctgcccagccgcccactgtgcctcgtggccatggcctgctcctggccctagtctgacttgtccctgcccccaaccctctccccagctcagctcccactggacacccttcacrgttcccaaggccagccagctgcagcagtgacgcctggaaggacatctggtggtccttaggggagtggcccctcctgagccctgcgagcagcgtccttttcctcttccctcaggcagcggctgtgtgaaccgctggctgctgttgtgcctcatctctgggcacattgcctgcttccccccagcgccggcttctctcytcagagcgcctgtcactccatccccggcagggagggaccgtcagctcacaaggccctctttgtttcctgctcccagacataagcccaaggggyccctgcacccaagggaccctgtccctcggtggcctccccaggcccctggacacgacagttctcctcaggcaggtgggctttgtggtcctcgcygcccctggccacatcrccctctcctcttacacctggtgaccttcgaatgtttcagagcgcagggcygttytccctcgtgtcctctggacccacccgccccttcctgccctgtttgcgcagggacatcacccacatgccccagctctyggaccctgcagctctgtgtcccaggccacagcaaaggtctgttgaacccctccctccattcccagttatctgggtcctctggattcttctgtttcttgaatcaggstctgctttccccctagccastacaggcagcctctgacagtgccgctttacttgcattctgcagcaattacatrtgtccttttgatccttgcccaacttccctccctctcccagctcctggcccctggcccagggcccctcttgctgtttttacctctgttccttggggcctagtacccagcaagcacccaaatgggggaggttttgggatgagaggaggaaacgtgtatacctgtaacatctggtggctcttcccccagaagtttgtgttcatacataattgttttccacgctggatcataatgtgacgtgcagttctgccctgtgctggggagccacatgaagcttcccctggctaacttgctaccccgcagcaatcccagtktggccgtctgcttgctaaaaaatggatctgtgctcatctgtattgatgtccttggagttctacaagtggaacttaagtgtcaaaaagaatatgtggtttttagctgagcgtggtggctcacacctgtaatcccaggactttgggaggctgaggcaggaggattacaaggtcaggagttcgggactagcctgtccaacatggtgaaaccctgtctttactaaaaatgcaaaaattattctgggtgtggtggcgggcatctgtaatcccagctatttgggaggctgaggcaggagaatcgtttgaacccgggaggcggaggttgtagtgagctgagatctcaacactgcactacagcctgggcgacagagcaagactccgtctcgggaacacacacacacaaaaagaatatgtggttttaatgtgctttgatgagtactgccaaacttactccacagaaaaggcctctttctgaacatcctcgcctgcgttcyatttcacccaccgtgatgcctggcctgagggcrgcgtgcttgcttgtagcatttcttgaggatttgctacttgttcacctgcctcttaggagcactgtgccctgcctccatggaagggctcttccggcagggatgcaggctcacagcgccctggggctggacascaccggccggagcatggcggacagcacacacggcccggggcgggaaccttggaaactttacacagatggggagctcagccattccacgtgtgctttcgctcagcacaatgcttactacaaacccacgtgtacttccttccagctggttgctttttattgttgctgtcttaaactccaaagttttaaggtgaatttattgaaacgtacgaaaatgctcagttcatacaggcttccaggtgaacaaactgttgtaaccagcacgtgggtaaaaggcaagttccacatcacccgacgtggaagctccccgatgcccacgtgcgccctaccctgtgaccctctcccatccagggccctgatgcccacatgcgccctaccctgcctgtgaccctttcccatccagagtagccaccaccttagccaccaagcagagatggaactggggactttgcatttggcgtctgccgtgggacattgcgcgagctccatccrtgccgagcatccatctcagcccctcctggctgctgggctgcttcgtgtttggcttagggtcattttgcagttgtgtgctttrctgtgggttgcatatttagggcccaacagaactgctgggtcagggataaacatgttcggcatttttttttttttgagatggagtctcgctctgtcacccaggctggagtgcagtggtacgatctcggctcactgcaagctctgcctcccgggttcacgccattctcctgcctcagcctcccgagtagctgggactacaggcgcccgccaccacacccagctaattttttgcatttttaatagagacggggtttcaccgtgttagccaggatggtcttgatctcctgacctcgtgatccgcccacctcggcttcccaaagtgctgggattacaggcgtgagccaccgtacccggccaacatgtttggctttaagaggaactgccatacccgtcttcccaggtggggaccagcccagtcagcagcaggaacacctattccctcttgactcttcccgttatctcctgccactcaggtgactggggtggctcctcccactcaacgcccctccctcctcctcctccagccgaggcctccgcccgcaccccccaccacccaactcagctcgtcataactcacaggccgggtccagggtgccaggaatgccactgaggctggcagagtcctaaaagggagtggcaggtgctgctccacaaggacggttgtccaccctcaatgagggctgcagggcaactgctgactgtctggcagccagaggacagggacaggcagccaccctcttgccatgaccacacctgggtctccctcartgtggctcccgaggggcygttgaacacagtgttgagaactgctgagaaaatcacaccaaagacgaactacccacagatgccagtcaccactccagggtgacgagaaagagaacacacaggcggcagcgtgacaaaatgagtcccagcatgctacatctggtttcgggttttattttagaatttataaaattccagtgtcatccatattcatgagcctttacacatgtttgcatataatctccaaattccaaagttaaggccaagggatggattgtagctatggaaacagatgatatggaagacatccaacaaggaggaaaagcacacgcacgcctcacccctgcctcatctctgcccagggctgtcctgacagcacagacgcttcagggagacaggcctggggacagtcatgtcatcacccttgcaacaaccacccaaaggaaaagagagcgctgaacagtttaggaaagggctcgcgtctaagacatcaagcgacatacagagatgtgcaaaacttggtgagaattaaaattgacctttgggagagggtaggggcaggatgttttatgacactgtagaaaagacaggaggaaccygctgcgatggagattgsggggagctggaagcaagcagccaacaggacagagttccagaactcatgcagatggggaagaggtgacagcccttccccactggcctcccccgtggaggtggagtagacagatcccgggaaaggcaggaaaagggccttgctttctttccctgtttcctaagccgtggtcacccyagcctatgaagctggaagctatattccttccaatcccaatttaccattcctgtaaacaggcccattcagggctgcctgagcaaatggggacttgccgaggcagctgcaactagacttgggctaagccgtctgggtctactcaagaattcgmgtctgaagatgaccaagcttgagttattcaactgagagtgaggtgtcaaggcggaagcgactgtccccagggaagggctgtgagatggatgggcgtgagtcagcttttccaaaactcaagtacctgggacaggacaactcrctagcagctcagtcacctccgtggcggacacagataaggatgttaagaccagaaaaccagagactagggccccgtcctcagccctcacagcatgacacagatgcctccctcggagagcagggtctctcggcatccagcggcgtggtctgcattctgctctacctcatgctctaggccccatgccatcgtctcggccctagaccrtgaaaactgccagtcacccgggacctgctcctaggggctggcctgcacagccggatggcctgtgggcggggtggaagtgcccactcccactccagatgggcctgctggccactgacccacctgtgctgagggagagcgccagcctccagcttaggtacacggcgcccacccccagctccacgggaaacccataaccaccagaaacatctcaatcaagagacgggtgtgtggggtggcactaactgcacagagaccactccacgccggctgaggtagaaagaaggcaactgaacacacagcagctagggcaggggcagggaggggctgcaggtggtgtgaagaagagcccagctgtcatctaaggcaaactgcccccactgaggacaagcgtaaggccctacctcccccaacctgtgcgcatctcaatcacagcagacactgtgacggccacaggggacccagatggtgcctaccaccttgcctccaggctccactcaccagacctcaggctgagggtctggcagtggaggtaggggcagggacccttggtgctttcagaccccacggcaggtaaaatcaggactgcctgagaacccgtcaccctctgcctctcaggtcaccccccagctccaggaacctgcctcctgctgtccaytgccaggtcttccttgcaccctgacacctgtgctgaggcgctctggcagctggaggaggctgattgcactccacaaacaggactgtctggaccaagggaaactggcaggagggaggtgggaaaggaagagggcaaacgtttggcttttataaagtcaaggacgtttatttcctgaggtcatgacacaggaagtggaatcctagccacggctgcggagctctcgtgatgaaggccagagtgctgactgacatgccgggtggaccaggagctggagtctgttatcttagcacgaatgctcatgaccttggtttagtgttaaacagtggagcaggtcctgagcgggcacggccaggcctggaggagcggccgcacacacagccaggcgctaggctccctgcgggacctcgggaagggggaagagcgtcaacaatttacrgagggtccagccrctgggtcagattgagacaaaccattgtgtrgttgggttygggycagcaggctggagagggttctgttctttttgatcattatcgtttggggcccmaagggagggtcttgggagccacctgagccccaaagctgggaaattcctcagagctgctcatgtcaggagcctgtgcagagagaggacacggcttcaggaggggatgctccccaactcgcaagcagcttccgacgcagttgccaccctcaggacaccaagcccgcctgcccgcccaccctccctgggacccaggagggcagaagcccgcatctgaccttctcactgctgctggcggtccagggtgcgtcccgcaccacaaagcctctggaaggtgccttggcctcttcgtgtgctgggggtttcatgtatacctgcagcgcctcactgtccaccacgtcagctagctgcaggcagaagacaggaagacagggtcagtctgcccagcacccccagcatcccgcccgcctgctcacccctgcacctcgcctgcctctggaaacacaagtgccaccttgtcccctgaagctcctggctgggcctcaggccggtggacgtgccagggcgcctcagggctccaaggcccacagagactcacgtattcctcctccagattgaggatgtggtcgatggcttcctccacattctctgggagccccgtcacagtgacgcagttggggtctggggstccgctctgtgggaagcgaatgtccacctggaaggggtgtacaacgtcagatgaggggactccaagcgaggaaaagggttaaaattatgtgtcaatttctagtgaagcattttctgagttagcaaacgttttaaaatctggtttcagagttgttctgaagtcagtcagcctcatcaccacaccaagttaggtgtatctcaggagcaccttgttcccagcagacagagggccgcagcacgtactgtgcgctcttgcatgaaattcccacccacagaggacgagctcgccaggcagctgtcaaggagatgccctcctaatggccaccgtggcagtgcagcctcacacaggccgtcgcctgcactgacccgtggtgtccatgaggacagttccactgccagccctggggttgtggcctcatcatcttgaggggaaggccatgccctgctctttcttctggccagccaggtgcccccggtgagagaggattctcacccactgtgcttccagccggctcaccttgaattcgtccatgattttgcgaatggctttgccgcgggcaccaatgatgcgggcgtgaacgcggtggtccagcgggacgtcctcagaaaccatctgctcaagttcacccacaattctcagtatagcatccctggcagcttctgtgttcttttcgtaccctgtgatggtaatttggtcctggggctaaaaaaggagaatgtagtcagaaaaggggatgccttactgggattcccgtcaggggcaagagccggcccccactgctgaggaaaacagctcaggagagaagatggaaagcaacgtcacggctgatttaaaacaagaggttaacaatgtccactcagggccgggcacggtggctcacgcctgtaatcccagcactttgggaggccgaggcaggcggatcacctgaggtccggaattcgtgaccagcctgaccaacatggagaaaccccgcctctactaaaaatacaatattagccgggcgtggtggtgcacgcctgtaatcccagctactcccggggctgaggcacgagaattgcttgaacccrggaggcggaggttgctgtgagccgagattgcgccactgcactccagcctgggcaacagagcaaaactccatctcaaaaaaaaaaaaacaaaaaaaaaacaccccacaaaaaacctatgtccactcagcttccatctcttcccaaactctacccaaaagacagtgaattacagaacgaaaaaggacatttgtcctcaaagacaaaggagagacactaacaggcaagaattctggactcaaggacagcggggcaaagacaaagccccaagcccctcagcttcctgcttctttgcccacgtgggccacagtctggaggcatctttgtgctggaggctggaggctggctggcattcctcagcgagcccctccctcactcagagatcccacctgctcaggccttccttgggccacacaaatggacaggagacaccataccagacttgggatagcagacaagcagaccaagcagacagttcagggcatagagaaggaaacgtggtaacaaaacacctgtagcccacaatcggcgaaaacaacatgtccacaacacaaaaaccaccatgcaacaggactagaggacrgggacaaatcacaaccatcacgcaacaggactagaggacagggacaaatcacaacacggaaccatcatcacgcaacaggactagaggacagggacaaatgcctggaaaggaaatgagcagaaagacctaacctagagacaacagagcagcagcccaagaagcttctgtccagattgaagcaaaatgccagagtgggaggcagcagccccacccaccgtggcccagcagagctgacagcctcaggcaccacccgcgtgctgccaggtacagaacctcaagatcggaagcacagctcacaggaaaaagctgcctgtgaagaaatgactgctccaccccacttggctcatggtgtattagatggaatagtctaattgctaaacaatgactttttttttttttttttaaagacagagtctcactctgtcgcccaggctggagtgcaatggcatgatctcagctcactgcagcctccgcctcctgcgttcaagcgattctcacgtctcagtctcccgagtagctgggattacaggtgcacgcgaccacgcctggctaattttcatatttttagtagagacaggctttcgccatgttggtcaggttggccttgaactcctgacctcaggggatccacccgcctcggcctccaaaagtgttgggattacaggcgtgagccactggtgactcacctataatgacttttaagattgataattatatagaatagtagagggaaataaaaggcaataagggtgaggggcttaaaagagctaaactcttgggctgggagcggtggctcacagctgtagtcccagctacttgggaggttgaggcacgagaatcacttcaacccgggaggcagaggttacagtgagccgagatcgcgccactgcactccacctggggcaacaagacaaagactatctctctcaaaaaaaagaactaaactctcaagatcaagactaaaaattaaaaaatgtatgtggggagggaagaggacgtgggagctggaggaggcagggtgcaggagggccctcctggcctggctggtgtgtgtgtgactcaaagatccaaaagggaacaagaagctggggaggaagaaggggaaggggaaggggaagcagcggaaaaccctgggcggcacatccacagtgggagcgaggggcgtggaggggctctgctgccagggggtytgctgtttctggaaaccagcacaactgtggccaccaaggcttgctagtctcccactgtgggcaaagctgtgctggacacgcctaggaagcagacaccccagcaggatgccagagccaggaaagaccaagcctgggaagtgtgtgcaagagggggtgttgggtgaggctgccctgcatgccaggtggcagggcccagagaggggatggggctgcctttcattttgttctgagtgaagcaggaggccatgagggccagtggcaggggggtggcactgcaatttggaggaagtaacaacaagagtttactaaggaccatctggcaagcacaacggtgtttgcagctggggctgcagagaaatgtccacctgaccccaagaggcccaggtgacaggtgaatgagagcccttgggagcctcagagaggcccgggtgacaggtgaatgagctacacctggaggcgccactgatcaaggacccagctggagctcctgctcattttctggaaggagacgcaggagaaaatgctccaggccccagatgatacatagtgccagagacctcacccatctggcaagtaccgagacacagcccaaacctcaagccagaattaggtcctgagagacttgccactctcaacttggccctcgaacccccatctaggcacatctggttactgctcccaagtcacaggaaaggtcaacaagcacctctgcccccgacacgctccaaccgaggctctcacctggttcccatcrtccttatcaggaaactggatgttcacgtcatgctccaaccggatttgggtaattactgccccctttctcccgataatcttgggatggtatttggggtctacagtgacactcagcttaaaactccttaaagcctacaaatgaaaggagcaagaatgaggcaaagattgagctgatccaccctgtgactccattccccttccaccctggtcataggacactggagatgctgcagtgttctgtaacccgtggtccggaatggtccgccatctctctggtccgacctctgccaccttccattatctgctaataatgagaaccagggaacttggctgctccacaaggaggtctataaatccttcaaaagagggcttgggaccacttgcraggatcgtgctcaggaactgacagagctaggcagtgagtcacgagcttggggccccgctctcctcatttgtcaaacagggatctgatggatacgcacagaaatgctctggatctttttaggactggggcagatgcagaccaagaagagggggcagccacagcccctgaacacccatggccaaaggctacaggtatgacctggctgcaggagacaacccagagtccacgcaggggtacactgacaccatgtraggttcacgagctccaccccattcaccagactcracgtgctcacgggaggagtggaaagccaacccccttagcaaaccagcaccccagcacagtctgctccaagttccagaacccctgctcctgtctgcagcactctgctcacacaatcctccaaatgtcagccctgccagaggctgggcgtctgcagcgctccgctcatacaatccttcaaacgtcagccttgccagaggttgggggggtttcatccctgcttaccaggaagtcattcgccctttgaccaccctgtgctagaggttagtgggggtccccgatgctcgtcctcactgcatagcacatgcttgggggcctctcgcaaccttgacctttcttgtaggtctgaggtaccactctgatttggttttgagagaaactgcaaatttacacggaagtccaactttgtcacttttttatgaaaaagagaaaggtgccatgctcttggctagttccacakcaagacccctggatgctgactgcgtcctggcactgcctgcatctcacctccagccagatgtcgctgggatgctgggatcctgaagaacttccctagattctgacatgtgcccaaagctgagcaccatggctctgggcagtgccccggccacctcctgctcacccggtcctcctgctcggcctgtagctccttcacacgctccagcagtccagccttggcccggtccaaatttgcagcgaggcccgtgatggcgatgatgtcagactgcagctcaggtgccgggacatgtatgttcacctacgtgaagagggggctgacttgacgttcaggaccccagagaacaggaaagagtccattggccctgggacccagaagtggtgagagggaaggccacccgccgtgaagggaagtcagtgcccagtccgagcaggaggaggcagagtcaacaggaagttgagaaaggacactggcactcgg

SEQ ID NO: 13227 - DNA, 317876 bp, Homo sapiens
  misc_feature (1)...(317876): n = A,T,C or G, or insertion/deletion polymorphism (see Tables 1-2)
agtgtcaggattacagacatgagccactgcacccggccaacttccccctctaatagttctaatgaaatattaactacccaagtatttctgtagcctgttttctgaatatctttctcactgtctcctcatctgactgtccattgccttaaggctccccaggtcacatctctttaagtgtactctaggcgggccgatcatgaggtcaggagttcgaaaccaccctggccaacatggtgaaaccccgtctctaataataatacaaaaattagccgggtgtggtggtgtgtgcctgcaatcccagctactcaggaggtggaggcaggagaattgcctgaacccaggaggcagaggttgcagtaagccgagatcacgccactgcactccagcctgggtgacagagtgagactccatctgcggggggaaacatgtactctaacctccttaccaactctgggtctcagacrtggctccacagggttgcttgtaaaatgcaaacatgaccatgttaatctcttccctaagagactctcataattctgcagtattaaaagtaaataaaatctaagctcattaaaatgatatttcaaagtccttcttgatttggcttcctgttcatttttaaaacttcatctcccacatatagacactgctgtagccctgctgagctactttctactgaaaagctttgtatacaccattactctgcctgaaactcctcactctactattctacctgggaactactcagatggactcctgggaagcctgcattccccttccaggcagagttaattctctcctccattgttctccaataaaggtctctctctctctctctctctctctctctccctccccctcccccaacctctgtttttgtccttagccatattctgattaccatgaccccttcttaaccttaaattcccctcatatgaaattctagtatactgggattaactttcatgtatgtttttgatgaccacargaatttttatttgtgaagtctgtgggaattatttaaaggaggagcaaagaactgagcattcagaatataaagggaggagaagtgaatgtcacagaaggagaaaaggttgcacagagatatcttgaaaaacataaaaaacaggagaaaggagtagttcattctgattcttacaaccaccttcaggtggttttggaaggagggagggagggagagaagggagctaagacttcagtgagaaaggctgtggagccaggatgaggaagaaagagaaaggtgagaccatgcgacaggaccggagcagaagtcagcaggtcatgaattatggatgagcagtacactgaacatttggataccaccctcattccatgtaccatgtatggtatcagcaacaatgcaaaatacatttgcatgtgtcttgctgaagaagtcaaagagagtaaaggctgatgagtggaaatcaacagtacagcagacaccattataaacttaaagtctacaacatgccattaatgttatcagtgttctgacctaagggttttatttattttttattattttattttatttttattttttgagacagagtctcactctgtcacccaggctggagggcagtggcatgatctcagctcactgcaagctccgcttcccgggttcaagccattctcctgcctcagcctcctgagtagctggtactacaggcgcccaccaccacgcccagctgattttttgtatttttagtacagacggggtttcaccgtgttagccaggatggtctccatctcctgacctcgtgatccacccgcctcggcctcccaaagtgctgggattacaggtttgagccaccgcgccgggccctaagggttttattttaatgaatgcrtacaaatgtgcataagggttccttaggtaaactctccaactaggtgccctcctccaaacaytgagcagcccccagagcagatcctccctgtccgagggctccattgctagcaccccatataaaagcttcctcaccctggttactcagttccactcaaggatgataccgtttcttttggattgcctgctcttcaaaactcttggatttaaatggaatcttgctctccacccaccaatgtggagttgttctgtgcttcctggagtcaccttgccttgttcttagacatcagttacctttgcctcacacctttaactccaggtcagcaatcgtcttcctcactcaaagtccccaattcatctctctgctctgaaatcctcttttataggagaaatgatcagacacccttgcttctccttgtacccaagattataaagacagctgtgaattctttttgtcaktttttcttttaaggaatctaaacccaagagaggatacaggagggtgaggattattatatttctttacatgatattgrtaacagcttatatttaatgaacacttattttgtgccagtaacctaatgtgctaaacattttacataacttcagtgctgttattatctgtctgctgatgaaaaaacaaggttccatggtcagtaagtgatggagtcagactttgaacgcacataaatgagcttcaggcccgtgttcttaaccttcaaccatgtggtcttccctagactggaggcttcagagggaagaatctgcaatttactacatttcgtgttcctatcatcttatagatggytaatatgtaaagggcacatgcagaatattagkggaatgcattctagattagggaasagacaggagttttacyagtcaatgaaagatagaatttcaggtctatagaatgtttaccttgggagaggagaaraagagaggttatctaccatatagatctgaaggtcatagattctaaaactactttaattcatctttcctgaagtatttctgaatagagtaagtaaacagaatgagtgccaatsccttggaaacagcaattgatttttatattgcttttcacagagtcaacatatgcagacagtctgacttgcctattgatctgagctagagttgagtgaatgagctggatgtaaaattccctaactcatcactaaaagtcagtcagaccttgaasgacggttactttcttttttttttctaacatgggtgacaatgagcaattgaatgcttagattgggagctgagagattatctttactttgttgagtaataaacacattaattaacaaaacaggaaaatcctgtcaaagaggaagtccttattaagatcatgctggaggccttttctattgcactggaaagattagctgagttcagtggtctttaagaaagtataatcatgaaaatagttacgtccagagctcagagagtttgaattatccttttgattggaagattctagcccagactattttatcctattctaaacttgccaaaaatttcatattgtcaaactttccctccaccccatgccaagttgttaagctttcaaataaacaaatttattatgataaatttcatctctattgatgtaaaggctattggatatcttttcttagcatttagtttaataccaaattaatattttgtatcatcctgatatatgaagacatttacaaatatagaagagaaataattttaatcagttttattgtgctgtaatttacatctgccaaagattatctattttaactatacagctttatgagttttgacaaatttatacagtcatgcaaccacaatcacaatcatgatacagaacattttcatcacccttaaatattccctcatgcctccttgcgatcaatctcctccccaacccstggcctctgatttgttgtctatcagtgtagttttggcttttttagattttcatatggaatcatgtgatatagaatcacttaggaagtagtcttttgtgtcttattgttgtccttgaaaaatatttttaagcaagcaaaatgacttgccacaggttggcagaaaaatatttgcaaaatacrtatttgaaaattcttgtatctagaatatatgagctcttacaatcaataaaagacaaacaacaaaattttaaaaaataggcaaaatatctaaacagacagttcaccgaagaagataaacaaatggcaaatatacataaaaagatgcccaacatctttggtcattagggaaatataaattaaaattgtaatgagatacctatgttgacacaaagacctgttcacaaatgttcataacagctttatttataatagtcccaaactggaaataactcaagtgtttatcaactgatgagtagagaagcaaactgtgggatagccatatgatgaaatactactcaataataaaagggaaccaattaatgatatacactacagcacagatgaattrcaaaagcattatgttgagtgaaagaagcagatacaagagacatatagaagaaattgggaaggtttaaaaaaaatttttaaaagcagtgactatttgagtatcacaagtaaagtttttttttgttttgttttgtttttgagacggcatctcgctctgtcccccaggctggagtgcagtggcatgatctcagctcactgcaagctccgcctcccgggttcacgccattctcctgcctcagcctcccgagtagctgggactacaggcgcccgccactaagcccggctaattttttgtatttgtagtagagacggggtttcaccacgttagccaggatgttctcgatctcctgacctcgtgatccrcccgcctcggsctcccaaagtgctgggattacaggcgtgagccaccgcgcccggcataagtaaagaattataagctatggtacataatgatcctctcctcaaagagcctacataagtaagacacaaaataagtaaaacacaaacagkcttgtcctgaaagagcctgcatgggtattaaccaatgcaatggtaattacctagagatttttcttagaagtgaaatttttacagctctccctcaaattcagttttgtctgtgtgctcatggaaagtctgagtgcatcaatagttgattttacaatcgaaatgtagaatattttcatcactctcagtggtttctgtagtcccagcacagagtgagtggggacatcagtgctccatgtcctcaaaccatatatccagctggaagggtgtatagcgcagtgtggaaagtgggaatggattccacagccgtccataggtcccacagggatgataaaaagtaaaaagtacaaattctttgtacattctggatattaacccattttcatatatatatgatttgcaaatattttcttccattctgggagttgctttttcactctgttgatgtattttttgatgcacaaacgtttttaattttgatgtattccaatttatatcttttggttgtctgtgtgtttttctttttttgcccatgcttttggtatcatactcaagaaatcattgccaaatccaaaatccaaggtcatgaatttttgtcctattcttctgagttttatgttatagtttcagattttttgaaccattgtgagttaattttatagttttagctcttagatttagatctttgamcttttttgagttaatttttgcatatggtatgaggtaagcctccwacttcttttgcatgtggatatctagttttcctagcgctgggtaaaggtggaactcctctgcaagggaggtgaggaaggaggggaacagagaaaggtgtagataatgaccagtttacttttgttgaaacctagttacttcttaagcaaagattgtttaagtggatgttttcaaagctgcttgttactgtttcaaaggtcaaatagataatgattaagttgcgcatcacttaaggtagattttgacctctcacaagttgaagagtactgaagatctaagatcatttacatccctctggaagaaaaaataacatagscttctagggcaaagaagaaaaaactcaacagttacaggatattccatggttcaaagtacacctgcctggtttgctgttctccaaaatcccatgctcagttggttggagtggcctcactcttacctgccaacctgggaggttgatkatgaacatgtctttaccttttctttggagtttgcttaccttattaatatttgctgaagtaaatggcgaagctggagaacttgagctgcagagacaaaaaagaagcatcaatctccaacagtaagtaaacacatgggtcattcctgctcagggactaggctaattcctcaccagttttcccaaatagccagataaacaaaggtgcaatttttcttgaggaaaattatgttgagaagcaaacagggaaaaacatttagactgaggtatgaaattactttcctatgcacaaattattatctgtcattttgcaaataatctgtttgcaattgccaggaggtatctctgagaaatgtgcagagaaaaaagtggcagatgagcaggggcagttgggttgagatgatcaaaaagtgaagatgtatttggcctgtagttattcagtaagaaactttgttattttggtttaaaaattgtacttgctaattactgatgcattctctsgtttgaattatataggcctcgaatggctacagagagaggaaatttggtgtttcttacggggtctgctcaaaacattgagtttagaaccrgatccctgggaaaaattaaattaaatgatgaagatctcagtgagtgtttacatyaggtaatacactggaaatatattgaagtcattttgtatatccatatacggtgacttaattgaacaagtctagattaatctgtaccttgaatcttttttaattattattttttattaatacataatttgatacattcctataatgtgtaaagttcaaatcagggtaattgggatatccatcaccttaaatatttaccttttcttcatgctaagaacatatgaattgttctcttctagttattttgaaatgtacaatagattaatgttaactatagtcaccctactggtctatcaaacactaggtcttatttcttctatctaactatatattgtattcattaatcaacctgtcttcagcctccctcccccttcctagtgtaccttgaatctttagcatagagaacataattgggcatcagacatgttcttgtaaaggacgatggcctggggttaatagtgggtagagggagtatgctaaaagatagaagctcattgtgccagacaatgcaccctagtccagagaaggcacggagggtggaactgaaactcctccacaggggatgcgaggaagtargggaccaaggatatgtggacatgtgaccagtttgcttttgccacagaacagaattggccagttattctcctgccttactgggtgttttcatttcccaataatcactgcatatttcagtcataatgttagaagtcagcattattcagagcttactgtgggccatccactgtgcttagcaccgtatggatgttatctcatttgaccttcacagctgtcctatgaggtggcctttattgtcaccctagttttacaagaggtaaagaaaccctgaagcagttaggtaacttgcccaggacagcaataaatagctgagccaggacttaaaacctaaacagtctgcttccaagccaggtttcttaataagcaccctaaactggtattataggaaaacatacaaatggaaaataccttgatctattgttactgaaaaggataagtggaattatgctgtggctattttagcccagtgtttattacgcatggtgttgttttggtttttataataataggcaagatcttagtgcttaaagtagaatactactcaagtttttaattatgttactgtaaagataaatatgatattttcactagtgctcttcatttcttcttctttttctaaaattagatccagaaaaacaaagaagatattatagagttaaaagggagtgcaattggtctgcctcaaaatatatctagtcaaatctatcagcttaattccaaggtaagtctgacatctacgtcataagaaccgatgagttctccctagttctattgtataagtaaccgttttgtaggggatataccaactttgtgtgctctttagagatttagcatgtaactactcactgtttggttaaatgacacagctgtaatggaggctgtagaagtgatggacagaaggcaggaaatgctgtgcaagcacttgttgcagaagtaggccttgggctgggagcagtggctcactgcaagtgaatggatgattaatataaaaaactgcctgtaatcccagcagtttgggaggccacagagggagggtcgcttgagcctaggagtttgagaccagcctgggccacatagtgagactccgtctctaccaaaaaaaaaaaaaaaaaaaaaaatagctgggcatggtggcatgagcctgtactcacagctacttgggaggctgaagtgggaggatggcttgagccagggaggttgagrctgcagtgagctatgatcatgccactgtgctccagcccaggcaacagagtgggaccttgccagaaaaaaaaaaaaaaaaaaagaaagagagagagagagacagaaagagagagagagacagagagagagagagaaagaaagacagagtgaaagaaagagagagagagaaagaaagaaaggaagaaagaaagaaaagaagccttgctgaagttctgagagcaatcttcttattggggaagtggatgcatcactgacatttatgaacattyccatagtcactgcctacagagaagcaatcggtcaacttatcagtgggttgtactttaaaaaaaaacttaaaaaaaccccagaaatctatgtgataggagggaataggaaggaagaaaatcctgaggggagaggaatgaagaggaaaaagggaataaaaggaggaatgaacaaagtgtgtccctagcagagggcattaggacaatatgtcaaggatataacatcacatgtgcaatgcctttgaaccagctaactgaagctttttcttccctattgccagctggtggatcttgagagaaaattccaaggcttgcagcaggtaggtctcatgctactacatacccaaatctttcacagaaaacatactagaatcattaatagagctgctattcttattttgaaggtgaatggatgattaatattaaaaacttgctttttcccataatttaattctcatcccagcrtgtgcttcccaggatgcagatgcagagctgagtctaagacagatgaaatgacaaggctgaggtctccgagcctgttagggcttctgaccctgagtttgcagcccacagcccacatcctttaccatcaccctttagctgtgtgtgctgtgcttggtcagctagtgatctcccaacttgctgattctcccatcagggactggggctcggaaagcaagcatcctctctgacgctaagctcggaagtctaggtgtatcacaaaatagtccgaattttcttaaaaygacatttgctggtaattaaacttgaacagtttcttacagaaaacattgtataactgtactacatgcttgtagactgatctatgtaaacttaggcttcttaccccttttgtaggaagctgaccttttaaagactttcatggaagctgtaaccttctatgcagagaaatgtacagaatctcttcatgtttaaaattttgcataaaaatctggggattccagtgtaagaatttctgcaaaaatattcttcatctgttttgctcatgcttcaagcattttcctctacttttaagtttgatctgtcccactgtgaaggacagatacaaaaaaaaggactcatgcagattgaggcaggtcccaccattctggcaaggattgctgctgcaaacctttttgtcatttgatgatcaagttcgtgtattccttttctccacttagataatacattgacccctcagctgtcatttttaagagagtagttaagcgaaagaaaatgagtaaagaatagtgctgtggaccgtgacactgcactcaagttttgtctcctggagggcttcattatattcgctcagccagtcctcctaccctcatccctcaggaggaaygttgaatgattttcaaatgtgaatgctttgtgcctttggatagggcaaatgctctctggccaccacagtccccaccactccctattgtcttcctcctgactcctgatttcattttctactaggcccctgtaggcttttaagattttagtccccagacagtgttgcttttgtctgacagaaaacctttgaatgagtttgtggttaatgttttaaagagcattctatgatggacagagccaattgttgtgctagcacaaagagaaaaatagaataatggaataaaacagggttcataaagagamccccagaygtgtggtcatctaatttatgaccaaagtggagaaggaatgtgctttgcagaaaatggtattgagtcagttggctatcctctggctttctatttcatccataaaatgaaggaaacagacgtaatttttttttatgagtcactgtatatagtatgttgtatttgtatgtgtgtgtgtatgtatgtgcatatatatagacacatatataatatatatgtatgtgtgtgcatacatatatatgaaatgtaatcaacagtttgcccctattttaactttttaaaarcagagaattaggttgggtacggtggctcacgcctgtaatcccagcactttaggaggccgaggcaggtggatcatgtgaggtcgggagtttgagatcagcctggtcaacatggtggaaccctgtctctactaaaaatasgaaaattagccaggcgtagtgggacattcctgtagtcccagctactgaggaggctgaggcatgagaatygcttcaacccaagaggtggaggttgcagtgagcygagatcataccactgcactccagcctgggtgacagaccgaggctccatctcaaaaacaaacaaacaaacaaaacaaygataccaaccaaaacccagacaattggactatgagtgaaattcataaagtggccatcattgcataatcaagtgttccctctaaagaagttttctctggctgggcgcggtggctcacacctgtaatcccagcactttaggaggctgaggcgggcggatcacgaggtcaggagatcgagaccatcctggctaacacggtgaaaccccgtctctactaaaaatacaaaaaattagctgggcrtggtggcgggcrcctgtagtcccagctacttaggaggctgaggcaggagaatgkcatggacccrggaggcagmgcctgcagtgagcrgagatygcrccactgcactccagcctgggcgacagagcaagactccgtctcaaaaaaaagaaaaaaaaatcaaaaagaaaagaaaaaagaaaaaagaaaaaaaagaagttttctctgcacccaaaggcagtaaaaatcttaacaagattcaaactggtagctgacatagggtcagattccccaggttatgtagatgtagatgtagacaaaggtaggtctgtttgtgatctgggctgaaagcagtcaggtgagcaccagggtgaaagatatgtcttagctggccacatttctaacaaagggacttggagcaggagttcagtcaccttaacccatgggaggaggggcagcagcagcagatgattatatttcaaaggctcacctcgagggaccaaagataagaatcaccggtaaaataaccggaatctccattttattttctttgtgcaatagcaacatccattattatttccayacctgaaacctttactcctgtccactgaggtctctttctcaggtgagaataatacttttccaagacaaagtgagaatcttctcccctcagacttcatcccacccgtggtcaaaagcatgctgagagttaaggaataggaacaagattgataatagaaaatgctttctgttttttcacaagagaggtgatttgaagaagaacataagtaatggctttaaagtgtagaaggagacccccactgattaagagttaaatgtaatcccacgtgcacggtaacatgcgttttgttgctgctgactgcaagtcatctcattgactgtcctgtttttgtttcagactgttgacaaaaaggtttgcagcagcaatccttgccagaatggtggaacctgcctcaatctgcatgattcctttttttgtatctgtcccccacagtggaaggtgagtcatctactctttggttaagaatgatggcmrgtcagcatctgtggtttccttggaatcatcaggcatatttaattctccatctaaagtttctaggattctgtggcctcccamatcaaattgaaatataccaggtatgctaaaacccaaacagtggtgagtatgattgtataacccaccaaatactaaagccattgaaaggagaggttcacttgattggataactgcctggaagaacacaatatttctgttaacattaatttaaattgttcagcattggaaagtaccaaacaaatcttgacatacctatgcaaattttctcattttctttgtttgtttattttttctgataacgatggaaactgtctccagcatgcacataaaaaaaaaagttaagtaagtattcccagatgtagcaccactgtgaactgaggattctattatgtttagataaggattcctctcctgtgactgctgtgatcttatgaagagctcttgtgttctattaggtgaaatctgagttccagaggaagaatagccaggggttaatatcagtattattgtatttgactttatgaggacttatatactgtccacgtataaatccttaaacgtatcatgtgaatgttcgctccagatacctctgtgacctttggcacctgactttgttccttatatgatcacagggtcctctctgctcagctgatgttaacgaatgtgagatttactcaggaacacccttgagctgccagaatggaggcacatgtgttaatacaatgggaagttacaggtaactttttttttttttttttggtaaatatcaggtatatttttgaaggcctaaaacatcccatagttaagagcatcctaaattaactatctgtattccaccaaaagttggtactccatgaggaaatatttagctcttgcttaacgtctacatagctatttttacttaactgaagaaaagctcatgagtcctttactctcaccccgtgaagaaatccttgctctaayatccccaaggaaccggaagaaggctcccgtgattggcacagagagtaagcatggcctggtgcaaaaggagctgaagacttaggaagagccggagcattgaaggggagccactgaatggccttaagtagaaaaggggacaccccaccacaccagtgtccccagctgtactctttccatgtattagcaagctcatagttttgggtaaagagagctttattcaatgctatgtcaaaatgtgacyataacgaggtcaaagattaaactgaggttcaatgaatgaagtaactctctctgaccacagtcatcattatcagtacagctctatcttctcttctgacttattctgtmaagtgacttgtccacagaattctcctgctcagctcaggcatcactttctgcaggaaactttcccttccctttttaagcagagtgaggcatctcagggcctctatgttcccatcatgctctagggatatccatcgtcaaagctttgctgatgmcacacacattgtctttctaaaaacgaagtccaaaaaattaaggcagatcaatgccaaacttacttttgtacagttctttgaagtcaccttttaaactagacagtgtctttccttatagtttggctggtctcttttattttgtgatttttaaaagattaataaataaattctgctatagaatgaacaaatcctttcaatgctctggagtagaatctcactggattgaagagcaattatttgctctcttactggtgtctctgctatcttgttcttcaatttccacataacaatatccattctagtctttccagcaaaaatgagtgcagtaattttgttttttaaaccatcactattttttttaaattttattattattatactttaagttttagggtacatgtgcacaatgttcaggtttgttacttatgtatacatgtgccatgttggtgtgctgcayccattaactcgtcatttagcattaggtatatctcctaatgctatccctccaccctccccccaccccacaacagtccccggtgtgtgatgttccccttcctgtgtccatgtgttctcattgttcarttcccacctatgagtgagaacatgcggtgtttggttttttgtccttgtgatagtttgctgagaatgatggtttccagcttcatccatgtccctacaaaggacatgaactcatcatttttttatggctgcatagtattccatgttaaaccatcactattaatgcacacttctaaaaatgcagtcacaaaccttctctttttatttgatacttttgtttttttgatctgatctttaaaacttttactcattccaggttataaactcaaattattcaaacttctactagatatgtctatgagttcaatcattatgcaaaagtaaaattaaccacttctgacttaaatttagtgttatgttattaaagagctttttgattccaggactctgtttctcatttaaatgaagmcttttttccctgcctttgttaggcttgggctggaagcaaaatgcagtctagtctctcatttccgtgaacccattatctcctgatttctgtttatgggcatttatcaaggaggattgctacatagaggyattggtggcaaatgtccaggctcctagaacttctgctttctgaccttcctgatatctaggaatgttacagagattagatttcactcctagtcttcctttatcatcactgtcttttggagtcttgtgggccaatagagcgacaagtatgggcaamctgtgatgagatccatagaccaagataaaggctgttgctgttttcagcacgttatttyttccccctgcaaaatgaaaaacaaaacaaaaacccttttactatttaccactctgcagcatgtcagaggttagagttctttwtccacacacacatatgacagaatgagagctaggaggaaaggaaccatttatttgttgaaagctgcatttctaaatgacagattcaactttgtaagaacagtacgaaattctctcttgcactcttttataaaggagagcaagaatacagaagaactratgatgtgtggatggctttggaaatgatcttgattcctagactctgcccttcatagatttgctggaggacattagagaacagagcatttaaatcagggttctttctcttgatatgggaatagtttctgaaacctcatgaattccatttcattatctacactttaagtcccgtaattcaggcatatgttrgagactttttgagggaataaaagaaaatgaaaaaaggtgcatgagcataagattaaattattgctttgtggaatccacgtgtaatgaaacaagtgaacatttagatactttcttgagttctgttaattatgtgaggttaaatccttgttaatcagggtattcactgaggctagaaaaccctttgggaaatttcagcacacattagctaaaagaaaacttgagcctcagaatcatctggacctgcaaaaatgtagtcatggcatcaaagttcgctttggagtttggacctcattcagtttctttaactmtttgagctcttttacttggacggaaaaaggagtctttaactggattaatmatttgccattgtaaagacctctgaaaaggtgcagatactcattcatggaaagtcctgtttcatacctgtttcataggtaaacttctggtggaaattcttttttagaacaatgattatagcacaagaaacatcattttctgtttccactgattcttttggcttgaggtctagacccagagcttcagacaactaacacaattacatttygccacttctccatgctgttactccctctttgttctgaagacgtgattcttgttgtttccctgctcactttgttttgttttgtttgtttttgtttgtttgtttttgagacagagtcttgctcttswcacccaggctggagtgcaattgctgcaacctctgcatcctgggtacaagcaattctcctacctcagcctcccgagtagctgggattacaggcacctgacaccatacccggctaatttttgtatttttagtagagatggggtttcaccatgttggccaggctggtctcaaactcctgacctcaggtgatctgcccgcttcagccacccaaagtgctgggattacaggcgtgagccaccgtgcccagcctcccctgcttactttggatttaagacagcccttgggatctgagcttgccatgcatggatggtgtgtgttgtacatttagggctcagatctagaaggctttccagaaaaacaaaaagttgagtttctctggttttccrgaaacatgatgattagtaaattttatttcacttatttccattcatatcactggtagattttacatcatgcagagtttaaacaatgaggataatctagttttagctcaggtggtagttaggtattaaacttattacctttttcactcagtcagtaaaattagtattgaaccatggactctaacacaagttaaactatgactatccaagtgtgtttaacctcttctcaattgccaaaatgcacttgcagtgttttcaaagaaaagcctagatttgttctgctggaaccaagttggcaataaaaggtcatagaaaagacacttctgctatatcagtaactaataactaaagcaggaatagtagtaagttggttttaaaaatacratatatggcttttrttttcacttagggaggtatataagtaattgttcatttttaaaggccatatcaagacaccttgaaaatatattttgcctgttaaccctgttatgtttaaaaggtacatgaggctgggcacggtggctcacacctgtaatcccarcattttgggaggccgaggtgggtggatcacctgatgtcaggagttcgagaccagccttgctaacatggtgaaaccctgtctctaccaaaaaatgcaatacttagcttacgtgctggcacgcatctgtagtcccagctacttgagaggcagaggtgggaagatcgcttgaacctgggaggcagatgttkcagtgagccgagatcgcaccactgcactccgcctgggcacaagaccctgtctcaaaacaaaacraaacaaaacaaaacaaaaaggtgcataaaaatgcagcatcttcatataactctacttatcagaatgtaagaatataacatgyaggaacaayggtgcaggagtcgggtagacctaagtgtctatttatcttctgccaattattcattttgtggttttgggaaatgttagtctgtaaaatgggattaataatacttgtctttgaggatcataggaaggaatcctatggtttacttgagtttcttcctccctttctctatcttctcacatcatctaaacttaagtgaaagaagtatactctgtagctatttagagaacagtataggattaatgcctactcatctcccagtgataatagcaaggatgaaggaagagagagataaagagaaaggatttaactgcaggtccatgaaccagaatctcctctcaaatcttatgtcattttgcaatagttaagcacttagtgataaaataaagacaatcttcttagcacttgctacagggraatgcctgtagactgcaatatgaccataattcacagagattaccactattatttcataagaaattgaggcagagggagttagtacattgtctgggtaaacagttaacaggaaggaccaaaatttaaacctaggcaatcttatcccaggggtttccaaacactcagatctcccagacatagaaaatagaaagctagtaacagttggtttaaagattcttcagcagggtgcggtggctcacgcctgtaatcccaggactttgggaggccgaggtgggcagatcacctgaggtcaagagttcgagaccagcctmtacctctagaaaagagacttctgctaaatcagtaactaatcaattggtttcaccacatggtgaaaacccatctctactaaaaaaagaaataaaaaattagccgggtgtggtggcacgcacctgtagtcccagctactygggaggctgaagcaggagaattgcttgaacctgggaggcggaggttgcagtgagctgagatcatgccactgcagtccagcctgggtgacagagtgagactccatctcaaaaaaaamaaaaacaaaaataaaaaagattcttaaacattgttgggaggtgttgggacaggtggcaaagtaaacttttagtaatgaagyctcctggatcaaatgctcaaatatgtgtatgaactgttttaaagttccataatcctcaagagtctaattaaattctctatacaaatattctatgtaaagatgggaggacmaagaggaaagaaaacaatatgagaaggraagtagagagagatgcggggaatataaatgtctatgggggggatggataattcaatttctctttaattttaatcatttattgttattttcctatgactttatcttagtgagccgttccaaaggcaactttggaatgctcagaaatgtcatatattaatgaatcagcttttatgtaaatatatactgatgtygtaaattgcatggaacatatttataccaaaaaatattcatttattggaaactcacatttatttgggcatgctgtatttttatttgctaagtctggcctcccgacttgaatgcatggatggtgctccctgcattcttattctccatttctggccacactcattgctctcctcttccttagaaactgccaaaaagctgccaccccagcaattggttctggggcccaccacaggcaagccgaatcctrtgcctggagkttggttcttgatgcctttcaaacagtcaaatgctaatttcccacaatgtcgttcatacattgtcatccatgaacattackaagctccttgtacctcactgtgtcttgttaaaatagctcttttcctttgtagaatggcatgggagggaggcctggccacgcaggcacgccctgttccttgtctctgacccctggcaccaacagtcatttcccccatgagagcttttcttgccaattctgctcaagtccggcaatcggcaacctctgggcctggccctacctctccatcagatgtgccctggcatgtggggataggcttaggcttctgggactcctctaccctcctcctcccctagctcccatgctcagatcatagaagttcccattaagctgcagagataaggctaaagcagctttaacaatgacaasggcttaaaacaacattgcttatttgattatcattggacttaaatcttctagtaacaaagcacccactgctagcttacgcatagtgtaataattaccacattttgttggaaattcaagtgtggctatgaaagaaatgccactgtattatattatataamtacgctttttatggatagaagacatattgccctttgtaagataataataatgatcatagactgtgaggtgtggacactggattgcgtgtggggttatataatcctagagagcattcagagttatcagtgtagcccacgttgcctgtgcttcatggcaggtccaattggacagatgatgaatggatttgctgatctctccctttaccttcttgaactaactccattacctttggcttatacacatctgacctttgaaaatgctgtttgatgacctgataacacaagaatttatagtgctaggcttaccagataataagttgtgattcaccaacattgtatttactcaatccaccacttggagcacagcagagtgattttctcccgagactccagtcagtaaatttgcattgctggctgacgattccaagttaacatcgttgatttgtaatttgaattatttttctcattgatattaagagacaggcactggccccaaagcgcrtgccctgacattgtgctcttgtgtaaccaacagttgtcactgcccacctgagacgtacggaccccagtgtgcatccaaatatgacgactgtgaagggggttctgtggcacgctgtgtccatggcatctgtgaggatttaatgcgagagcaagctggagaggtgggtcccttccccaaatgtgcctccttgcagagagccatggttagtagctcctcctcctcctatgcccactgcatacaagcactacctggagcttacagaggtgaagtcacttcctgtctgtaagtaggacataggcgaggaggggagatgaastatgcaggaagtaggacccagagattaagatgtcattatgtaaaataggatttttttttttttttttttttgagatggagcctcactctgtcacccaggctggagtgcagtggcacgatctcagctcactgcaaccttcacctcccaggttcaagcaattctcgtgactcagcctcctgagtagctgggattacaggagcatgccaacatgcctggctaattttggtatttttagtagagacggggttttgccatgttggccaggatgrtctcgaactcctgacctcaggtgatccacccgcctcagccccgcaaagcgctgcgattacaggcatgagccaccgtgcccggccgaaatgggaccatttttattatcccgtcatgactctctctgagataagaccttctcttggccttgtaagttttattttaacagtgacaaaacacaggaatataaaaggaccagtcttgttggcaacatgtggtttcaaggagtctgacttttcccggcctgggtctctggaactgctgcagactctaagagcccactccccagaacgaccctccatgccctgcgtcctgatgactttgactcctgaccctcaaggttgtccagtcttggctggcttggctcttcatgagaacttcaattctttatttttagttgtattttttctacccatgtgatggaaaataattcccgtccaatgatggggatggaagggttgaggaggtgggtaggaggaagaactttccaaagaaaaacaaacggaattgattttccaargtctgtgcctacatgggtgtttttccctctaaaaacatagcaggctgagttgattgactttaattatattgacttacagttcttgattgttgttactctttccctggcatctttgggagaaattatagcttgcttttactctgaaataaagatgtttccctttttgcatggtctggtctaaatgcttaatcatatgggaagaaaaagasaagccagtggattggccttatggaaatgaacgttagaggataaacagttaggggcttgatgaaatgttcaaaggcttttcttgctgattttcatgattgtctttattcacgctgttgtcatcctgccagcccaagtacagctgcgtctgtgatgctgggtggatgtyttcacccaacagccctgcctgcacgctggacagagacgagtgcagcttccagcccgggccttgctccacacttgtgcagtgtttcaacactcaaggctctttctactgtggggcctgtccaacaggtacattctcagggccacaagccaggctctgcatgccaggttggcgaggtgccagaaccaattttctttcactattgatgagtaagaagacaattcttaggaggtgttcaaatccagttttgtgtcctggttctgctcracgatctcactgctatcacaattccacgtcaaaagggggaggcttgtccaaaactgtgctagagtcagactttggggcaaggttagccatagaatttgtaagttagacactgcattgcagtgaccaccaactgaccagatttgagatcaaaagagatactctagtcccacctttcatactaaccagatgtttgtacacatggggaaattatttgacctctttgcatctccaccacagtctagtagctcttgcctgggtgtgtcattagagtatcttgcggccttgacctaaacagaggtatccagctccattatgccctgcagcaactgaatctccrgggatgccatatgttgagtcatggaaaacatgggctccgttagtcaaagactgcctgtgtttgaatccgagggcatcttttgttttatgagatagtcatcatatattccacacattttttttttgtaggatgcctactatgagcaaagcactgtgctgggtgcattggtaggcaattagccagacctcaggttcatctgcgctccagggrtgttcttagaaatggagccacaaagataatgtaataatagtagctggttttgttttgttttgttgttgttgttttgagacagagtctctccctgtcacccaggctggagtacagtggcatgatctcagctcactgcaacctccacctcctgggttcaagcgattctcctgcctcaccctcccgagtagctgggattacaggcacacctcaccacacccggctaatttttgtatttttagtagagatggggtttgccatgttggccaggctggtctcaaactcctggcctcaagtgatctgcctgccctggcctccaaaactgctgggattacaggcgtgagccaccacacacggcctggtttttatttttaatcaaagtgttattaaggcattgtataagcaatttttaattcttttaactacaacaaaatcaagacatggtaaaaataagtattactcacattttacaatatgagaacttgagcttaaagaggttgaataacttgcccaagatcgcatagctttacagatagccagaattgaaacccaagtttcttggcaagtttcttctygccaagaaaccccacacacctattgccccatgtagtgatttttggtttagtggttttctgcgtgtatatatttagatctygtaaaactggaaagaaatggaaaaaaaaaacctataaagactttttccctcttagttctcaggggcaagcacaatttgcaagcaatcacattttgaaggtaatttatcatggacaatctttaaaaactataaatcagaaaaataaattatttaaattagaagattggcaatgtttttacattcttctttttattgttggagaggaaaaagagaaacaatttttttgttttcttgtttatcaccctatttttcctgaaatatatggtagttatattttataagcagcaaagcaatatatgctgcttataaaatatcactacaaaaatatggaaaaaatagaaaaaaatacctttgatcttatcacacagaggaccatgatgaacatttgggcrtttttttcttccaactttttttcatgtacacattttgccatgcacaaatatgataattttcttaggcagagtcttagaagaggattctacttaaatcaaagaatatgaatatttttaaatctttaaaggtttttaagaattcttataattttaataatttgaattataaatctacaaccattgaatacaatgggaaccactaaagtaaaattcttaaatctcatcttcctaatgacaccattagtcatttgttctccttcctcttctactttattcttcatttgtacaagcacatatgcaagagtttaaaaaattctttccccaaattaggagtatgagcccaatcctccatatgattttaacagtttgtttttgtttttgagacaaagtctcgcccaggctggagtgcagtggtgcaatcttggctcactgcaacctccacctcccgggtttgagggattcttctgcctcagcctcccaagtagctgggactacaggcgtgaaccaccacatccagctgatttttgtatttttagtacagatggtgtttcaccattttggccaggctggtcttgaactcctggcctcaggtgatctgcccacctcggcctcccaaagtgctgggattacaggcatgagccaccttgcccagccacatttagtattttaattaatgtatatacaaaaattctttcaatgtgtgtgtatgcaaatgtaggtatacaggtgtacacatgatattaaaaagcgtttttagtatttggtcacaaagatgagtcataaggtgttcagctatgcttctattgataattgagggttttttccctattaaacagtgctgcggtagacatcctcttacctacttataccagtatactaagatgtatactaccatcttagtatactggtagttttatcacaataggctgagttttaataggtgcaactggcagtcaaagtctatgtattttaaaaattttagtgaatactgccagagctctttccaaataggttatatcaatttaatgtctagctatcagcatataagaggagcccatttgcccactttgttgtcagaatttgattttaagaattcaaaacaacttttgccaatctgataagcatatctcatttttattttatagttccttaggtggagaaggtttttatatgttttgactcttgtatttcttccttgttgacttgtctatagagctaaacttttaaatcctcttgttttcctaggctggcaaggcaatggatatatttgcgaagatatcaatgaatgtgagataaataayggcggctgttctgtggctccacccgttgagtgtgtgaatacacctgggtcttcccactgccaggcctgtccaccaggtgctgcctcggttcaatgtcaacctcctgaccccagcacagggaacacagacataggaatayggaatctagtgctccatttaaaatatgatttctggctgagtgcagttgctcatgcctgtaatcccagcactttgggaggctgaggtgggcagatcacatgaggtcgggagttcgggcctggccaacatggtgaaaccctgtctctactaaaaagacaaaaattagctgggcatggtggtgcatgcttgtaatcctagctactcgggaggctgaggcacsagaatcgcttgaacctgggaagcggagattgcagtgagctgagatcgcaccattgcactccagcctaggcaacagagtgagactctgtcttaaaaaaataaaaaataaaatattatttctgtcttaggagaggaaatagtacagaaagttttgcttatcttgtgaattcaggacacattagtacaactctatgataagaaagaaaaaacattttgaatatcagtagaaaacaacaaactttacaaactgtcaaatagctacagagataatgcagaatttgaaaagttttctgagtggatcacagacttactgttccattgccctcacgaataatttgttaatatcatgcactcctgagttgttttgcatataccaagtttactaaaccacaggcatcacagtaggcatatatcgtaattgttggtttccctccttttctggaaagaagtcttttctgctattctctaatctaaatcgaattactacccaagaagttcagggagtactaagggataaactgaaaccttgtatgtttaaataacatggaactacagtactttgggcttctataataaytgacctctaagaacatcagagtcactgtaatataaaaatattaactttcttagtgtcagcactttctaagtctaccagtagttttatacatatttttttcattagaaacaacccagaacattgcttatgaaatcaggttactaattcttgttatttttcttatttatgaaatttcatttgttgatgacattttatacttatattttttgtttcgatgatagaggatccctgattggtccatttcatgatatttgaatcctagacaggctttgtcctcccatcttcttgacattgtttcttatgacctggctcttgttctcatcagggtaccagggtgacggaagagtgtgcacactcacagacatctgctcagtcagtaatggaggctgccacccagatgcctcatgctcctcaactctaggtaatgactcatctctctctttggctttgggtattgtaatatgaccttctaaaccaattcaacatcttaaacacaaaatcctctgttctcaaaattgttattttgaccttcaaacctaaaattaatccatgccataaaactacacatttggctttcttaaatatgtaataaactatgctctttaatggtctgctctgatttaggaaataaggtaattaagccagttaattaattaacgactgtattccaacaagcaggcaggagaaaaggaggaagaaggcaatgccaccttcttttgaaggactcttccatttctaggccattgcttagaactgagctttgctgcaaagggagtttgggaagtacactctatatttcaggcatcctgagtccagctgaaataaggagttcagaaagaaggaagtagaaaatagatctagggtgacaaccaacagtgtttgcaatgctgcatagaagggtttaaccctgtaatttaacaaaatatatactgctaaactttctccaagaaagattgtatcaatttatgtattcaccgacagtgtataaaaatacatatttactccatctttgacaataatagatattattattatttttcatcttggtcagttttataggcaaaattagtttttccattattttcatttatactttttgattactaataattaatactttccacattttcactgggcatctttctacttgttcatcccctttgctctctttctttcttactgattggtaaagtttctttatgtactaaggacattatctcattatctgtcttatgttttataagtgtttttcctggcatgttgtttttgttttaatcttgtagtggtagtgctattcagaagtttagaatttttacgtagtcaaaaagataaatcttttctcttactatttctcccttcacagtcatgtttaggaaggctttctttactgaactctttaaaaattgtcaagtacatgttcttttwtacttctatggtttctttttttatggtaagatattttatatttttagaatgtattttttatccgtagcatcaaatagagatctggcttggtatttttgctcaaataagtggacccarttccatttcttgaataatcatgtctcttgctatttcaagataccacctttattttttattaatttgtcatatacttgcatatatagaaaagaacatatatgtgtatgtaaacacacacacacacacacacacatatacttgtgactaaatgcttattaaatgattatcaacataccaaagtggttaggagcatgatttctagataaagactgcttgcatttttccctgggctccaccagattttagctgcttgtcctcagtgaagacacttaatctctgtgctttagttcttcatctgtaaaatgaggataataatagcacctacctcagggtgcttcagatgattaaatgagtccttatatgtaaagtgcttgtaacaaatattattacaaaaataactgttttttaatatggaggacagtcataatgttgatgacatgaagtattaataacactttgtgtacttttaggctgcccttctttactgcaacctgtaagtttaccctgggaaacttaaaaaatttctactcagagcttcaacagtttcagagcttgcttactccatttttccctataaatatttttaaaagaagtaattaactataaaaaaatgcatttctaggcaattatttatttaaaagaaatatttgtgttttttaatattgaagtggaatcttgcaagtaatataagctgagaacataacaaaacttgtatttttgccaggcgcggtggctcacgcctgtcatcccagcactttgggaggtcgaggcaggtggatcacgaggtcaggagatagagaccatcctggccaacatggtgaaaccccgtctctactgaaaatacaaaaaattagccaggcgtggtggcgggcacctgtagtcccagctactcgggaggctgaggcaggagaatggcgtgaacccgggaggcggagcttacagtgagctgagatcgcaccactgcactccagcctgggcgacagagcgagactccgtctcaaaaaaaaaaaaaaaaaaagaacaacttatattgtcattcaattctactgtaaatctgtcacattgtgtaatttgttctattttttaaattattcagcagggtttttctatccatctttaacagttcttgctgatggaggaatgtagttaactgccacattgatttccttgtattatttcaaccattgtgcagtrgtagaaagaacatatatttctgcaatgagatgtggctttttgctattaagtgagaaatctggaaaactctctggatattaaatttagtaaaattttgtaatgtctatgacgagtatttttaacctaacattgcgtaagaaaactgtcaagatgctggatgctctaaaactmtwgttagctattacctcatgtacatcataattaatcgtggatgttaattcatgttttaaatagacacgatcatttcaaattccttttgaccaagttccttcctaacctaattcgattgccattgttttaaccttgwaccttggcaatgaggagctcatcagaagtgtgggagaagttttggtgctggtattttgttgatgtccccatatatttatgttactatattatcttcaatctgtggttttattgcaaacrtcttttagagacttaagttcattctgtgatagctatttagcctgtttaaaactggcagcatgcaatctgcacatccacataactggggacatgtggcctgcctgtgtaagccacactcctgtacaggtgtgctgtaggcagcctacacacgaggggagtgcttgctstctgggctcccctcattctagctgtgtgtgtgtgtccttggccgggacaggctgtctgtgtactggcttcatctgtaaagtggggattataagagagtacctatatagggctttttttttttttttttgagatggcgttttgctctgtctcccaggctggagtgcagtggcaggatcttggctcactgcaacctccacctcctgggttgaagtgattctcctgcctcggcctcctgattagcctggactacaggccaccatgccccgctaattgttttgtatttttagtagagacagggcttaaccatcttggccaggctggtctcaaactcctgacctcaggtgatccgcctgcctcggcctcccaaagttcagggattacagattccatagggctctttattagtattattattattataattaaaaaattttttcttggaaayggagtctcactctgtcacccaggctggagtgcagtggcactatctcagctcactacaacctctgcctcctgggttcaartgattctcctgcctcaccctcccaagtagctgggattacaggcgtgtgccaccatgcctggctaatttttgtatttttagtagagacagggtttctccacattggccaggctggtctcgaactcctgaactcaagtgatctgccctcctcagcctcccaaactgctgggattacaggcgtgagccactgtgcctggccctctattgggctcttgggaggattaaatcagtcagagtaagtccagtgcttgcaacagatagtttcatcctaagaatctccttttctgcattaactcctccatgatgaggaatgtctgtcttccccaggtgcagctcacctttgtgcacagctcaggaccatctgacatatgggctgacagcacccatgtcaacccagtacgtcaataatgtgtggaaggcatttaatggctttcttattttaagataagaaatacaaaaataaagattctaatattttctcctcataccttgttttgtctgcccgtcaaaatacacagactggatgttggtggatccttgtctagacagcagattctgagtttagatactgcatccgaacagaggaggagacctgtatttacacgtttgtttttatttctgaacaggttccttacctctctgcacgtgtctcccgggttatactggaaatggttatggghcaaatggatgtgtgcagctcagtaatatttgcctaagtcacccctgtctaaatggacaatgcatcgtgagtcctttgtttttcctgtggacagagagtacctgagaattagtttcacgcctataaaatgtaacgttataggattcaggaatgtcaagataatgagtcaagtttcagataaggaactgtcgagaactctcagatgaaagatagataatgattttagttcttaggaaaaaacattgagttaattttttgtctcagtggtttatgaagtactaaaactacgcctgcagtttgatctaaataaatctgacatacaaaacaattaccatttaaacctattaataacaagtagactactagaaaatacttacatataaacacatatatatttgtagcacctgttaaatatatcagtaggccaggcgtggtggytcatgcctgtaatcccaacactttgggagggtgaggcgggtgcatcacgagccaggagatcaagaccagcctgaccgacatggtgaaacactgtctytactgcaaaaagttagccaggtgtggtggcgcgtgcctgtaatcccagctactcaggaggctgagaccggagaatcacttgaacccgggaggcagaggttgcagtgagctgagattgcaccactgcactccagcctggccgacagagcgagactccatctcaaaaaaaaaaaaaattatatatatataattatacatatataattattacataaataataattatttttaaatatataattatatattattttatatataataattatataattattatatattatatatctccatggcactacattcctattatttggrttgattaaagtttaktgtctatccatttgttttatggtattatgtgttttttttccccttaggacactgtctctggytatttttgtaagtgtgactcaggttggacaggtgtcaactgtacagaaaacatcaatgagtgtttgagcaacccctgtttgaatggaggaacttgtgttgatggcgttgattctttcagttgtgaatgcacacgtctctggactggagctctctgtcaggttcctcagcaaggtacagtcagcatttcttatgccacggatgctcacagcatagcagcagcatcctttagtgagtccctcaacagattcctctgctgaacccactttcttgtccagttgctcagatactgagaactaagtctttccttgcagaaatggtataaaattcacaagctaaatmtttataaatctcactgtaagccaagaacttttcttccaaagaataaatacattagtatttgccattttcactatgtcctttttgaatataaaacatgctaaggtattgtcttttatggttttctaaagggaagttttctgaggagcagccacttaatttccctagagtactgcattgaatcaagtcactctccctttccaggatacacagtggcttcccgttgcctgttaaatagagactgggattaattttcaatgatcttctataaccaagtctcactcaatccatctaaccttttttttcactagttccctagaaatamcttcactcaagcaagttttctttcgtcaccrgaccccatgtaccaccatgagtattttccactgtgttcatttatttggaatgtttctcccgataaacstcctcacacatcttccttgtttctcatccagatgtgtctgtccctcaggagcacttccctctcaacttcttccataaagtcacttttgactcttctgcccctcacttaaactcctgatttggaatcaacacatttattgagaggttgttgttatatgtttaggrcaatagtagaccctatggaaaaatatgaaagtgtaaaatactgtctccacttatgaactgctcaccttgcagctgaggagacaagaccaaccccaatgggagaacagatacaagagttaaagacatgagctatgttgtgtggggtgaaattgggtgtcacagggacacagagaatgggaatcagtgaaaacataagacatggcagttcatggagcaggtgatgaggcatcagctgagctttgaacaagaggtgggatttctatggaagttgacagaaaaagggcacagaggagagggaatggcagggcttttatctccaaccttcattactcaaattttctctaagtttatcagcagcagggttacagttgcccaacctcttccttttaggaacctctgaaaagcacagttcatcttttcctttgcagtttgtggagagtccctctcaggaataaatggaagcttcagctacaggagcccggatgttggttatgttcatgatgttaactgcttctgggttatcaaaactgaaatgggaaaggtaaatgtagtaactcttgcccaaatgcatattatatttgtatatataaatatggagtatgtgtatattttattacataaaatacatgcaatgataattcaactatcatatattgagtgcttactaagtacggagtgccattattttggctagacatatacctaccttttcataaccttacattaattgtttgaaataagtcacaggggctgggtgcagtagctcttgcctgtaatcccagcactttgagaggatgaggtgggtgcatcacctgaggtcaggagttccagaccagtctggtcaatatggcraaaccctgtctctactaaaaataaaacaaataaaaaaaaattagccaggtgtagtggcacattcctgtaatcccagctactcgggaggctgaggcaggagaattgcttgaatccaggaggcggagtttgtagtgagcrgagacagtgccactgtactccagcctggccaacagagtaagactccatctcacaaaaaaaaaaaawaaaaaaawaaaaaagagtaacaaggccaggcctggtggctcacgcctgtgatcctagtactttatgaggctgaggcgggcacattgcctgaggtcaggaattcaagaccagcctggccaacatggtgaaaatccagctctactaaaatgacaaaaattagccaggtatggtgatgggtgcctttaatctcaggtactcgggaggctgaggcaggagaatcacttgagctcaggaggcagaggttccagtgagctgagattgcaccactgcactccagcctgggtgacagagcaagactctgtctcaaaaataaataaataaataaataaataaataaataaataaataaataaatargaggatcctccttttatagatgaaataatgaaaagtaggtgaagctaaacattttttgttaacacttcttagcttgtaattgtaatagttgaatttcaaagtcaagtttgtctggttccaaagtccatgctttctccagcatgaatgattctctacactggttgactgactgcaagccactagttaatctgtaaaatcatgttgttactgagacagtattttagaagatggttgcttagttttatgttgattattrtgcaaaaatggccactgatattaagatagttttcttatcaaatgtctttgctctgccatgttctatactaagtgctccatatacattacagcattccatttttaactctcataaccctgaaagatagaaattattatcttcattttacacatgaggaaacagagcctagtgccattgagaagtgtgtccaggtgcatgtggttcgaaagtggcatgcagtgactcagacacaggccagtcacctccacagcctgtcactctgagccgctccgtgaacgctcttcaaattaagatccaagtccaaggtttttagtgctcttatacccgacattaattacccaggcatttctaaatattgtttctcaaccacctcctggattcataaaaataaaatggtatgtctgaatagataaaattttcccttgaaatcctattaactttttccagcaaactattacagagggcattgtacaagggtcaaaaaacatttttttttcctttgaggagggaggactatttgcgacctggtaacctcacactaaaataaactccaaaataaatttcccagtgggtatgctatgtgaatttccttccttccatttagttttcatgaattctatttcctggcattgaaaacattcttttgaaaaaaaaatattcttaggtgagaaacttgtaatactttyattaccaattcgcaagaaaattcatcttgtttttttcttgattattgtgatttcatatcttctcactcataatggacataatatggtagaaaatatatacaaatcaggatagttcaattartgaacatttgagtttcatttaaactgttttaagaaagtcatgtagtaataggtaactgatcttaaaataccctagcacagaatttwaaaaattccttatattctttttcattaactgaatattgttgtgattttaggttctgatgaaaattaaattcgacagccttcttttgattgtttatctcaaatraggttgtcagtacgttttataagttatattactatatttgaagtctgtattctaatccattcggacacatttttgtgtttattctcttctacttgtatgctcagtatttttcctgttattcttgtatgctcagtattcttcctctcattctctactcttggtattactcatcctttaattatatccagtccctgaagccgtccaggccttgcttgtctacatcccgcctactccgcccacacctgagcgtgtcggtctgggctggcgtcagaatcttagcccctctggaatcaacatmcctggcgggcagtgatgaacgtctgtgtgtttgataacaggccacaggttattcagggaattagggtgtacattcttgtgaatggtaatattagccagttcaacttaattcaggtagattttcaaatctccaatttattttactgctttagaaacaatgtcagttatatatttgamataccttggtctggtggacttgacaagtttaatgaaattggggtaaatctatgttattaacattaagattttttgatatattttgatattagttgaagtttgtttttaacaatatttagcacaagttatttagtatatagattgccatatgtactggtggataattagggaatgataggtctagctcttgaaagtgcctcagtatgaatgctgcctaggaagtgggagaaatactttaaaatttacatggaagtaaaagataatatatgtggcctttgtatttttaggtcctgcgtatcactttcacttttttccggttagaatccatggacaactgtccacacgagtttcttcaggtttatgatggagattcctcttctgcttttcaacttggaagattttgtggctccagcctccctcatgaactcctcagcagtgacaatgctctctattttcatctctattctgaacatttaagaaatgggagaggctttacagtaagatgggaaacacagcaaccaggtatgtgtgaacctggagaaaaaagcaagcaaaattttgaggttattaagtkttcttaatcagtgttagacttttggatacatgagatgttttgggatctgaagatatataatatttttataatttattttattttattcatttatttattttgagacaaggtcttactctgttgcccaggctggagtgcagtggcctgatcacggctcactgaaacgtcgacctcctttgctcaagtgatcctcacacctcagccttctgagtagctgggactacaggtgtgcaccaccactccaggctaatgttttgtgtgttttttatagagatggagtttctctatgttgcccaggctggtctcaaactcctgggctcaagcaatccatctaatttggcctcccaaagtgctgggattacaggcatgagccactgtgaccaaccataattactttaaaatcaaatcaacctagaatkaattagaatttattttgtgtctaaaggcaacaaaataagcatgaaatagaagggattaaaaaacatgagtcttagttggtcccttatcaaattactgaacagcctttttataagctctactagtagtttactgcaggaataytgaggacattgtccaccccttcatgtagtattccttcatcttaatgatcactcaataattttttctttttgttattattttgttttaattattctattttcttttaagtttttactatgcaagttttaaacaaataaaaagtaaagagatcagtataccatgcccccaattcattcatcaatacatctgtggatcaatttcagcattttctcatcttttttactggtgtttttatctatcctgatgctacctaggcttaacttctgatgcttgaaatctgagagtgtaatttcaactttgttcttttcaaagatgttggatattctgcatttccatataagtttttgaatcaacttgtcagttttcccaaagaattttatgggaattacattgaaactataattaactttggaagaaatgacatcttaaaaatattcagcctgccaatgcatgaamataaactattttwaaatttagttctcttttcatttatcctggcaatgttttatagctttcagtgtctaagtattccatrtctttgttagatttatttacagatatttgatatattatgcttagtgaaatattaattttctaaaatttaatttttcacttgttatgtaaaaatatgtattttttaaatatttgattttgattccatatacattgttaaattcactcatcatgtctaattattttttgtagattcttttggattttttaaacgtacataattacatcatgtgtgaatgaaggatatttttcctcttcctttccagtctttgtaactattatttcttttccttgacttattgccctggctaggaccttcaataccaagccgaataaaagtggtgaaaaggaaatccttgtcttttccccagcagcatggggaaatgctcaatatttcattgttgaatatgatgttagctgtaagttttcacagataatttttatcagatgaagagtgttctttcctatgtcaactactattgctgtataactaatttcccacaaatttagtgttgtagaacattaatcatttgactttgtttytgattttgtgggccaggaatttggaaagaacctaacatgacagttgctacttgaaatctattcagcagttataagcgggtgtcagctgggactgtagctgwctaaaggctggactgggctgaatatccaagatggcctactccagtggctaccaattgatgctggctttcaatgagagttcaactaggctatggacctgagtgcctacatgtggctactctaaaaagtttgtcttagaatagtgaaactttcttcgtggcaattggcttctctcagagcaagcattacaacagaaccagacaggtgctgcgtgggaatttttcagcctatgtttggaagtcattgtgttatttctgccatactcaatgggttaacttagtcacaagctgacccaaattcaaggygaggggacataggcccacttctaaatgggagaggtgtcagaatttataaagaattaaaaaaaaacccacaccttttgttcctagttaccaagaattttaaaaaatcatgaatgaatgttgaaacatataaaatactttttctgactctattcaggtgatcatatgttttttgtcctctattctgtaaatatagtgagttaaattgattgattttgaatggtgaatcaactttgcattcatcaaatattttccatttkttcatggcaagttatgctttttatacattgctagattttatttgctaatatgtatttttaggatttttatatctatatttgggtgatattcttttgtaattttgtcaagttacaggtaatgtcaatgttttaaaattaatagaaaagtgtcctctctttttatattctctggaaggatttgtgtaagattgacaatatttcttaaatgtttgaaataatttaccataaagttaattgagcctgcaggcttccttgtgagaaggctttaaattatgattcaatgtatttaatatagatctattcagagtttacatttcttcttttttcagttttggyaatttttttctcaagaaactcatctgtactttcagaatattttcttactatgttttagtgttcgtaggctctgtagtgatgtcrtctcttttcattcctgatattgataatttatgttatcttttttaccttgataagtcttaccaaggatttgttagttttactaatgttttcaaaattccaactattggctccgttaatgttttctgttgatttttatttcattgattttcctcatggttttatcattttcttcccttgtgttattttgcacctaatgtatggttactttaacaattttttcctagcttcttgacttggaagcattgacaaatgagtttgaacttcttagaatttctaatatatgcactaawactaatgcattttccttggagaacttttatttgcatcccacaggttttaatatgtatgttttcattagcattcggctgaaagtattttgtcatttttattttgaattctctgtgaccataggttttattaaaattatactgtttatttaccaatgtgatcactaatcatgcagtatattatttcaatctttaaaatttgttaagatttactttatagaccaaagtctattttggtgcatttattgtatggacaggaaagaatgtatattctgtaatggttagatgtagtcctctacctatattaacttagtcaagttggtaaatagtgtttttcaaatattaaatttctttactgatttaaaaaaatatttgctttattacttagtcwgaaagttatagtaaaatctcaaactatgattctagatttgccagctttttgttctgaaacttttgctttatttattttcttacattatttttatcttcttttcccaatatttcaagcatttatgttttcccagctttattggagcttaactgacaaatgaaagttatatatatttaagatgtacaatgtaatgttttgatattttgatatatgtataacttgtgaaatgattaccacaatgtaactaatatatctatcatacatagttaccattttagtcaatatggtgaaaatatttaagatctactstcagcagttttcaagtgtataatacaatattgttaatgatagtcaccatgctgtacattagatctctagaagctattcattccagagaacataaacgttttascctttgaccaacatttccctattgcccccacctctcagctcctggccaccaccattctactttctgcttctatgagtttaactttttttagatttcacatataagcgagagcatgcagtgtttgtcctcctatgtctggcttatttcactcagcatgtctccctgtttcatccatgttgtcacaaatgacaggatttccttttctttttaaggataaataatatcccatttatgtctgtgtgtgtgtttttgtgtatttatatattgcacwttttctttatccatttacctgttgatgagcacttagattgattccatatcttggctatggtgaatgtatgaatgtattgtgaataatgctgcaatgaacatgaaagtgcagatagctcttccagatatttatttaattttctgtggatatataaccagaagtgagattgctgaatcatgtggtagctctgtgtttaattttttgaggaacctccatattgttttaaatatggctgtaccagtatactttcaacaagggttcccttttctccacatctcatcaatacttgttgtcttttatcttctcgataatggccattctaacaagtatgaggtggcatyttattgtggttttgatttgcatttccatgatgattagtgatgttgagcattytctcatatatttgttgaccatttatatgttttctattsagaaatgtctatttggatcctttgcccatttttaagattgggttagtttgttttgttgatattgagttgagttttttatatatttcagttgtgcttttgtggtcatatccaaaaaaatcactactcagactaatgtcatagggcttttcctgtatgttttcctggattrgttcttcagttttaggccttatgtttaagtctttaattttgagttgactttgtatgtggtgtgggataagggttcagtttcatttttctgcaaatggatatccagttttcttagcaccatttattatagactatcctttacatgttgtatgttcttgccatgtttgtcaaaaatcaattcagcataatatatggacttatttctgggctctctattctgttccataggtctagatatctgtttttaatgccaataccatactgttttgattactacagttttgtaatatattttaaaatcaagtagtgtatttttattttaaatgtatttttaaatcaggatgcctccaggtttcttctttttgctcaagattgctttagctatttggggtcttttgtggtttcatatgaattataggattctttttctattttgtgaaaaataccattggaattctgttagagatggcattgaactgtagactgctttgcatagtatggacattttaacagtattctttcaatttgtgaacaccaaatattttctttttttcattaatstggtatagttttcaaaatacagatatttcactttcttggttaaatacattcctaagtatttaactttttgacactattgtaaatgggattttcttcttaatttcctttttgtacagttagttgttaatgtatagaaatgcaactaattttatatgttgattttatatcctgtaactttactgaattagtttgttcatttattagttctaaaagtattttagtggagtctttagggtattctatgtaygaaagatcatgccatttgcaaacagaccattttacattctaatgggatcatttttcttcagcctgaagaacatattttaatatttctcacagagcatgtctgttgaagacagattccctcagcttttgtttaagaatgcattttttaccttaatttttgaaggatattattacacatagaattttaggttgaccatttcctattagctctctaagaataccacatcagtgtcttgtcacttccataatttttttggggagaggaacctcagcagtaattcttgttgttctcctgaagataatgtgtctttttctccmccctcactgcttttattgtgtgtttatatttaattttccacaacttgattatggcgtatctagrtctggttttctctgtgtttgtcctgcttgagagtcactgagagttttgaatctataggttgctttcttttatacaattttgagaaatttcagccaatattttttcaaatattgcattgccacttttttcctctttcttctccttctgagactcaaattacacatatgctgaaggttttgactgtttctaatagttcytatggttttatattcttgccttctttttttgctttgattcyatttggttattttgttttggaaagtctgtaagtactgttgaaatgttcttcaactattttgtcaaccttttcctctaagttttatcataattattttggagtcattgtttggtagcctcagtatctggaatgtttctggctttgctgagattgcctgttttatttattattgggttttggttttttttttactacttcctcacaggcctagtcagtttttattgtgagcaggacattatacgtgatatgttgcaggggttctggattatattatcttcctctcagaagggttgggtttttttctagtaggcacttatgttcctggcagatcactttcattcaatcaaggcttgaatttwcaggggacctatttcaaattttccatgaatcctggtggattgccatatttcctagaatatgaatcttactcctgtagcatacttttctcacgtttcaattcagttctcagggttttcataaaagtatctcctttctgactgaatgaggcaacacatcccttcagtatttattatgcagtctctcttcaattcttagcaacttccctcccctccraaactgytctctgttagttagacctgctgtcttctctgtgcatttgcagcttgggaatgagctaaggacccaaggaaatgcctgtacatttttgaggtgccatttccatgcagctgctttccttatagtrtgcagctccaaaaccgccagatgctttggtagccctaaatcrtgagttgtttgtttgccatagcaagggtattgctgtctccttgggcttcacttctttgaattcttgagtgtgtatgggacatactttatatgcttctcttttcagagattacagtcctttgctgtttgttctcaatgcctgaaaatgataaaaactaaaacaaacaaacaataattccttactattatcaatcattaatcattgttcattttttcttaagtgagagcaagtttattaagacagtaaagaaataaaagaatggctactccataagcagagcagtggcatggactgcttgactgagtatacttacagttattttgtgattatttgctaaacaaggagtgaattattcatcagttttctgggtaagaggtgggcaattcctggaactgagggttcctcttctttttagaccatgtggggtaacttcctgatgttaccatggcatttgtaaactgtcatggcactggtaggagtgtcttttagcatgctaatgcactataattagcatatagtgagcagtgaggacgaccagaggtcactttcctcaccatcttggttttggtggtgtttgactgccttctytactgcatcctgttttatcaacaaggtctttgcgacctgtatcttgtgccgacctcctatctcatcccgtgactatgaattccttaaactcctggaaatgcagtctagtaggtctcagccctattttatccagcccctattcaagatggagttgctctggtttgaatgyctatggtttattaccccactcccttttmcaaggggacctttaatcctaagggttgtagagggatgtcagtccattttctgtaactccttcaggatgaataggggtgatgatattcctgcctaactattagggtctcttgtattcagggtagagaggagcttagtcagaaagcgtcagtatggtgagacccgttcataactctgataaaaggtgatatccacagtctgccagttggtgctacagtctgtttcctatgggtcaggggttttctccgtatcgtccctgtggggtttgccaggaagatgttaccagaaaggattcctgatctagaccccaagagagggttcttggacctttcacaagaaagaatatggggtgagtccatacagtaaagtgaaagcaagtttattaagaaagtgaargaatraagaatggctactccataggcagagyggcccattgttcaaatttatttgtgaaagaaatggattgtttgttctgtagatcatcccacatcttggattttgctgtttatattctacatgccatttgtcatgttgtttgtaaactggtgcttataccaaaaagtttggttaaatccagggggttttatgtggtaaaaaataatcttttcaggagatacatgaaatctgcttttctattatgaagttaacattggtcrgagtgttctgatctcctcaggttgaacttcccattaaaagcctcttttgcactttctctaatggttttagcattctttaggttcagtatttagatgagttattcaytgagacctacaacatgataatagtttgattttattatttcttctttatttatttattatttgaagttctttaatggaatagaagttactcatatcagctatttggttgctctcatacagagatcatgtaggaaaggtaggataaatgcttgattttctctctttttcttttttttaaaaagtattcaaattaataacttggttccttagcattcttcaaaatggtcacttattccattttattttgttttgttttcgatatctgtacatttatatattatatcacatttgatgtgctttaatcaattctaggcatttaaaaatgaaacacttttccgtgttttgtttgttgtgtttgttaataatttgttttcaaaactctggaaaattttccagttagtttctgaacttgttttaaccaaactccagttacctttgaaagctcctttgctttctggtcagaaaagatgttctaggctcttcctgcacattatttacctcaggactgaaaaccctgatttccctaaagagctstgactttttctgtgggaaatggtatttagatctcacaatctgggtgctacggatggctattggtactgggtgtgtcatcgtctctagacctttcagtggacagaattagaaaaaacttttttgttgttttttaaagaaaaaataccctatatattcatagtgatyttacactatattggaatattgagattatagagttgctttttttttttttttttactttacatttctacctcttctctcatacagtaaaaatcctggttcccaatgacatgaacatattatttatgtacttagtcctactgtacatattttcaaaataacaatactaatattattactaatggtatgataactggaaaccatttaagatttctttgttcttttttgtgtatttaaaatatgttttgcttgagcggtatagtcaaattacagtgtttaaggtcccttggaatatttctactctctatggttgtcagctcaatgcaattatttcaccagtttcacttcagttgtgattttaaatatttctttcatttttctcaaattttgctttataattatgtaaaatatatttatagttccaaagccaaatcaatgggcatggtagattatgagaggtctagcttttttttttcctgtcccttccactctgttctttctcccccattagagaacagtttttattagtttttgatttatccttctatttaaaaattaagcaaatgatctcatataattgtattttcctctttcttagataaaagggagcataatatacacactggtctatagttggctttttttcacatcatrtatcctggagattactccataatcagagcatagtatgccgctatgtgatgtctcattttctgttcaatcaatactctattgacggacatttggcttgtttccagtcctttggccattttctttttagtcttttgttttttatttttgagacagggtgcgatcgtgtctcacagcarcctcaacctcccaggctcaagtgatcctccttcctcagtctccccagtagctgggactacagacacgcaccaccatacccagctaatttttatttttttattttttgtagcgatggctgcccaggccgttcttaaactgggctcaaatgatattcctgcctcagcctcccaaagtgctgggactacaagcatgagacatcacacccagtcttgtttccaatcttttggaattccaaatgttactgcaacaaaataccttattcacttgtcgtattgtatttttgccaatgtacctttgsgatatctttccaatggtagtattgtttggtcaaaagaaaatgaaatgcataggtttttgctaggtattgctatattctcttatgtagtgatcgtaccatcttgcattctctagcaatgtgtgagaatgtctatgtccccacagcctctccaataatttgttttcaaaactctgcatttttaacattctgaggggtaagaaatggcatctcaattaaggttttatttgcwccttctttgtgatgagtgaggttgaacatcctttcatatgtttaagagacatctgaacttttttcagtgcactctattcatgtctctattctttttagaagttctttatattttaggataataactctttgttgcatattgcattttttcttattttgtcattaatcttttcctttgcttatgctattttatgcatttaaaactggtaacttttaaagtattacattgggaaatgcctctttttctgargaactgagatgttttctcagtaggaacaatgagactcatggaactaatttgtttcattttttactttggcaggaaaatttttatttgaacaacctgtatagctatgtaaatttcatatcttacacatctaaaatgttacctatctcacttatttctaatgtctgtattactacagtctggatttttattatttagtgtttctrtcatttgatttacagtagcatttctcatagaaatctaagccactacagattctttgttaaataaatgtgggtattaatgaagagcaggttcttccagtcactagtcagcaacgttagggggccgatgtggtataatgaggatggtagtggggtcagcatcagaaagcctggctcagtccctcacttgctccattcttggaacagtggctcgatcactacagacatttgaattttttcatttattaaatgaatgttttaactatatgatagtattaagaaaccttctcaaatgaaaattatgtcacacttaaccattttaatatgcaaagtgatctggtttgctgaaacacacagaggttggcagaagttctggaattcyttacaatttcacatacagaaattaatatcatcaaagtgaaaaagatgactctacaatcctggtattcatcgctcagatggttcagccctgtttaaatagtgtcagcatgtgatggctcacaagcacagagcttgacacatgggtgattcatttgtttatcaattgatacttctagacttgtaactttataaaactggaaaatgtaaatcttttttaatttatgagggtgtctaaaactgctcatagttatttaaacaaagtttggcttcttacgccaagggctctgatcattctccataaattatagcatctatacaaatgtaacattatttttccctcttattttagagtgtggaggtatcctgactggtccttacggttctattaagtctccggggtatcctggaaactatcccccaggaagagattgtgtctggattgttgtaactagtcctgacctcctggtaacatttacttttgggaccttgagcctcgagcaccatgatgactgcaacaaagattaccttgaggtaaataattatatttagatagaacatatcacaatatgattaggactcagggcactatggtctagccatgcccatggatgaccccaaaatattagctgtagttaggtgtgtttctcaatagtcagtcaatatctaactcttgcaaagtctctatttttaactgtgcctgtttgttgcttcttcttctgggttccatttgaatctgggaaacagattaccttgccctgctatggtgttacctggaagctcacacccctgccatgagaatgcagaatttatgaaataaacactcagtaatagccatctccttcaatgcagattcaaaccttcagttgtctgtggtaaactggcaaggtctttcacagcttaactgtagcattccacgaagaggccgggtgtggtggctcaagcctgaaatccctgcactttgggaggccaaggtgggcagatcacttgaggttaggagttggagacagcctggccaacatggtgaaaacccatctctattaaaaatacaaaaactagctgggcgaggtggcgggtgcctgtaaccccagctactcgtcagtctgaggcaggagaatcgtttggacccgggaggcggaggttgcagtgagctgagatcgtgccactgcactccagcctgggtgacagagtgaggctctgtctaaaaaaaaaaaaaaaaaaaaaaraaaaagaaaaataatagtgattgtgttgaactgggttaggttcctggaataaagtaatcattattactgagaggagaggtatcagccgaagctccttctgcctacccattagtaaaagattaaaatayggaggaggagaaaaggctcttatattcaaatgccgtttgtacgtaggtgcatcaaaaagtgttgctcttcatttgtagactgacaagataatggagaagattgagttcccaggttgycctgtattttttatcaccataaatctcagccccttgcagcagtgtgaaaaagacaatacgcatttccaagtccattagagaggratagagtcaatgcaattattcataaaggatagaaggatgtggtgtcaaaaaggggctctgcaagtaaaagtcattagtaattcagcaataatggatttgaaacctttgggaatgactggaagatctgtctctctctggaaaatttctgcaaaatggtcatttaaatgttgacagaaaagtgagttatcttgaaattaattttcaataaattccatcaagttaaaattagaggctttaaaaaattcctacacattcatttctggagaccatatggtagaaagtgtcaaccactctgacaatattgaaatgtctctcatttctctttaaactacagtatttcaaagaaccagttaaatattagaataaagttatgctgccatctaactttgatcccagtaagaaaagtaatttgaatagacaaaattgaccatattaaaatattctttagttcattgactcctcrgtggtttatatagtatagaatttgcaattacaacaaaattatagagagattgacatgattacatcatagattaaaaaccaacaattagaaaaggatttctaaggtcacgtcattatcattgtagtacttacttactatcaaagttgcatttttaaattcactaacctgtctttctgttgtgtctaatctgatggcacttcctctctacctctgacccttctgaaaacctggaccaagttatgaatcagttggcatcaatggtgttccttcttctgttttctttgcttatattcattttcttctagatcactaagaatttataatgaaaaaaatcaaaagggaaagatctttgattrgtaacatcatgacaaaaattcwaactatatgtccagccttggaattgaaatccagtcacaggccaggcgcggtggctcatgcctgtaatcccagcactttgggaggccgagatggtcagatcatgaggtcaagagattgagaccatcctggccaacatggtgaaaccctgtctctactaaaaatacaacaaatagctgggcstggtggcaggtgcctgtagtcccagctacttgggaggctgaggcaggagaattgcttgaacctgggaggtggaggttgcagtcagctgagatcgcaccactgcactccagcctggtgacagagcaagactccatctcaaaaaaaaaaaaaaaaaaattcagacagagagaaggcattggggtgatgggagaaggagacacactttgctgaacctcagccatgagttacatttggatgtgatggggaaacttccttgagcgatcacttttaaatgatagattttatgaagttaatwtccaaagtgacctagtttgttaaaaatctgaccactttgagcttaatgattcatccttttgttttagattygagatggtcctttgtatcaggacccccttcttgggaagttctgcaccactttctctgtcccaccgctccagactactggcccctttgccagaattcacttccattcagactcccagattagtgaccaaggcttccatatcacctacttaacatcaccttgtaagtaacctaccagttgggggcttaagagggatttgaaggccaatgctatgcttacatctgttttatattttaatgtgattcagaggatgactgactgtcttagaccaagaacatttctttataaatatttctctcatagcttcatattttttctttatcttcccaatgctctattattaatactgcaataccctttgatccctaaattatgggatccacatcatgataaagatgtatgaggcacccaaacttaaataattcagggcaccaggtccctcgtggtgtttgatgtttagttgtgagagaggtttgtgcatgcgagcagtgcagtctctctggattttatcctcggrtcaagtccagctgcacaggggctggggctggcttccagcatcacagtgycccagactctagagcttcacttccagccaaatactattagctgttaggacctcagttgctttgataccttaaaacaaacaaacaacaaaacacaggaaatactctatgatttggatttttttagggaagtggaggattttgtttatgacatctattattgtgcccttaataaatgttctcagaaaaagtaccttttaagtttcaatatcaggaagagtaacaaagaacatctttacttgtcccctttcttcatttccttttctttccacggaatctgstgccaacctcctgttcccctttcaattgttttccrtgcaaatcaactccccctggctacatcttgctattctgtattcattttttctttaatctgcttcatgtatacagttatgtagtttattttgttacatgtttttaataaccatctcaaatcttattgaaatgaagcagagcattaatgtatttaaaaagcaacttatagaagagaatggcagattggaagctagatcacacatctctgcatctatttctttaagccactacagagatgtcccacaacacatcaaactgaaaatcttaaaattagaggcacaagcctatagagggtgaataaaatggatatgtgcttgtgtgtgtgtgtgtgtgggtaaatttttagaaattggatccaatgcctgcaagccagagcaatgccattgccatgacctgttcgtctcttccctgttcttagcggatctgcgttgtggtgggaactacacggacccagagggtgaactcttcttgcctgagttgtctgggcctttcactcacaccaggcaatgcgtctatatgatgaagcagccccagggagaacaaatacaaatcaacttcacccacgtggagctgcaatgccagagtgacagttctcagaattacattgaggtaactttcactactcaatcgcccttagatgacattcatcaacatttttatattctgcagagtggtggtcttcaaaagatkgttgggccaccagcagccagaatacctgagagcttgttagaaatacaataataactaagctctaatgactaaggtgcaggcaaataaggctgataggatgtactaataagatacagatttattatctagaataattaatacaggaaagaactcaacccagggaagtgaagggatttgcccagatgacccagctagtcaagtggtaataaagtttaagtgttgaatgacccttgttttggaggttagggtttttccttcctttattctgcttgctctcctccagaaatctttaattttgatttaagtgtgggtaatgattgtaatacagggaatatttgaaacagagacaggctgtttttgtttgctgggcctggtatttcttatgctaaattattggtcaagccacaaattaaagtgttgagcaagataaaacattgtttttttgggcataatcattttacataaactagagaagaatttacaattttgtttgtttgtgcaagttaaatccatttattcatccaggaaaaacctatgtgacctcctgtcctcttctttctacatttagacagaggaaacagaactttagcataagatctagctagacttagttgaagtgcattgaccatagcactacagcagtatgtatgtatgtatgtatgtatgtatgtatgtatgtatgtatktatktatttattttgagacggagtttcgctcttgttgcccaggctagagtacaatgtcatgatctcagctcaccacaacctctgcctcctgagttcaagcaattcttctgcctcagcctcctgagtagctgggattacaggcatgtgccaccacgcccggctaattttgcatttttagtagagatgagatttctccatgatgggcaggctggtctcaaactcccaacctcaggtgatcctccggcctcagcctcccaaagtgctgggattacaggcatgagctactgcaaccggcctgcattttttttaatccagaaatttttatttaagatcatttcagaatgggtatatttattcaatttaggttttctaaagtctcttataaagtatattaaagttttacactacggaagaatttcaaatatttttatgtaaatcaaaattaaattattaacccttttttttttaacttttgagaacagcaaaaatagctttcaattagagagtgcttcctgtactccaggcactattataagactttaaaatagtataacaaattaaatagataatgatcattgtcagcttactgcctgccatgtgtggtaagtgcttttcgtgagttatttcattgaatcctctcaacaaccattattatttctgttttaatcttaggaaactgtagcccagagaagttacttgtccatggttacatgtctagcaagtaatggagctgggattcaaatttaggagatctagttatacttatcttcagtaagaacagaaatgcaattgtgtgacgttgactacaagaggtgtctcatcttccatagggaggaaggtcttgtgaattacccaattccatacctggctctccgatcacgagactaaaacatgaagccgagcatcatgattttctcagatacgcaagaatgtaactataattttcagggaaatttggggccctttctgttaaagccttcatggtgattctctggttctaaagaactatcagtacctctgaatggttcatcctctcaggctttgcagaacactagaactgaatttcagtgagcggttccatgaactcctctgaattcttctgaaaagttygcacaaaaaatcataaaactggctttggaagttttaatttcataaaccagaatggtggaatgttttgtagccagaaggggattaaagttagttcacctaacttcttattttagttcatttgtcagatgaccgtataaccttggacaattctttatctggatctttcagttcctacttcagtaagatgtcctatctatttctctaaactttgggggtagaatcaaggaaataaatgataaaaagaagcttgaagtgttaaaaaaaataatgcaaatgcaaggtttttctggaacaaagttttaactctagccttgaatttatcagttcagagacagccgatgtggctgtcacagttggccagcgaggtatctacattctgatgtaaccacatatcctcaaagtcttgaccaaatttccctcaaggattgttgatggaaaaaaaaaactgtattattcagaaggagaggtcatgtacggtgatttaaatattaatagatagatttttatattatatctttgaccaaccaacctaaaggaatacaaccaacctgtagaattttggcatcagcaaggaccttaattttacaaatgagaaaattgaggctcacaaaggtcaaactctagttattgtcaaagtaaaacttagatgtacctctatgagattctagatggacgtacattgactttggttaaagctcttgtctttaaatcatctctatccattgggaaaatttgtgaactgaacccgttttctaaaaagtatattcacttctcttgttgttcttcagatagtggtcatacaagaaagtgatacaggaaccaaattctaatracattattatgactcaatatattgttccctaaaatgatgtcttcattttttaaagctatctctaaaaaatgaaatatttatgaaaaagaattaaaaaaagaatgttggtatttcraatactttggtggtttagaggggggttgactttgtcctttactgactccattgatgagtaaaagcagtccacccaaaattttagaaagagtggagaagagaaaagaaattcyacagagatgtgggagaatgatcctaaggacatttactttgcatgtgaataggtgtacttttaagaatcctagatcttctctttgtgtggttttaggtgccttggttgccaggcaaacatatccttcaaatgaagattaaggtaccattgctgagtgtgtatctttcacagatactgtggttttgaaagacttacttttgctcagtaagagagttccataagcactcattaaagaatagattttaactgcaaaagataagaatgatattgacccagtgtagcatatctttctttttttttaacacaagkaacacacattaacatgttaattcttagatttatatatctctcttaagtgaagtttctacttttaaagatatacattacccatggaagatgtgacatggctacaaatgaatgaatacaagaacagatcaattgttagttcatctgtttttgtcgaagagagcttttaaattgtatagaatagttcaatgaaggtgatggaagcatctttccagaataaaaagcagcacctctcattaatatttcataagtgatttaagccatcagaactctgagtgaaggacacataggtagtaatgaaagtttaattttaaatcccagagaagggaagttgtaggctgaataataaattcagaaggctatacgatgttaaggtgaaggcttgaggtaggatacgaagggaaatgagtagaattgttcacccatcaaatctccttgaccaatcccaaagtatctgcctcctctccccagagacactgaggaaccagaaagggggctctacaagagacgcagggagagcgatgtgccttctggagaaagagaagggctttcgagaagttgttgtttcttagatgtggaaagcaaatacaaacagaaaagttgaaaaatataatcaataagacaggaaggagtaatttacattgaattttatttctgaaatctagggaatatacctgttctacaagtggygttgaaccctaattcatcatattttagacctctatggcaatcccagtaaattaacaaagcagaaattgtacatctcttcacaatataacataacccaagattatttataaacattttaaaatgcccaagtgtgtggaagtatgtgaactctccaaaataatcattggcttgagaaagaaataaaaaatgaaagactacatagaaaatgacaaacaggaaatgctgtgtatcaaaacctgtgagatgtgatgaaactcaactccctggtaaaatctttaagatttaaaagaagagaaccaaaataattgggaaagcaggagagcagaagctgaggcaggaaggtctgtcctcygtctgaaccttttctttcaccaccttcccctgcatccttccctctacttctccctccccgctacactcctgcttcagcctaagcagccctcccrcatctcctgcatgtctttagatgaatgcaaattcacaaaggacctccttttgtgacttcttaggcattgagatgattccactatgagcttgggattgggtgggggagagccaggacttgtggaatgcatgaggcacttgcttccctcaagtggacctgctgctcagagtctcatggctgcaattcacagactacacacctaaatgtcagaaamagaataaggcctggagcaagcaaacacaccacataggctgaatagtattgtgtttttcagttaagtacatattgaaattaattgtaggtcagaaaaatatctttctagagagggtaggataaagggaaaagggggagatcctcaagagtttgtactcttggccaggcatggtggctcatgcctgtaactccagcactttgggaggctgaggtgggtggatcacctgaggtcaggagtttgagaccagcctggccaacgtggtgtgaaaccccatctctactaaaaatacaaaaaagtagccaagtgtgatggtgggcacctgtaatcccagctacttgggaggctgaggcaggagaatcacttgaatccaagaggtggaggttgcagtgagctgaaatcacgccactatactccagcttgggtgacagagtgagactccatctaaaaaaaaaaaaaaaaaaaagagtttgcattcttgagcatattggatttagggttttgacagagactaggaacatttggttagactctgagctctgttgttgtgagcacagtttttccacaactgctggaccatcgtgatgctttttagtgaaggaagaagataggccattcctctagtgaaataattctgtaggttggagtagtgggaggcaggaaacagactgagagatgatagaacacctaatttggagttgtgagaacttgtagagaatacatttttgctgtgtttgaaggagttgcatgctcatgtagaagctgcaaacccattgaacatgcgtgatgtagagcagtaagcaggaataagaggatatggatggaccattatcaagaacattacaaattcctaggtcaaatagagggtatggctggtacttttctgatataaaatggaaacaatattgcatggaaacatgataaaacccttcagctctctgtgttactaaaggcaagatacctgtaagccacagcttcctcatgtgtaatagggatagtactagtagtactagtagaaagagaccattcattcatttatctattcattctctaaatatttatcaaaccacttaggtttcagtcaccatgctagggaatgggtatgtaatatagatattaaataagtaagcacacactacataatttcaagaggagataagtatgggcaggaaagaaacagtactgtaagagaaaagaacagagctactgacttcagtggagcagtctgagtttgcttctcaagggtctttgtatggctagctcattctcatctgtagaccctgtatgtaggatctgcagatgaggagtgagcaatgcaaagaactgagagaaggaggactccaggtagtggtgctaacccagccctagagactgaagtcagaaaaaataaactaaaataattggaaatagaccagggtggctggaatcacacagggatggaaaagagaaatatgagttaggcaggagctagaccctgaagggtcttgtagaccgagataaagagcctgggttatattctatatgcaaggacaaacaattagaatgttccttgtcacattgtgcctgtcacacaatgaatgctcactaaagttaacatcatgatgataatgacgatgatgatgatgatgatggggaggagaagagagggcaggagaaggtgacctactggagtttgcaatcatgagggaaggcacttctaggtaaaacttattcatgtgttcttgattttagaatatcagatcttaaaagatcagattatatttattaatagagatgttagaagggacactttcacaaggcatgaaaaggtttaaaataccaactctaaaaatcatgaaacatactaataaagaacaaaggataataaccaaagtaaatgattttgagatcctaaatggcttctctcatctcttatcctcctcaccccttattctctcactgggggcagggcctcattcctctcctgctcacccagattagcccaaggctcctccctaaggtccagtctttacttagctaagatgtatgtcagcctgaagctcacttcacagaaagccacatgttaaacactaccatacggtgtggttctcttttcagctctcagatggactaagcgtaagtgccagcatatttgaattgctttgaattaaaatttaatgcttattattttagaaattatagtataaaaccaaatctggattcatagcagaggaagacaaatgagcgtgcrtattaagacatggctttgggacttgactcattccagatgttaaagctcacgactcactaggctcaaaagcccacatttaaaatttcatgtaaatggtgtttctcagcaaagtaaattttagttctctctatagaaaatcattcctttacaaaaactcgtttttttttatgagtagtttctcttctggaactagtttaatctgatgaatgtaaaaattggaagccatttggaatacaccatatgctgaacatcctgggacctgaaaccttcagtgtttcctggacgaataaggcaatccacaagaaatctgaacctggtccgtgaaacactagaattttgaattggttcttgttgtttccttgcaaatgcgattcactaaaaagaatgaattcactgtgactcctctgcaagtgatcacggcatggcttcacctgacttagaaaaattcagtttttctgcacaaaccagactcagatattggtcatctttctctaggttatgctgcaataacaaacaattagtagcaacaaccagaaaaatcaaaaacaataacaaaccaaaagcgtctgtggctttcaataacgtgtttattctttgctcacaatagcaggttagttttggatccattgcagttctgtttcctatgtcagtttcctgtgccttcaccgtcctgagacccaggctctagagcttgctgggggaaaagtaaaagatggttgaattatgcagtgacttccaaagcttytatgtggaaattggtktatcacttttgctcacactctgttgggcaaagcaagtcctatggctaagcccatagtcaatgggaagattatgtattaattctccgtatggcagtattgcaagtcacatggcaaaaagcatagatagtcaatccttttacaggaagggaagtgaataactatgtaaaataatgccatccatcccagttcatgagcataaaggaaagaggtttttttttttttttttggtgggggtgcraatttatcaagtcctagattattgaacgcaatacrtgcttcagaggtagctagggtcactttagaacatttgatgaattttattctagtgtctctttcaaaggagttgtagttaaagtattgccatgtctagaatccagggagaatacaggctttcagaattaataaggtttcatttccacagagagagagagaaacagagccaaaatcaattgcaccttctaggttcagggcccttgagccctatgagttcctcttaaaacatttggactacagctgcctttctccttgttaaaatccttgaatttcattagttggggcccaggggaatggcccactttagcttgcagtgatgctatttggctgttttttttccttcttgtcatcttctaatgggcgaaatagaaaagagagactacartcttcgaagaagcaaatagaaccctggaggattagagagcaggaagataactttgtgtttcatgctttctagttttcaagaactgcagtatgtctgtatctctaacaaaaactgaaccatcatactgtaccttaaaattaatgaatcaacaagaatttgtcaaatacctatttgcaaagttttttttattagatgctgaagggcaaacagaaatttttcccttccctcagagacttactgtttggttagagataaatttagcatagctttactacaatatgtgaaatttgtgttacagatgttgtaagagctcagagaaaggaactagtatgagcctgagtcagtggagaggcatgtgatttttcatgtctgtgtcagactctatcatatggctgaatcattatttatttaatcacctcactattattaggcctttagaatggtttcaattattgttattatagagcagactttgatgtggatctgtatatgtcttttcctgcatcttgaatatccttgtgatacagtgttagaagtgaaatacccttaatacatattgtcagtttattttccagaactttatacttccaccagttatggatgagagtaactgtcgccacatccctaccaactttgaatatcatccttttaaaatctttcctttactggctaggcacggtggttcacatctgtaatcccagcactttaggaggccaaggcaggcagatcacctcaggtcaagagttcaagaccagcctggccaacatagtgaaaccccatctctactaaaaatacaaaaattagctgggcgtggtggcgtgcccttgcwgtytcagctayttgggaggctgaggcaggagaattgcttgaatctgggaggcggaggttgcagtgatccgagatcgtgccactgcactccagcctaggtgacagagtgagacttcatytcaaaaaaaaaaaaaaaaaaaaaaaaaaaagaaaacaaagaaaaatcttctctttactacctgtttgccttggcctagataactcctactcagctttcaagtctccgcttaaatgttatttccactgagttttccataatcccctgggtgagttcagagtctttggttaacccagtggttctctacaatttaagactttttaatatcactccttgattattcagaaatgaaatamactgatttaaccccactagacacattatatttaaaaatatgtaaagttgtaagaataacattaagaaaaaatagagtaacagaataaaatcacatttatttcagtatctgaaaacctaggcaagctgtacttgaagacaaaataaagcagttgattgtctggaccccaaattgctatgaatatgacagtacaaatgcaggctgacacagttatgtgggttggtgactaatttttcagaaatagtgactaactcttgacagatttccaggagaaagaatcttcaatttacactctacttgtaatcctggaaaattcagtatgcattaaaattgcacaaaactactttgcgcttaatatgtaaaatagagcgagattttatacccaataacagaactttcacttatgtgaatgtcacacaggttcaggagaattcttgttgtgtgtgacgctcacatttcaggctgcctcgtgtctttggtcccttgctacttactaaatgccagtaatgccccatgattgctgtgataataattaacacaaaaccaaaaaggtactctcacacatttcccaaatgctagattgyggtccctgctgagaaccaytggttaggtaacaatgaagtatcctgcgcttccccaaaaaccgcagtcatcatacttttcaaaaatgttcctgcctattgtaagttccttgtgagcagtgactgtttcatggtattgtcacctgcacagttcctggcatttattcatgccttgataatgttaatgaagtgaatgaattaatatttggatgtctgtatccttcagaataattgtactgaacagcggcggtatatatatccatcgaataattcctgctcatagtagcaagcctccagtgtttcacctccaaaaatgtccagaataacaacagctatccttagtcaacattttccattaccaaacatttggctaaggaattcacactattgtttcatctgtttgcttcaacaatcccatgagcttagatagagtaacttgctcaaggctattaagtgaggtggtttgtaagtgacagaggtaggttttgaacscaagtccatagactgtattcatggccactatactataagagctggctatttggccgggcgcagtggctcacgcgtgtaatcccagcactttgggagtccgaggtgggtggatcacctgagattgggagtttgagaccagcctgaccaacataaagaaaccccgtctctactaaaaatacaaaactagctgggcgtggtggcacatgcctgtaatcccagctacttgggaggctgaggcaggagaatcacttgaacccaggaggcagaggttgcggtgaactgagatcacgccattgcactccagcctgggtgacaagagcgaaactccatctcaaaaaaaaaaaaaaaaaagagctggttattgatttaaaatcagtagtctattatatgaaggaaattccttttttttctaataaaacaggaatgctaacaatgttttttgaatttatggagttatcatatggcttatcttatctgatgtactgaggaagttaatttatagtttataatttctaacctttcttgcactattattattcccatatttgatctggtatataagctggcaatggactgtgaatttatttttctagaactgtgtttaggatttgtgtatctatattrataggtgacatcagtctatagtttttatttctataatctatgttgggatttggtaacagcgttctaacaaaaattatttggaaattattctatgtttgaggatggcttagaataaattatacatgggaattatctcttccttaaaagttttaaagaatgtactaagtagagcatcttatgggagatttttctttttgggggttgagggtgggatgggaataattatttgataatgttttcaattttatttatgacttatgtctgttcaaatcttatttttcttctccttcagataattttaatgttatactttttctgaaaataacccattaaaaacattcatagagttgtacatagatttcacrtttaaaaaaatcttagtrtctgtgtctttgtcattttcaattttgtatatttgtgcttatatatttattttctttttagacttgccagagatttgtcttttatatccccacccataaccttcctcaaaaaaacagttcttgaatgtatttatgaataccacatgattttgtatttcatttattaagttttgctcttctttttactgtattcttcctcattttaaggatttttttctaacttaaaaaaattgtacatagagctgggtctcactgtgttgcctaggctgtctccaattcctctcaccttggcctcccaaggtgctcagataataggtgtgtgccactgtccctggccttctttctaagtttttaagttgactccttacattcttttactttctctctctttcatcaacttttcttttttttccttttttctttcaatggcaaaagtagtttagtccataactttctttgattgcagatttggctaacacgtgtattttttcataggtaatattctcattttttattgttttccaagtagtctaaattgtgaatttatttcctctttgacattgtgaaaattattaggagaacattctttaaattcttgtgcttttggactttattggcttaggattttatcagcatttcatgttattgcattgtgcttaaaaatgacctactgctttagaaaataatagaaatatgtaactcaaattggattatcattcattttgaatctgccattttttcatctccaagtaacgccaccattgccgacgtaagtttctttatttgaattacatctctattttatttttctctttaggttcgagatggtgaaaccttacttggaaaagtctgtggcaacggaaccatctctcacattaaatccattactaatagtgtctggatcaggtttaaaatagatgcttctgttgaaaaagctagtttcagagctgtttatcaagtcggtaaggaaacatataatttttaaatgtctaatttgcctgattgtaatattttaattcttcaaaataatttagtcattttatgtcctcaagtgttaagtggaaaatattctcatagaaatgttatattcggttatctcctcaggcagtattagattttgcaataaaattgrgataaaattattaatatctggacaagcactactataatttttatgcttacagcttgcggggatgaattaactggagaaggggtcattcgctcrcctttttttcctaacgtgtatcctggagaaagaacctgtaggtggaccatccaccagccccaaagccaagtcattctcctcaacttcactgtctttgaaattggaagttctgcccactgtgaaacagattatgttgaggtaagagggaaaaaatctttgaatttgtatttggttgtatattataaaaaatattatgggttgttgtcttcaaatctgttataggaaatgaaagtagtttatgtagaccaatatgtcttatggatacatatgtaaaaatcctcagcaaaatactggttcagtgaatctagcacaaaaagaggatttatataccatgattaagtgagatttgtcccgagaattctaggttgatataaaaccccagaatcagttaatgtgatacatggtaccaataaaataaagaacaaaaactccatgatcacctcaatagatgtgagatctggattttgctggatttgacaaaattcaacatcctttcatgatgaaacactcaacaaactaggagtagaaggaaccttccttaatctcataatggacattcatttaaaaactcacatctaacatcatatttaattatgaaacactaaatgctttgcccctatggtcacaaaaagacaagaacgtctgttctcactacttctattcagcattacactggaaattctagctagagcaattaagtaaggagaagagataaaatgcatccagaatgaaagggaacgagtaaaattctctctattcacagataacatgaccttgtatataggaaatcataaggaatccacacacataaaaaactattagaactaatccattcagcaagttgtgggttatgagatcaaaatatagaaatctttctttttctatacaccagcaatgaacaatttgaaaatgaaatcaaggaaacaattccatttacaatagcattaaaaaataataaacatgaaggaatacagttttaaaaataagtgtaaaacttgtcctctgagactataaaacgtccttgaaagaaatttaaaaagacctaaataaatggaaagacatttaatgttcatggattagaagacaatattgttaagatggcaatactccctaaagtgagctaaagattcaattcaatccccatamaaatcacagcrggctcttttaaaaaaatacataagctgatcgtaaaattcatatgaatatgcaagggaaccagaataaccaaaatgttcttgaaaaattacaaagttgaaggactcacacttcctgatttcaaaacttagaacaaagctacaataatcaagacagtatcttattgaagtaaggatataaatatagatctatggaayacaattgcaagtccagaagtgaacacatacttttatggccaattgatatatgaaaatgatgccaaaacatatcaatggagaaaaatcattttttcaacaaatggtgctcaatagccacatgcaaaaytatggtgctggaccccttccttatagcatacacaaaaattaactaaaaatggattatagacctaaatgtcagagctaaaaccatgaaactcttaggagaaacctaggagtagtctctatgcccttcagtttaggcaaagccttcttaaatatgacacaaaaagtacaaacaaaaaaagaaaaaagaaaaataacttcctcaaaattaaaaacgaataacttgatttttaaaatgggcaaaggaggctgagcacagtggctcacacctcatcccagcactttaagaggtcaaggtggatgaattacttgagctcaggagttcgagaccagcctgggcaacatagtgagaccccatctctacaaaaaattttaaaaatagctgagtgtggtaatacacgcctgtagcctcagctactcagaaggctgtggtaggaggatcacttgagcctgggaggtagaggctgcagtgagctatgattgtgccattgcaccctagcctgggtaacagagtgagaccctgtatcaaaaaaaagaaatgccaaaaacaaaaggayacacccataggatagctataataaaaagagtcagataatggtgtggacaaggatgtggagaaattggaacctttatacactcctggtggagatgtaaamtggtacagccaccttgaaaaacagttggcagttcctcaaaaagttaaacatagagatactatctgatccagcaattctacttttagatatattctcaaggggaatgaaaatatatgtccacacaaaaatttgtatgtgaatatatctacagtcatcatctataataacatatacaaatagcaaaatgcaatcwttatttttaattttaaaagtagaaacaacttaagtgtccatcaactggtaaacggataaataaaatgtggtatatctttacagtggaatattacaaggcattaaaaaagaatgaaataatgatccatgctacaacgtggatgaactttgaaaatgttatacrgtgtgaaagaagctaatcacaaaagaccccatattgtataatcccattttgtttgaaatgtccaaaatgggcaatctacagagacagaaagtagattagtggctgcctggggctgtggtttcaggggaatgaggagtgactgctaaaggatatgagtgttttttggggggtgactaaaatgtgctaaaattgattgtattctcaaattgatttgtactccattaaaaacatttcagaaataattattcttgaagcagttttcaaaattgatatacaacatatttgaacatatcttctctaattttagattggtagcagttccattttgggttctcctgaaaataaaaagtattgcggtacagacataccttcatttataacatctgtgtacaattttctttatgtcacattcgtgaaaagttcttctactgaaaaccatggtttcatggctaagttcagtgctgaggatttgggtaagagaytgttcccttttttttttcctcctcttgggcttgtatcagaataagtgaatgatagaaataaattatatgaaaatcatctgtactgtgaaaaattttaaagtacactcaaagacaaagaatrtatattttctaatcaacatttatatcaaaagttaattgttacttattaataagagaaaaatcaggttatcttaagtggcaactaagaaacatttttccttttaatctttgaagaggttattatcagagccttttaatttgaaatccaggtagcttggttacttgctgcagtaattawaatttttatttcaacagcatgtggagaaattcttacagaatcaacagggaccattcaaagtcctggccatccaaatgtctacccccacggtatcaactgtacttggcatatattagtccaacctaatcacstgattcatttaatgttcgaaacatttcatctggagtttcattacaattgcacaaacgactacttggaagtttatgacaccgactctgagacatcccttggaaggtaaggttatgtttgtttgtttgtttaacaataaaacttcactgatttcctgcttcagtgaaggatcttaaaatygaccacgttgtgttatgaaaaccaggtgagatcctcatgcttcttaatgaccatttctacataactactctgtagttgtggcctgtaggcattaagttttgacatctgtatatattcatgaagtcaaaaccaaaattaaaataatgcatatatccactacccacaaaactttcttcctttccgttataattccttgctkttgttcctcacccccacccacaggaaaccacaaatctactttctatctctgtagattygtttgcatatcatctaaatggaatcatactatacgtactgaatgtttttctgactttcctcaattagcataatttttgttgagcttcttggatccgaagatttgtagttttatcaaattgaaacattcttggccactggttcttaaaatatttttctgtctttcctccccattagggactctgatttcatgtatattaggcacttgaaattgttctacaactctcttgatagtctgtttgatttcaagcctctgttctctgtgtgttttactttggaaagttcctattactatatattcaagttcactcatcttttcttatgcaatgtctaatctgctattaactttaccaagtgtatttttcatcttagatattgtagttttcattttagaagttcaatttgagtcattttatatgtagtccatgtctctactttacacatgaattttttttctctagcttaaaaaatctgtgagatatagttgtagctattttaatgactttatctactaattcagacatttggattgtttcctgctatggttttatagaytgatttttcctctctttctgagttatactttcccacgtcttttcatgtctgggtaatattcagtgggataccagacattttcaattttatgtttttggctgctggacattgtcatattcctgtaagtattcatgagcgttgttctggaaagcagttaagctacttggaaacaggttgatccatttcagttttgcctttaaactcatttgtttcctgtctctgaaggtttgttgtcctacattgcttgatatccagtgttttgagagccattgttttatacgtttttgtccaggatttttgttgtttcaggtgcaaagttaaatctagcctgttattacatttctgttggaaatggaaatcttttgatattttaaaatgtctttatcttgcattttattttctttatttctcattcatgttttaaatatccttcttatcctaatctttcatctttttaactttcttctttttcttttttgggaaggtacttaacacatcaccactgcaaaatacagaacgtttgctgaatggcataaactataatgatcttccccaaatttcatatacatgggcatatacgaaggcatttaaaatatcaattagttcacctacctttattttgatgaagatattaaattttttttcacactgcaatggtattatacaccaaattttctttctttttctcctttagcaattgacgtatccatttcccgtactcaacatttcctctctttttggtttctatatttgttttctttatcatttcttttggttaattttaccaagtgtgctttgatttgagattcctattttattgtcacttcttcctacaggtatttctccagataaaagctcatggcattctgtcttttatcacaactctctttttaacattaatagaatagtttttctgagctaaactgcttttgttcagcagaaacatggcatggctgaatcatcactcttatctctttataagtgagctgtttaaggacaatagattccctctataggggttacgattgtaggcactgttctaagtgctttatatacagggtattaactcatcacattctcaaaacaactctatgaagtaggtactgtcatcattcccattttagggatgaggaaggcaaggcacagggattgagtgatctatgagtttagattagagagatgactctatgattttatgatatattgtttccctttgttgtataagtttattacatttctattaaaaagtgtattaatatgctatatggcaatctagtgtagcttttattaaacttctcatacatgacaactcacatagccagtcacatacctaaaaccatttcagggatataatcatgaacgggacaatctttcgtaagtttgcaaatcttttttgcctgaaatatatttgtgttttaaggttgatgagaggtagagaacaaaacctattattatatttacatgtccaaatttttgttacatcattttcagtataccaaactaaaatacacacatctgtcctttcttggtttggaatagatactgtggaaagtcgatcccgccatctctcacaagcagtggtaactcattgatgctggtgtttgtgactgactccgacctcgcyyatgaaggcttcttaataaactatgaagcaatcagtgcagcaacaggtaacaaaacagcattgcatactcggttttattgactccattgcaaaacagtgctaatagctaaaacacaatgagaatacatcatccgcaaacctgtggcacacaatgagagctatatttagaataaagggtagtgacttaaataccttccttattaaaagtagtgactagataagaatattgtgtcaatattaaatcttctaatgttggtaattgtactgtggttttgttaaaagaacgttttttcttcccttaggaacaatacactgaagttttcagacggtaaagaaatataatgtctccaaagtactctgaattggctgagataataagtgtgaatatttgtgtgtctgtgcatgtgtgtgtgkggggggkggagagagagagagaaatgataaagtaatgggagcagaatacaaatacataataaatctgggtaaaaagaattcaggagctcattcttgcatcttttaaaattctatcagaatgaaaagttaccaaagagactgaatacttatgttaagaaattagaaacagaataacaatgtataaaaattagagactaccgcatgaaattccagggaaaggaatggaagatttcttggcaaaatatgcatttctcaatttgacctaatgaagttaaacttttcagcatttattcctttcattgtatttttcctattacttaatttctcattattactatgcyctttgcaaatgaagtataggaaacaaatcccttttgcaggcacagtctttgaggtaagatgtgaaccagagatgctcccagccccaagagcctgtgcatgggattgatgaaggagtcatatttcgttaggctcatgtttccctaggatgtgttsttttttagagactctgagctttccttttgcatcattgtattaaaggacccaaataacatccagcatagacccatagtaggcatatggtgaccatgcttccaagcatttctccgctttgggattaccccagcagcatggtacaattcactgagctccctccagaaagaactggtagsttttcctatgttgggacatgcaccctgtgacacactctggcatcctgagaaccccagatgcttatcttttaaagtccccactccctaaaataaataaaagtttaaacatctcccactcaaaatcttacccaatttcccatttatttctccttcagaggggctggccactactcttcatttcaggcaaaactctgcagcagttcaagttctatgttcaaaagcatggctttagatttgctccagaatcctgagtgtgagagaatcaatcaatacttttctcccaggtaggaacctctgcaggagcagttcattatccagctcaagtgcaagcacatgcgaaatggaatccctggcagttacaayaggctatggtgtgtgattgacgtattcactggacttcattcaggtggttaacatccagtgaccaaaattggtttcttaagaaattatagggtgcacacaatttttcatgctgttgtagttttatctgtctggtatgtttggccccaaagcacactgaatattagatcaggatttggagcaagtcacttgaactctctaggccacagttttctcatctgtaaaattaaggaattggatttggtaatcttcgagagatgacttctggctttaatcatctatgaacatmattttaatttggtgcatgaataaactggctgtatcttagataacatataatacaggcaggkcctcctgaaaatgtggaaatctttgtaatgatatgcaaagtaagacatacctttgtaaaacaattctattaccatcctagcttgtaagrcaatattttgtgcagaaagaacccagagcagttaaaataattgggcagggaggwtattagattttaattctaaaagttttcagaaagataagatacacgtaaaataaaaatgagtcaggaaaagagayagaagcaaactggacaggaaaggaaactataaagaaagagagaagaaaaagcaagcaataaaagtgaaggggagacgatgttttcatagaaactcaaaagattctccagctggcttccctgtgtgataatcattactttggcctctatttggtctgcataaggctgaaatcacagacgagggagtgtttgctttctgtccctgggctgagcccggctggtcactgtgcccgcttgttgttggatgaactcataggtctgactaacacagtcaagccattctaaatagcaatcagatgacgagatccaggaagacacaacacaccttctgtttataattctggagcctgtcacagtttcccatagatcaagacctgagagatcggctctcatgcattgctgagggggggtcctgcagcattttttagggaagggctggtgtcaggagactgagctggtgttgggctggtgacaccaggtggtgggctagtactttaaggcagtggctagacctagaaggcagccagagtcagagtgagctgctggtgtggaaacacagagatgctaggactcattcttttcaggtgtcatcgtatgttggatattttctgcagaataaaatagcatcagggaaaagcatcaagggaagctcagtcatttgccctcatcttactttattgttctaacagaagttatttccagagcagtaatgttggtatttggttgttgatttctagctcctcagcccaacaggtgtgagtttgcctgctgaagtctttcttgtcttcatctgataaaggttaagtttccggatttgagttcagatacttttccatctgtagtttgtgccatgtggctatgatgtcagccccaaaatatgtgtttgggagaaaaaagattggtttcttgtgattactgggacttcctcccttgttactttgtttctgcctttatccagatgtgcctgggaaaacagaaagaaaagaactaacaagtacaggtttaacaggttaaaactcttacgaagttcttagaaactacaagactaagctttaatttaacgtattagattttgctcattcaaactacaaaatatttgaatcctgagagactataattgactaatgttatcaatttaaagtaaaattttatattctattaacatgtattgcatatacattaatatataatcctgctaagagggaactttaaaagtataaacagggacagataaatgtaccggattcattttcaactttaatattagaggaaaacctatgtaacatctagtccagtgcttttcaaactgcaattcatgactcattcgtgagtcatgaaattaatttattcggttgctacttgtgattgytaaaagtatggagtaggatagaaaggaataggagagaaagtatcagagtttatcatacaaagtaaggtgccgcttcatgagaactgtttgtagtatctccgcgcatgggtggctaacgtaaatgtattttttagggtatgtcaagaaagtttgaagcacaaatctattccagttaccttaatttttaaatgagggagatagaagtctaggatgttgaatttatcctcccaagaatacatagctgattggtttgaaagtcagactaaacaactgagtcccgtcttagaatccattgcttttgccatgtctaggttagctcttagaaacgctctaaatgaactgcatataacagctagtaacatttaattcagggctatcatcaaactgtggtggatttttcatatttcctgcaaagcgaaaaccttcacaattgtccagggaaatggccaaggatgatcccaacaacaacaacacaggattagagatgagccctactgggctttcttggcctccctccttcccagggcagggttcccacctactcatcagtgggtggttagtgctgttttttatcagtgatcctggaatgagctcagaagaggcatctagcagtgcaaagttaagaaatgatgacaaacatgcccaaagaggccttctttacactaaacgggtaaagagagttctgtttctattttaaaacttcagtttgggagtgtagtgttctcaaattctagtgttcataaggaatttgagatgggggattttcttgctataaattcaggcatctgggccccacccagaaattctgattaaaataggtctagggtgcttgttcgccaagcaattcaaggggttctaatgaaactttgtagtttatcaaggactctgaaagtcaagccttagcatgtgaattgctgtagaattacaagggagatacaatagtggattggactgtaactgctcatgatggaaagtactattcatgacacagggaaaggggatgctgtagggaggtcagaagtcttggtcctactctcagccttgatactaattaggaatacttttgtttgtttgtttttgggttttttttgttgttgtttttgttgtttgttggtttgttttttgagatggagtttyactcttgttgcccaggctggagtgcaatggcaatatctcagctcactgcaacctctgcctcctaggttcaagtgattctcctgcctcagcctcccaagtagctgggattacaggcatggtcaccatgcctggctaattttgtatttttagtagagacagggtttcaccgtgttggtcaggctggtcctgaactcctgacctcaggtgatcccccygcctcagcctcccaaagtgctgttattacaggcatgagccaccgcacccagccataatttggaatactttggacaactcacaagcctctctgattatttctatcgaccttgaattctgtattctttgctatgagagattcagatattttccctctggaaaaggtgttgtagtaagtcgattcgtcttttaaagatttactttcttactggctagtgttttctcataattttgtatgtacaggtgtcccagcacttctctgctcagttcrtttatcttgtttgttatatttcttactccttagaataaaaatgcaacaaaatgcttaatcatgatattctgagttccctacttgtcttcatccttaaattgacatttcctgtgtagaaaaaccagggattgtggccaggcagggtggcttatgcctgtaatcccagcactttgggaggctgaggcagtcggatcacctgagatcgggagttcgagaccagcctgaccaacatggagaaacccagtttctactaaaaatacaaaattagccaggcgtggtggctcatgcctgtaatcccagccacttgggaggctgaggcaggagaattgcttgaacctgggaggcggaggttgcggtgagagaaaatcgcaccactgcactccagcctgggcaacaagagcgaaactccatgaaaaaaaaaaraaaaaraaaagaaaaaccagggattgttaaagagaataggatttggaaagagggaacttgggttcatattttatcttggccatgtctgaagttaagtgtcttttagaatttaatctccaggaacctgagatctctcatctacacctctctaaaaagtgtggtgataatgcctggctgttttgcaaagttgaggaagacaaaatgagacattcaatgtgaaaaytacattagagttgtaaaggaccatgactttgccagatataaaatatgattctcaatatccaaggacaattttacaatagctactttgcttatttctatatgaatctgcactggtcatctgagagggaaaagaaaaagcaatgaccatgaccgcctagcagaaaattgtagcaaaatgttgagtttgattgagaaggcttcttctttcttaagggagaaactgaacctgtaattatatcttcccttgggtcttcactttgaaggatgctaaaccaaatatgtctgtggaagcagatgatggctcctgggttagctgtttatttagcacattcctagaatatcagaggtcatatggattcattcagaaaccaaacatttcataagtgatttcagaaagcatagcctaaagattgagcctcaatgtaattggatagtcacataaatcatcccataatgcaaagcaggaaggagctggagcagttccccataatctagagtctccctatgagatgcattcctctctccagaggatcagcttatcctatttctgtggctcaaattttatgggactgatatcattgttgctttgtggtttggaaggttatagatgtttctcattttcccctttgataatgagccaagtcctgtgttacaaaaacttatttgaaaatgtttagtgaaggcaaagatacattgtgagttttagaaaagtctagttttgtgatttttgtaatggtccacagaaggcatttgtatgttttttcatttctttctttacattttttttttttgaggttggtcagagagaaaaatatgtgagttttgccaacagttgtctttgatcctcagagatgtgcttttccattgctagttcagttgaatttaggggataggaaaaatgtactttcatttttcatttctttgtaaatgttcttagaccataataaaaggctaaactgatattggatatgaattttcctttggcaatacaagataaaataaaaggcatagatacatttttatctttgcattttgtattgatgtaataataagcatcatgccaacacataaatatccttgtatggaaacacattctaatttaatcatttgtgctttgttgaaaatcacaagaggaaaccaaaacttagtattgatatttttcagtattactattattctagaaggagccatttatattgtcaagggaagaaatgtaaacatctatagagttcagtgatagttaagaggggtttttaatctttcaagaaatagatgcattaagttcagagaatagtaatttttctctctatgaaatttgaatctcataaaactaccatcaggttttaagattaaatatcctattgtttaatacgtgtagcaggggtcccttcaaatatgatgttttatttctctatttcaattttatgtattctttattagatatctgaattatttattggactttctctagagagtgcaacctgtctgtgcacagaactttcaagcttttaacataatatggatttttccctgtaatttcagtaaatttatccataattttcagaattgtgtacacccatttaactacctctccattcaagctatcgaatacttctgtccctccagaagggatcctcgtgttccttttattagtttcctcaacaacctctatgtcagcaaacacacacctggtttctaccaatatagaatagttttaactgtgcaaaaggcagctgtgaacaggaatacatagtatgtattcttttgtgtctggcttcttttttttttgagacggagtctctctgtcacccaggctggagtgcagtggcgcgatctcagctcactgctacctccgcctcccaggttcaagcgattctcttgcctcagcctgcccagtagctgggattacaggtgcgcgccaccatgcccggctaattttttgtatttttagtagagacaggttttcatcatgttgaccaggctggtcttgaactcctgacttcttgatctgcccaaattggcctcccaaagtgctgggattacaggcgtgagccaccgcacccggcttggcttctttcatttggcataatgtgtctggaaatttttcatgttgctgtattcatgtgtttttttctttctattgctgactagccttccattgcatcgatatatcataatttgattatctgttcacctgttgttagatagttgagcttttttttcccagtttttagctattacaaaaaaagctaccatgaacattgacttgcaggttttttgtggacgtattcattctcttgcrtaaaatacctaggagtagaacttctgggtctcatatggtaatgataygtttaactttataagaaagtgccaaattgttttccaaagtggttatgccattttatattcccacctatatrattgacaattctgaaataggagttggggctccacaccagaccagatggaagactggctaaaacagggaagagacagaagcacctctgcataagacatgcccaacagcgccatgacagtgtgccattgccatgacaacacccagaagttaccatcctttttctagacatttccaaataactcaccccttaatttgcatgtgggtgtaaatatgactgcacaactgcgccaagctgctaccctcaacacgttgcctatggggtagccctgctctgcaggagcagtcacggagctggaacactgatacctcagtgaagctgattttttctaccaccagctcacccttgaattctttcctggccaaagcccaaaaccttcctgggtggagtcccaatatgggggcttgcctgccttgcagcagttcttttctccatctttcccaatccttaatattgccaatcttttcatttttrgccactggcagttgcatagcagtatctgatggttttattttgcatttccctgatgactaatagtgctgagtccttttcacrtgctttttgacaattcatttattttcttttgtgaggtgttcattaaaaccatatggttcatttttgtttgtttcttattaatgagtcatatgttgtatattctgcatacaaatacgtcctttgccagataaatgtattgcaagtattttcttccagtgtgtggctaaacttttcttttccttatggtatcctttgaagaacagaagttcaatatatccttttatcccttttatggttagtgcattttgtatcttgtctgagaaatatttcactaccgaagttatcaggatctcccacgtgcatccttctagaagttgttttttttttgagacggagtctcactctgtcgcccaggctggagtccggtggygcgatctcggctcactgcaagctccrwctcccgggttcacgycattctcttgcctcagcctcccgagtagctgggactgcaggcgcccgccaccatgcccaggtaattttttgtatttttagtagagacgggtttcaccgtgttagccaagatggtctcgatatcctgaccttgtgatccgcccgcctcgtcttcccaaagtgctggaattacaggcgtgagccaccgcacccggctccttctagaagttttatagtttgagattttatacgtgttctatgatccattttgcatcaatttttctatatggtgtgagttatgtgtccaagtgtgtttagcaaatggtatttaattgttcaagcaccatttattgaaaagattctccttcacccccactcccactgaattgcttttgcatttttgttgaaaatcacctgcctgtgttcatgtgtaggtctgcttctggaatctctatttcatcacactgctgtacatatttacccctttaacaatagaacattatattacttaatgttacataatttcatattgtatattaaaatctggaagtataaaacctctagattgrtacttatttttcaaaattgtttgggctatcctagattttttgtgtctccatattcattttagaatcagcttttcaatatataaaaaaacttgagaatttgattgagattgcattgaatttacagaccaatttggggataaaggtcatcttaaattcagccttccaatccatgaacatattttacctctccatttattcagatcttccttcatttccttcagcaataaagttttcagtgtagagtttgtgcatgtttctattaaacttgttatcaagtgtttcgtgtttttatgctattataaaatgacatgccatattatatatgctattttaaaattttactttctggttgtttggctgatatatgcaacataaatggatttttgtatacatatcttgtattctgcagtcttgtttaactcagttattagttctaatgacttaaataaatcctttagtatatactacatagatgacaataactgtgaataagttaaataagttttattttttcccttctctctctctgtccctctttctctgtgtatgtgtattgctgtgatggctagaactttctgtgcattcttgaacagaaagggtgaggttggaatgttggcctttttcttaatcttgacaggaaagcgtttagtcctttaccacttaagtatgatgttagctttggattttccatagatgccattcatcagtttgtkgagttcccttctgggcatacttgctgagtttttatcctggataggtgttgaatttttctgcatcttttggtatctttcaaagcttttctttttttattctgtttaggtggtaaattatgttgatttagtyttctactgtcaaaccaatcttgtgtaatacatcagaactccacctggttctgatctattataacttttacgtgtattcagaattgttatgctaaaattttcttatggatttttgcatcagtgtaagacatactgaactgtaatcttcctgaatttctttgtctggtttggtataggagtaatattggtcttgttagttagaaaatatcttctcctctattttctgagtttgtggaatataaacaatttcttaattgtttgatacaattccaccagtgaaattatttgagcctgtagttttctttgtaggaaggttttatattacaaatttaatttcttcaattaatagagactattaaagctttctatttcattttgagtcagttatgggaattttgaaagaattcatctattttatgtatgttgtcaaatatatttgcacagttttttgtaatggtgtctttctattattttaatgtctgaagattctatagtgacatcccctcttcattcctgaaaatggtaatttgtgttttttttcttttttctttgatcagttttggtagaattctatcaattttaataattttctcaaagaaccaatttttgacattgtttattttctctattgctattgcattttccatttaattgatttctgttcttatattatttcatttaattcttgccttagttagcttttctctagtttctttagataaaaattaactacagatagatagatatagatatagcctttaagcactacttcacttcacctccccagttttttttttttttttgagacggagtttcactctcgttgcccaggctggagtgcagtggtgcgatctcagctcactgcaacctccgcctcctggtttcaagtgattctcctgcctcagcctcccaagtagctgggattacaggcgctcgccaccatgcctggttaatttttgtatttttgrtagagacggggtttcaccatattggtcaccctggtcttgaactcctgaccacgtaatctgcccaccttggcctcccaaagtgctaggattacaggagtgagccactgcgcccagccacctcccaaattttaatgttttattttcagtaacttccagttcaaaatattttccaattatcttgtgatttcttctttgttctatggattatttgcaaatgtattatttaactttcaaatatttgcaggttttctagatgtcttattgatttataatttcagttttattgtggttaaatgatatactttctaagttttcaattgtttaaaatttatggagaattgtgttacagccctgcatgtggtctatgctgctgaatgtttcatgtatgcttgaaaaactgtgttgtctgcagttattaagtgtagtgctctctgtcaattggctttaagtcggctgagtgttggtcagattttctatacccctattcatctttatctgtttcattttcggttactgagagaaaggtgttaaaatcttcaactctaatcatggttttatttttttctttaatttttgccttttcactttccttcgtgtattttgaaactattacttcatgcatgcacatttaggattattatgttttactgataaattgtcccctttgtcattatgaaatgtctttctataaatctaataatattwtccttcttgaagtcacttttgtttgatattatttcagtgatttcagctttcttatatttactgttcatatggtatatcttttttcattcttttagttacaacttagtttcaccattatatataatggcrtcattatatataatgtgcatgcatagtaaaaarcatataattgggtcctgctttttctgtgttttagttgaagtatttagaccatttacaactaatgtaattatttttatggttgaatttaacataccattatggtagttgttttccattcatctctttttgtgttgccattattctgtcttcattttggtttacagaatattattagtattccattctatttccttcattgtctttttaatgatacctttttttttgtatttttacattaggtctaaaaatatactccttaacttataagcaagttttcttagagttaatatgcagctgctttacatttcataccttccaattcatacctgacacttcatattacacaaattcccctttatacttcacaagtgaaatactgtcatactagtgtaattccatgtgcctatccttctgtgtgctgttttagttatatcttttacttctctctgtgttataaattcaccttactattatttttgctttaaatcactaattctctctctctctctctcytttttttttttttttttttttgagactgagtctcagtctgttgcccaggctggagtgcagtggcaagctcccagctcactgcaacctccaccttccgggtttcakcaattctcgtgcctcagcctcccgartagctgggactacaggcatgcaccagcacgcctggctaatttttgtattttttttagtagagacagggtttcaccatgttggccaggctggtctcggactcctgacctcaggtgatctgcccacctcrgcctcccaaagtgctgggattgcaggcatgagccaccgcacccagcctacttctctctatattataaattcaccttactattatttttgctttaaatcactaattctcttttaaggagataatgaaaagaaagcctatcatttatatttatacaatgatttatcatttccagtgttcttcattccttcttggagatattttctgtttggtatcattttcctttggcccaatggatattattatttcatacagtacaagtcttccagtgacaaattatgtcagcttctgtttgtctaaaaatgttacactctcgttttttaaaaaagtagttttgctggatatttaaacctgttttccccatctcaacattttaaagatgtattccattttcttcttgcctccattgcttctgtttagaagccagctgtcatccttatcatgatgtccctgtatgtgatgtggcttcccccccgccccaactggcttctgtgttttccttgtttctgttttctaatagattcactctgacatgtccaagtgtagttttcttttatttctcctgtttagtattgactgaactcctatatcttactagacatttttcataaaatttaggagaattttagcygctatttccttctcyttttttggcccatttttattaccttcttcttctggttctctaattgtatgtgtgttaacctatttgttgttttttctttgtttttttaaatatctgtccattttcctggagttcttttttctttgttctttagattaaattatgtctattaatacatattaaagtttactgacctttttttcttctgcctacagtttactgttaaacttgtcatgaagttttaatttgaattagtgtaattttaagttatataattttcatggttccttttaataattttctccctttttgggccaaaatttcatatctgtttactttttaaggctttttctttaagtctttgcacatatttttaatggctgctttaaagtctttctcttttaaatctaacacctggatcatctttgaatcacaagatgacattttttttctcaactatgaccacatttttcttgactactgatgacatttcttttcttgatttgattcatattttctcattttttgttttgtttttttaagacggactctcactctgtcgccaggctggagtgcagtggcatgatctcggctcacygcaagctccacctcccaggttcaagcgatcctcctgccttagcctcctgagtagctgggactacaggygcccaccaccacacccagctaattttttgtatttttagtagagrtggkgtttcaccatgttggccaggatggtcttgatctcttgacctcatgatccacctgccttgacctcctaaagtgctgggattacaggtgtgagccactgcacctggcccatattttctctctttttttttaatatttgtaatagttttgggttttatagtggacatgatagattgggacatgatatgggggtcccatatcatgtgggtaaattatgtgttgtagacactctgtattatcttatcttcctctgaagctagtttgatatctagctgattactttgtatctgcataggtttatatctgtacttgctaaagaatatttgtgaacatccctgtttctcgagcccctctaacttgctaggtctctacctccaacttctatgattcctgcaggtcttgttaagacttatcctttggcccggaagttctagagagccctactcttggccatggtcttcacttgtaagatatggccttttaggtgtctcatttgaatgcctgaggtgttaaggaggtatccccattctggaatgggagagaactctaaatgatcttgtttccgcttccagcctagtagcagctcctgtctgacatgctttctgaagtctcaccttatgtattctcagcccaggcttagctaagaatccatgggaagccctactcagatgcccggctttcctctctatatacttcttcttctctgtagaatttccatatagttccagctgctttggcaactctaatctttgcatcatcagctcagtaggactgtcattcactacttggacttcagctcccttctgtggtcaggaaattctgcacaggtagaaagccaaggaaatcaagagtcgtacatcatgagtttcctttctgtcaagaatcacaatcttgtactgcagattgtccaatattttgttcagttttacagttcttaaggagagcagctagtttagtacagttgcttgtcatagctggaattaaaaaaatattaaagaacctcagccaaccaggatagagtacaggaagaagagagagagaggaaaaatgaggtgagaaaaatagaagtcgtaggattggagtttaggggtagtttgaaagagaagaactgaatggagtagggagagtgggaggaacttagatgcatgtaccagtccccttcgtttccaacacatcatgtaataatatttcaacaactacttactgggacctcatctgggccaggtactacagtgatagtaaataatggttaataaagtcttagtcatatcccaaggtttagtaaggtaaatatactcacataaaaacaattacaaaatatgtttggggttcaaattgctatttgcataaaattttattatgctaaataaattaattctgcttggttgggaaaggtttcagccaaccttaaatgatgggtaagagtgtatatgttaaactgtgtattgkcaggggttgttgggtggcgggttaggtaaarggtaaagcatttcagacaaagtgaatggtgtaaatatcattggaacacatcaagaactgtagtttacttttgtgccagcaayagaaaagaagcttggtgagtaaatcaaaatttcagtacagattaacagactcccaccagttgttccagaataatcacattcatgtaagcaagataaagggaaactacccatcattattgccccaaaatgtcattaattcaggttcctccacctgagacctaatcacacttaacattctcccacagacaagttgcattagagatatgcaagacaattgtatttcccytccaggagtacagtgagtaagcaagaacaagtgacgacagataatttcctctaaatatttgatttactggccaaagctctctgtgtgtgggtcaatgagtctgtctrttctgtcaactcagggatactgggtcattgctttcatttgatgtcctttttttagcttagtaagtttcattrctgggtctgaaatattaatagaccaatgctatactcctccccgctctctttatccctcttttctgcctttcctgttgtctcccttctgtctgtcttattcccttcctctctaccttcctttccacttgtggaaatattttggcagactacagagaagcatacttttctatacttttggagttaaacataatctttggtgttaaatgtcactgtgaattccttcaataaagtaaagccttgattgcttgctgtttaaaatagagtaaaatcaaatatctggcgaatgcccattcctttgagagctacacacagatagtagaacctataatatgttctatgcatctctatgttttcaataccaatgattcttcttttctgagcwtggggattatatagcagcaactagggaaacagcataactaaacatccttattattattattattattttgactcacaatgaaacacaatagtttattgtatccaaaacctttcagtaggagacctctgtctactcctataccctagatttaggttatggctggatgcaattggaaatacattaaaaatgcatttatttgctgggcatggtggtgcatgcttgtagtcccagctgctggggaggctgagacaggagaattgcttgaactcggggggcagaggttgcagtgagccaagatcccgccactccactccagccttggcaacagagcaagaccctgtctcaaaagcaaaaacaaaaacaaaagcattcaaaccagattttctttgtaaaatatttcagatttggagggcataggagattgagtgggtggtaataaacacagaatcgastgaatagrtaacgttaaaactgttaaactagaaaagtttttaaagaagatatttatttaggacttcaaaattgtccaggtactatgctaaatgttttataaatgacctaatgtcttccttataaagtaaatgaccaccatttactgagtgcatatcatgggctaagcccttgtaatgcattatctttaactcttaaaccttcagtcaaaggtagcaatcctcttcatttgcgagatgtgagaactaaggcttagagaagtacagtaactctcccaaggctgcagagcttgacagtgtttgagagggttttcattcgagatcactctgatccttgagcctgggcccttattcttcaccccgtggtggaggtacctgctttgtcatttctcataaatgcatgctttggtgaaaaccactttaaagggagcttatgaaaaggcaagaytgaattatttctaggccctcctgcagtggatcctaatttttaatgtttatggtaatttgcaaggattagaaaaacgtaacactttcaagacttaaagggttgtttactcaagatatatataacaatttcctctccatagcttagatttagtgttggtaattattttgtctttaagattacaaaaactttgtttcagaatgaagtctttatttgcacattccagaatggcttattgaaaatcaagtataggcacaaattaatgaaatacatattactggatgtattataaacatatcaatattttctattttctctcttatggtctgtttctgttcacagcatgtttgcaagactacacagatgatttggggacattcacttctccaaacttccccaataattatcccaacaactgggaatgcatttatcggatcacagtgagaactggccaactgattgcagtgcacttcacaaacttctccttggaggaagccattggaaactattatacagattttctggaaatcaggtcagcacttttatttatttcattataatcttttcattatttattctcattaataatctttcctaggaagattaaggaaaaaaatatggaaattctctgcaaagctccctgctgtgcactttcttgcaagaaataaagtttgtcatttggagcctgacttaggagaaatacaggaattgcataagattctgtggttattttgaagtgattattttattggaaatacttgaaaataaactccagattttatgtgggcaaagaaacagatgtgctactactctgaaatgatgtaacttgctactgttgaatacctactttaattatgtaaaatcgatgtaaattttaggctgtttgctgttcatttaatctaattatattataaaatgatggcaggatagcaatcttaaagttttcacaaagttttcatgttcaggtaataaaagtctaggcttgtgaatttcagtacaaggcattattctttcattatcatcattttgaaagaatgtgtttaaaaagttatatttgcagtaaaagtaagttagcttatatgttactatctctccatgccactactttgagttaaattaggctaatcattctggtgggcatctatatcaaatgttttatttgggattttaaatctggaatcttatgtattataaatgttattctataatataaagtaaggtattaaaataataaatcataattggaccctatcrtgctaaaatgacataattttcttaatttacagcagttactcactggactttgatgttgaataaatcccttttttgttgtttgtttcaaaaagctacagattataaactagaattaaggccccagaagtttttaggaaaatgctatttccaraattttgctaagtatatcaaatatgatatattacatttcaaaaatttccawatcagaaggaaaacgttgaaagattctctgtaaaatacagcagtatgtttatatagttaatagtatagtttctttatcgtgttttctctgacacatttgccagaggctttattcgaaagggtgaagattaaacatattctctcagtttgtgattggttatataaaacaccataccagctatgaatgwtggttattctttgttaagtcattcaaataygatttttaaaaatttaaaagtgaaaatcgtgttttttagagtaagtgtagtgtttgagagaaattacttcatccaataaactgctaatgtttgcaatcccaaagttcaaattatgttaaatgtttatacagtaatattgtcagtaacccaataaattttaatttctgtattctgccagagatggaggctatgaaaaatcaccattgctgggaatattctatggctcaaatctacccccaacaatcatctctcatagtaacaaactrtggttaaaatttaagagtgaccaaatagacacaaggtctggattctcagcttactgggatgggtcatcaacaggtaaatagcaaagagctgtcttttactggagaagccaatctgattggtttcttgattctgggattgtcatgctctgtccctcacttgtccatgtttgcccagctgtatttaaacttcaatattgcaaataattttaaattaacagcagccatttctttttaacagacaaagggagaaagttctagtttctttttatcaataaataagaatcctggttagaataaggaaattgcattaatggaaattggggctgggtgctgtggctcactcctgtactcacaaacactttgggaggccgaggcagggggatcacctgaggtcaggagtttgaaaccagcctggccaacatagtctctactaaacatagtctctactggccaaccccgtctctactaaaaatacaaaaattagctggacgtggtggcaggtgcctataatctcagctactagggaggctgaggcaggagaatcgcttgaacctaggaggtggaaattgcagtgagtcaagatcatgccgttgcattccagcctgagtgacccagtgagactccatctcaaaaaaaaaaaaaaaaatagaaaaaaataaaaattggatttttaggctataactactctttcatgatgccattttgctgtgcaatttgatttaaaggatagtagaatggcaccagtttaatgcagacaaaaagattcaatttccccagaaggaaaggggtgtgtgtcattccacttctttctcctgtaggttgcgggggtaatctcaccacttcaagcggyacgttcatatctcccaactacccgatgccctattaccacagctctgaatgctactggtggttgaaatctagccacggcagcgcatttgaactggaattcaaagactttcacttggagcatcatccaaactgcactttagattacctggctgtatgtataatgtttccatcatattgttccctgctcccatctcacccaacgcacaatgcacttatttttattttcgagattcaggaaaggggagcatctaaaccgaacatccatataaaaattcaaacaaaataaaaacataaaagaaatttggtgaaagtgaccatcttcgaagtactcaatggctcgatacactaagtatttaaaatatattgatagactattaagatatggtgaaaatctcctgaaagggattacaggatttattataatcattatttatgtttttccacatatgcattgaaaaatcacaatttagaagacagttttggcgaagtagagaagataatatgagtcattccactaggayttttcacagtacagcaattcaccattgttcatttgttaaaaatctaaataaaaatgtattgaagtgtcatgaatcataaactatggaatcaaaaaacaaggaggacagttgacatcagctgtggcattacaatatgtattgggctttcattttcaatattcagccttcagtgtaagctcacacgcttattactgctgcacatgtccacagcttaattgcctgagtttatggcctgagtttataaatacctaaatataatttwtaaggttattttatttcatggctattcttttgtgatgtcatatatataacaaaaaatatatatttattatatataaagatatatttattttatatatatttatgtttacatataaatatttaatacatatataaatatatgtatttaatgcaaatataaacatatgtgttgaatacatatataaaaatatatgtattaaataaatttattttataaatatattatatataatgaatatttataatattttatatataattacatatatttatttataatatatatacataataaatatatatattttttcttcctcacttcttctggattatagtcctttacataatgtttatagtctcaaccatctaacattcaaaatattttcttaaaggtatatgatggcccaagtagcaactctcatctgctaactcagctttgtggggatgagaaaccccctcttattcgttctagtggagacagcatgtttataaaactgaggacagatgaaggtcagcaaggacgtggcttcaaggctgaataccggcagagtaagtgtgaataccggcagagtaagtgtgtatactggcagagtaagtgtgaataccagcagagtaagtgtgaatactggcagagtaagtatgtatactcgctgttcagtgcctagagtgggccttcaaattcttgaaacaaactgaaataagtgtaacgcattggtgtgagcaattgaacttcatcttagtttcttctgtgaatcgtttaactccatttgagggagaaataygtattaaatttaatctcatataactaaaacatctggcaaactatagaaacttagaagagtatttaatatgctgagagagttgcaattcagtgaaagatcagtgtaccagactaatgactaatagcttttcatttgcctcacacattgcaatcttgcagtgtacattatattattccaatgtacatagtattctatcacactagtctctaccttaaaaagtaccttaattttattagggaaagctgtggtccatgtgagtcatgcatggaataagcatgttctttacagtagaaaaatctggccattgtacagatgccattttaaatctacttttcccagatagcaacatgatggaattaaaggaacactgagcaaaatgtcaaggggcctggggtttgttctggctcctaacccttgagaaagtcacttttctttgtggtcccatggtttcttcttttagaaaaggagattaaattagatggtctctaaacctgccttctagctctagaattaaatgctttttgaagttagttccaaaatggacattcaagaaaacaatattttcttgaatttgttatttgatagagacttttactttatcaaagtaaagtctaggttttggaaacataattctactgaatcaaaatttatccataattttacacaattatcttttcccacagaatcaaaatttatccataattttatgtaattrtctgaaagtggaattaaaagtcacaaaattattaactgtatacacaatatcccttgaattaactgaaagagtaataacatttaaccttgattatgtatgaattttaagattcacattgatttatatctggggattaggctgaatcctagatagttttgaatattaagttttaatatatagctttgttcttcagaaatgtatcactagtacataaaaaggtctcctaagttctatcagagatacatctgtttkactatgtaatcatttatctaattttattactgctgtgctaatctatttctggttataatcagattgtttaagggtttcttttttttcttttcatttctgagatatttttctgtcataatttcagaatcctgaaagtgtaaatgagtgcacataagaggcaaaatcagagcaaactagtgagattatctgtaaaatttgccatgggaaattggagatttacaaatagtrtaaggtctgagtgctgagagtggcccatgtggtttactggaatgtattttcctgggccctgtgttgcccctagtcatcgaggcacgtgatgcctatctgcctaataggtgtaccttctcacagtcttctaaaacaataagattattctttaaaaatcctttatggacaaaactgtgacctaaagattttcaaacagaatgggtttaagtattctccctgctccaacaaagcaatattttgaagmgccacaaatgtacacttttttaaaccaaagttataaatggtgttctacccaccttcagaaagcatatcgtagtaggaatacatctatgaatcacactttcagagacagctcattccatataatgtttatttcccgttctcttttattgcacatcatagagataatatattccttgtttaagtcattaggattggctgaactgggcacccaggattagacatacttagaggtatctggtttggttttgttgaaaactcagctcaagaaaatgccaccattggattgaagactttttttctgtaatttcacattttcctttcttctttaaatcctttctactctrtctattcgcttggtacttcctgatgactaactagagggagaacggagcctttaytgtgaatttcatgcagacttttgaatgttcaacaaagccatgttgttactggtttttagcattcccataggattttgggtttttaaactgttgaatttaaaagtcagaatttctgtcccttccacgtgttaacattaaaaaaacagcagcacagaacgtcgaatgcgcttctctaacaaacaaatcagactgatccctgaatataaccaagttattctgctctccacaaattcaagggaatttgatgcctattttaacatgactatttaattttcatgactctttagtttgaattcacttcagtattatttcacatttcttctaaatggaaatcctttcactatgaaaatactgcaccaaatatatatgtgtgtgtgtctctgtgtgtgtatatatacacacacatatatacacatcatatatgtgtgtgtgtacatacacagatgatttttatttwttttttttaaagraaaatctcatcttggagcacttatgaagtatataatagtggttcttaacagtcatttctttttccagcatgtgagaatgtggtaatagtcaatcaaacctatggcatcttagagagtatagggtatcygaatccttattctgaaaatcagcattgcaactggaccatccgggcaacaacaggcaacactgtgaactacacatttttagcatttgacttggaacatcacataaactgctccacagattatttagaggtatgtattataaagcttgattgatcactgctttttcagatcaagggagatgtgtcaagttagaatccatcatgctttttagaataaaatccctaactctgccccacgcatctataacacaccaaccacccatggtatttgaacaggtatatttcatatttaatgtattaaattgtgaatacagagaactatctatgtttttaggtttcagtgtaacttctggactcattgrcctcatattacttaacttacatggaaggagagtaataacctctattttttgttggttgtttttatgtttgttctctgtgtataagagatcagaaaatgtttgggtatcttggatttatttaagatgtcatttttctagtatgaggtatcatggttttaattgttgtttttatttttaaatgtaagttcatttcagtatatttttatttttgtaaaattgaagtttcaattgttataatcatgaccactrgtaacatttattcaactgtctgtatgcaayttcaggcaataaatcttgcttaaatattaggcaaccttgaatataaggtaatatgttatttttgcaataagaaattttaacttaaaaagctttttgataacttgcatatgtaacttttagggctacaaattgggaggttattttggcatctacgtttcatcatcagtaaaataactttttgagtcatctaaggcattatctttatttctgtctatattgttaatatataatacttcaaaaaatccacatataatgttttcactagataccctttctgaagtgataagtacttgctctgataacaggacattttttttcccacctgccctcctacctgcagcctagtgacttaaggtagttgtttttaaggtggtcagtgatttttagaagtcttacttacaaagacttcaacatccattgctggcaactctggggtcatattcccaggaaaaaatatgttattcttgtaaaatgttcttaattgtgtttttacaagttgtataggaaaactagcattggttgaggttggttgaggttaacatatattttccaaatagcacttttgtttatgaaaacaaagagtgacaacaaagcattctgcactttgagagactctgtgaggtcctaactataaggagattcccttgtttttcagagataattttttgggaaaaaattttgccttatatttacaaaagtacaatattacagaaatattagccatagtgtttacccattagaaagttttgtttaccagtattctaagaaaatatgacacaacatgaaacaaacttacaagcacgtacttggcaatggttttaaagtccaccttccttgacctggagttcaactggtcttcacaagcttaatgataccaggatggtatcattaagatactactagaataggcatccatttcttcacatggtgagaccttgtttgtgttttagaaaaagcagaaaagttgctttcaaagccctttgtttataccgtgaacacagcagttggtcatacctccttttaccagttaggactattctgattcccactggactgtgggcttctcgaaggtctgtgctgtctcctactaactttgtaacccaggcacttattatacaggtgggacattacaggagttcagtaagttcaagttgaattgaatatcacagccatattttagtatcagtctaatgataactactaatgaatgagaaagattgaattccaaactggcgtttttgtacgacctcctacacacgcagtgcaatcctacaaattggagcacaaaccaaaataggactcatgatcttgccgagcgttgcacgtataacagtgtgctgggcaccataatcrtgatttggtaaagcrtaatggagaaagcyacagaaaggaggatgcttttgaattgggctttaaaggaggctttggcagaaagagggggggaggaaagagatgaaacatttccaggacctgaactccatttctttcgactcatttgaggatgaaatggcaacaaaaaggtgtttaaaaactcaaattaaaaaatgcttgttccagcaactgcagagtagctcattagasccccttatggatgacgtgtctgtcatgttatggtcatgccatttctcttgtgcaacattgacggtgaaagagcaaaaatacaaaatgagaaccagaagttcagaaaggccttccaaaaaaacggcgctrttgccagagggaggagattgttttccatctctgtgagccaagaggccagaccagagcaatagctgcaatagctggtctatgatggaaattttaacacacaaacaaccatttacagagagaaaactcacacacacagaaatctagcttccattattttaatcgcttctgggttttttcarctgacttccccaaatcccaactggatgcctgttactagagccagaatttagttattctgaattaataaaatggaaactacaaaaagacttaattacgtgctggtcagacactatcccgccttgatgagaggaatgggtttgaaaagatcccattggaaaccaaatgcatcctttattatttcaccctctgggcaaaacaaaatatttcagatctggaaataaaatatacagtgggagaagggaccatttgcttaaaggagtgagaccatttgcccgtgcaaacatggggaatcaacctgaagagttctggctgtattttacaacttgatttcagtcttccatttttattttgagtctgagtctccatgcagaaaaggagatttcaaacgagtgattgaatatagaaatggaaatgatagatttgggagaaatcaacatggagatgtataggaagcccagggtatttgttaagtcaacagggagcatgtgtgtagtgagaagaggaagtaggaacactaagaggtgattgtggctgggcacggtggctcaggcctataatctcagctactcaggaggctgaggcaggagaatcactagaacccgggaggcggagtttgcagtgagctgggatygcaccattgcattccagcctgggtgacgaagtgagaccctgtctaaaaaaaaaaaaaaaggtgactgtgtcatgggagccaagggaagagcagtcgagagaggttgtggttcagaagggtcccttggagatcaatgtgactctggtcagagcagtgtttgtggggcgagagcaggaaccagacagtgtaaagaggtacaaagaggagagtgagtgtagactgaagtctaggtccctgaattctgaggctstctgtaacaaaccagartaagtgatggcttcttttctccaatccttatccttcatttccctaactggtcctcatctagttcacgtgtgtgggacacactcctttgcatgttctcttgtatgtcagtgcctctttaaatgtggccccagaattggatgcaacagttcaactaaacctggctaggcccaagtaggttggaaccgtattatccagttcatatatttctggtggtctatgctgaagttaaatggggtttattgtagctaagtcatgatattggcctatatcaagatttataatctccatatcacttttacatgaattattatgaatttatgattatatgatttttaagaatctaaacagagatatttttcctaataaatcagatttgattttgtctgagaatcccaacacatcatgacctccctaaatcttcattcattgcttttcagagcattattcatttgcatacagactcattggccactgacctagtacttcttcaaaaataattgataaaaatgtcaaacaagattgcatctatttcaaatactcttaaatgataagttcttttggttaaaattgatctattattaagtgcttttggaatagcactattcaaactactaggtaataaaagctaatatttattcagcatgtattatttgccaggtaattctcacagcaaccctgtattataagaaatattatccccattcgttaggtgagaaaagtgaggcagatataggttgttcatattcagaaagattataagtgtcaaggccggctttctagcaggcactgtaactccacaccgatgctctcagccataacaccacataccccgggagcactctcacagtgtcctgtcaccctcacagggatcatggggaagtgttcctgctkcccccaagtctaccattctattgacactgccgcaaagagaaatcaatgttttgcatgactccatagataagcaggtgccatttattataatcacctctttctttgcttcatgttgacaaattatttttagtgtctaatttagaatttttccaaaaattactgttaatcttactgatctacgagattctagaatgaatctttccccatcttggaagctggaacgttttcccttcagccccctggcagccctgctggttctccttgtctgggctcrcactcttggtggtggcaccgaaacacaatctgagccacatgaagaggacaggcgcatgtgacaggctggttactttgagaaggctcacacctccccacacacaggagaggctgagaagcctggagaaggtgggaagccaagagagtgaggcagattctccactcccacttcctaaggctctgctcctgctccctgactgttcccatccattcccatccctctccccaaaggcttcctctgagtttcagcaacctcggaattttagcttcaacaacatgaccaccccagccttgaccctacaggatcatttacctcaagtgcttgcatacaaccagactttcccttggtgacaaatccccagcacagggagctcatgtgtttgagctcgacagcaaatgcatgggtctagcctgcctatggacgatactcattagggcagtgtagccaagccctctagccggtgatgttcacagattatgttctgggcagaagcagaacttgtgagcaggggcatagattccgctggaatgctaaaactttttttttttaatttaactttcaagttcagggtatgtgcactaccctgatagtagtacacataccctgaacttatttattatgtaggtaaacttgtgtcatgggtgtttgttgcacagatcatttcatcacctaggtattaagcctagttctcattatttttttggatcctctccctcctcccaccctccaccctcaggtaggccccagtgcctgctgtttccctgtcctgtgtccatgtgttctcagcacttagctcccacatataagtgagaacatgcagyacttggttttctgtttcctgcattagtttgctgaggaaaatggcctccagctccattcacattcttgcaaaggacctgatcttgctcttttttatggctgcgttgaaaacattaaccatgaactatgcacccatgaattcaccaagattacaaaatcagctctgtaatcactatacctttcagtgctgtggcatataattcccttaagcctggaaaagttcattgaaaagagttgactcttttatcttctaaactggaattccatgtctcttcttccagtttcaaaatcaaactaggcatgtttctacctcctcttcattgacatcacactctcttctgaaagcatccatgccatccdtgtttccctctttcatttgccctagtcacagccttaaaattagacattttttctaatgttcaacaatatttttctgtgccatttcccaaagtttagctagttcgtatgtgtacccataaaatggtcagaaagttccatggagcctcttggatttctgcttagattgatttctttagagggttctccttttttgcmccccccaaaattattcctgattttgtagtgagaatttagtttttcagaatttgccaattttctagaatgttctttcctttttcaattgcgttttcatttgtttttttttttttttatccataggtttatatcttgttttgaagtttgaatccccaaaaccttagtccggttaagtggtcagccatcacaggctctaagttaaggcaaggtgatcactgtctcctattgtcttggtgacttccatattaacaaccacttctttgctagccagaattagtccagagttgcacttctcttcactgtctcctttatatgaagagagcatataaagaattcaacaaatgctacatttttygggggaacaagacatctcatrggtgtccagattgttgaaacagtctccccgtcgccactcctgtagatctcttttggtacattagtgtttatagatttcctttacaaaagattgcagtctctactgaaaagaagctgaggtgggaggataaagtccttataactggctaccaaatctggctgcattccagaatcatctggggatcttgttagaaaaatttattcctagtcctcatcccagacttaaccaaatccttgaggattccccaagagcaagctttgcacaagcccctggtccagcacttgagaccactgttcatagcccacttccaccaagatagcctgttttatcctcacttcaatgctctctcctggggagggaaaagtatcttaataggcatcttgttaacatacatttgcctgctattaaatgttactttccagtgaggacttactcttccattgctatggctgagttatgtattttatctcaccaaggcctggtcatacagttgatattatgtttacctcattatattaaaaatgtcagattcactttacagtttttgtattctgattctaaactttctcccccttttccttatcgggcaccttgaccactatcatcttccattaaatcatttccttattccttccccttttccactaaagtccatttcaagtcctcgtgayagtgtgggggacttcartcaaaggcatttccctccagtctttataacatgcatttcatctcttgccaaatccttgctgatgtcatcctgttcaccccagatgcttatatcacagtttgttgcactcccgtatcctcctttcagttgcaaaataatgcattccaagaggaagaatggataaaaaacatcaccagtatccctgaatcttgcagtgtcacatccatattctccatgtctacagcctaaacaacattttccatataccacgactgagaaacatcgggctcatgggatattgtcaatacttaaagtgatgctagctgttatggagaactcatacattctcagttgcttactgcaacacaggttatttctaatcacatcagagtaaaaggcaggtgttcctggcttccatgtggtagttcatgaaaccaaaggaaggggaagtcaatttgcagaagccacataactgtctctgccacaaatgttggtagatgtttcacaaatagagacctatattctaataaatctgcgatatgccaaattaaaacacaattaagcagggtttgttgttktgttttgcgtttgctgtggtatttcctcaggctgtcactatcctaaatatgcattcttcattcctttatccatgtatccagtcagtaggatatattttagacacttaggctatggacatgtgactgttttagcatcagttttccttgtcatgatggaggaaacacaccttaatcaatttatcacacaataaaaatttaaccacaggcagcgttaagtgctgggagggacaattatagtgcacccagaaggcatgagatgggaactgagctcctttgtgggtcaggaaaggcctccctgaggatgaataacacaccaggtgccaggaggcttgagatgtgagggactggaaggagagcagtgtgaggctctcaggtggacagggacctggcctgcagagcagggtgggcacattaagagtttcagagacctcctggagagcagcaggaggtctttcaaggatgtggtcagatctgcacttttaaaacaatcactctggctaccagaataaactggagggaggtaagagtaacggtggagacccagtaaggggattgctataggccaagggagagagaactccaggtcttcaccattgctggggaggaagcatgagatcgaatgatttcagagcacttaggaggtacaattgacagagatggataacaacaggatgaaggaaagggagacatcagaatatagcctgatagatagaactggacgcagggaaaaccaccaggggagattagtcccaaagagattatccttgcccagaagtctgattaatgaacatctattggacatttgtattccatagaacattctgaggaaaacattattctagagatattttccaagtttatttcattttcccctcatacaaacaagcaaactttgaagttcatgaggcattagagagttattcgcatctcagatgttattttgagaattacagtaatatttgtcattaatggaatgcccatcatgtgctagacastactaccaatactttgatagatataattgtctgtcctcatagtagtccagtaactgagtataagtatgctcacaggagaacagggattgagatggggaaccatactcagtgcaggaagtgtcatcactacatgaagtgatgaaactacgttcacactcagtgcygcacgaatacagtgtgggctctggagtccacctggctccaaagctctttaccagctgtgatcttgggcaaggaatttaacgtctggctgctttggttctctcgtgtgtaaaatgaagataataatccacacacctggaaaatattgagtcctcaggaaatgcttattactcccctccacgccccttctggagagagcccagctcctgcctggtcattcagcttcttcctgggacacttcaggaaatggtttctcacccttacaccagctgacctccatctcttgcaaatgccatctccattccttgtgccctgccagttaggagcagtggctcctccctggcgaggtctatcttcctctccaggcagagttcacattttgttttctttctcttccgagttccctaactcgatccatggacttctccataagggctttgctttctctctgtgctctccgaatctgtttaaaggcaaatttcttctgtccttggaaagaccttgcatccgctctartaagygaagcgtaaatcagtgtttgtgtttgcagtgcacgtcactgctggtcacatgatggcataacagattccaaacaggtgccaaggatgattcttcaatttccaaattgcttggtttaaaggtaaacgccagtctttagctccctattgaaaacagctccaggcactgtgctttctattgttctagaggggagtcactggaattagaactgcctcagccagcactcttctatctggtgactaccatgggatgctaatgacaaagatgtagtaagtcctctagcactcgttygcaagagaatgtcttctaggcacccagacatatgatagaatgtgctraattggtagtctctgtacctgcttcagagtgaagcaggtaacttcagaatgaagtttaaacccaaactccactacttagtagctaggtgaccttgggcaagttccttagtgtctatgtgcctcactttccctttctgtaaaacrgagtaataagagtcaatgaatccatatatgtaaagagccaaaacaaggtctggcaaatagagaacaaatctataaatgttcactgttattatttgcactgatgctgatgtaagagaaacatctcagtaaggtatagagaaattcacaaatagagagccttcawttctttaggttgagatataattaatgattcatttctcaagacatttaattttcctyttgttttctgcctgcagcctgcatggttaatgcattttgacacttctcactaaggataaaygacaaatgataaaaccaacaatttttgtccacttattttactcaaagctccrttaagaaaaataatgaaaaaaattttaatttcagtgactaacaggagtgttcgtattgtccctatcattttaaaaattgttttggttactctctattattacagagaataaagactttctgtatcctggagtttaacaactcttattttattttattttatttttgagacagagtcttactctgtcgcccgggctggagtgcagtggcgtaatcttggctcactgcaacctgtgcctcccgggttccaatgattctcctgcctcagcctcccgagtagctggggccacaggcacccaccaccacacctggctaatttttgtatttttagtagaaatggggtttcaccatgttggtcaggctggtctcgaactgccgacctcaggtgatccacacacctcggcttcccaaagtgcagggattacaggcatgagccaccacgcccgaccaacaatgcttattcttaagaaaagaactgccacagaaggaaataggaaaaattcttcttcagtagttgatgcctttcaaaatattaaattactaaacctctacctacctcagtttccagaactctaaaatgaagataacaatactacctgcattacagagctgctaggatttttaaattagaataatgaccagcatggaataagtgctaatacatattatctatggttattttaacataaacatagtctcatggattatttttttgtgctctgaagcaggagaccccaatctttttggcaccagggactgtttttgtggaagacagtttttccacggaccgggggtggggtgggagggtggtttcaggatgattcaagtgcattgtatttattgtgcattttatttccattagtcttacattgtaatatatagtgaaataattatacaagtcaccatcatgtagaatcagtgggagccctgagcttggtttcctgcattagacagtaccactggggggtgatgggaaacaatgacagattatcaggcattcgattctcataaggagcacgcaaccyagatccctcgcgtgtgcagttcacaatagggttcatgctcctatgagagtttgatgccaccagtactggtctggggactggggctcttgctctrtagcattttgtggtaaataaatctgtggtttccagagcagccttcccagttgtaattaacatcaattggccccactgtgttgaaagcagtgctgcttctcctgcctcccagttttcctacaaaagccactgggattgtagayaaaatcctgttttccagttggcgagatgcagagaagcagatgagattttgtctgagcagcggtggatctgagccgactttgattatggctccaccgccaacgcttcctgggcagatgagtcatgcttcctggaactgtctgtcagaggaagtttgcttctgggacttttgcattttgcttagagcttagagataagctattacaattctaagttcagctgctattcaaaaacatgcataaaagctgggaagagtttaccaaacatttcaatttataacttgataccagatatgagtctagcaccgtactaagcatgatacctggattcaaaaaaagtttagaatgaagtatatccattagttagcgaagccagatgctttgtagtgtcgttgagtttagcatgaggcattttagaagaaattttggttttaagattgcctgagtaaaatgtgattttttagttataaaaaawtgaaagaagaaatgttatttcagtgtgatcagaatccctttccttaaaaagaaatgctgatcttttctgaccatctttcacaatgaaggattttcgtatgattgcattaatttgcagcagttaatgaaccaacgttccaaccttcaaaagagcctctgctctcagattcaaragaaactctgcgtgtttcctctcttcaaacatgaaggacagaattaggatgaataataatcaaacctaaaataatttctgaactaccctgaagcagtaaaaattccattagatgctcagaacttgaattgtcctatgcacactgcctttcctggttgacctcaggttgctctgctcctcagactggcgaaaggcagggcaaccgaaaggtctcttccactatcagacaggctcatggtatgaataagcatgcattgagcaaaatgctaaattttaaacactggtaatcacagttgtgggtttcagttaactatattgactttctactttttaaaatgggaaagatttccaattgcaacattacagaattttgtttaaacacgtctttaccctgcagttcctacattggctctttatttatttatttattattttttctttctttctttctttttttttttgagacagagtctcactctgttgcccaggcttgagtgcagtgttgcattctcagttcactgcaacctccgcctcccagattcaagtcattctcctccctcagcctcctgagtagctgggattacatgcgcccaccaccacgcctggcgaatttttgtatttttagtagagacagggtttcgccttgatggccagtgtggtctcgggctcctggcctcacgtgatccacccacttcggcctcccaaagtgctgggattacaggcgtgaaccatcgcacccggcaggctctttatttaatagactttcttttcctgatctcactgtcttcagsgagagcccggatggcagtcctctggcttcttccagctcaaaggtctatgatttcacgttgttctatgaaccaggttcttctctgttcctgagaccatctgcagcaggtggtgagaattttaagaggcwtaataataataataataataataataataataataaatgtttagtgttttactgtagcaggataattggcagrgggaaggctgaggtttatggaattaaattttcatgtatacacaggagagtatgcttagctttcaaagcatttcacttaccactagggagggatttaggagcccttgctccatcagtgactatcgaaacatatgtttacatgaaaccgtcagtccctgaacatctgaagacattattatttttaaaatttttaatttttgtgggtaattaataggtgtatatattatggggtacatggtgtgttttgatacaggcgtgcaatgtgtgatagtcacatcatgggaataaagaaataattttttgtaaataattagcctaattaataataaaaatctagttatgataaaaggaagcattataggcaaaatatgattttaaattaatgctggagcagattaccttacatggtaacatttcagtggattaatttttacatatmaccttgagatacttaagaaaagattatggagatagacaatttaatatttttagtaggccaggtgtttatttgacagtctaaaagggtatgaaattctgagattggagaagcattactaatgcatatctctactgccatgtcaataggtccccaaagatattgctttaaaaataaatttatcagatcacaaaggaatttatagtcattataggaaattgggaaaatgtagaaaaagctagattaaaaaatcctaaaktatatcattattactaatatttggtggtattgatttcctgtcatcgctccttgtatatttattttattttaatattcgaaggagattattcagtacatactaacccataatgacttttttcacctaacaatagcttgtgactatttccccatgttatttattatgtcattttcaacattgctcatcccatcatcacaatacagccaccaattcctgttgtgaaacacttagaatcttttcaaatcttcaccattagaaacagttctgagataagtatctttgtagttaaatgttttcccacacccatgattggacaatgatttaaaaaataaaaagactcaaattgtggcttctaataggagtaatatatagaaagcagaataaaaatgtaaattctagtaagagcagacagcaactagccaccacatagaaaggaaacgctggtttttatatgagacagacctgtaactcagggtgacaccaagtaactcaaaatgtggtatttcgatgggttttttgctctcatgcaaagcccaacattatgagtaattgttacttttagatgatatttcatatttcctgccccaccctgtcagcacatggcaaggcggctttttctgtgcctatgtcagggagcatgctatgagtggccatgtgccttatggaggggacttagcctcccaagggccatcttggagtcggctgggatcaaccatgctctgcttatcagccttcctctacatttgcctcatttatccaccatgatttgattttgcatttgcccccttgggctttgcttatccacaatggaagcgctgtatctcctctgtgattcttattatttatttatttwtttttttttttgagagaatcttgctctgtttcccaggctggagtgcagtggtgcgatctcggctcactgcaagctccacctcctggggttcaagtgattctcctgcctcagtcttccaagtagctgggactacaggcgtacgccaccacacccggctaattttttatatttttagtagagacagggttttgccatgttgcccaggctggtcttgaactcctggcctcaagtgatcacccgcttcggcttccctaagggctgggattacaggcgtgagccaccacaaccagcctctgtgattcttgctttgcaatttctactgttgttacaggaacatttcaaagcccttcaaatttaaagtaacctraacttggataaagttccaagtttytccaggagatgtgagtgcaaacctcagcaacaacatttttaacaatcaccctaatgaggcctctscacagatcctgctgtggtggttgtttggggtggggaacatctgagcagatgccctgasaattccctaggtcccatccttctggatctccagtgattcagcascaggaactacagggctgggtaggacccaaaggggaagggaggctgcaacaggaagagatgctgctcacttttagcatgagagccactttgcttgccagtggactctatccacctcaccgtggcagccttaacagcctctggtttcctaactctctttgctgctgtcccctgcatgatctgtcctcccgcaatcccttccacacacacagcatgcttatctccaccccacacaggatgattcgccttggtttctgcatggctgtccgggatgcctcagtctccacaatgcccaagttgtcatagcaacacacygcgaggattggcctccacctcctcactgaattcatcacttccccatctgccctaccagtgacgatttctgtgaactcttttatgtgagtcagctcctgttctctaatccccaacatctttcttttctcatagctattttgggtggtttctctggaaaaaaatgttgattccctttgcctctgacaaagagttagagtaacaatttgagcacattccacatgccaggcctcatagcaaaccttttacgtggtttatctcatttgctgttggcaacaatattatgagataagtaccattatggtgccagatttatagataaagacattttagcttgaagaagttcaataattttcacaaaattgtgttctctaaattttagagctgggctatgaacacagagcctggctctggccacattgacattagtcaagtacattctacaataaaattgctttcctgcttgtgattgaaatataatcttctattagtgacactcacttcaaaatgccactctataaactgattgagtatagttctcaaaaattgaacgatcatcttttcattgagtagaatttttattctatagaaagaataggggattctctactacacccaaaatttctcctcacagcagatgaattatttcaattacatattaagctctaaagaatagaggttttatggaatttgcaaagatttataattggaaatggaccaaattattctccagaagtttctccatgttttaatgatatcatcctaaagaaactcttgagttgctttttctacatgaactatatttaattaattcttaaaattgatctcctataaaaaagaattttcttccagaagaccttccaggaaataaaagaaacaacatttacaaacagtatgaattagatgtcaatctaaaacagaaagggctgagttttaattgtcactcactgtgattctaaaatgagtttggggctgggcatggtggctcgcacttgtaatctcagctctttgggaagccgaggtgggcagattgcttgagcccaggagttcgagaccagcctgggcaacatggcgaaactctgtctctacaaaaaatacaaaaaaagtagctgggcatggtactgcatgcctgtagtttcagccatcaggaggcttaggcaggaggattgcttgagcctgggagggtgaggctacagttaaccttattgcaccactgcactccagcctgtgcaacagagcaagatcctgtctcaaacaaacaaaaaaatagttaagaaaaaaagttaatctctacatcccaagctcatatatataagataattacttgtaattttaatttattacagttttaaatttttagccatgaaacaatttagcaagyaaggcacttgaaagacatatttttgttcttggagatcctgcagttcataaagttgatttctactgaggggacaggtggggtgtctgggtctctgctcacttagaacttgactttcagtgactcctaagtaccctcaatcttacaaaaaaattggatctctatcagtgattgaccacacgtggtgtctttagtgttatatcctcccctttgttatgggtccttcctatttagaagtccacggatcacttcctattgcaactggagtctgaattcactaatggtattgtaaagtatgtgccaaattatcaaacccgcacaaaggaagtagaaactggtaagtatggctaaggcaagagatttccttcctctctgagtgtgtcaagaggagttgagatatttgggggtagggtgggggtggggggacctaagccackaaaatcctaaatgaataatctctttaagagaataacaaaagatttcacagaggaaggttttgtaatatacacatctccgcatctgaagatatatttaatggccaatttgaaaatgtaagcattattttagtaatttagaaaaatacccctaaacacagttatagaaattagatctgcatattcaaggtgagaatcgcaatctttcttagtttttactagtttcctttctgtaactcaattagaacttcaagtattgttcactctgagtagatcttcaggctctctaaaagcagggccactccagcttgcttgtcagtagttgcaatgagtcacagctggaacgtcctgtggttaacattctgctctgaaaacagaatcagaatcagtgagacggctttccatggtaacctgtatttgtatactttgaaaaatgactgttcctttttgtgtggttttgggtggtcaatttgcgcgggaatgaattgtagaggtgacgttacccatctgtgtgaatataaacaaaaaacctgattttattaacggcaaactttaaaaaacgaggtatgagtttttttttttttccttttcgagacattgttctayacatttattactagattggacattatatttaagcattttcataaatgtctatttgatgcttattttaatgcataattttctccccccaaaggcaaaaagaaactaattgtcattcatcagtgttgccccccaaacctactgcctagcycctccacccccacccagtacttttacaatgtgttattaaagaccactgaacagctgagatccaggggtctccttcaatgcgtaatcccatccagaaggaaggaaaaaaaagaaatctctttaagtcacgtgaaaatgccacrtttcttaatcttgcagagctgacaggcaaaaatgctatgctgttcatgaccttgtgcaggattgaaatataattyygcaacatgctgcgacctagtattccgtaagacacatcgagcttagggtgattatagttatggagaaatcttacctatgttttgttggataagggttatgatgacttagcctgggctcagaggcctgacagaaatgaaataatttatgctttggtcactaaattacaatccaaaggttaagatttggggagtgaaagatggtagagcatttgcttgctaattactccactacttgggagcagtatgtttgtttctgtgctaattagtttagaactgtacttcatgccctagaattaagaaaaactctaaagctgagatgaatctcctgcagggaagcagggatttagaagcacaggctgcaaggttggcctctcgccctccggtttctccgcctgcakgagagggtgggactgaacgctaaggtgaaaagcttctgttccgtttcgtttccctcttcattttctgttgctttattcttctcttattctcccctattcattataggggaggcttctgataaatgtgtagaataytagaaacttgataataaatatacacattcaaagcagcagtamgaaaaacagaaaaaaaggaagctacagcagtaagcctgaaaaataaaactcatctttattcatttgcttaaaatgcttaggtttagtgctttggggtgaatgacataataggcttctgagcttgtctttttaaaaatatctgctgaccttccctgaaatctcacaagcacttatgatgagcagccgatttgagaactcagcgagacaggccaaggtttaaaaatctgcgatttatcataaccttaaacaaggccctcacctggttctcccttctacggagtggcacaaagggtccaaatcctttatggtctaagaggagcctgttgaaattgaggattgtatggcactactacctatctaactgtacagagtgcaaataatcgtgcagattgggtcctaagtaaaataaatacagctggcgggggaaatcactgcgttcattcattggagatgcatggggaacctgcctttatcaaagccctgctctgggcagtgaggggaaggccagaggtggtctgtgctttaaggcgactcacaatcagtaggggaggtaagacacacaagcccataacaagaatgcctggggatgtgatcatttccacaaaagaagcacagatgaaaagcaagggctttcaaaggcagactaatttatgcctgactgcagggattaggggyggctccatggaggtgctttgtaacatttggtggtaaagttctccacactcaaatcaatatgtttcaaacaatatttcatgtcataacattttttttcaatgaaaataatttgatcagtctggaattcattgaatccagattatacatttatgcacggacacgtgcaaacacacagacactcacacatactcttaagtagatgtactctccaagggcatcctcgaggaaatccatgagtccattaccaggtattttatgtttcgttgtcatgggcagcttatcccaagggtaactggaacaaagtgtttaaagggaacatgaaggcgattaggtgaaaatgtaatggccttagtcctgaggaagccagtcttgttggattgccattatctttctcaagtgaagagatatagtagagagatttttgtgttttttaatttttatttttcagtttggagatatacagctgataaaatcattaaatgaggtaggttaaggggacacaaccttgcaccctccatttctccttgaagatgtataaatacctcaatggaaaaatggacgaagacatcagtaaacaatttacaagagaagaaatctaaatgcccctaaacatgaaaaaaaaaatccttcaatgtcaaagtaattaaaataacacaagttaagacaattacaaaaaggcagtttttcactgtcagtactagtttaaaacatgatcrtcatcataattgacaaagctccactgaaagaaacacctctgttaactgcttgtgggaggataggttggtataaactttctggtaagaaatttaataatattttataaagagccatatgattatactgtttgttattccctttctaggaatcttttaaaagaaacatttgaagtatcaaacagctatttatatcagcaaaagattggaaatatcttaaatgaaacaacaatagaattataatataaatacattatatttgtggcattttacaccaaggtttacacaattaagtgatatgttcaatgaaaaacaagaaacacaattaaatacatagctcaaatgtataaacacatatatacacctgcacaaataggtatattacacatatatacaaatgaaaaaagtatcaagagaaatttttggatttaatgaaatattaacagtgtttgtctttagtcgaatcaatrtttgtattttcctttttcatatatttctaaaatgtctgattattttacaggtagcatttattttaaaaattacctcttgaagggatggctaccccattttctatgatgtgattattatacattgcatgcctgtgtcaaagtatctcatgtaccctataaatatatacacctactatgtacccataaacatttaaaaatatttttaaattatatcttacaattataatagctgctattcattgagcccccctatgtgttgttaatatgtgaatgcctactatttccgtattctgagcctgaattatactttggacttgctaggttgacataaaaccaaaagttactagttgggtttccaaatttattgggcttaggaatcagatccatctctaataccctctctatgcaatyatcaatttttaattcttatgttgagttctgtgtactcaacccacctcagcagatttacctctaacttttgaaccaaggaacagcttttgctacttgtgtagacttggatttttccatcccacaaaccatgtgtttttatatgggaaagtttctcttcaatttcagctctatgatggaccacggcagatgggacgctactgtggagtagacctgccccctccagggagtactacaagctccaagcttcaagtgctgctccttacagatggggttggccgccgtgagaaaggatttcagatgcagtggtttgtttacggtaagccaggtgctgatctcagttgtatttgcagttgctatttggccaagaattttttctttttcagttccaaacttagaaacaataccatgaacaaataatggaacccaggtagtaatctcatgcaagggtttaagaaatatacttagayattggtggaacttggagagttaagtctgttaggattaagagaggaagtgacatcaaagtggaaagaatttggttaattgtaggtgtagtaataaattgccttagataaagaaagaagcagaatgaagtttctagggatgaagagttgaacctgggtatagcaagctaactgcaagttggggtgggagtatctcaggtgcaatggaatagaatgagacttaaggctcaccttgacgttaagcagagaaagggtagggatagactagaaagaatgaaagtcagacagggatgggraaraggaaggggtagggttggcctgagaggaggagaatttgagctgcgatgcacaaagccaggggcatgtgttgtacttgtcaaacaggaaggggcacatctggatcccacctacgaattggtggttcaggaagcaggtagggatcatcattcctctgaagatgaaaggtcttctttaacaagagatcygaaatgtcttcaaatctcaggtgggccaatctgcaagtggagagccccagagcagtggttcccaaaatgtggtccytagagagcagcgtcagcattacctggaacctgttagaaattcaaattcttgggccccatcccaggcctacagaatcacaaactttgaagtggagcccagtaatctgtgtcttaactggtctccctggtgattaaagtttggaaactactgagaggtgaagccggctgagcttctgggtcaggtggggacttggagaacttttctgtctagctaaaggtttgtaaatgcaccaatcagcgctctgtgtctagctaaaggtttgtaaatgcaccaatcagcactctgtaaaaacccaccaatcagcrctctgtgtctagctaaaggtttgtaaatgtaccaatcagcggtctgtaaaaacggaccaatcagtgctctgtaaaatgtakgaatcagtgctctgtaaaatggaccaatcagtgctctgtaaaatggaccaatcagcaggaygtgggcagggccaaataagggaataaaagctggccaccctagccagcagcggcaacccactcgggtccccttccacactgtggaagctttgttctttcactcttcacaatgaatcttgctgctgctcactctttgggtccacactaccttaatgagctgtagcactcactgcgaaggtctgcggcttcattcctgaagtcagsgagaccatgaacccaccggaaggaaaaaactgyggacgcatctgaacatctgaacaaacaaaatccrgacacaccatctttaagaactataacactcaccacgagggtccgcagcttcattcttgaagtcagcgagaccaagaacccactggaaggaataaattccggacacattttggtgacccagatgggacaatcaccaagcggtgagtaccactggacccctttcgcttgctattctgtcctatttttccttagaatttgggggctatataccgggcacctsttggccagttaaaagtgactagcatggccgccagactaaagacacgggtgtcaggctttctgggaaacggctctctaacaacccccaactcttcggagttgggagcgttggttggcctggaaccagcttccrcttttcctgtacttctgggctgagctgagggttgacagagaggaaagccattcagctctggggtcccaacaacaagttggttggccctgcagccatgagtaaaactctcaaagtcatgtcacccaagcaagacttgcccatctatcctatctatcctgacccttgcctcctgggtcctaatgcctgtcagacaaatttcctctcgcctctcttctctgaggctagtccygcttctaaaaaccactccctgtctctgttgcttttctaggttctcctgtaagaatgatttctaatataaactccaggactctgttaccttctttaggcacctgggttcaccaatcagaaagacataatytttgcccaaagccccattgtagggggtactatctggaattttaggatccctcctcagacaagcaggcctatcaawagctattcctgaagctaggatatgggtagcatcagaaattgtatccttcctattcatataagtgaggacaaaaggcatcactcttccaactctggagatcccttcccttcctcaggatatggccctctgcttcatttttggggcataacacctttatacratgcgggtaaggtcccagtactaacaagagaatgcttaggactctaacaggttttcaagaatgtgtcagtaagggccactaaatccaatttttcttggtcctccttgtggtctaggaggacaggcaagggtgcaggttttggagaatacattgataagggccactaaatctgaccttcctcagtcctccttgtggtctaggaggaaaactagygtttctgctgctgcgttggtgagtgcaactattctgatcagcagggtccagggactgttgcgggttcttgggcagagggagaaacaaaacaaaccaaaagcacrggcagttttgtctttcagatgggaaacactcaggcatcaacaggctcacccttgaaatgtgtcctaagccattgggaccaatttgacccgcaaaccctgaaaaagaggtggctcatttttttctgcactatggcctggccccaatattctctctctgatggggataaatggccacctgagggaagtataaattacaatactatcctgcagcttggccttttctgtaagagggaaggcaaatggagtgaaataccttatgtccaagctttcttttcattgaaggtgaatacacaactatgcaaagcttgcaatttacatcccacaggaggacctttcagcttacccccatatcctagcctccctatagctccgctccctattaatgataagcctcctctaatctcccccacccagaaggaaataagcaaagaaatctccaagggaccacaaaaacccccgggatattggttatgtacccttcaagctgtaggggaaggagaatttggcccaacccaggtacatgtmcccttctccctctctgatttaaagcagatcaacgcagacctggggaagttttcagatgatcctgataggtacatagatgtcctacagggtctagggcaaacctttgatctcacttgaagagatatcttgctattgttagatcaaaccctggcctttaatgaaaagaatgyggctttagctgcagcccaagagtttggagatacctggtgtcttagtgaagtaaatgataggatgacagctgaagaaagggacaaattctctactggtcaaaaagccttccccagtatggatccccactgggacctcgactcagattatggggactggagttgtaaacatccaatgacctgtgctctagaaggactaaggagaattaggaaaaagcycatgaattattcaatgatgtccaccataastcagggaaaggaagaaaatccttctgccttcctcragyggctatgggaggccttaagaaaatatactcccctgtcaccygactcactcgagggtcaattgatcctaaaagataagtttattacccaatcagctgcagatatcaggagarggctccagaagcgagccctgggtcctgaacaaaatctggaggcattattaaacctggtaacctcggtgttctataatagggatcaagaggaacagacccaaaaggaaaagtgagatcagagaaaggccacagccttagtcatggtcctcagacaaacaaaccttggtggttcagaaaggacaaaaaatggagcaggccaatcacctgggagggcttgttatcagtgtggtttacaaggacactttaaaaaagattgtccagtgagaaacaagccgccccctcgtccatrtccactatgctgaggcaatcactggaaggtgcactgccccwgagtgcagtggttctctgggcmagaagtccccaaccagatgatccaacaacaggactgagggtgcccagggcaagtgccagctcatgttatgacccttattgagccccggktacatttaaccattgagggccaggaaattgacttcctcctggacactggcatggccttckcagtgttaatctcttgtcctggatgactgtcctcaaggttttaccatccaaggaatcctgggacatcctgtaaccaggtatttctcctacctcctcagttgtaattgggagactttgctcttttcacatgccttcttgttatgcctgaaagtcccacacccttattagggaggratatattagccaaagctggagctattatctacatgaatatggggaacaatttacccatttgttttcccctacttgaggagggaatcaaccctggagtctggacactggaaggacaatttggaagggtaaaaaatgcccacccagtccaaatcaggctaaaagaccccaccacttttccttatcaaaggcaatatccctcaaggcctgaagctcataaaggattacaggatattgttaaacatttaaaagctcaaggcttagtaaggaaatgcagcagtccctgcaacaccccaattctaggagtacaataatcaaaaggtcattggagactagtgcaggatcttggactcatcaatgaggtggtggttcctctatgtccagttgtactgaacccctgtaccctgctctctcaaatgccaagggaggcagattggtttgctgttctggacctcaaggatgccttcttctgtattctcctgcactctgactcccagtttctctttgcctttgaggataccacagaccacacrtcccaacttacatggatagttgtgccccaagggtttagggatagccytcatctgtttgctcaggcactggcccaagatctaggtaacttctcaagtccaggcactctggtccttcaatatgtggatgatttacttttggctacctgtttggaagcctcatcccagcaggcgactctagatctcttgaaatttctagctaatcaagggtacaaggcatctaggtcgaagacccagctttgcctacagcaggccaaatatctaggcytaatcttagccagagggaccagggccctcagcaaggaacgaaagcagcctacactggattatgctcaccctaagacattaaaacagttgtgggggttccttggaatcatcggcttttgctgactgtggatccccagatacaaggagatagccaggcccctctatactstaatcaaggagacccagagggcaaatactcatytagtagaatgggaaccaggggcagaaacagccttcaaaaccttaaagcagaccctagtaaaagctccagctttaagctttcccacaggacaaaacttttctttatacatcacagagagagcaggaatagctcttggggtccttagactcatgggacaaccccacaaccagtggcatacctaagtaagaaaattgatatagtagcaatagtcagaggctatcaaaataatacaaggaaaggatctcactgtctggactactcatgatgtaaatggcatactaggtgccaaaggaagtttatggctatcagacaaccgcctacttagataccaggtgctactccttgagggaccagtgcttcagmtacgtacatgcacggccctcaaccctgccacttttctcccagaggatggggaaccaattgagcatgactgccaacaaattatagtccagatttatgcagcctgagatgatcttttacaagtccccttagctaatcctgaccttaacctatatactgatgaaagttcatttgtggaaaatgggatacaaaaggcaggttgtgccatagttagtgatgtaaccatactgaagtaagcctcttcccccagggaccagcaactagttagcagaactagtggcacttactcgagccttagaactgggaaagggaaaaagaataartgtgtatacagatagcaagtatgcttatctaatcctacatgcccgtgctgcaatatggaaagaaagggagttcctaacctctgggggawcccctattaaataccacaaggaaatcatggagttattgcactcagtgccaaaacccaaggaggtggcagtcttacactgctgaagccatcaaaaaggggaaggagagaggagaacagcagcataagtggctggcagaggcagggaaagaccagmagaaaggaaagaaagagayagaaagtcagacagagagacagagagaggaagagagagacaaagagggagtcagagagaaagagaaagaaagagaaggagacagagagatagaaagtcagagagtgagagagaagaagagacagagagacagagagagaaagagaaagataggaagtcaaaagaaggagacaggaagagacagagagaaagtcagagagagagagaggaagagacagacaaagtcagagaaggaaagagaggaagagacaaaggagtcaaagagagagaaagggatagaagtagtaaagaaaaaacagtgtaccctattcctttaaaagccagggtaaatttaaaacctataatagataattgaaggtcttctctgtaactctgtaacactccaataccaccttgttgtcagtgtaaacaagggcataacctgaaagcactgaggccactgacaacccatagcattcctatcaaacatccttaacccagcaagtttcctaacaggggatctaaatcttaattaccatacaaaggtcccaccagacataggaggarctcccttcaggacaggatatagatggttcctcccaggtgattaaggaaaaagacacaatgggtattcaggaaactcttatggaagcagagttaggaaaattgcccaataattggtctgctcaaatgtgcaagttgttttcactcagccaaatcttaaagtacttacagaatcaggaaggagccatctataccaattctaagttaatatggatggaatgaggttttattaatagcaaagaaaaattaaaatcccaaacttacaaggttttctactaacgtagagtttgctaaaagttaacagtgtaacatgcattatcctactaycacacactctcaaagcatttctcagacagtttgcaagaaataacaaaatctgtccagtaaggatagtaactacaatcccaaatagactcttyggcagcagtgactctccaaaactgctgaggcctagaccctcctcactgctgagaaaggaggactttgcaccttctttgggaaagagtgttgcttttacactaaccagtcagggatagtacgagatgccacgcagcatttacaggaaaaagcttctgatatcagacaatgcctttcaaactcttataccaacctctggagttgggcaatatggcttctcccctttctaggtcccatggcagccatcttgctattacttgccttcgggccctgtatttttaacctccttgtcaaatttgtttcctctagaatcaaggccatcaggctacagatggtcttacaaatggaaccccaaatgagctcaactaacaacttctatcaaggacccctggaccgacccactggccctttcattagcctaaagagttcccctctggaggacactacaacttcagggccccttctttgcccctatccagcgggaagtagctagagtggtcatcacccaattcccagcagcagttggggtgtcctgtttagaggggggattaagaggtgaagccagctgagcttctgggtcaggtggggacttggagaacttttctgtctagctaaaggtttgtaaatgcaccaatcagcgctctgtgtctagctaaaggtttgtaaatgcaccaatcagcactttgtaaaaacacaccaatctgcgctctgtgtctaactaaaggtttgtaaacgcaccgatcagcactctgtaaaaatggaccaatctgcgctctgtaaaatggaccaatcagtgctctgtaaaatggaccaatcagcaggacgtgggcagggccaaataagggaataaaagctggccacccgagctagcagcggcaacctgctcgggtccccttccacgctgtggaagctttgttctctcactcttcacaataaatcttgctgctgctcactctggkttcacactacctttatgagctgtaacactcactgtgaaggtttgcggcttcattcctgaagtcagcaagaccacgaacccaccgggaggaacaaataactccgcactacctttaagggccgtaacactcatggtgaaggtctgcagcttcactcctaaagtcagcgagaccacgaacccactggaaggacgaaactgcggacacatctgaacatctgaacaaactctggacacaccatctttaagaactgtaacactcactgtgagggtccgtggcttcattcttgaaatcagcgagacmaagaacccaccagaaggaataaattccagacacactactgtsttagagtgatctagccctggaacatgtagtgcttgtgggtctcatagcagtagttctcaaccatgatgctagagctcattggtgtatttcaatcaactggaaagagaagtggagttccaagattataccaggaaccaagcatagacatctaagctgtggccctgctgtcaaaatcagggctgagctctagctgagcacacatgaatgtgtgcagtggttgactmttaacattgttcacattctggtgcactcattataggaatgtcagagctacttataactgaatagccctattatacacttaggagtgctaggcgttctgagattataaactgggctctgagtgtatgtctgttaaaatatgtatggggctttcagtatttaaaaatagtcagtggtcatccacagagctacttgcagcttgaaacgtacattaggaattcccaaagtaaatgagttgtgataactaagcttgtagaagttctggaccttcctcttcatcaagtgagtagatatttatatatttatttatttatttatcaagataggatcttgctctgtcatccaaactggagtgcagtgtcctggtcatagctcactggagccttgagctctgaggcttaagtgattctctcacttcagcctcttgagtagctgagactacaggtgtgtaccactgcacctggcatttttttttttttagtagagttgaggtcttgctatgttgcccagtctgatcttgaacttctgagctcaagmartcctcctgccttggcctcmcaaagtgatgggattacaggtgtgagccactgcacctggcccaagtgggtagattcaacctaagtcaactcatggatccgttaaatgcagggattggattgattcatctctataatacagatgatctgtagtattccrtgattctgaaacacatgattctaactagagacagtgtgaaaagagacagaaaggtcaggagaatcctgggaaatggcccagaatttcaagggctggggcattctccagagcatacgtgctacccagatgctcctgtgcacatgaaccctggggatcttgttggatagaggatggggtctggggcaaggcccgtgaatctgcatttctaacaagctcccrggtaatgctgctggtgctgctctatggaccgctctgaggaacaaggtgagagcaagtgttgagactggagaaatgagatggtagaaagacagtatccctagagactggagaatccttctgagatgttgaaagggcacattgtactgtttgttttaatgacagtaggataatagcaagatctaaagcagagagaactttcccccagggacagaagtgtagaaggtaagaaatgttaaccaggaagcctgggctcagggccctggagagtgttctcagtcctagatgcaccattggaattgcctgggagttttaaaaagtgcccatgcctgggttccaatatccagagacaggattcagttggtctgcagtggggccctgactattgctaatttctaaatgctccttaagtgattcatccgtacagtcaggatggagagtttgggagggcagtgattttgctgattactttctcctaagtggctgcttcctctcccctccaggctgttctagccttactagcccaaggccactctaaggagcttgattgaacggtcatggcaggctgtgcccagattactgtatcaatgggctcttccagccaatgtgctgaatattctggtgaaatctctgagttttatgttgggaacatttttttctaccagttctacttggaatctgtcttcctttgggagagtcaaaggcaccctctgtctattctgctttcctgtttactatttcaaaactttctcccagttgctggaaacttggagccagagttatgcaacaaaatgttgccagctgggaccagaaccgaaatataaaattgttttttaactctgtgctgctcacaatatgtaaattatacttgggaggaaacttctggaaaggaatttttagtcatttagatctgtgcaaaattgactatcatattctacaggtatgcaatgccacaggtacacagagttcaatactctgcatctgaagtaggtctttagtttgagataacctgagaaggggagcccacagagagggcgagctcttccatgggagaggtcccgccatttttgatccattggagktaaatgcaagacgtaaatcatgatgtatcattcacgcatttgttcattccacagacactaaggatgtcttttgtgccaggtactgtgctgagacgggggacacagagtgactcagaccagcaggcctggtttctactctacagagctaggctaggtgggagaagcagacatcacgcaaaaacacacttaaataaatagaaaatcaaaaccatgagtagtgccaagcgggcacacacagggcatctgacttgggcccagcaggaggtcagggatgatctccacgcaaatgagacctctgaaccaaaacctaaaaaataagcaggagttaactaggcaagcaggataaggaaaaggattccaggtagaagaaagaccctgtgataggagggagyggggagagcccgagggacctgagaagtcaagaggatggaactgagtcgaagagaaacagcgctgccaaggtggctgcagagctaagcacataatgtggctaagcgcgcacacacacacacacacacacacacacacacacacgagcagggattctgcagccatggggccaaaataaatttaaaaattactctcaatgctcaagacacacacacacaccacacacacacacacacacggggagggactctacagccacrggactaaataaatgtaaaaattactctcagtgctcaagagacacaccacacacacacacacacacacacacacaccacacacgggcagggactctacagccatggggctaaataaatgtaaaaattactctcaatgctcaagtgtaattgtaattttttttttgagacgaggtgtcattctatttcccaggctagagtgcagtggygcaatctcagctcactgcagcctcagccttttgataaggtgatcctcccacctcatcctcttgagtagctgggactacaggggtgcaccacttcacccagttaacttttgtattttttgtagagatagggtttctctgttttccaggctggtctcaaactcctgagctaagcaatttgcttgcttcggcctctcaaaatgctgggattacaggcatgagccactgagctggtcataacattcttaaatgcatttgtgtgagtgtgtgtaacatatcagaaggaaaataattagaaaggcttctccttgcacagccccgcaagggatgttctcagaatcaggtggagggctcaggacagccccgctaaygctggtcctggagttgctcttcgtgccctggccaggtcaagtggctttaaactcctagcctcttttcctcagaatcctatcaccttgcaatcccttccccctgccccaccctccccactgsactcttttctaaactgtgcagtacgatctccaaacaccaagcagagagttcaaacttggcagcgacatcatttcctgagcactgcttctgaggaagagttcctacacacttcattcatttccccagttcatacacaaacgcatttacaaaatatgcttctttgtgaacgacacaaaccttctattggctttaagaaaacggatctacaacgaggctttatctgtgggctctttctgaacatggccatgcagacatgagacaaagtaacattgcagggccttttaygcgggtcctcaaagagggccccaccctggaaataaagaaatggccacagttgccctgtctctaatcggttcatggtattcagccttgacagcattgtccagcggctgaattcagccttggaggcctccatctgggttgcagggggagggggtgggggataggggtggggaatacagaagtttccgcaggctgtgtgaaaagtggcctcccaaccagctgcacagaccccctcgcctcttctggtcgttgctcccagaagccttctttcacttagtgatggaatccagcatacaaacaaggtcaaggagctttgtgagcgagagagtgacatttgcaaagggagcgaacccttcagctgggagcttgcaggagcagggctaaggggcatgtgatcaggaggtgatgtcacccaggatttccacaaaggaaaaagtggccttttctttgggaagatagatgacatcagcctctcaaatgggggctgggtccattttatcttccttttagctattaaggagatttctcaagccttgagaagtttcagaaattagaagagaacattttaaaaaccgtgtcaacatcttttatgactggctcggtttggatgtaagccagtgccttcttractacctgtgggcatgaggcactgtaccaaagggcttttaaaaaacatctttagagcactggcagaaaaccgccatgaggtcggcagtgtttctcttaaagttagatctttgctccaggtctctttctctcgagtggtctttcattagcctttgtttatcactggtctttcgggggaattccttctcattcaaaaattttattccttttgtgacttagagtacatgtagtacgatttctgggaggttcaccctttaaagacaaaggttttatcttttgtaattctgttatccacttgtcttgtgtgagagaaaatgccttagggtgtgagggtgagtaagctgggctctaggagaagatctgctggacccagcctataatgaacaggcagctacaactgtgaatcatgttaattacatgattatttayatgtcaattacacataacctctgccagcagatattttttgagaagaagtttttcattcattcaaccaaccatccagcayatattttgggcttgttgtctaaatatagagagtattaatttgcttgggctgtcgtaacaaaaatgccacagattgggaggcttaagcagcagaagtgtgctgtctcctggaggctggaagtccaaggtcaaggtgtcggcagggttggtttctcctgaggcctctctccttggcttgcrgatgctgccttttccctgtgtcctcacatggtgttttctctgtgtgtgttcatcctgatagctctgtgtgtccaaatttgctccttataaggacaccagtcagattggattacagtccattcagcttcattttaacttaattgcctctttttaaaggccctatccccgaggacagtcacattctgaggtctgggagttagaacttcaacatatgaattttggcagagatacaattcagccyataccagaaaggaaggagatcacattcttgactttggggagttagtcatagagtaggcaaggcaggtaaaccaagtgtagaaatatatacataatccaggacgccatgggaacacagaaaaaaatagctaggacagcctgcggaagttcaaagagacctccaggcagctttgacatttgaactgagttttaaagaatgggcaagaattgatcagacaaatatctgggagaggaaggcttttctaagtagaagcagcaaggygtgagggcacaaaagttttgcaaagagcaagtccttcagctagaccacacattctctgcattctccattggggcagtatcaactccaaggaggtaaaattggctcttggtagggggattaagaaattcttactctttaatgtataaagcataaagatatacagtacataacagatatgcaatatacttgtggtattaaattttcatggttgagaatttggaaaaaaatgtccgaacaatctccttagggggctgataatgaacaaaaggtgagaaacactagggaaagggagtgatagaagttgacgcaggacacgttatcagaaaccaactgataggaaacatcacaagaatttggattttatcctgccatcagggaaagaccaccaatggatttttaagtgggaaatttagtgatgcaaacagaagtacactttagaataagagttctggcaagtagagggatgcccaagaagaggaagagactgagagtttggtgactagtcagagcagggagaaaggaaatgagtagtgggtgaggcagcgtattaaagagctgtttagggctgggtgcagtggctcacacctataatcccagcacttcgggaggccaaggcaggtggaccatgaggtcaggagtttgagactggcctggcccaccccatctctactaaaaattcaaaaattagccagctgtggtggtgcgtgcctgtaatmctagctactcaggaggctgaggcaggagaatagcttgaaactgggaggcagaggttgcagtgagccaagatggcaccactgcgctccagcctgggcaatagagtgagattctgctaaaaaaaaaaaaaaagagctatttagaaggtaggatgggcagatctgatggtggagtagatgtgtgtcaatctgggagacagaagaaggaatcatggatagctcccgttttcctgcggtrtatgatttggtgcatggtggtgccattattcatagataggaaatcccagataaagaccatgtttgggggaaaattgtgagcttctatttgaacatgctgaatttgagatgttcaggggatgtatcctttcagcaattgctggtgtcagtataaaaattaggtgaggttttgggccagagaaagagactttggaataaactacatgttggtgaatttggagttgtgagcatgatgaaatatatatccaaaacygtgcaaggtatttttaggcatatgaaagaaataccacgttagtctttgtcttcaagctgagcatgatcagttaggaagcaggtgtagaaaactaacagaagtgctgaactgtgaggtgcctattgcaaggctagtaaggaggctggaagtcattggggaaaatcttcacggactctgtgagattttagagcccttgaagaatgatcaggacaagaaatgacagatggtgcctggataagcatgagccaagaaagagagagaaacaagcctgatgtaatgaagacagtgggatatgaggcttcgtagacctcctgggctagattctttagaattctcaaagccagctagactagtgtgaacttaacgtagtaaggaaaagggaaccactgttgttttagacaatggagtgggaaatgtcaagggaggagattacaactggagacatcatagatcacagtgacagaggcaaccccaggggaccattctgggtcctggttactaagagcgaggaatagcggtctgcagagacaagacaactgatgatccaaggtgagtaacattctgatgaatcctcagcaaagacactcaagggctatgtggccagtkctgtgataaatcctggcacagaaaatattagatcaattgccgcattctctcttcctaataatttcttcaaagttataactttgaaatacagactcatgattacctaagttttccagtttgaaaatgattttagggctcttttttgttattgaacaaaaaacttttgttgaacgaaaaaattttattgaacaaaaaatgttcaatttaaaatttttattattgtgtgtccttgctgccacgtggtgaaaaaattcacaacaatctggaagtatgatgttggcaatgaaagtgatttatgaattgtggtcagcaaagattctagcgcaggttcacagggctgggctgtgaatcacactgtctggttctaatctcaggcgcagaccttctctccgtwggtaatggaattgctttcacagtgtcgcttcctgctaggctgtgatagacataatgtcacacagagagaaatggtaaagcacccatccatccgcctccaaagtaacctcaagaatttgatgtcagataaggaaatcctgcttggttttggtagaaatttaagtaaaagagaagcttttaaaaacaactagctctgtttaagttaagagatatttccctaaatgctgactattctttctctcacatttatacatgctatatcccatcctgtttatgatggctttttcagcctatttgatattttgggcttttgtctttgtgatactcttaaaatatttttaagcatggagactggaaatgagttccttcttagtgtggaaccaaagcacaggtttctgcatcgtgatactgagtctgatttgtatttatgacaaattttcacttatatcttttctgcaaagaaattcttaatggacgatgctcatttctaagaaatctgtttctaaataactccttgttgtaaagttgggatagtgactaagaaaatcccacagctcttttggccttgacttcagagtttctccagcaaggtcccaatgatcagaggcagcattaaagctgtrcatatgcagacctttcagaatgagtggaaaagctcactcctgacatttctgcctccttgacgacagcagtaaatacacatccacacagttgaccttcatctcatgttggctctgagtctcttcaccagcaagggcctctcaggagtctcgcctccccattcccatgtcgccactgtttgaaaaagttggagttctatttctattgccactctttgaaacagttataaaaagaaaaaaaaataaccctcaaaccaccatgaccttcccaaatcacagattgcacaatttgtaataacagtccttgagatctgggccaaagaaagggctttctcgaaacttctgtttgtgttctggttccctggcaacaatatccccaatagaggaatgcatgtactttgcaggggattccacactttttcgtatgacacaaaaaccaaaaccacacttttttttttcagtttcaaatatcatagcagccaaaaatgaagtgtagaaacttgagttctaagccaactcagaacaaatgtgacgttcagcgtagaacctgaatttttgtccccagaggtttctcttttcgaccattgacttaaatgttgccatatttgtttcaaacattacatatccaaggacttgttttgtgtgaatgcactgtgtactcagaggaacagaggaagcagtgccaggtggcagcagcattgtctcacaaacagaacaaatctggtggaggacagtaactaccacttataagagttagtagaatttgataatctgtagatcagtaatgacaataatatactctgtccctgatttttttctcctcctagttccacaggctactcaaatatagactattttgaccctgtgtaccaaaataatgmaattgaaggaatgcaggataaataatatagattttaccacctaaatgtaatcttaaatttgtctgaagatattatsataaaaataaactrtcttgccatgtaaagagtgaatgaaaatatgattaaaygcttagtgcattggtttaattgacatctcattcactattactgttgttgatgttatcattttaaaacatgactcaacatgtgtaatttaaaaatatgatcttgagaagtgaagccagctggacttcctgggtccagtggggactyggagaacttttctgtctagcttgaagcattgtaaatgcgccagtcggcgctctgtggctagctaaaagtttgtaaatgcaccaatcagcactctgtaaaaacagaccaatcagcaccctgtaaaacggaccaatcagcactctgtaaagtggaccaaccagcgctctgtaaaatggaccaatcagcaggatgtgggcggggccaaataagggaataaaagctggcctcctgcgcaccagtggcaatccactggggttgccctgcacgctgtggaagctttgttcttttgctcttcacaataaatcttgctgctgctcactctttgggtccgcactacgtttatgagctgtaacactcactccaaaggtctccaccttcactcctgaagccagcgagaccagaaacccaccgggaagaatgaacaactctgcacacaccacctttaagagctgtaacactcactgtgaaggtctgcagcttgacacctgaagtcagcaagatcacgaacgcaccagaaggaagaaactccrgacacatctgaacatttgaaggagcaaactccggacacaccatctttaagaactgtaacactcactgttcaggtccgtggcttcattcttgaagtcagcgagaccaagaacccaccggaagaaaccaattccgaacacaatctcatgtctcatcccaataattttcttaaatgagcattatcattcccttattatggatgagaaaactgaggaagaagcctgagacaagttaagtgatgtgtccaaacttacacatccactaagcaatggaatcagaacacaaaactcagtgtgtgatgtcaaactcaaaggccgtgcaataagtagcacgatggtgcctgaaagcaaatattttttccccacagcttttcattgcaaaaaaaggtcaaatgatattgcaatgcaaagaaggtcagagcttatagtaggtaattttataaattcccgtaataataaatgtttttaaaaagatgtgtgcaatcttacccaagtaaatggtgatccagtttcaaaggcttcccactaagtgacacaattcattctttctttaggttcaagtagcaataatatgtgggttggggcggaggggcgcattgctwggcaaaagacaagttcgaaatagctgatgttatttgcaatccttaaacacaatttctgctttattactcatttataaagtgctgttctggagctgctatatatgttgctgatggaatccaccgatctgggagaaaccacggagatcatctggtcagttgccaaggtttagttatacaaactcgcttacaagagggagaagttatattaaagtgaagagtaaaagggtagctgctcccagaacaacttggccrggctagagtggaccatgggaatggggtggagcatgtgaggatttgggtaatttagttgtttttcttcccctaagctaaggacccaggctggctggatgcaggatttgccctgcgaggggcctgcagcatgggatgttgtaatcagagaaaacaaccttgaggctcagatttggacagagtttaaagggtcacagaacaccactgccatggacgtggtgctgcccacctgtgtccatttctccgggtggagtcctctcmctgcagagggaaggttagaggttggaggaggtgagggaaggaatcagggagaggcctgcaatgtaggtccctggaggctctttgagcttttccctgcaagagccctgtgtaccaaaataatgaaattgaaggaatgcaggtttgartaatatttctaaatagaagtatgactgttgaacttggaaactgcctacagagaacatgttttctctgtctttgtttgtttgagggatttcataaagaagctttcagtagccttaggcatgactgcttatttcagggaaggttagtacagttatcttagtctcatttctttccttgtacctttttatactaaactttgtttagaagtcttcaatcatttcaaaaacatccaaggagagggaaaagagattgatcaaatgattgatttctcctgaagaattgtaagcmagggatttctactgggaaaccattttttaatttgattgaaattagtagcttaaaaggaaactgataaagttaatcaaagtgaaaagatgacaagattggctaacttctctaggttaagacgaaagatagtatccttttgtatacaggaaattaaaatttatattacacagaaactccaaaattatggcttctttggatttctttctctttgatgatgtactaaagggaaacacatcagtatttagatctaggccatcttagakagtcagatggctatgacagtcttaactttgagtatttatatgacatyttgaataggaatgtaaaggtcattatatagcggtccacagcattgatttctaagcttcttgtatctgttttccaagtcaytgacktcatgcaataacttattctttcactgttttttattgtatctctaccattgaaacccgatgctctactttatatccactgctgtatagaaattagtcgaataaaatggattatcacaaaatatggggcaaggatgaagtctccatggaacatgaaactttctaaacgttcattgactctccaacactaaaaatcgttatgacttaactccctggttcttgggtttacctrtttcttcctgatgtgatacctggccctgtatttgctgctagttttctcaacaatagaccttttctrttttcatgaaaatcttacccttgaccaaccatcctctaaacctcargatgacaaataggaagtaataattacaagatggaatacagaaagtttacaaatgtgcactccttgaataccacacaaatagttgttaccattttgtacctacctgggagtttggccacctcaattatcagggaaagaatgaggatacattagcttcttagggctactgtaactaagtaccacaaactgggtggcatgggacaacagaaatttgttctctttattctggaggctggaattccaaagtcaaggtgttggcagggtcatccctctgacggctctagggaagacccttccttgctgcttctagcttctgttgattgatggctgtctttggctttctaagccttgtagatgcataactccaatttctgcctctatccacacatgaccttcttccttcttggtgtctgggaccaaatttccctcttcgtataaggataccaagaatattggatttcagttccaccccaatccagtatgatctcattttaacttgaytgcatctgccaaggccctttcctccaaaaaggtcacagtcacaggttcctggtaggcataagtctcgggggacagtgttcaacccaatacagggacaactctctcctctcctggagtcacratgttttgtcctcttcttccttttcactctcttctttcttccttcttttttctcaaggaaattttatgttccttggcctttatattacttgattttcttctttgatttcatctcgtsatcactccagtttgtgtccccttcctcacagaatacatgctatctgactaaatccctcagaaaaatccatctgcacatgcttcatgtccttatgaatttgaggagctccacccttggccttgtgttcagagaggactagtgaccctagtaggacagatgcctatcacttggccacatacctgtgaaatgytggggaattaactggtaacatcaaaccaggaattactgactttttgtggttctcattacatgccagtcacctttggacaactttggccattttaaggagcacatattcctgtccacttccccaccctccctgacctgaaagtttctgttcaaaatccttgtaattacgtttttttatgtttcatagatgtatcggaagtgaggcctgtatactcactccaggaaatagttcactttgccttgggttgggccttccccagattctgagctcttagttaccaattcacatcacacctgccttaccaaaagggtccttgctggcagtttctcttctgtgtcctcccttcctccacaagctgcctttttttttttttttttagatggagtctcactctgttgccaggctggagtgcagtggtgtgatctcagctcactgcaacctccacttcttgggttcaagtgattctcctgcctcagcctcctgagtagctgggactacaggtgcctgccaccacgcccagctaattttttatatttttaatagagacagggtttcaccatgtttgccaggatggtctcgatctccagaccttgtgatcggcctgcctttgcctccctaagtgctgggattacaggcatgagccactgcgcccagcccacaagccgcctttttacacaatgaaggcaaactggccttgccartgaagcacatctcaaggtcttatagagcagaaagagtttttattgttaagttatagaaaaaaagctattaaaatataaattgagcattttaatgaagcacgtgaacatcctcactaattacttttaaaatttaattctctttcactgtgccttggcttttggcttcgttttaacagcaactgttgatttcccaggcatttcctttaggaatgaagggataagggtgggagggtgtcggtgatgaatcacttctctcttccttttctgccatcctctttgggctttagccatgtgtatttcaagatgttattcctcctgatgccatcagtttatggcatatagtttcaggaaaatgccagccagcaaagcgctgactgcatttgagcagtcgccgggcaatacagcakttactttttaaattttgtgccttggattccatttagctgtttcattactggtttgcttttattaaagctcttatwaaaaaaacacacagatacgaacttaaagatagtacctacataggagattattattaaatgtttcagtactggaattttataactcatggcttgttttggacaaaaaccaaaacaatattagtgaagttcttttatgaaggtattttaagttatctacacaagtaagcaggtttagcaacagcttgtaactcttggttgttatgagttcagcagatcaatgtgcttcctgcagataaagcaagcacttcctttcggcagatgagtgagagtttggaggaaaatcaaggcaaacagatgatcagtcaccagctctaaaacttttataaagattaactctttaaaactgaaaaacataggcttctcttcagggcattattttattccagttcagctgatgtctaatgatgtattctgttagattttgcctcaaagtcaattaaaagatttttgctttgtttacgttttccaggttgctatggtgattgtcttyagtggagggacaggacagtaatgagggcagcattcaacattgttagttccgtgcctttgagctgaagttctcggcaaggcatgggggagagagaacacagaagtggaggtcaggatcggggagggtgggtgtcacaatagggttttgtacccacatctgccattcactaagtgatatgagcatgttccacagctttcttgaacctcactttgctcacctctacaatgggcctgacatcattgttacctgcctcccgttgtcatgattaatttcaaataaaataatgcatttcaaataaaaataattcaaataaaataaaagcacttgagaactgaactaccataaaaatatggattgtcttttaaaaaatttttgtgcaccttaatgaaaaaccaatttcttacctcttctctagctattcatgatagctttttaaccagtaattcctcttctagctccaagtctttgtctcaaatctggggataaagtcttgtgaggatacaaaacacggccaggtgtggtggctcatacctgtaatcccagcactttgggagggaaaggtggatcacttgagcctaggagttcaagaccagcctgggcaatatagcaagatcctgtttcaaaagaaaagagtaaaaaaaaaatgtaaagatagaatacacagcatgtgtgaaaggattatgatatgcacaacatttagctaaaaactttggattgtttcattcattctatgtaacaaccctatgaagtaagtattcatacagctatagatgaaagaaaggttagattacttacctaggaactatcacagccagtttaggaacccatttgtctgaactacagcccatgcttcctctgttacactataatgtttccaaaagttttgcaatctaacatgccaattaagcagttctaaaatcgtgtctactccatgaaaactttctcttaccaaagtgacaaagagccactgtgtctatttctctcaaaactctttattcctcatgtcactgttcctttcttggttggtattttcatctttttcatttttgagacggggtcttgctctgtcgcccaggctggagagcagtgctgtgatctcggctcaatgcgacttccacctcctgggttcaagcaattctcctgcctcagtctcctgaatagttgagattacaggcgcatrccaccacgcccagctaatttttgcatttttagtagagacagggtttcaccatgttgggacaggctggtctcgaactcatgacctcaggtgatctgcccaccttggtctcctaaagtgttgggattacaggtgtgaactaccacgcctggctggtattttcatcttttaaattatcttcttttatcttcttttgaaaggcttttctaaatcattgtcatctattttagattatgaatgaccggtgttaaaaacttctgtatttcttttacattttattgttcattcaaccagacaggtaaccggatgacgacaaggatgttggtggtctaaacatccctgcctgtgttatttcctgatgggtattggtttatataacttctttcctctccagacttgtgtattctccatctctttttcccttccctgtttgttatccctttgtcatgcatccagagtcgcaaatatgactggtaatggcaggatgagttatttattcttatttgtaacttaccagtgattaacatgtaaaggatagaatagtattcaggttgttttcttcaaataaaaacttattgaaattactcttagtaaactgaaggagaagcaaaaagggtttaataacttgcaagaagacatgtgggcaataacactttttatgtctataaatgtctttctttttttcaagagatattmaatatgcttggcttctatagcactgcttgtattatgggcagatgctcaataaacacttatgagtgaatgaaggaataaataaatggaaytgggaagctattttacctctttcaaattttagaaatacgaagacagttaagtttctaccgtaattaccagaattacaacgtgcaggtttgttacatatgtatgcatatgccatgttggtgtgctgcaccctcctagtactgtataattttgaccagaaagtaccactaaattaatctatcctattttgcatttgctgtgaacttttaattcaaatgtttccttttgatatgttaatcctcagaggtagtgagagcatgaaggagaaaaagaaaacttcagagatttcaagccctaactgtttctttccctctttctcatgatcatacaatatttttcctgacagagtatcactkataaaattgaaatttctcagctgggcatggtggctcacacctgtaatcccagcactttgggaggccaaggcgggtggatcacctaaggtcaggagttcgagacaagcctggccaacatggtgatgaaaccccatctctactaaaaaaaaaaaaagaaaagaaaaagaaatttttctttaagaagcatacatatatgtgctattaacaagatatacttaaaagtaaaattttgctctttttattaaagaaaaccttgtggattatttgctttaaatactaggaaaaaagacattgtgggtccatataactatactgtaatttttttaaagcawtactgaatgccccgaatctgtattaccattccagtttacagcgacaatttaagggtattagtatcctgttatttgcgaaggaattcacaaggaaaygtaaaacaattggaaaagacaatggaaaaatgttacacagagttttatgtgaatcaactaagataaaaaaattgaatcagattggctgatgaacgaatgctaaataaaaatgcagaaatgagctatctaaactttcatttccttcttatcttttatatcatgtggccataaagttattttcctctagattttttccattggataatttatttgatactactgatagaaagaaccatctgagctgaaaatgcaagttgagaaaaaaatttcagtaacaggctttgcttacctgtaatgtattttagtaaaaggtggtacatcttaacacragttacatgaggcactgtgttgtaccactccggaagcatcctgttatagaatgtcctgtgagcggtgctccctggagttgggcattggtacaggagatacggacaatctgtgatgattttggcttcaggaatatttgccatgtgttgttgtagtcggacaaatattttctcatcttttacggtacttgtgtttttttaagattcatcatagtctctaaacaatgtcagcacatctaattttaaacagctttttcgtaggctttagaaataaaagccggaactttttaggacacaggaaagatattgctctgtgcaatacatttaaagtctgaaaacgcagaggttttcaagtgaaaggagactgagaagtcaagaagatagtagtgctttgagctagagtcagatttctctgccgaatcaagattcttagaattctcagtgcttctcagtgcagtggggaattctgcacrgagattttttttttaactccttaacttttaaaagcttttcttctaactcactgtacaggaggaatttgcatagagtggacagtagacaagatctcagacttggtgtcttactttagaagccatggtagtttaatgttatgtgaaaaatgcacgtttactcataatggagtgaggaggcactgttacttttattttattttttattattatactttaagttctagggtacatgtgcacaatgtgcaggtttgtcacatatgtatgcatgtgccatgttggtgtgctgcacccattaactcgtcatttacattaggtattcctcctaatgctatccctccccccttcccccaccccatgacagaccttggtgtgtgatgttccccaccctgtgtccaagtgttctcattgttgaattcccacctatgagtgagaacatgtggtgtttggttttctgtccttgtgacagtttgctcagaatgatggtttccagcttcatccatgtccctaaaaaggatatgaactcatcattttttatggctgcatagtattccatggtgtatatgtgccacattttcttaatccrgtctatcattgttggacatttgggttggttccaagtctttgctcttgtgaatagtgcsggaataaacatacatgtgcatgtgtctttatagcagcatgatttatattcctttgggtatatacccagtaatgggatggctgggtcaaatggtatttgtagttctagatccctgaggaattgccacactgacttccacaatggttgaactagtttacagtcccaccaacagtgtaaaagtgttcctatttctccacatcctctccagcacttgttgtttcctgactttttratgatcgcacataaaaagccttgatgaagaataagagaaggtaattggaagaatttaccaaccaataaagaatattaaaaaaaaaaaaaaamagaaaaagaggcccagaaatgttaagagcaaaaaatgttttgttaatcaccaaaaattgctgttggaaaacaagataatttcttttctaattgtgtctctcataagccttcctcaaattttacctcttctgcaaagttttctcttcctctccatactgaaatctctgtctgaattcctgcaaacgatttgagagcctgtgyggtatagtaatgaagtattaagatacaaccagatcacctcagttagtatcctagcatcaattaaccttggaaaatccacaccacctctgtttgcactgatttgctcatttaagaattggatcctaacagtacctacctcatgtggtccttatgagtacggaaacagaaaacacatggaaagcccatatgaggactcaatgaaaggtggcattattctactgtgtgccgcaggctacagcatttgattatttgttgtcatggtctgcctgaatggctttctaaggcatgacatatcaagattctgaaacacatgctgttgtctttttccttggttggatttttctatatccattgtatttttttaatgtaaatttgctgagttaggaactatataatttacttgtttatttcttacagtctttggtacaaagctaaggatttttagcccttaaaattctagttcttagatctgcacgggactgcagaataatgtattagctacaaggacactgaaggcccagggacctgaagttcacgaccacggctcacacggtccattgtacttccgactatgttatgtaattcttaccttaytataakaaagaaaatctaaaattagaatgacttttttttaaagtacgaaggtttgatatggtaagaaaaaggatcgagcattattgtactaaattatatataatccagtgtttttgaaaggataaacttaataagttgtagccatgatttttttctcattgttttataactgcataattataactttattgtaacttaacggttttctcctaaattaagcattgtatatttttgatggcctttyggtgagttgaatttggaattattttccaygkgctgttgcccactttgaactgactgaacctttctgttttaacaggttgtggtggagagctgtctggggccacaggctccttcagcagccccgggttccccaacaggtatccaccaaacaaggagtgtatctggtacattaggacggaccccgggagtagcattcagctcaccatccatgacttcgatgtggagtatcattcaaggtgcaactttgatgtcttggaggtaggaagtgagatggttttttcagcacattccaaagtttggggtagaacargaaatcactctgccaagattccgaattctttccagtagtcagcagtgttctattcttagacattttaatgagcatcagcccttcggtgatcatttggtagacatgggattaatgtgtggtttgggttttcctgaagcaatgcctgagggccttgcagcagctgagttaggaggtaatgccaggaagccrgagcccaggacgagtgagtgaaggaaaggaggagggggaaccagcagagggagcccctgggggcaacttgggctccatccgctgggaccttctgaaggaccacagtggaggcactggtccgccaactctggttcccattggtaaggactgcacttgggatggctaacacctcacacttgcagtctgagaaagctcccccagaaagagcattcgtgtggcggagcatagagactgggcactgccaacaagcacagggayggcctaccagggctgccgctgctcttcaaggggccgccagggccatctgccgcagagcgcttttgtaaaaaaatggccacctaggtagcatgaggcatttgaagatgaaaattttcccagcacttctgcgaagggtgtgtcttggatcattaaaacagtctttgagaatcttgagcccaaaagtttattataatcaatgtttaattgcaggaatttagtcattagaatatgtgtgtgtgtgtgtgtatatatatatatattttaaatatatagctttaaaatattttgttgtagtttataaaattatataattcattataattatataaygtactatatagttacattatttatgtaatattcttatataattttataacatatatagatatgtcccagatatatgtaatatattatgtagtatattatatacttacactataaattataataattaatmattacaataattaatatttattataacagattattatattatatattttaatgtaagtatataatacactacatattatgtaatatgttatatatagttacatgtatgtaacacatttattatgtatactttgaactttgacctgtctgcaaactttaatatcttccaaatacacacaaaaatcctgtgacctcagctctagggactgctgtagcacagcatgacaaggattctatatccagtagaacctaaattccatgaggctagatgtttgtttgctttgttttactgctatattcccagctccacagagtacctggcaaagagtaaacactcaatagatgtttgtggaatgaatgaaagcatcaacgtctctgattgtcacaccataataatgcacatttagggcactgtacagaggaatttttacctccatgttctcatttaaacattaaatcgttccatgaggtaagaggggaattttattcccattttacagtggtcaaaactaacgctcaaaaagrttaatgggcttttccatgaccacatggaaggggagtggaagagctaataactgaagccagtcactgctcaacactccartaaatcctgagaccatagatgggtgcagggtgcaaggggtcgataygaatagtatggacgttacaggaaactttaacaaaaactttaattataaaacaagttcttaccttgaaaagaaatggaattatcccctcagtgagagtcactaggaattacttttagtaattcatcacttttagtaatttagtaaagtcatccttctcagtgagagtcacaaggaattacttttagtggctctaaaagacttaccatttctatctctgatttcatttactgtagctctacagacaatttactattgtaattgtaaatgaaatcagatagaactggaaagtcttcacggaaggactgttgccaagtcatgactccatctcagagragaaacaaggtgcctcctgaaattcacactcacagcacaaagtaggactagcatccatgtgcagaatgttcagatggcctcgctcgcctgcaaggatattgcttggttgcataagaccccttatcacttacaaagggctggaggtggatcttccacagctatgtgcaatgttccaaaccctttattttcatactccaaagtgcatgtgattgttgcccacttggcaaattataaatgggccaattgtgtttcgggttgtgtcatacccattacgggagaaagtagagacaggggctgttccctacaagcaggcctggggcctcagggacgaaatcagggactccaggcagaagcggctttcaaggagagccctatgcctgacagaaatggctgtgagaagacgcacagtctgcttggggcttatttttattatgacaagctgacattgcagtggcctcccgtgttccaccaaaagcagggtttgggggactgttctgaggctcttaaatatttggggaaagtttttttctgaaagctaaaaggagcaaccctctgacattttgttcaaaagccttgttttgcttttctgcaaatgttcatttggaaaacgctgtaataaaattgggctaatggtggtggaatggtttttttcacccctccctagctgctgataacatgttagtagtgggtttaaaagtttgttacccatgatgggcatgtgatctaaaaacttygctgactttctcagcctgcatgtgagtgtagtcaagtggggccttacagccactaagtattgggcttacctgggtttcacaaaatttattcagaagccatttttcccttgaaaaatcagagtccggaaagtggcccattgcaaaaagcagcagctgtttggttactcataaccccggaatgctgacttgattgtaacaataaatggagctaacagagcagaaagaaatgttcaaaacagattaaaaccataggctttgaaatgtcctccatcctgagcatttgctaaaacacatttttaaatctctgatcatcagaccacttctttttcccccaaagtttagtcatatgctgtagttgaatgaaccatgccctgaaattctttccatctttttcttcttttgaagagtcatgtactatcggttttatttgtggaagccagaaggaccattgtttcggtcatggaaacactctgcctgattttactttaatctctgagaaagtctttagagagattctgaactggcattaggcagaaaaggaaatccactccttggagcagtaaaccaggacaattgcttggtgtggacagttacctcagtctggcctctctgcgataggcttttgtgagctcagccttgcaagaagggaagtaaataatgtccamagtggcagtgtttattcttctagaggcttctgggtccagccaactcatacccattatgtttgtgatctcaaggggatgtttgagcagagaaaacaaagaatattttgccgacgtgcgagttttctttgttagaacttaacacttggcgttcagtggtctttccaaatatgtgctgttgattgggcttgggtgattgggagcacatgctgtcagtttcatgctgtggggactgtgccctaggcgagggggtagggagatcttgaaaatgggaaagaaagctggctctacacaccatgcaagcttgcttctgccatttgcatatgtgtacgtgtcaggggccacacagggctcttcctaaagccctgcttttgatgggacttggggggagtgcacaaacatcagctcctcctaataaaaataagcctgaagcagtcggtatgcttcattcctttgcaattactgtccttgtgctcagccctctgtgtaacagccgtttcattcattttggcctttaccggatggctggggggaattaatcagacaaagaaatcattatagattcaaatcacacactcctccccaaagtaggcttcttgttctcactccctctccccagagaacacttgagtgattttcctatcagtcagcagtgggtcctgagggtgggcaagggccgggggtgctgaggaatgggggcagagtgtcccgaggtgggggaaaggcacagagggagggtgggagggcgctgtgcccagatccccctgagagccgccttcctggctctggtcctgagtgcctgtacatggatggctgcagttgcagttatgaaggtctcagataccaactctttgaaaactgtctcccaaagatggtctttcttttacaaatcgaagtttgaaaagacctgaagatgaggagtcagcatcttctatttgattcccatcctgccttcgccaccctccccagccccacacatacacacaggagataaacaggacccagaggagactgagaaacctgtctgtgaggcctcctggaggcctggcctaggctmtccttgcctgcaagatgccctccgtgagcccaaggagactctttccagaggactatgtcactggggtattggattccagtcagacagacagtttgggagatttggaggagcctacgtggtctgaagtcatgtgtgatagatctagaagtgaaacaagagagttccctgaccaccccgtcgcaggacctgtgacaggggtgtggcacatctgttcggctgtggtgccctcaaaccccttatgggagggggagcatgcagattggcaggtgcaggaacccaggcaagatgctacccacagtacggtctagtggtgggtgcctgtgactctcaaagcccycatgggcaggctacagtattcttttagctctgccatccacagagggctcaagtgttaaccagctcagtgactcttggtacccgacttcctgtctggcatccaggaagaatcaggtcacacacggacttgaaggatggtgaatgtggggattttaytgggcgatggaggtagctgtcattggaatggatggggaactggaaaggggatggagtgtgaagatgatcttccccatagagtttcgctgtgctgtggatgatcaactgtctgaccatccccggccaaactcctctcaacgttcagatgctccttctctctccttctctgccacgttgttcttctcctcctctgctcytctattcatctgcccatctgctcgtggagcctggagttggaggtttatrtgggtacaggagatggggacgtggcaggccaaaaggcaacatctgggtgtggaaacaagaatgcctgttcccgtttagggccgtgggtttccaggcttggggatggggcctttgccagggaacctccctcttctacccagtgtttccctgtctgctgtctatatcagaaggagccatctggagactaaggcagagtctagggcaatccctgagcagaaaagtgggatgcacttagtcaggttcctgggcatgggcgtgctgggagcaggcacagggagggtgcatagcatccccttccttaggctccaaaacacacccagagagctggtatttccactcctcctaaagaagcatacgtgttatattcaatgtgtggtcttagaaaacattcagtttgcagggtaggtggaaattcctaaaaatataactgggatattggtagccttcagtgaactcaactttcataacaaaatggctttatgctaagactaatcatatgtgccagagttagaaaatcagacatttctttttttaaaggtccccctaaaattcagaaaatcgacttaatattgtatgatctgtaatgtttctgctagagaaagcaggaaagcccacaaagamatgaaaaagacaaaaagaggagatagggaagattctggaataatctactccgtcctcctctgcaattctggctgatgaaacaagcaggcattttatgggtgattgaacttgtgtgttcctaaggcacagggagtgcctttgaaaactcagctcaagtttatagtgcatccccacccagggaggctgagatttcaatctcyaataatcatagaacccaaggagccgggggtcaaaatgagccagagcaagggcctgtaattgcttaaaatattttttaaagtcttttttcctacatcccatgttagatctatggaggccccgatttccactctcccagaatagcccaactgtgtacccagagatcacctgagaaccccatgcaggtctccagcactggaaatgagctagcaattcgattcaagaccgacttgtccataaatgggagaggcttcaatgcgtcatggcaagcagtcactggaggtgagtgagaaaaggaggtttcctaaagtacttaagccgagccctcgttaaatttcatgaaatgcttgggaaaacgtatgaaggctacacactkataacttagtgacatcccaaagggcagcctactgagacctgacatatacccttccctaaaatacgtgataaagtttaacttcctaagggtcaccacatatgtgaaagcaagaatgtaagtgtgtaagtccatggtgagagcagaactagggtgataggccagacccactctccaagggctcrtacctcttaaccagcctccatacctcatgccatagtacagacctttagattcttggcaaatatcaaacttgcaaacattaaatttgtgaatcccaaggaattactgtgtgttctatggtgactttctgcccaagattttaggyagtctaaataaattgcctrttgtatatttttaaactatarcaaaaatctatggcacaaaatagtgtaacagatgttagcatatgcaactactagagatagccacatttgcagaatgcttactgtgtactaggcacttttctaactattttatgaggattatctctagtccttacaaccaccctgtgagggaagtccgcttcatatcctcatcttaccagtgtggacactgaagcttagaaaggttagtgkcttgcccaaagttccacagctagaaaacgtcaaagcacatatgtgattccagactaysttatggccacacttcttcaactctatcataaccaaggtatctatataagagctctcccctaaagttaattatgtaggaatttaaataaacacacacacacacacagacacacacatttagtgtttagattacccctgaatgattctccattattagaaaatagtgccaaagttttctattattggcttatattatcataaatccaagaaatggtgggtcatagagaagacattgaactaacaggtatttgataacatcaaaggaattttwaaaaacctaagtaactgtactatatccgaatattaaatttttaaagggtagatattaaattatttttaaatgcatgcactactagattatcacaattctggaaggaaacatrttattcttccagtatgctatatttttagaggacartgaagaagcagcattccatggctttgtgaaaacgtgatttcatttgcgtttccttttaattatttttaaaataaattttggcatctgtatttaaagtgtttgaagtattytcttagtatcatccatgtcatcccttcttattctgttgggataaatggcttaatgtggatatcaaattcttcagtgtttttagcatcgactaactgattcaagcaaagtaatgtattgatctatacaaccaggtaatggattattttcgagcatccatgattcctctcatgaaataattgtgttccccacttccaggttgtggtgggattttccaggctcccagtggagagatwcattctccaaattaccccagtccttataggagcaacacagactgttcttgggtcattcgggttgacagaaatcatcgtgttctcttgaacttcactgactttgatcttgaaycacaagactcttgtattatggtaagtgacataaatttcaagcattgtctccagtcaaacctcggtcaaaacactgccatataagcatatttagtgaatrtattacttatgggtgtttttaatgtcgawtcataggaaaccaaactattggcaacttaaaatataaggacatttattttttacctaaaaacaaatcaggaagtagataatctctaggttttttagcaagtcagtttctgcgctaccattattagcctgttggcttttcattttgttgttacttcatkgtcaaaaaatggctgcagtggtttttatctgaatgtcctacctgagtctacctctgaaaaaaggaagaagcaatagtgttaactatttctgttttgtttgtgtttcttttaataaggaaagcaaattttccaaaaaagcccctgatatatcattagccagaactgactacaaaagagatccagaaagtatcrtggaatagatttatcataaatgttttagatcaattattattattaagcatctgggattttcacaggattctgcttctcttgagacaaggatatcttgatttgctacttgaacaaatccatgttctgatagaacaggttgggagatgggagtggaggagaaggaatatggctatgaattggtcagatgacaaaaagagtttctgctactgagatgggarrgtttcctkgactcctttacaggacttgcgaagggggtggcttatttgcttggctgcctmgctgaattcaggagggagcacacgaatagacgaatgcaggaaccggggtgaacgaaccctagaactggctggtccctcmtctctggtggragcaggctctgtgcacggcccacggcagcgtccaagcttsttacaatgctcttttagctctgccatctcggagagggtgtctgcgaccccaaragccccaaagggcatgtgttgcaatcagtgctcttttagcatttgccgtccatggacagctaagtgttaaccagctcagtggagggtcagggtgacagccttttacaccctgacctcttgggtacccaagttcttgtccagtgtccaggaagaatcaggtcacacgaacaaattgaagggtggtgaatgtggataactttattaagaggtagaartggctctcagcaggaaggcgagcttgaaagaggttggaggaagtgggttgcaggagtctggccttccttggctgaactcctctctgaccatagtctccgatgtccagctccttcttctcctcttgacgttcagacacttctctcttctgtgtgtgtgtgtgtgtgtgtgtgtgtgtgtgtgtgtgtgtctgctgagtctggggcttggagttcttatgggcaccagatgggcgcagggcaggccaaaagrcaacatttgggtgggaaaacagggatggttctcactttgagtggcagatccaggcttgagggtggagcactcaccagggacctcaacctcttctaccaagcattttcctgccttctggcccatcactactaccaacacttttaatgmattcctacctgaaactaatgctttgcgcttcatataagagtgaatgaagttctattttgaaggktttttttttctttctgtttttaaattttttggctacctaattttcttttattattgttattattattatactttaagttctgggatacatgtgtagaagctgcaggtttgttayataggtatacacgtgccatggtggtttgctgcactcatcaacccgtcatctacataaggtatttctcctaatgctatccctcccttagccccccacccctcgacaggcaccggtgtgtgatgttcccctccctgtgtccatgcgttctcattgttcaactcccacttacgagtgagaatatgcggtgtttggttttttgttcctgtgttagtttgctgakaatgatggtttccagcttcatccatgtcccttcaaagtacatgaactcatccttttttatggctacaaagtattccatggtgtataggtgccacattttctttatccagyctatcattgatgcacatttgggttggttccaagtctttgccattgtgaatagtgctgcagtaaacatacgtgtgcatctstctttatagtagaatgatttataatcctttggktatatacccagtaatgggattgctgagtcaaatggtattwctggttctagatccttgaggaattgccacattgtcttccacaatggttgaactaatttacactcccaccaacgagtaaaaacgttcctatttctccacatccttgccagcatctgttgtttcctgactttttaataattgccattctaactggcgtgagatggtatctcattgtggttttgatttacatttctctaaggaccagtgatggtgaactttttttttcatatgtttgttggctgcataaatgtcttcttttaagtgtctgttcatatcctttgcccactttttgatgaggttgtttatttttttcttgtaaatttgtttaagtttcttgtagattctggatattagccctttgtcagctggatagattgcaaaaattttctcctattctgtagattgcctgttcactctggtgatagtttcttttgctatgaagaagctctttagtttaattagatsccatttgttaaytttggcttttgttaccattgctcttggtgtttaartcatgaagtctttgcccatgcctatgtcctgaatggtattgcctgggttttcttctagggtttttatgattttaggttttacatttaagtctttaatccatcttgagttaatttttgtataaggtgtaaggaaggggtccaatttcasttttctgcatatggctagccagttttcccaacaccatttattaaatagggaatcctttcctcattgcttgtttttgtcaggtttgttaaagatcagatggttgtagatgtgtggcgttatttctgaggcctttcttctgttccattggtctgtatatctcttttggtaccagtaccatgctgttttggttactgtaggcttgtagtatagtttgaagtcaggtaacgttatgtctccagctttgttctttttgcttaggattgtcttggctgtacaggctcttttttkgttccacatgaaatttagagttttttttctaattccgtgaagaaagtcaatggtagcttgatggrtatagcattgaatctataaattactttggacattatggccattttcatgatattaattcttcctatccaygagcrtggaatgtttttccatttgtttgtgtcctctcttatttccttgagcagtggtttataattctccttgaagagatccttcacatcccttgtaagttgtattcctaggtattttattctctttgtagcaattgygaatggsagttcactcatgatttggctttctgtttggctattactggtgtataggaatgcttgtgatttttgcacattgattttgtgtcctgagactttgctgaagttgcctctgtctcagcttaagaagattttgggctgcgacgatggggttttctaaatatacaatcatgtcatctgcaacagagacaatttgacttcctctctatttgaatatgctttgtttctttctcttgcctgattgctgtgacctgaacttccaatactatgttgaataggagtggttagagagggcacccttgtcttgttccgggctacctgattttctaacaaaaagtttttcatctttcatttgtgtatatcaacatttcattcaaatacaaaccagattctcttggttactggatctttcaatgttagtgtcctgatagtttcctacacaagatccaactggctagcttctttcaaatttaacccaagaaaactcaaaggtttgtttacatttttccaagtagtccattttaatggtatgatttcaatattattttacaagattaggttattaatgaaagttaagtttatttatcactgtatattaaccatccaaatgagtcttcagagtctaagttggctaagcatcatgcagactgaaagcgtagaacatccagctactctcctgacaaagaccatttygaaattttggatgacatttacaaacatctttctaaaagtagccartggttcatgaggtagtgtgaagtttctgagtgaatatctgagagaggtgtgagtccagtctttgggaccattttttcctgcagggcctttactgatccacaaaggtttagcagctcttctgagagcctctcaggacaaagaggaccaaagtttgagtccagagctttgttagagtggcagtcttggtaagccattcgtatcttaggtaaaatgaaaggaaaacagccttcactgagactgcattcaatatttgagttacctgagtgaatccccaaaatctgaagccatgaaataatgagagtgaatcttgtatttctcgtgcatctaggcactggacatccagcaaaagcaatttaaaatcttcttcaaagagagatattaacattctagacatcatttctacctataatttttcatgtgtaatagccgattaaataagagagttccctgacctccgttacaggacattcaacaggggtgtgtctcatctgttcaagtgctgcakgttcaaaccccttatgggcagggaaacatgcagacaggggtgcaggagccggggagagtgcttctggactccgggccccatggtagcatctaggggtgggtgcctacaactcccagagccctagtgggcatgctacagtgctcttttagctctgccatcctcagatggcttaagttttaaccagctcagtgtcctcttggtacccatcttcttgtttggtgtccaggaagaatcaggtcacacatggacttgaaggatggtgaatgcaggggttttactggatgatggagacagctcccagtgggatggatggggagctggaaagggggtggaaagggaagatgatcctccccctggagttcactgtcccatggccgatttcttctttgactgaccctggctgaactcctctcaatgttcagatgctccttctcttctctctttctctgctgtactgctcttctgctcctctgctcttctatttatctgctcatctgcttgtctacttttgaagcctgggtttaggggtttatatgaatacaggataagggggtgtggcaggccaaaaggcaaaatttgggtgtggaaacaggaatgcctgttcccatttagggccatgggtttccaggcttgagagtggggcctttgctggggaactgccctcttctacctagtatttccctgtatcctgtgtgtatcaccaacacactatcaaagatagtcatgtacttgaggggacaatataacaaaaatgagatgtaatatgagtaagagacaatagaaacaaatccactaatatgccagatagtaaagttacctggcacacttgctrtacaactgtgattactcaactcatggaaataaaagtcaaactgagaactttcagcaaggaactgcatactatagaaagtgacattgcaatatgaagaagacccaactacaaatttgagaactgataaataccatagctaaaattaacacctcagcagaaggctttttggggggaytaggcagagatgaagagataaatagtgactacagagaaacagtgaactggaagataagtcaagaatctactcagaaaaaagtatggataaaaaaaggatgaaaaatatataagagaggttaagacacatagarsacactcagaaaatatataacacacasttaattggagtctcacaaggaaaagagagatatatggaacagaagcaaactttgaagagctactgactaaaatttttccaaaactggtggaagtcatcattaaaaaaatagaatctcaaggaacccaaacagcaaagcaggataaatagaatgaygtacttttctaaaaaaaaaataataataacaaagataaagaraaaatgttacagtcagctagaggagtaggtaggtggggaacagattgcttgttagaaagtagagactaaatgctgacttttcaaccaggattggaagtaaaaaaaatttttttaaagacaatagactgatatattcagattaaagaaaaaaaagtaactaccrgccaggaactctatgctctcctaaaattcctttaagartgaaggtgaggmtgtgtatggtagatcacacctgtaatttcagcactttgggagcatgaggcaagaggatcacttgagcccaggagtttgagaccagcctgggcaatgtagtgagaccctgtctctacaaaacagttaaaaaattagccaagcatggtggcacagacctgtaatcccagctacttgggaggctgaggtgaaaggatcacttgagggtrgaaggcaggagttgcagtgagcacagatcttgccactgcacttcagcctaggcaacaagcaagaccctgtctgttaaaaaaaaaaaaaaaaaggaataaaggtgaaataaatattgaagcaaaagaagggtcttggcctggygtggtggctcacaactgtaatcccagcactttgggaggcctaggcaggcagatcatgaagtcaggaggtcgagaccatcctggccaacatggtgaaaccccatctctattaaaaatacaaaaaytagctgggtgtggtggtgtgtgcttgtaatcccagcgacttgggaggctgaggcatgagaatcgcttgaacccaggaggtggaggttgcagtgagccaagattgcrccactgcactccagcctggcracacagcgagactccttctcaaaaaaaaaaaaaaaaaaaaaaaaaagarggtctttaagagaagtttgaatgggccagagacaaagctacttatagttttgachntggtgggtattgctctaccccttgtttcctccctcgtctgcatggtgttcttttstttgatacagtgcagaayccatggaatttaacatacaaagtgtgtcaccaaaccaaagcctaggtcaacagcatgccagcatggctaggattttccctcttgtggtcatgaggagggttttccacctacatgggacataaacacacagacaaggttttctatgaacactgccrtatttcagcatgcagctgggcttggcttaacaaagtgcagcaggaggaaacagcaggagtgaaacctcaaatgtgatcgggtcttaggcacggagatggaaaataaactcaaaaacaagtgctgggaggagtttgggctggtaggtaaggcaaaatataaaatgtaataatagtccaaacaagttgtcagaatcagataatgctgtatgaagtacagttgactcttgaacaatgctgggattagggtcrttggccccctgcttccctgtcrtgcagtgaaaaatctacatacaactttcaagtcccccaaaacttaactactaatacctatgacggacagaaggcttaccattaacataaacagtcaattaacagatattttrtatgttttatatattacatactgtattctttcaacaaagtaagctagagaaaataaaatgctatcaagaaaaytgtaaagaagagaaaatatatttactatttattaagtggaagttgatcatcataaaggtcttcatcctcatcatcttcacattgagtgggttggggaggaagagggagggggcgctagtcttgctgtctcaggggtggcagagacggaagaaaatctgtgtttaagtggacccaggcagttcaaacctctgttgttcaagagttaactgtaggccgggcgcggtggctcacgcctgtaatcccagcactttaggaggccgaggcggggggatcacgaggtcaggagatcgagaccatcctggctaacatggtgaaaccccgtctctactaaaaatataaaaakcagccaggcatggcgggaactcgggaggcagagcttgcattgagccaagatcacgccactgcactccagcctgggcgacagagtgagactccctctcaaaaaaaaaaaagagttaattgtagttggaaaatcccagccagtgggcagaagagacattagaagcaaatacctctaagaacccaggcaagacattaaaataaraagtgagccacaccgatagtgtgagtcagcacagtgcttcagctaagaaatctagctctaatatagggtggttctgggrctgagcctggactttgtgatattctagctgtgttctttggargaaagttaacctttcagcttcagtttccttaatggaaatggggataataagaggacctaggtcagatttattgttaggtatttgagataatatagatgacctgcttgctgtcacatagagagttctccacttgtgctagccattatgatgctgctgatggtgagtgttttgggggaggttcatttaatgaggactagaagaagagacagcgcggaatactaggagcagaaatgcacttagaagtcagagtcagacatgcatgcccgtgttcatcgcggcactgtccacratagcaaaggcatggaatcaacctagatgcccatcaatggtggatgggatgaagaaaacgtgctacgtatacaccrgggaatgtgacacagccacaagaatgaacaagaccatgtccttttcagcaacatggatggagctggaggccataatcctaaatgaagtaacacaggaacagaaaactaaatactgcatgttctcactcaggagtgggagctaaacactgagtacatatggacacaaagaagggaacaacaggcgccagggcctacttgaggttggaagctgggaggagggagcaagttgaaaacctacccatcacgttctttgctcattacctgggtgacaaaatagactgtacaccaaasccccatgacaggcaatttacctctatagcaaacctgcacatggacccttgaacctaaggtgaaagrtttttagaaaaagaagtcagggtcaggacttgccgtctgtaattctgggcctcaagctcttaagcagaagagcccactttcgaatcttcytcgtagtatagcacctaggatttagcatatctagggctcagtgctctggaatcattgtgaaaatggccgacatcattcatttgggcctggaagccagggaagcgttcacactggaggcgacatttaagtggcagagtctcgccagtagaaatgcagcagtgaggccacgaggggaggctgcaagggaaggatgrggaaatggtgcacgcacatttgggaataaaaaatgagagtgttgtccctggagcgtgaagaaatgcyggggagcatgtggagaccaaggggctacagaagacatctgagctctcttctgctccagttaagaatttgaaattatcctataggtagtatggagtcagtgaaaattttctgtaaaacgggaataacatactcagagctgtattctacagtgacaacaggyagcagtgtgtgaagaatggcttggcagagaaaaagaaagatggtagcatgtctgtttgggaagcaatggaaaaagcttggatcagaggtgataaggtctcatagtaggcagtggtcttgggacacatggagagcgcagggacacgtggagaactgtcacggtggcagtcactagaattagaggctaattacatggtggtgggtggggctggtgatagagatggtggggggaagcctatttgcttgaagaatgaatgaatggccgggagtgatggctcatacctgtaattccagcactttgggaggccgagacaggagaattgtttgagctcaggagtttgacaccagcctggaccccatctctgcaaaaaaattaaaaaattagcctggccaagtggcacatacctgtattcccagtaactcaggaggttgaggtgggaggatggcttgagcatgggaggtcgaggctgcggtgagctgtgatcacaccactgtactccagcctgggtgacagcatgaccctgtttcaaaaaaaaaaaaaattgtgaatgatgaggccattaactgagtaaagggagtagatgatagtgagtttgacttgtaaacttttgggtttaaatattatatagtttgacataagagttcagagcttgggataggatctgagctagacatatacaattgaggataatttctgtatattgggtggttattaaagttgtgggagtaggtatgatcacttttaggagtattttaccaagagaaaggggccaagccaactcytggggaaacactgccatgtaacgggtggatgaaagatcagaggagaggaggctgaggaggtgcgctgagtgcttggtggagaaccagaagagagtggtagcattcaaaccacgagggaagctgaatttcaagggtgggtgatcaaaggtatcaaatcccatgcaggatgccaacgagcgtgaggattgcaacaaagcccctggattccgtctttaataacctgcaaggagcaggattgtggcgggtggtggtggaagactcaaggtcacagtggttaggaggtgcaggagcttctgagcttttccccagagttacggaaatgagtggcataaggagaaaatgggcagtaaccaatgggttaaccaaaatcagtggagagttggtttttwaaaaaaaatggagaaatataagttgtgtgaagagggcaggtggaaaaagagcagctgaatgtgrgagccaggsgaacagtagagaaaatcatgttttcagsacagagacaccaagaagcgccagattggttctatkaatgttgtaytttttagaataagaaattgaaacccatggcttggcacaagatttttctgatttataaattcattatgttaaaaattgcataaattgtatacaaactaagtcattttttcttggatgatttataaatcaactttacaaaaagataaggaagttttaaaagaaaacaagactgtccaggtaagttggggtagagatctgctatatatttgccaaatgtgcccacttaaggggacaggaggtctgcagaggtttggaaccagaccaggcaatgccctggcaaggctggaagcttgttagttagttgtccagggattcatgaaggccggmgttgaagcaccagccctctrtcyttacagccagatggacactggaygggaaacgtaccccaaagtccaacatcttacataatatctctgcagtctcagttcatataaagccaatccttcattttggagacattcaagttaatgtcctgktcctrttgcttagacagagttattagcaaagagaaaaatattcagttgccagtgatgctgtcagataatgttggggttcaggagatttttaayagagttcaagtgtactctttaaataccagtgaaaattatgctggaatgggaccagccatcctgttttttcaaaacttctataacaattygggttgttagaagaagaaatagtaatttagctgtatgttaaatatgatttcacatatgattaactgtcataaacctatagatacatagaatgttaaggttggaagaagaaagcttagagttcgtttgctgttgtcacctaattttttwaaaaaagacattgaggtggaggtggggcagtgcaaaaaataaaaattaattaaaaaataaaaaagatactgagatccagaaatgtcagggtcaaggctaagtagaaattaacagcaggatcagcactaaaacgaaagccttatgcttcctacgaagtgaataagtattttggtaaaatataaaaattgcagttatgtacaggawacggaatggcagactagaaaaatagagggagaaaataaayttagggtcaggctggagccactttgattttttttttttttttgagatggagtttcactcttgttgcccaggctggagtgcaaaggygtgatctcagctcactgcgacctccacctcccaggttcaagcaattctcctgcctcagcctcccaagtagctgggattacaggcatgtgccaccatgcccggctaatattttgtgtttttagtggagatggggtttcaccatgttggccaggctggttttgaacttctgacctcaggtgatccacccgcctcggcctctgattacaggtgtgaatgctgggattataggcgtgagccaccgtgcccagcccactttcacttctatatctgataagcccagccttcatttgtcaatagaaggaaaagtgttaagaattcaaatatgaaatggaaagtgtccttgctttgaagtcaggaggtcagggtttccttcattactttccccttcggtgccaaatatgtaccagacactgccaggygcttgtttctggacrtgtaccacccctcaccctcttcatggcttggggttcttagtttgcttatttagaaaatcaggtgcctggggaacagaagcagaaagaagaaaactaaggaagaggattsagttaggagttgcatttgtgggtaagaaaaggaggacaagatggcagatgaaatggccactgagggcccagtgacgtcagtggtggtttcatcctcaaagttgaagtcaacctcaggcagccaccaggcttcacatgatctctgggttacaagactatccccatactcttctgggaatacaatagaaagctcttcttagagtaggcctagtccctataggttccaaattgaggcaagctaagcccacatgtaacagccattactcttggtgtcatggaaacaaaggcaaaattcgccaagtagaagaaacaaatgaacatttaaaaatggaacagtagactgggctcagtggctcacgcctgtaatcccagcactttgggatgccaaggcaggcggatcatgaggtctagagattgagaccatcctggccaacatgatgaaaccccgtctctactaaaaatacaaaaattagctgggttttgtggtgcatacctgtagtcccagctactcgggaggctaaggcaggagaatcacttgaaccccggaggyggaggctgcagtgagctgagatcgtgccactgcactccagcctggcaactgagcaagactccatctaaaaaaaaaaaaaatggagcagtaatacacagcctccatcctctttcacagaacccacagcagtagtctttatatcrccaaagcaccaatgtttttgatgcatgaattgttratagmtgmatagctgaataaatgaatttttgtcatctctgctcctgcaatgctcagtgctttggtggaaaatctcagaggacaccatygggaatgtgctgtactgagttcactccctggcattgttattgatatacaatcttcgtgttgtgagccacatgagcacttagataacatcacagaagtgcgttttctagaattgcatgctgctataatgagaaaagggaaaaactggattttttgacttctrttgaaattgtgatggcatcgagsggagctaatcaggaagctggacttgmaggcaggtttcaacacatttggtaatatatttgcactttctgctcagtcaccttcaagtgtctggtgtaattaaccttgggctctcctcaatgacacatcaggagcatttcttgctaaggaagctgtgggacycatcggctgggcatggccttgtctggtcagcacrcaagtggcttcattacgtttcctttcacgaaggctgagtattaaagtgacctctgrctgacagttwaattgcttaattagagcctttcttctaagtcttcgattcatgtagctctgcaagctcttattgatctcctagaaaggctgcttgtagctcagtgtgagagcaggaagaggaaagtccgttcagcagcaccagctggcccctggagattcctgacctctgcttccagcatcctctttgctcagatsattggaatgtctgctttgtgagaatcagcaaggagcagctcaaagcaagccgaccatggtccaggtcctgcctctcatttggaggaaaacacaaacgagggctaacagagcctggtaccaaaaagcaaaagcaaaagcaatrtgattagtaacttctgaagctttttgtggctatctaggagaaagaaagaaaagtgtctgatgtgatcyggaaaaaaaaaaaattccctgtgctcccacccaaagctgcaatgtctgttgttgttccattattcgacaataaaatgcagggtggaacagggcagatacctaacgcagcatcctcttttgttgtatttttgtaatacaccacccatgatgtgtttccttttaaaacactgatggtttccaaagcagagcaaacagacacaggaataatagaactctgggtttcaaagagatgatggaaacaagtcttctttaaatatttactgttttacaaacaaatccatgacagaaaccagtctctctctctcccctcctcttcctctctccctctcttttcctctctctctctctcttttcctctctctctctccctgtctttctgtccctctttctttccctcttcctcttgctctctctccctctcttcctctttccccctctctctccctctgtctctccttctctctctctccctgtctctccttctctctctctccgtctctccttctctctctctccctctgtctctccttctttctctctccgtctctccttctctctctttctccctccttctcttcttatctttccctttctttgttcytctctctccctctccctttttgtctctttctctctctcctccctgtatctctctctcactctctctttcttccctccctcctttaygccccacsacaggaatttttgtttccatctgatacttgaggatgatctttttcaaacgtttatcttgtgacttgcatttgtattaacatgcttagctactttgcttcctggtgcgggtgtcttattracaaccaaatgctgagccagtgctttgaatctgcaagatgaaggaagagttgagttgaagccacagctctcaatctgtggacacgggtttggtttggcttggtttccatttcagctcagactctccttaaatgtttatttgtgaaagtaaaacgagcatcttagatttcttctcatgtcaacatttccaggaatctttgagtcagtgctcgcaacaactgcaartttttagagtttatagtctcttgtaagatgtgaagactgagtgggagagtgtagmacaaagaaataggggtgaacgcatcgtgatatgagatgtggggttgtgaattgaacttagtattgaatttccaaggagcgtaactggaaaaaaatcactgacaaaggaaactgatgcttcctccttcctcagccccaagaaragatgctataatgagtaatattttcatttccttccgcattcacatttatgactgtaacagcttgtataatttcctgagggatttccctccctatcacttaatgtttcctctattttggagaagttcgtattccaaagtggsaattccattagcagstataccgccatattataacatgtgaaaatacctcatggactctcratcctcaaaatcactttgcacctccatgtgaattatctctcctgtgccctaaatgtcttattcttcaccacatttttgcaccctgctaagatcaaaggcaatccagggcaggagacctgtgttaccatctggagttaaaaatgtagcaaagcgggactggcacagtggctcatgcctgtaatcccagcactttgaaaggccaaggtgggtggatcatttgaggtcaagagttcaagaccagcctggccaacatggtgagaccctgtctctactaaaaataygaaatgtagctgggtgtactggtgcatgcctgtaatcccagctactttggaggctgagacatgagaattgcttgaacctgggagacagaggctacagtgagccgagattgcaccactgcactccattctgggcgacagagcgagactctgtctcagaaaaaaaaaaaatgtagtaaagcataagggtccaggtgagaargaggccacactagaccagagaatggcggttggaccagagaaggacaaggaggagctyyatatctgaatccaggaatagaatcaagtttatgtggcaacgatagaagttstgggtttatgtattgaccccagacactgygctctttgttacccattctgctaagtgagccatgctgggaatcccatgcacgttcactggaatggaatgcaggacagatgccaaccacttggaaagccacrggagcccartayaagactttctcaaatgctactgaggatgcttgattgcaggttcagatgcaaaggatgggggactcccaccctatttccagagctgctgtggttttctttcttggagaccgtgaatatctcacttagcttcacagaatcatggtctctcaacattctaactgaatgaatacaacttgatttcaccttttctctaggtttaatcatacttggtcggacgtcagacagatggggtttgtatattggctctgcactgctaagcgtgtgattgggcaagtcatgtatgttttcagagctcagttttccctgctgcaaagtggaactgttaagaatcaaatgtaaacaaatgtatttaaagtacctatcagtgtctggttcagataagtatttgctgctattcctaatttttctattacaatgactcctgcttctattactattaackctatgttaaagatcttaaggaatcttttaaaaaaattttctccctgagcaagatgaaacttagtaaacaagataaaaaatccagtagaaaaaaattcctcacttcctactttccaacaatctcagggaatatattcctgtttttttttttttttttttagaaataaaaatacagatattactgaggaagctacaattcatttccccctcaktcatgaggggtgcaaaygatgactgacatttcagtcaggtggtcacgagccatttaatcaccccagggttttgattacagcagagaggggcagccgctgaagtgctctgcatcacgtccaygtcaatcacgtggtctttagtgcttaggcaaagcatgcgtgattactggtctttmtttcgtgcaatttaaaaatgtatgctcagctttactttagtatgtgatgttacattttagaaagcgcacgctgtgcactgagttgttttgagactgaatggaaggaagacacaaatggaaggcaggggaaatttcagggtgttgtagtggcctaggcaagatgtaatgaggccccacaccaagacaccagagagggacatggatgaagtagagggaaggagccaagcgatacatcggacaaacagatgttagaacatgctgatccactacatgtagcagggatgggggcggttccccaaacggtctggccgttgggtacatgcttccggcatttactgtggcaagaaatgtaggtaagggagaaatgagagggacaggaagagggcttcagtttgagacactgattttcggggtttgtggaacatggaagagatgatgtctacgatacagttgtctatacaagcctagggcttaggggagaggrctggggcacagttrtagatattaggcaatgaacagatgctttggagatcttaaaacagaagccacgtccattaaacttgatacattcctggcggcagcaagaggctagattaactggcgttagtagccatctggcttgggtrctgcagtgctgttatatgaatagtgccctttcatgtctgtatgtaatcacttatgcrtccgagtgatgaaacactaaagaacttttaatatagattttatttttaaaccttacatgctcctcatattaaatttgtagaatacagaaaagaagaaataagaaattawtgccatccttagtattacaatatagatacaagctattgaaattttggtttatttccctcacaaacacacacatacaaatatatacacgcactcatgtacacacaaacatgcatagttaagataatattatatataattttgtatcttgcctttttcacttcatattattygaaattttcttaaatagtttctttggctagtcaatgaaatggacgtgctgtaattcagttagccacgstttattattaaccatttggattattaatgggttttttcttttcttgttataacaatgctatgaggagtatctttatatgtgaatcttagtacatttcctattatttcctttatatagcttttcttttctttattgaacactctactatgaaatattttaagtatgtagagaaataccgactatataatgcatacaaagtatataacatacaaaaacttctccctgtccagactggccaaatcttcatattttgccacatttgcttcaagttcttttgttttctcccaaacagaaatgaactgttcaagacacaggtgaagtcccacrtgctcctatcattgatcccatgccctgttccccgtcccagaggaaactgctaatgagatttctggtttgtgattcccatgaaggtttttatagttttttcattatatgcatatatccatacacactatgaaatattattttgcatattttaagactttatgtacatcatgtcacacgctacatatccttcttcaacttgctctattcactcattattctgtttttcacattttctrcattgtaatgcatacagatctaatgcattcttttagtcactacacattctattttatatatgcaccacaagtcatttgcccattctcctgttaatgaacatttaagttgcttgcaatatttttccttagcaactttttgtaccgaatattcttgaagcaatatctgtatgtaaccacctaagactttctctagtgtaaacctgcagaagtggaattgctagcttttaacttttctgtatgttaaatttcgttagaaatttatatatgaggccgggcacagtggctcatgcctgtaatcccagcactttgggaggmtgaggtggatggattgcttgaggtcaggagttcgaaaatagcctggccaacatggagaaaacctgtccctactacaaatacaaaaaattagctgggcgtggtggtgtgtacctgtaatcccagctgcttgggaggctgaggcaggagaatcacttgaacctggaaggcagaggttgcagtgagcaccactgcactccaacctgggtgacagagtgagactctgtctcaaaaaaaaaaaaaaaaaaaaaagaaaagaaaagaaaaaagaaatgtatatatgagaatttctggaacgaaatgagaaaaacttaccttcatacttgtaatcagtttccacaaaactttcaatacattgtcttatttgatctttacaataaccttatgaggctgcaaggggagtttacctaccctcatttttagatgaggtctctgaggtggttactgcaaagagcagtacagcatgtgacttgaatacagcactggacagcctcattcttcggaagcctttgttcttcattccacacccgcagacttaccccaraacttaccagcttaagacaacaacatttacagtttccgtgggtcaggaagccaggtgccactcacctgcrtgcttcctggctcactcatgtgaatgtacacagggttcagttccttgcaggctgttggctgaggcctcccttgactccctgccacacaggcctckccacggagtatctcagaacayggcaccttgctcaccagggcaagcaatagagaggacaagagagagtccaacaagacagaaagtgctagcaagagggcaggaaccatcttttctcacctcattatggaggtgacagactatcacttccattgtattctgttaattagaacmaatcacgaggtctatcccatacgccagggaggagattacacagaggcatgaataccaggacgtggggctcactgagagctgggtcagaagttgcctaccaccccccacccctacaatctccagttggaaaattttcayttcttatctctcccactcctacctacccatatttctggacaacccccaccccaccccttggttctcttttcttttttgcctccatagctttctaattccctacttcatttcttacrcagcaatttagctcccactttgtctcactttgatactagaggctaacatctatcacatgcttactacatgccagccactctcctaagtattgtatcttttaacttattcttgtgaacagtatgagctatatattcatattaatccaattttgcagattaagaaatttagcaacagatgagaaagcaaagagaagggggcaacttgtccccaacaacataaaataacacctcccctactatactcatgttctgagagcctatgaagatattttcgtcaataaagattgcttttccggccgggcgccrtggctcacgcctgtaatcccagcactttgggaggctgaggcgggcggatcacgaggtcaggagatggagaccatcctggctaacacggtgaaaccttgtctctactgaaaatacaaaaaaattagccrggcgcggtggygggcgcctgtagtccyagctactcaggaggctgaggcaggagaatggcgtgaacccgggaggcggagsttgcagtgagtcgagatcsygccactgcactccagcctgggccacagagcgagactccgtctcaaaaaaaaaaaaaaaaaaaaaaagggattgcttttccctctaaaaggaatcctgccaccaacttttaaataatgcaacatgcttttaaataatgcttatttatargacaaaggtgtgtatgagaattaaaaagttccctttgcttggcttctttattttcccacattaccgttctttagaactatgatcacaggcctccagaactagaaatgccaccaggaagggatgttggtctcacacttgaatggttttcctcctgtgtcacttgacatgtgacaaagttgaacacatgttaactttagaaatgatggacatttatgcaaatctcctcaaggtatcgaagcatcaggtatgaaaattaaggccgggcactgtggctcatgcctataatcccagcactttgggaggctgaggtggcaggatcgcttgagccaggagttccacactaggcaatacagcaaaatcccctctctacaaaacatttaaaaattagccaagtgtggtggtgcacacctgtagtcccagctatttgggaggctgaggtgggaggatcccttgagcccaggaggtcaaggctgcagtgagctgtcacaccactgtatgccagcctgggtgacagggtaagaccctgactacaaaaataacaattataatactaattaaaagaaatttcataaatgtttggcttagttctcacttctggctagagctgaggatgtggaggggacttgatagcaccataatatatcatgtgttcagaatactctgggccttggggacgggtccaatgtcctctgcccacattctgcctctgccttctctcaccctgttggtgaagggcccctgggagcggagtgcatgacattggctgtgccctgtggttgggccccttcattctccttcagacctggcatataggaagcctgcccagaaagcagccgagctgacctccgtccccctgtgactarcctcttacccacaattgtgtctactatgtgtttacagcattgaatctatgagggcaaggacagctgtttcttaactmagggttttcctcaaccctagttctcaatttttagagaccagcaactgtcatacatattcatttattcatttgttcatcaaacatttattgcctgtatgtgccaggttctgtactttttaaaaagtctcctatttttatataataaagttaagctttttgtttttgkgggggttttttgtttgttttgttttgagatggagtcttattctgtcacccaggctggagtacagtggcaccatctccactcattgtagcctctgcctcctgggttcaagcaattctcgtgcctcagcctcccaggtagctgggattacaggcacacgtcactacgcctggctaatttttgtatttttaatagagatggggtttcaccatgttggccagactggtctcaaactcctgacctcaggtgatccacctgcctcggtctcccaaagtgctgggattacaggcgtgagccactgcacccggcctcatatgtattttgaatatgtgtgttagtatcttggcattttataaaattctggatattttacaaaaagactggtcaacttttctgtagaaattaaatgaccactccattagatctgcctctgttttaagagcttcggcagttagaattctctgggggacagtggccactttttattttgtggcttcaacttcaaatttttattttattactatcatctagaaatgaattagttgacatgtacaaagttttattttgtttgtatattgccctgacttttaccacttaagtaacgatcagaaaatcaatgctgaggcctagcaaactcttggcagtagacttaagtaagaattatatgttatattaatatatgtgtatccaatagtaatatcatttgctagctttgccttgggaactaaatggaagttaaggtgaaattcatatcgataatttttatgactttagaattgtaaatgaatgggagcaaggtttctcatattttcttccttgaagtgcttttcttgtggaattttataaattgaaactttaaatgtgagttgttttttgtctttttttttttttgagacggagttttgctcttgttgcccaggctggagtgcagtggcactatctcagctcaccacaacctctgcctcctgggttcaagtgattctcctgcctcagcctcctgagtagctgggattacaggcatgtgccactacatctggctaattttgtatttttagtagagatggagcttctccatgctggtcaggctggtcttgaactcccgacttcaggtgatctgcccacctcagcttcccaaagtctgggattacaggcgtgaaccaccacacgaagcctgagaatawtgatttgatattataagtgttaaaaacactcaaatgaaagaatttatatttcaaaatctgttaaaaatattctccctccttgatagcctgaggtttyaaaatttcataaaatgacaattaggtacataaaacttaataactataatgctacggtttgaatgtgtcccctccaagttcatgtgctggaagcttaatacctcctctagtgtcaggaggtatggcctttgggtggtgttcaggtactgaaagccttgccatcatgaatggattaatgttgctataaaaagggcttgcaacaacaggttctctctcttctgcacttctgccacttggtgacatgatgttcctccccacaagaggatgcaccattcaaggtaccaccttgaagcagagagacccggctgtaacttgctggcagcttgttcttggacttcccagccttctgaactgttagaaataaatttctgctctttataaatcacctggcctcaggtattctatggtatcacaaagaagcagactgaggtgtgtcatgagcwttttaaagagaagtaacatggtaaatctagaatttggagagagaagacgctgctactcactagtgatgtgaacttggatgacttactagcctacattgaatgagacagtagtttaatagcttagcacttgcctccctgtctttatttttatagaaaatcacacaggttaggatgtttgtgayggagcttgtaaaattataacatgctcatcacatttggggtgtcattggtatataatttgaattccgggacacatgaaaaccttctttttattgagatggagtctcactctgtcacccatgatggagtgcagtggtgcaatcgcagctcactgcaacctctgcctcctgggttgaagcaaatctcatgcctcagcctcctgagtagctgggattacaggtgcccaccaccatgcctggctaattkttttttgtatttttagtagagacatggttttgtcatgttggccaggctggtcttgagaaaaccttctatttttgatccattccttgtgaagtattacttcagccagatgaattttagcagaggtcttgtaattccaggacctcaggggctgggggtaggggaaatagctgggaagtctgtaaagcttctaggtgtgcccctttcaaaggacccccaaggaaatgggtgattcgggtgattttctgaagatttcagccttaatattttagtttacttttgttccccttatttcctcttgtcccttgagaggattccaaccactcagactgaaaacaaggactgtgagagggaagaaacaatatgtacttattccttggacctttgaatttcggagaaaatttttttaaaaccagaagagtcttattttgtgagtccatggacttgcaaaatcttagagttttttcttttttttttttttgagaagtctataaacaccatagaacccattgttccactagtttaaaaaattaagaaatgctagacacttaggttgattccatattttggctattgtgactagtgcttcagttaacaaggaaatgcagatatattcaacatacttatttaatttcctttgtctgcttatcccaggagtgagactgttggatcatatggtagctctatttttgattttttgagaaatgtccatactgtttttcataatggctgtatcaatttacattcccatcaatagtgtgtaaaggttcccttttccccacatccacaccagcccttattattttctaattgggattaagtggtatttcactgtggctttgatttggatttcactggtgattagtgatgttgagcattttttcatttacctgttggtcatttgtatgtcttctcttgaagacaraaagacttatcaatggatgaatggatttttaaaatgtgatatatataaacaatgggatggtacttagcaatagaaatgaacacaatcctgtcatttgtggyatcatggatgagcctgaaggactttatgttcatggaaataagccaggcacagaaagataaataytgcatgatgtcactcatttgtggagtgtaaaaatgctgatctcgcacaagtacagggtagaatagtggttaccagaggctggggacggtagcagggaggaaattatggggagatatttgtcaaagggtatacaattacagttaggtaagaggaataagttctgatgttctataacacagtagggcacccacagtaaacaatattctggtttataaatattatagtgtgttaaaagtaactagaagagaggattcttaatggtctcaccacaaataaatgataaatgtttgaattgatggacatgctgaataccatgatttgataattacacaatgtatatgtgtattgaaacatcacactatccctcatacatgtgttcaattattatgcatcacttaaaaccaaaataaaraataaatataaactrtatatattcataaaattgaatcttaaacttttataaaaatgaaaaaatgctattctaaacaaataaatgaataaattatcttgagagaagtaaatagtctgtgccttaagattcaattggtgtattctccatactctgtaaccacagatgttctaagaaggtattcattatcctttgatattaaaactaagacagtattaatagaatattactacaagcttaggacactgtatctataaccttaggacagcataaaaccaagtatagagataataaagacttgaattaaaccaatggtggtgatatttgagagtagactcaagtatgaaygtagtaagaggttttgtagtgatggwttaaatgtcattttgtctactgtttacagtgttcaacgtgttcaaaggaaggattcatactagattggaaattataatttgaattggttagaaaaatggaatttagtttttaatcaatctttgttgaatgaaaatcagtcatcaggtttcatttattggagakatatatatatatatttaaattttgaacattaaataataaaaaagaaaagatttgctgctccagaacagacccacatttgttttaaacttattattgtaagagcttyagctcctcagaaagttaaaaatcctattgatatttgattcatgggcttgtataagccaaactgagaatatcctgccaatcatacctgtggctaaagagaacatgcagaatcatacctgtgtgctaaacagaacactgattataatcatcaccagatttttaaagtcacttgcgagtamcttccttacattgaatctccgaactttctatttttttccccaagattttcttatgaaatataaatggcaatttgtttttaatgaaatggccatattttaccttcatactttcagtcacattctaatggttggcaggttgatgcatgcrtcctgctcagttgataycttgcagtgaacaagaggaaagggtttcaattctggactctggaatctagtggtctgattcaaygtgacctgctccctcttaggaattgtgtgacttgggcccattacttaggctctctgtgcctctgttgtcctgttcttaaaaacagaaagaaatttgggaggataaaatgggacagtgtaygtgaagggctgaatccagttcctggcacatagtaagcactaatgaatgggagttattattaatcatccaagcaaaggaactcatttcccccctgatttacacataagagtattcaaaaattcatcyagacactgagttccaagcaaattagtaagcttcaaattttacaaatcaatacagagatttcaggtatatgtgacatagattccatttcattacatgcctggagggtcagctaggtcccagcatggcactaggcaagacagagaccaacagttaaaaagagagaggtaattttcttttccttttttttttttttttttttttttttttgagacagaatctcgctctctgttgcccaggctggagtgcagtggtgggatctcagctcactgcaacctccgcctcccaggttcaagcaattctcctgcctcagcctcmtgagtagctttgactacagrtgcacaccaccacacctggctaatttgtgtattttttattagagacgggggtctcgccatgttggccaggctggtcttgaactcctgacctcaggtgatccacccgcctcagcctcccaaagtgctgggattgtagatgtgagccaccatgcacgggcaaaaagagagagaggtagttttctaaatcagccttatatcacccctatcgtttgaaaagaattctgccatttctcttctcttgagcattaccctatcacgaaacttatgaagaacaaacagrtccaacaaatgtygggattctgacaacaaatgctcatcactcatcattatttctcgtctgttttctcatgtgtctattcttgcattacacatttccagcacatgttgtgggcatggcctgtgaggtgactacactggggttgggaaggaaggggagtgtggaagggacggcatttatgaagatatcaagaaatctaatagtggctctgacagaggaagtcctgctgaaattcacgtcagcatccctagaaatgaccaaagacttgttacagctgtgagaaargacaataaagccagtttccctagatccagcaaacgtgtgattatccactagtatatcggcgtgcagacagttcgtggaatacaggccttctagatgtgaatctgaaccactgtttgccctgtctcctttcttgtaggcatacgatggcttaagctccacaatgtcccgccttgccaggacgtgtggaagggagcagctggctaaccccatcgtctcctcaggaaacagcctcttcttgagatttcagtctggcccttccagacagaacagaggcttccgagctcaattcaggcaaggcaagtaccctgtggatcttcccaggcacaagagaaatcttcagtgctctgtttggtgcaacagtgaaatgagacctgtgctcagaaattgatcacagccttctacttaacatgtaaaaaattaaatagaacaaaagaactgtgacttacaattatcccaactcctgatgcttgtaaccttctccttctctgacttcctttggacccgcatctctaacaagtttaaaagtgcttttaagactagaaacagtataaaaaagttttatccaaattcactgatctagcactacccaaggctttacactagaatgggatacactgctatcaattacaagacttgcttgtaatgtattcagatgccagcccctggaagcagtggtttccctcatttctgaatcctgccattgtccaactgaggagtcactgttgttttccatttatttttctttctttgttccctcccytcctcccctcttcttccccttcctctcctccccttccttttcctcatctctstttccctccccttccctttctttccacagggtctctctytgtcacccaggctggagtgcagtggtgcaatcacggctcactgaagcctcgacctcccaggctcaggcaatcctcccacctcagcctcctgagtagctgggactataggtgcacccccacgcctggctattttttttcttttttagagatgggatctgctctgttgcccrggctggtctcaaactcctggcctcaagtgattctcctgtcttagcctcccaccatacctggccatttttgttcttaaatcaccacttctccaagacctttttacccattgcctttcatctgctcgttytaagagatgaaccccttatcccatagtcagagatgacttgtattcagatgaytcagaacattcactacaaatacatttagtctgtgtagtcattatgtctatcttagtcaactcgcttatattctgtagtaaagagctctggatkgggacagtgcctggatcgaggtctcccaaatacgcaccatagacctttagactttggagcaagacagactatattcttgttgattttaaagaaaaactagtttcctaatagttcttttgcatgttattattcacttgtttgttgcttcatagtaaaaagtccctgctagctttcatccggactgtaacaacctcctgaaagtcacctacccttaccccatctctctccaaagtcgcctgtaaaagccctgctctgatcatgccattggaatgctcaatgtctgtcccgtctccacctggcctggagaataaagctcaagctcctgcagatgttaaccaagagccccagaacccaccctgacctctctccagcrtcagtcacccacatccctggggcaccccatgctccagctgagcctctatagatgctcctctgtgtctgctcaggcagtcccctccctggcctcccttttctcaccctccaagtcctagtttagcctcggcctcctcctcagcaagactcctcttacgccctccagcggtgaccgcctctccctcttcaagactcacatcgaattttgctcttctctagtaatctacagtcatccttatgaagccttattcaattgagtatttattttcctgaaaaaaagaggtcatttataagcagattatccctatgcctatgatttatgagtgggcagtgtaagtgaatccatgcaagaattttgtttgaatgacttaggcaattcatagacatttaatctgttgctttttgccacttcctacttcctgtagttgaagaataattgttaaaaatataaactgtgctcctgttttctcatggtttatgtacagctctccttatggagaactttcttggcgtgcattttagaaataagaagaaaaatcattgatggttttattcatcaaataattgttttgtacggtcagtagaaatgaaaagcatatgacatgtatgtgtgtttgtgtgttccccagcctgcggaggccacatcctcaccagctcatttgatactgtttcctctccacggttccctgccaattatccaaacaatcagaactgcagctggatcattcaagcgcaacctccatgtaagtaacaaaaatgaaaaagaaaaggcacacaggagagaaggtgtctgtgggaaggtcagtctatgagtaaccttcttatctcagtgctaacaatcgatggccttcctcttcatcttttgcaagtcccaattcctgatgtgcttaagaacaagcatttcctaatctgatagggaagtcatttctacagttgcttctaaatttaaaaacaatttcttttttttcatktcaaggcctagcaaaggttaaaaamcacacacacgcacaacaacacaacacacctacaaccttgctgtattaacaggcgtatgcaggcgtatgagattgggggtaaaccaaaataatcgataaatagtttttgacatgtgtgccttgagtatagctgatgttcaagacagttgctgagtgaacaaatgaagaagagtcacagactggagaatcagtgactcacggrccagaatgcaatgcgcgcacctatccatcaaagcaaacattcataaaacctgggctctcctgcaaggtactattccagcacaggcctagaagaaacattgaataaacgcttactttcttttcttttttggaaccctagaatcttattttctgacctggtaacagtccgatggtaaggacttctgtcctcattttacagacagagaacatcaggaaatgcccctcaaggacatgacagaatggcygcaaagcgggtgatgctggggcccttctgaatcctgtttcagaggagccctgccctcctttgaggtttgcaggaaaatacagtttcaggcataatgtaggaaagkctttaagttcttcactctgcacagtaattaatcgcctgtgtgaaaatagggaagtcacttaagctaatcaggccatgaaaaagtaatctgcaaaatgaagagtttggcttaaatattctctagcactttcccctgggatgtcaggagttaacaaattgctagtatcttcattgacatgcataagatgtggcagccgatgatgtcatccttagccaattcaaacggggaggtggagccccaaagaaagttgccagccagccagaaactgagctgtagataaagaagccccctcccttgaactgagaagtttgtgcctgaggattattttctaatgagttgtaaagcatttagatgaaagatctcactggttcaagaacagcaataggaaaagatcctattctgaagattagggagcttaaagaacaacaaaaagaaaatgtatccaggtgcttgctgttctgcaagtaattcaaaactttcttgataaatgtctctgaaccttagggcactagctctagcctgaaaataaaactgagtgagctaaaatgtgggctccagggagaaaagaatgccttatttacaagcacatgcaaagaatccgaatttaaggaaatgagtctattgagaaaaatgcttctgcgaggaacacagcaatggtgatataaaaactggaaagacggcattttccaacaagatattcccttatagtgcctggaatgaacctacccaggagtcctcttatttaccactgccagtgtttcagatgccacaggcagtttcaaaagcatctattccgttactcttcawaggaaaccatctattctattactcttcaaaggaaaccatctaggatagaagttgtccccttcccttgctttatcccttcaaccatgtgcaaatccgcctcattcattacttctctgctggagaacccttacatgaaattaccagaagtaaaatttatctccctgtatgttttttwattttaattttattttgtaaaaaaattttattgttaatttttgtgggtacatagtagatgtatatatgtatggggtacatgagatgttttgatacaggcatgcaatgtgaaataatcccatcatggaaatggggtatccatcccttcaagcatttatcctttgtgttacaaataatccaattctactcttttaattatttttaaatgtacaataagttattatcgactacaattaccctgttgtgctatcaaacaggtcttactcattccttctattttttatagtcattaaccatccccacctccccgtcttgccccatctccctgtatgttttatttgccagtactttacgagagagtcttctcttttttcttccagtaaatcatatcaccctctcttttacccactttgaacttgaaagaagcacaacgtgtgcacgtgactttgtagaaattttggatggcggccacgaagacgcgcccctccgaggtacctcagcgttcactcatctacatctgtggtcttggctgtgctttatttatagatccgcatatttataggctgccattctaggttgcaatgtttccaataaatagaaagagcagcctaagccaaataaagatgattagagggtaagaaagcaggcttgaatgtggggttcagggaactcagcctgtttattaatatattcaaacrtgtgaatagtttgtgtatatgttttaaaacatttaaaaattgcagctgctttaaagaatagtggaatgcaacccatcccagcattaggtagcattctatcagaaatttcttgttaatatttgaycaagttcttacattcacatggagtatgtttctttcagccttgtccttagtggaagcgaaaaaaaaagcacttaattagrtaattaattaattaattccattaaaaatctgtctttttgtttgttagacatcccaataaaattaaagagtgccgctatctagtttctgaaatgctctcaggcaaaacaaacaaacacacacacactacacacacacacacacacacacacacacaccaggccatttaagctttctccgtaaatttcctaacttttgaattttgttgtaaaaacttctcatcctgcactagaagacaaggtctgtcagagaggagactgtttggcctgttgcctaattcccagtgcccaggacagtgtctgagacaatagtgaacaatcaatgaactctccacaccctatgcacacctctcacagcatttgttagtaagcatttgaccaaggataagggtatattatttaacaagctgttacatagcaataccttgcgctgagtactgttctcagtatgttataaatagtaggtcaatccttgtaatcttatgagataggtttcattattttcaatatgcccctttttccaagtgaggaaactgaggcaccaagcacgtaagtcacttgcctaggatcacacaactagcaaatggctgagccaggggctgaatccaggtagcctggctccagcatccacacttttctgtgctacaaaatagtgratattagtgcatttatttgtatgggtccractgggctggagatttttgctttaggtacatgtgtcccytggtcatctaagtttttcctctggtcctattgttcttgatcatgtttataaatcacctctcctatatatagctcctatatatagtttattttaaatcatcaggtattgtctcaaacattgaccctgaatgaagtggttctcctagtggcaatttcttcactttgttttggtctcttgtaattcgagtaaagatgtgtttcctagaaacagcggtctctgccatgttgtcattcattctccttgtcattatcttcattatttaggccgttactgtggcaccgacatgccccatcctatcacatccttcagcagcgccytgacgctgagattcgtctctgattctagcatcagtgctgggggtttccacaccacggtcaccgcatcagtgtcgggtaagaaaccctagcacctgactctagcggttaaaagggatgtggtagaaattcttggtttgttattggggactctgaccttcgtagttgggagccagtttcctgagatcacctctgggccaaatcttaccttcttcccaattaagtgatcgtgttgtcaattctagcaataatgaactctggaagtgtggaggattggttggaaatgtagctgtcttttcagctacatgccatgctatcagatgacttggtgttcttttgttgtttttgagatggagtctcacttggtcgcccaggttggagtgcaatggcacggtcttggctcactgcaacctctgcctccccaattcaagcgattctcctgcctcagcctcctgagtagctgggattacaggcacttgccaccacacctggctaatttttgtatttttagtagagacgaggtttcactrtgttggccagactggtctcaaactcctgacctcgtgatccaccagcctcggcctcccaaagtggtgggattacaggtgtgagccacctcgctcaccctggtgttctttttggcttgtttgttaaggcagcccyaacctggggaggagaggaacgaggagctacccaggactgggtttcttagcctcttagcccagagagtgctgttggtcactgccatcttccttgtttttagtggttaaaagctacagaacacctagaagattggtgtgtgcatttcggtgctctactgagagggaaagcaagcatgctgcgttgggttctaggccagggttgaatagaatcctggtcacaaaagccaagtggctgtaggatggtaaacaagtcttttattcttcaaagttaccgttcacaggaagaaacggctttgagaaaagacattgcagaaattccttctaatccaccacactgcatggcccttggtcttcagtttgcagaattgttcccttattttatatgacatgaatgttttaaaatgtgwgatggaaatactatctattcttttacattgataatggctctagcgttctttctcctttrttttatagtgtctgatgcagtctttgctctgatactcactttatttctattttcttccagcttgtggtggaacgttctacatggctgaaggcatcttcaacagccctggctacccagacatttatccccctaatgtggaatgtgtctggaacatcgtcagttcccctggcaacyggctccagctgtcttttatgtaaatccttttttatggtgtattgyttcagtgctaatgaatctgtaggaaagaagttctggtgctaataggatgggcaactcatagtgtacgtgaaatttaggaagtatttttccaaatttcctctgtttcagtcatagtttgagttataaatagcatgaagtttctctcgaccatggttcttgvgtcctgtctaacatttccaaaagtacattcttgagtccttggtgaatgaatgaatctgtggcgcattcatgttcagagtacaggaatcttatctttttttttggaattagacacattaaggttcttccagggaatcactagtattgtttattccagcagagccctcccatctcaattaagcattctttaygcttttatcttatmcctacctcaatccacctttccttctatttctgtcagaagaatggttctggggctggrtgtagtggctcatgcctgtaatcccgcactttgggaggccaaggcgggtggatcacttgagatcaagagttcgagaccagcccggccaacatgacgaaaccccgtctctactaaaaatacaaaaattagccaggagtggtggcgggcacctgtaatcccagctgcttgggaggctgaggcaggagaatgccctgaacctgggaggtggaggttgtggtgcactgagattgagccactgcactccagcttgggcaacagagtgagactccatcttaaaaaaaaaaaaaaaaaaaaaaaggaatggttttggaagtttttttaacttccaaacttaaacttacttaaactttaaacttaattttttagaacactttcatattcctcattgcactataacactttttgaaatggactataaatatggaattagtagtaggatcctatcacattctgagtggtcttagattaaattagacagcawcaataatatgtcctagagtagatgtaaaaagcacacattttaatcaaytgatagagaggtatatgtgacacgtcacactgataatggatgcttattatatattgagagataagatcctgraatttaaattgccgttttgaattgaaatttatttaccagtctattttacatattactaggctgtggttgggattgctaattctgttttgaagcgaatataagtaacttatggttgagagaagaggattgttttgaggaccctgtcctgtttatttaaaagtcttacttttcttccaagacttgctaatctgtgcatcaggaactgattaaaaatatgggacaactatcctatttgtggaccaagttcaaacatctcaagttgctttttttaatccatcaatcagacagagcctcttcagggtataagtggcctygtgttaaaacaaagacaccctctgcatgccraaaggcaatgcaagtttaagctgcctcacaggaaggaggttttggtttgtctttttttttttttttttttttttggagacacagtctggctctgttgcccaggctggagtgcaatggagtgacctcagctcactgaaacgtcgcctccggggtttaagctattctcctgcctcagcctcctgagtagctaggattacaggcacatgccaccatcccaggctagtttttatatttttagtagtgatggagtttcaccatgttggccaagytggtctcgaactcccaacttcaagtaattcacccaccttggcctcccaaagtgctgggattacaggcatgagccaccgtgcctggcctggtttgtctttgtcttcactaagagcacagcgttctggatgggaagaaatctatatactttataatgtttaccagacatatatttattctttcactcaacagatatttattaagctcctaatatgtgctaggcatgtagttggcacatgctactctcctatgaggtgccttctatatattgatcaataaaacaccatcattgtccttagaataaaatccaaagcccttcgcacagctttagtaggcctatcagaattgccaaataaaatgatttttttttttggtcttttcctgtttgtctctaccacattcacattgttgactgctctcattcagtggttgccaggaactgagctaggtgttcaagacagataagatttcaggtcttgacaaattactcataagccaacattaagaagctatttaattaaattcattttatttctgtgggataataataacaagtttctataaacaaatttatagtaatttcaaatttctaggactgtgaaggttaaagaagatgtcaaatttaaaacgcataccacacagctagtgcatagcaaatgtttggtgacttaattctctcaatctttaccatttctgaagtatcttctgtgatagctcacaaataaatccaaacrggcagcactaggctctccttccagaggatrggagattacacacacagaaagcaagtttcatctatttcagtgcttaatagacattacattttaattaccatatagaacatcgtaatgactcagctatttcctttctcgcctgtaagaagttaattttgattcctctgagttacttgcttgagttttatttttaaaatggacgttttaggctgcaagatgcctctttttttgcagttgattaatgagaaggcaaggcctgtgagttatttctgccctggtctaaattctatccagatggatgcttggaaacattaccctggggtgtgtgagagcgtatgagaagcatgtgtatcacatcaagttctaaaacatggggctgggattgtggtgaaactgagtagggaagaagactggagaaattatggttgaatctgcaacaaaaaggaacggggagaaataaaacctaaaaaggagttttttgtaagacatatatttaaccatttattacccataatatgaccaaaaatgtgaatatggtaaattgttttcttctgcttctcagaaagcagaaagggaagaaagggagatcattttcctcagaaggtaaattacatgcagttgtctctaaaatctttctattcaaagtgcagtgcaatctttctgaccagttacttcacccctgcggtttggtgggcagggaattgacagaaattgtattttatacttgcagagtgcttttagaaagtgataggtctcagttcaagaatcagaatgagataataagaaacagtgattgtactatttttgttccacatcctacatttactaacagatctaagccaaagggtgtagttgcttataaaatgtaccagcctaaagcaaagacttccaagcatawtaaagctttttttatagtttaatttaatccttctaggtatttgcctaccaccatgtccaacggaatgtcttttctgccatctagcactggattgcagtagtcaagtacttagaaaagaccttcactttgtaatcttctggagcatcggacagaatgctaatgtgcatgttgatcayctaggatcttgctgaaattcactttctcactgagttggttggtggggccagattccttgtttcaaacaagctctccrgtgatgccgatgttgctggattatgcactttgcatagaaagattttagaggcaacttcgtgtaatttacgttctgaggaaaatgatctccctttcttccctttctgctttctgagaagcagaagaaaacaattttgcgtatttcacattgttgatcatattatgagtaataaaattgagcctgaatgtatrcacaaaagttggcagccatcccaaagatggatttagaccaattccttgcaaaataaaaaaaagattgaagatagaaatattgtgttataaatcatcagattgtcaaaggagacaaatatgtggtttgttttgtctgatgtggatatatcctgatttcaattatcagttatagcttgctgtraaaattccatctagwctagtccagatggtctatactgtagtgacccaccttggtgggattctgagagccaccagcttaccaccaggcttactgatttggttagagacctaccaatgctagtatctggcttgagagctaggttagagcagagctgaccrgttacttcacccctgtggtctggtaggcagggagtgaccagagatgtgcctggtatattgattagtggtagggcttgaggtggtcagagcctccaggctggttatctctaactattctcctccattagctgagatagagccccaggggagcactatacttagcataaagtaaaatcttgccatggataatgttgagcattaacagaaagatacacatgacagagaagtacatttttcctttcctttccccttccccttccccttgccttccgttcccctcccttcccttcccttcctttccyttcccyttccccttcccccttcccttccttttcccttcccttcccttccttttyccttcccttcccttccctttttcctttaccctttcccctttcctgtttgttcatgctttcatttcattggggtataaacctagaagtgaaattgctggttcatatgataatactatgtttaactttttgaggaaccaccaaacttttttatagggatggactattttacattcccgttagtaatgcgtaagagttctaatttctccatatcctcatcagcrcttcttattttctatttttaaataatagtcttcctggtggtttgtagtgttatctcwttgtggttttgatttgcatttytctaatgactaataatgtttgaaaatcttttcatgtttttattggccattcataaatcttctttggagaaatgtgtattcggtttgttttccattttaattgggttatttgtttttaattttcgagttgcaggagttattttatattcaggatactaccttggtcatgtgtttttattttctttggktatatayttaggggtggaatttctgggcattaattggatgtacatttaattttatragaaactcccaaataattattcaaagtggctatgtcagtatgcagtcccacgaggaatatataagacttcagttgctttgcacgcttgtcaacaattgatcttgtcagccttttaattttagcccttatgatgggtgtggaatgatatctgactgtggtatttaagttgcattgctctgatgactaatcatgcagagtacttttcacattcttggtagccattttcttgtcttcttttatgaatatctgttcaagccctttgtccacttttaatttggttgttttttcattatctgtaggaattccttttatatttcaactttgagtcccttgctagataaatgctttacgattatctcccatttccccaccccggtctgtaacttgccttttcatttttttaaatatatatatattttctggacagagtctcactctgttgcataggctggagtgagtggcacgatcacccctcacttcagcctctatctcccaggcttaagccatcttcctgcctcagcctcccaagtagctgggattataggcacaggccaccacacatagctacattttawtttttgtagagagggggtttcactgtgttgctcaggctggtctcaaactcctgggttcaagtgatcctcccacctcagcctcccaaagtgctgagattatggttgtgagctaccacacgcagcctattcattttcttattcatgtctttaatgaaatgtttatttatgaattcaaatttattaattttttatcttgtggttagtgctttttgcattctatgtaagaaatatttgcccatcccaaggtcacaaagatttttctccgtgttttcttctaggatctttatgtttctagcctttatatttacatccttgagaaatattaagttagtttctgtgtacgaagataggcagaggtagaggttctttttttcctctctctccataaggatatycgttattgcatcaccatttgttaaaatgagttttccccttgatttgtcttggcaccatggattgaattggattgacagtgtatttgtgggtccccttctggaaattctttcctattccattcatccatttgtctacccttacaccaataccactttatcttgagtagctcatgtttttaagcagtaaggccaagttttgaaagtactcaactagsacctacatgttccagactctttagatatgttacctatgaacatcatatgaggtagatactatttcctatcctcgactccccaacacatcgtagttgcagaatataagacaagttgaataggtcacattcaagcaccagcgggtgttgttacaaatcccataattttgctgcctctccagaaattaagtacatacacctttgcagcgcatttaagtgccacctaaatgatcccatcatattgccccagttacatgttttaatggtttctttttttttattatttaccttcagccaacccacaccatgtcttagaggtactcagtgttttaaacaaaccaggtatctcgtggttttctgaatatgtcccgcccttctctgcacatgtgccttggtggcatgcttctttgcccaccatctatagtgcttacatccagctcacatgtatatttccatctcaaaaagtcttcccatcaagctattgcagagcaccacaatcaaatatgatgcctctgctttgcaattcttaaacgccactttataactctgatggcactcacactattctgccttatatattttttttctgtattctcgtccagttttgcccactaggaagaaaactccttgatggaagtgtattcgtcgtctttgtagctattggatacacatttcaacaagtccgagtgaaagaaattttttgagacagccaaataatgttgtgatcaaagttaaagaaagtttaaaaaagtgaacgggttaacctagcatgtgatccgggagaatcccaaagtctattctctcaatttaatccctttaaatatttttttcccmaaatcagatctttccagttggaagactctcaggactgcagcagagattttgtggagatccgtgaaggaaatgccacgggtcacttggtgggacgatactgtggaaactccttccctctcaattattcttccatcgttggacataccctgtgggtcagatttatctcagatggttctggcagcrgcacgggcttccaggccacatttatgaagagtaagttgtttctattttagtgatagcttccagaatatgtcttacaaactagaaataataattttctcagtaatatattaagcaagaacaatcctaaactctacactattttcctacattgtctttgtgaattaccttataacatattagaaaaactgaattgcatatgaatggctcaataagggcaagggagagcactctcaatggttctattgttctttttaagctctaatttctacctaatgttaaattagtttttttcatgacgttgtgttagagtctggtaatatattatagtttgggtttggtgtatttatatcaagtgtgtttcatttgatttcataaactctacgttcttcacatttaagacatttagtattactttgggattggcttaagtgctcacatataacaacaataggggattcttctaatagtataaaatgttaaatatttttattctctagctcaacttttccattattggctatttcatatgtaatttcaaactatcagtttttcttgtaaatttctttaaatgttccattcttttgaaaaacaaagtaaaatagataaaccaaaattagagagtggggctgctcaccccaccttcccatgtccccaagtcccctaggggctcagaaccccttttcacatgggaarttgtggcctcttttcacaccatgcaacgttttaaggaccttttctaaggaagtgatagcccagaaaccaaaaaggaggcagtatttctttccctagtcagaaaagaaatcacagtcaattaaaagtccatccttttcaacaccctttgccttttgtttttttcatttgattaaagagcaattctaagtgggtctgatttactactctgtcttccctcctagtatttggcaatgataatattgtgggaactcatgggaaagtcgcctctcctttctggcctgaaaactacccacataactccaattaccaatggacagtaaatgtgaaygcatctcacgttgtccatggtagaatcttggagatggacatagaagaaatacaaaactgctattatgacaaattaagggtgagtttccacatgcaatcaatgttcataaatattrgtgaattgctattggtaaaaataaatccaaggtaacgtctattcaagcatttgcaaatcatgtgggatagtctgctctaaatcatgtttagagcagactgcctctagattacatggacaaaggcaatttcagtattgtatttattattttccatttcatatctaaggggttttttaggattattataattttcctgttgagctttgtctaagcatgcatgtatgtcctaaataagtatttattctgtcttatttcctactatcctctttgtttttatgttagagtattaaaaattttaatgatcatataaaaataaatataaatataaaaatcatggtgatcattgctatccagacattggctaccatatcarttccagaaacacaatcggatgcttacaggctatgaccccaccttattcatcttggattcttggtcatgaatagatcccagtgcctgatgggtgcccaatatgtatgggaatgactattacataatttgtttggtrgagtattttataataactgttcatatgaatttgtcctgagctatttaaaaattatcacagaatatgcctcaaaataggtaatttgagattttaaaaccaaaggtaggagatttactaagtgctttgaacatggtgagccctacaagttttggctattttgttgtcattaattcttctttccttctgtggaaatatggactcctttaggatacctgtccactttctctcattaaagcttttctcttcttgttattttcccttctttcttcctaattcctccctttgaagccccaaagcacatttattaagtactgttggtaggcaaccatcctggttcctatttttccatccacaaattttactgtaaatcatcttatgagtgattcccacagtgcatgtttattaatataattctgcaacaaagatgcaaatgttttcaaaacattaaattaccttcaataatattttatattctctggcagtatgtgttttaagctaaaattaaatgtttactcatttgtcatttttttgttatgataacattgtaataatataaggcatcttttttattttatctttttatgaagaaaaatatagataatacaatgctctattatctgtttttatgtacagatctatgatgggcctagcattcacgcccgcctaattggagcttactgtggtacccagactgaatctttcagctccactggaaattctttgacatttcatttttactccgactcttcaatctcrgggaagggattccttctggagtggtttgcagtggatgcacctgatggtgttttamctaccattgctccaggtgtgtttggtaataaatgaagttmtttttaggactgatatgtgcaggccaatgtttcaaaggatcctatcataacaggggtcagatataaaaataagtacagccccaaagcccttccaccatatgttcagatgttgttttaaattcataaacactaccttttgtagaaattgtacgtttctttctaaaaaatgcaggtcccattatatwktttatattaattaggggcttgatatccataagatcgtctacttacaatttctagagaccactttagaaatccctgaaaatttgatttgcagatactacacatgtacattcacacacacacacaatcagttagttaaggatcaactcataaaagtaactatttttcctctgcattttatttcaaatgtagcttcagaaatgcttcagtttctccttagctggttgtaaatttccatgtttcaaagtaaaatgggccgaattttaaacttttattttacttttttacattcctaatcccctcagtgaaagtgatattgagctagcattgtttggggagacttttttcttgaaaaatttttaaatgagaccgggtgcggtggctgatgcctgtaatcccagcayttttggaggcagaggtagacggatcacttgtggtcgggagttcgagactagcctggccaacatggcaaaaccccatctctactaaaaatacaaaaattagctgggcgtggtggagcgcgtctgtagcctcagctactcgggaggctgagacatgagaattgcctgaaccaggaggcagagtagagtttgtagtgagccgagaacatgccactgcgctccagcctgggcgacagagtgagactccgtttcgaaaagaaaagaaaagsaatttatttaaatgaatttgagcgtttcttatggatttcaggattgacatagaagaaattaatcagatatttcttggaggatattctaagtccttgaatgcttgattggaacacagaatcacggtatctcattgaagaatattcgaactctgaacttgttctatgacttaaaagattagcctatttgcttctaacttcttatatcagcagaagtcactaatgaagataatttgtacttatatttatttaatgtcccttagtattccattctgaaatgttgttcytacctctctaataaggtgctttcatgacactgaatacaaatctcttacttaaaatattgatctgtctatctaagagcaaagaaccatcagcaagactgacaaatgcaatttagaggcaacatttaaatctggatggatatatccagagctcttagaaataaacttgagttaagctttcttttatatttacaaccctcaaggtagaaaaggaattatttacttgtgtaaaatattataccaacaaattttcttctaatattttattacgaaatttcataattatatgatgtaagtggacaggtgaagaagagagccataaaccttatttttcttagtcaagaagaaaaagaaaaaaggaaagtaaggggtcaagagaattttagagtttactaattatctagatggcataagtgattatcctgtaatgataccacactgtgaaagtgtcattaaaacttaaaaaaccttaatattttgaaatatgtcaacttattgagcattgtcctatcagtatttctttctttttttttttctttttttttttttttttgagatggagtctcgctctgtcrcccaggctggagtgcagtggcrcaatctcggctctctgcaagctccgcctcccgagttcataccattctcctgcctcagcctcccaagtagctaggactacaggtgcccaccaccacacctggctgatttttttgtakttttagtacagatggggtttcaccgtgttaggcaggatggtctcgatctcctgacctcatgatctgcccacctcggcctcccaaagtgctagaattacaggcgtgagccactgcatccgtcctgtcctatcagcatttcttatacacacatatatttattttaaatcaacgcatatttattgagaatttattatggatacactgagaagactaagaaaggaaaatgaggtacaatctctactctccaggagcttaaaagtaatgggaaccaggcacagtggctcatgcctataatcccagcactttgggaggctgaggcaggagggttgcttgaagcccaggagtttgagaccagcctgggcaacagagggagaccccatctctacaaaagattaaaaaaattaggtaggcatggtggtgcatgcctgtagtcccagctactcaggaggcagaggcaggggaatcacttgagcctacatgctgccagtgagcagtgatcatgacactgcactccagtgagaccctgtcctaaaaataaatacataaatagtaaaaataaataataaataaaagagattgggaaagaaaaaacactcatatgtgagttaagtaatggtatcgtaattaaatgggtacatgacaaagcaaatggtaacagtagcaaataagcaagggaagaaaaatgagcttactgtggactagggtcaactgaaggaaattcaatgtgtcaagtaggaaaagcagtcagtgtgtcagtcaggaaaagctcagccatatggcggtaacaaacaatttcaaactcttaggtgctgaaaacaacaggtctccttctacatgttcctctcgtgttaactgggtgcctctcatcatccatcacttcctaactcaggctgttggagctgccattgtctgcgatattgcctgagaccatggcagtaggcaaaagagcccttggatgtctcggtttaaaagtgctcactgtaaagtaacacatgccttttgctcatagttcattggccaaaactggtcaaatggcctctctcagccacttgcagaatgcagttctaccatgtgtttggaagtggagacaaaggaaatatytggcaaacagcactaatgacccacagtcattataaccatattttacaaattcaagataagaaatatttcacatagaggaaaaccttaaaatttgaagatactggataacattcagcattcagattttccatgtgaaattgctttaaaaaaatctgtagcctacatagtaatagggtaaagaaatcaggacctagttctacaacattttatattcacttcctgttggccctgataagattcaaacatattatggtgtacaagttgtaaacttctgaaatggtgaagattggatctctgaaatatattgctacataaaagtgatggcaaaaataattgttaaaatcaactttttgagaactctggaaatagaccaaagccttatagcaatctgyggcatatttattcaagaaaaatcactgaatctaagtaagagtcatttttgtggcattctcttcctattcccatctctctctctcctcctagctttgtagtagcctcatgaccacagtagctgtgaaaatgagcagctttaacagctgtgggtggtggggccgcagaggtccagaaaacagcgcatctcctcagcattgccattattccagttcagcaacttcctggaaaactgcattctcaggtcttgtcttcacaggacctgggcaagagctcactcttttgtaaacagccctgtccctggggtctttgccgaaaacaatcagcaacagctgtttcacatcacaaccgtgcaaggcagtgacaccagttacagctaatgagaaactgaccagtaaacttgaaaggaaaaaatggggaaggagatgcccactggggctttgaaaagctccgacatgtttctggaaatctagaaggccacacacatagcccagctgtgcacatgcccaaaaatagaccccgagaaggacctaatctgtcaactcaaaattgcctagatataaattacaaaagtaactacgcaaaaatgataaagaaacatgagaaacacaggaatgaatacagttctacctcagtaatacaggggatcctctacgtgtctttattgatgcctaaatagtcagcacttgatattaaatgggttatatagcaaaattatggtgaaaatggagaacacaatgcattttttttacatcaaagatcaaytgcggaaattgcagctttccgaatcagtgggttacatacgatattcattgatttctctgagaaattgtttcaattggttgcttcttttcagtagagggctgtcactttcaagtgaaaaagtgctagctagcgtcttttccattagggctgtgtcaaagatgttgctttctattctacaggtgcttgtggtggcttcctgaggacgggagatgcacccgtgtttctcttctccccgggctggcctgacagttacagtaatagagtggactgtacgtggctcatccaggctcccgactctaccgtggaactcaacattctttccctggacattgaatctcaccgaacgtgtgcctatgatagccttgtgatacgagatggtgagaayattataaagaatgctgagtttcaaccctgacacataattagttctagtccattatcatcagacttgcatactgcctccatccgtttggtttggaattacacagatattatggtcaaggaaggcatcagtaccagaaatggctacaacttctgaaggacatagaaagtattaaattaccggtcacagaatatcaggaatagcacatttctataaggaaaaaaggcttttttagaggcttaagaaggaaagaatagtctgaatgtcaacattgttcacctgtcctattgagatacctctgagataaatattgatattttatgtttctggctgaaaaaaatacttataattgtaatgtgactggacatagtggttcacaccataatcccagcactttgggaggtcgaggagaaggatcacttgagtccargagttccagaccagcctgggcagcagaatgagaccctgtctctaaaataataataagaagaatataaaatagtaatgtattcatttctctttgtcccctgaatgtgggtagaataggtagagttaaggggtgatattgttgtattctttcctttgtacacaggcatggtgttgctatgtgacataaagttagagacataaatattgctgatgtatgccttatacaaaattgggcttcacagtctgcatggactggaatgaaggaggacagcagaaaggccacatcctccacgtcagtatttctcagtgtggcccccagatccacagcatcatttgttagatgtacatgttctcagcaaaaagaaacgtgtttgtctttggcccacaggttgctagtgtgcaagatcttgtctcccttatccctgatccctagacccctgccgagtgagaaaaatcgaatggtgaaggtgctttatgtcccttctgtagaggcagaacactaagtagagactcaaatcratcatacacacatgatgagatgtcaaagcatgacactccccctttttcccatcagcaatcggctatcagcacgttgcacagaggagtatcaaagcaccagaatgccctcttcacatctaagccttcctgtgcatactgaaatttaaaacttttcatgtaatggaaaggatgtgcatccttgcacacatattctagtgttcagaacctactagaagttttaaaaaatatctttgaaaaaaatcttaagtaggtaactgcatctatgaagtaaattatggttattcttttaaaatcacattccattgagttgtttttgttccatcactaacttctcttggaagcagagagtctggggagcagtccttttttcctgtgtggctttgcacaggtcacaaagtggctccaaacccsttctacctgtgagatagacaaatacctccctcacaggctttttctgaggattaaggaaagtaataaatgaaatctttttagcaaaagtacaagcattttgtagatgatgaatttggaatagtttagatttcagtttacttagatggaaatttctaagagaggtttaatcagtgcccttgctcaggcacagggcggcttgaaagagctaaagaaactcaggtgcgtgccaaaacaacacaaatgttttaaagtggttatgcggcctttccgtatggattcctttttatgcactggcaatgtgagtagatgctcaataaggttccttccttcctcatttgtttaattatttattcaagaaatagttattgagtgcctrgtctgtgtcagttggtgagtattgtagtcatttacacattgttaatatatttttatgactaaatttgatgtttttttttttttgagacggagtctcactcttttgtccaggccggactgcagtggcgctatcttggctcactgcaaactctgcctcccgggttcatgccattctcctgcctcagcctccctaatagctgggactataggcacccgccaccgcactcagctaattttttttttttttgtatttttagtagaggtggggtttcactgtgttaaccaggatggtcttgatctcctgacctcgtgatctgcccaccttggcctcccaaagtgctgkgattacaggtgtgagccaccrcacctggcctatgactaaattttaaatcccacttcaattatttgttctttgcccagccagccttttgcttctgagtagcagaagcatgtaacattctgaagcaaatatctaaagccaactggccacagacaaagatacttataggctattcctgctcatgcaattggcctgtcatcacaggcctttggccgtatggaggctgtgaaccttcctgggctaccccagagagggtcatgcagcattcttgggagaactgagtcactgtcccacctgcttattcattttatagagttgccatggttcaaaatgaatcagtttcttccagaccacgcatctacccattctgtataccaaagatccctccaaactgagagtccatgaaactacattggtcctagcaaaacttttaaatagaaaagaaattgtataaaaaaatcagtaatcctttaatctagttccagatcttaagtgtactttcttcatgaccttagataaatcatttaatagcatggttttggggcatctgaggttaatctgcaaaggttaacatcactgttaacttctatctctatgcccttgcatacagcaaagtggcttgtaactcctgtaagattcagttcytcatatacaaaatggggataaaaataaatgcccacctaatagtgtcactgtgaasataaaatcagatagtacatgtgaagcacttaaaggggtatatastaattgctcaataaatgtcagtcttgaataatcttggggcctcagtgtctatatctgtaaattgaagaggttggactagagaaagaattgccaagttgccttctagtgctagcctttactgttctttgacttcccctcctctttaaagattaggctcaagattaggctcaatctttctgcaatctatatgttgaggttttggaaggctccagaaataccccagtactcagtatgaagactgaaggggtggaygggcaagtaacaaaccatctgtgatttttgggtcatcttcccactaatgagtaggctaatcaacaagcacttattttgagataagcattgtttcaccagatgatctggagtgaattttagaaaagaaatcaaaatcaatagactcaactcactttcatccagtgataaaatatacacgtgaactaataacatataataaacttcaaaattttgtagtacaggtaatcagagaataagtcaacaaaaaataatattgggtgaaatgtgtagcaaaatagcataatgaagtgcacttactataaatgcaaaagaaytataagagatacacttttgaattataaagaatgcaaaagtttccagcgatcagaaaccctccaaagaatgccattttgagcattttgtatttataactctgccattacatttgtaatcacaagaatagaaaataacttattttctaaagtggttaataatgaatgagtttcaagttgtagtcagtgccacaaagaatccatgtggctggttgtataaaagggcatatttactcatgtctcatattctatttttgttttttataaactcgaratttattaattctctgccttaggacaaaagagaaaaaaacaacatattttcccagccacggcatccaagtctgctataatcccctttgctccattttggtttcagccggcacaggggctttgatcaaagcttatatccaagataatcaagatgaaaggagacgtgtggtgcccctgctgtcctttgtgtctctgtgggggtggggcacagttgctggaactcttctctcaccctccacacaaatgtgtggttgtttttataccaaaacaaacaaaagcaatgaacaaacacagatgaaaagttttgtttaaaaaaaccccactggcactgaagaaagggcacatacaattgcataccttttggtgaatgatattgtaacattagtgtaggatctgaggtcaaagagccaactgtttttttttttcttttacctacttgaccttcagcartcagagtaactgaggtcagagtctctaatcgacagacatatcatcactgggtctccatcgcttcccaatcccaggtactctgattttgagttttagtgacagggagaactggcagccagtttttagaaagacggtggaaactgtcaaagacgtctttatcaaaaagggtaaagaacccagcactttgggaggctgaggagggcggatcacttgagatgaggagttcaagaccagcctggccaacatggtaaaacccctgcctctactaaaaatacaataattagtcagaagtggtggttcacccctataaaaccagctactcaggaggctgaggcaggagaatcacttgaaccccrgaggcagaggctgcattaaaccgagactgtgccactgcactccagcctgcgcaacagaggaagactccatctcaaaaaaaaaaaaaaarrggggggtggggtggggtgggggtaaagaaaagggcaggaagcaccattgcaagctggagccagaatgatatcacccctgaggggtccttctttttgaggatcccattatctcctacgagtcctgatgttctgagaaaaatgtgtgagctgctttggctaagctgcaaatgattgtagagtagattctcaagatgtattttcatgttgttccctttctttcaacgtaggagataataacttggcccagcagctagcagttctctgtggcagagagatccctgggcccatccggtctactggagagtacatgttcatccgcttcacctcggactccagtgtaaccagggcaggcttcaatgcatcctttcacaagagtaatgagttcaaatattttttaatcccatgttatctcatctcctctcttttcctctctctttctctcttcctaatataatgtttttgggcaccaggacacaagacaagtcagaggacatgggtctctgcccaggctctggatggctggctccccttacatcartgctgagtcctcatccaaagcactggggccaagtcgtacaaaagtgtgctgccttcaggtctctggtgkggcatcttcgctccaaaggaggtgtgtccagggaatgcatgagagagagctttaaagcaatttttcagcctagctgagggctggaactagatagagcacagctcatatccataactcatcgaaggagcaaaacgtcatcatttattctcataaattacttggttgaagtcagccatctgagggttggcaggaagagtttgttgctcttgaaatatgaatttgatgagtcaaaagcrggcaccatatatgggataccatcatgcacagtatgattgagacttttcaaacttgacatgtgaagtccagtaacagccttaaatccaaactaactgaaaggtgataaagtagtccaaggaagagtgaaagactctcatgttttgatcaaaaaacataattttaaagtagattctcaatctaacattaaaaattaatctaatatttcctccatgcttatatataccttttataaagtagggagcaactgaagataagttgtgttcctcacgctcaagggaggcaggctgcatagtggcttaagagcatgggctttggaactagacctaagatacattttcacctctacaatttaactagctgtgtgagatgtctgcccttactgatgagcttctrgtccctgacaactggagaattaatgcctcctccttttatcctcttcctttatctcctgccctctcactctcatgtatatattactatgtatcgcaactcattatacatacatacatgtatacacatgtatgtatatagtaagggtggaaccattggaattaatatgtgtgtttatatatgtatataatatatataaatatgtgtgtgtrtctatgtatatatacatacttggcagctcccggtctagaatgtatttcaaatttaacctgtgagtggtataatggactttggagactcagaagyggggaggatgggtggggtatgagggataaaaaactacatattaggtgtaatgtatactagtcagggaaccagygcactaaaatatagacttcaccagtatgcaattcatccatgtaacgaaaaaccacttgtatcccaattagaytagatagatagatagatagatagatagatagaaaaaaaaatttcacctttgaaagytgaacactttattcccacccttttccatgccaccaccccccaattctacactcctcataatctcagcaaatggaaagtacatttttctcattatttaagtcaaaatcttgatgttatttttgacttttctgtttgtctcacacttaaccatcaacaaatcacactggctctaccctcacaatgtatctagattccaaccacgcctctccatttctgttgctaccagcctagcccgtgcacctatcatctctccttggcctcaggcggtcccctccttattggacactctgctcctgtccttccctgtcctccaccccttacagtctaaggactgcacatagagtgacattttcaaacttaagtgagatcatgccattctgatgcccaaaacccttcaacatcttcctcttcttattcagaataagtcttttcagtttcctgcatgacctagccatgctacctttggaatctctcattctgcctcatccattctgacttccatgatgtacctctaacacatcaagcctttacactgttttctgaactggaatgttttctcccccataactatctggcttgatcsttcatttcattcatgtctctgctaagatgttactccaatgacgtggcttttctaacttaactctaacaataaagtacccttctccctcctctcatccatttttctttatagaatttatcaccatctcacatatcatgtatttgtttattgtatgtcttccccakctataaagaaatctttatgaaagcaggtaatttgtcttgtttacttacctctgtatcccagatctcaatgaccaccacaaactgagtagccaatagcatgtgctcaatacatgcttgttatgataatcatttcctgcactctggctttattttcaagcatttttattgcctccactttgaaaaccccccaagaaaactaagaaagcataaaaatccagttgccaatgctatttaaataaccgacctttgtttctttgtgggaaggctgcggtggatatttgcatgcagacagagggatcatcacgtcccccaagtatccagagacttacccatccaacctcaactgttcttggcacgtcctggtccaaagtggcctgaccattgctgtccattttgaacagcctttccagattccaaatggagattcttcttgcaaccagggggattacttggtggtaggtcttgctgctaccctttctaattacattttccatagacttcattcagaaaacaaaatgataatttttctctcctgggacataaatggataagaattgcgtactccttcttttgcaatgtaaaggagttgatgmaattttaatttgtctttccagctaagaaatggtcctgatatctrttctccacccttgggaccccctggaggaaatggtcatttttgtggcagtcatgcttcatcaactctgttcacctcrgataatcaaatgtttgttcagtttatttctgatcacagtaatgaagggcaaggatttaaaatcaaatatgaggcaaagagtttaggtaagtattttcactgagaattatatctgcttttcctgcaattgcttgatcttctttgatataaaattttcttttctgaaccaacagtaatagaattaataagaatgcctactctcaagtacttattatatttgatacattcaatatctcatcgtgactacttttcaagtaaagtatcattatttccattttaaagataaataaaatgaggcttggacttttccaaggccacatacctaattagtgaccaaagtgaaattttccatgagtataaaataaactattcttcttgatccctggaattccttagacctttccattataagatgtctaattgtaagttaattctagttacagaaacattataagacttacatttgccttattttgtaataatttgtatgctgttttcaaaagaacacataattttttgattctattattactgatttaattatatattacatgatatcygtaattgcttgtacttaattacacttgattataattgcatttaattctactgtaatgatttgattttgatgacatttgctttttagtaatgtttaattgaataaataaataaataaataggcatcacttcaaaaaaagggagtaatgtcagtagaaagtaatataataataaatttttcctttgtcccaccagaagttagataatatagatttcaaaatgatcctatgacttgaatcccagattcatatatatatatatgtaaatgaaatcatatgttttattgcacattgtatgagatttaaagtcaacatggtttctttattttggtaaaagagatgaataagagtcttcaccaactgacacacaaaaataagcaaatagcttgagtaaggtccagaacaccagggaaggagctttggtcacttcccagagctctggcacaaggagggagctttaatgcagctctgtgggcacccgcgccattgctttctaagctgggaccttctcatccctccatctcttgatgctgagctttgcagctgagtcatgaatgggcagttttcacctggtaccaaagcatttcaagagtagcagtgtcctgagtctagtgagtagacgtcagcccatcctacccatcctacataactctactcttttgtttttgtttataatagactcagtcttttttttctttcttgagacagggtctctctgtcgcccaggctagagtacagcggcatgatctcagcctactgcaacctctgcctcccaggctcaagtgatttcctgacccagcctccctagtagctgggattataggcatgcaccatcatgcccagctaatttttgtacttttggtaaacatgggatttcaccatgttgcccaggctggtcttgaattcctgagctcaggtgagccacctgccttggcttcccaaagtgctaggattactggagtaagccaccgtcctcagccaatagactcagtttgatttatatttttaaagtcaacatttagtggtaattcagatacactaagagatacactaagggtgtgtttgacattgcacctcttctattcctttgtggattcactgttcatgcaagtatggttatggccattactttctccctgtctttcttgaagcttattatgactgctgttaacatcagacttaaaagtcttttgatttcacaacctgttcttggcaacctgaaacaacagcatcactgttatttctctctacttaccaactcaagattgttccataactatagccagccttctacttcccacgtctatctggctatcttcccaccatatctatttccatgccactcccacttctcagcctttaacctaggtccttttgtgaacattttttgacatcaaatcacctagttttataccatttttctccagagacactccttcrctrtggttgattgagatttctaggaccctgtggtagatgccttttattctcacctgattaataggcctgttaattaattagtcaaacatttacaaggtgttycacatcatgcaaaccaccgagttctgccaaggagttcacagtgtggtaraggagacagacaagcaaaggcacaattagaacatgatataaggctgggcacggtggttcacgcctgtaatcccagcactttgagaagccaaggcaggaggatcacttgagcttaggagtttgagaccaacctgggcaacatagaaagaccttagttttcaaagtagctgaacatggtggcgcacttctgtggtttcagctgctcagtaagctgagttgggaggatcacttgagcccgggaagttgaggctgcagtgagccacgatcataccactgcactccagcctgagtgacaaagcgagaccctgtctcaaaggaaaaaaaaaaaaaaagaacatggtatatggtataataagtgctagaaagaggaatgcacagaacagaaacacctacttcagcccaggacatcagagagggttccaggggaagtggatgaagagatttgcccatcagtgataaaaagatgtgaatgcatagaaartctcaatgttacaagtcatattcaataatttgaaagaattcactactgctagagatcagagtcaaaaagagataaacataatagtgatgaagcaggcaggaatcactctgctcagggccctggatgccaccctcagttagttaagatgttaatcaaaaggttatgggaggcattggaagtttttgctccaaagcctgaacagcgtgatcagattaaaaacactaatgtagctgcaacactgaaaacattggagayggggaaggctgaagagagagagaccagatgaaagagtaatttagggaaaaaatttactccctgaactaaggcaatggcagtaagaaggtaggagagagggcatatcaaagatattataaatacaggattgagtgaatttggcggtcagttggatgtgaggcaggagggaagggatgggaggagccttaggagcagttgttaggtttttggctgggtggatccattcttcccacagacatttatcaagaactttccatgggacagacactgtatcaggccccggggatgtggcagtaaacaaacaaaatccatgtcctcatggaacctaattctagtgttaagatgcagacaataaataagtaaaatatataatatgccatatggtgaaaggtatcaaggagaaaaataaggcagtaagagtggatgcagagtgtccataggaagaggggctgatgctgtcatcagcagactcaggtatggagctctggatgacgagcaaatgagaatgttcatttgagacaagttcagtttgaaatctctgaattacctccattggagatgcccagtaagtggtcggaacaggaatctcgaggtcagaacagggatctagactgaatctgtaaatacggaataatcaacagactgcttatcatttaagtcatgaggatgtatgacagcaattggggaattattcagagtgagatgaaaggcctacaggaggattcctgagggcctccagcaatgtcagggaagccctggagagatgcgcccaagggccagaggaagaatgacatgaagagtaaaaggaggagaagagcttggtgtcagaagccaagggacaaaaatgtaaagaagaacagtgtgatcaactgtgttaaatgctgtggatataaaataagaatttaaaaagttctttgggcatataactgtgaggtgacttgggagaacatgagtgctttcatagggttgaagaaggaagggcaaaaagagagaaggagagagacagacagacagatagggagagagagattaaatagggcaagatcctggaggagacagtaggatgggaacttgatccagagatacaggaagttaatgtacagagggaaaaatagagtgtagagatgcagattaatttattgaggatagtaataaattaggggtaacaaatggaagagattctcatctgatttcttctactttctttgtaaagtggagcctaatgtaatgtgcttagaatcaagaggaaatggggaaagtcaagggcttagggagtaaagttccaaacagccattgtagtttatatgaaaagtaatgggtgaattgcttggctgtgttgagatgggagaacatatatttgcaggggcatcaatttccwtgaatgaatggcttgaattgaacacaaccacggagttggtattttgcaagggaagtttgaaggaaagacacgaagcragggagttggagctcatcaaagggatttgcaatttagagtttcagagatgggggagttggaagtatgacagaattcaggatgtgactgtaagtggatgagtgacagtggacacaaatgttctagagttgagcagatcaagtatgtgtatggctaagtgattggacaggttaatttcattggcattgtaagtacttttactcctatctggtttgtttgttgaaaatgccaaagaatatttattgataatagaaaaatattttttgataatgctttggttttttagaaaagaaatattaaaaagctcctttatcctctggcataacattactaataaattatttcattccattgatcttggttctcaaatgcatctaaatcctgaagaaatstaatgaatgaatgctccccgagttgtgcaaagatatatctgcttagtcttttaaatataccaagatcatagctctgcatcattctgctgtactgaatgctcagtgggaagctgtaactgctagcatacttacatgcttatcgaagtggtggatatttattcatgcttctgtgatgttctgccccgtgcaccatgtgccataatcatttggttggctttaagaaagaatgaaatttccaatgagaayagataaatggtctggcaaaataaaaagtgtcacacctcgtagctccctcgatagcaaattgagaatttgtttgctggaaaagaaaatgaggatcataacagatgaaaggaaatggagwcaaaatacagagaagtcgactttaaaagatgatttgtggccattgactgcatccccttcaccagatcatagactgatttaagtgtgtttgctcacagcctgtgggggcaacgtctacatccatgatgctgattctgctgggtatgtgacctcccccaaccaccctcataattatcccccgcacgctgattgcatttggatcttagcggctccaccggaaacacgcatacagctgcaatktgaagatcgattcgatattgaagtaacacccaagtatgtcacttccattttcatttttttcctaccccaagttagtattttttaaccgtcatgtctcaaaacagtccatttctttcagtagcacatactgcaaggaaatctaggggaaaagggaaatgcttaatggctcaggcctgaaaacacagtcggccagccactctcccatcagctgagccggttatgtacgtggatactgtcccttgtgaccctagacacttcctgcaagggacactgagggtggctacttgagattgatgttatccattcttcctcccacaggaaatatatcatgtttctgatagatgaatatttatttgaccagcctcatattcggtgtcacaaatgataaaatgtctgtttaacaaatgggaatttgtgtggtgtgtcaccaggggtcagcactgtcggaacagtactaaagcatgcacagtataatttctcagtctttatttaataagagttctgaaaggattacaaaacagtaagtcttactatgttgaagagaaagaaaaactatattgatcgtagaaaacatttttctctttccttgaacaaaagtatgtatacatttgcatgaatgcagctgtggtgcaaaacttggatataagatcttctgttgctatttctggcactgggtctaatactacttttccactcatggagcattaattggctaatgtgacttcctgaagaaacgttagatacatgcttatctacttttatggacacagaaaattccagttgggacgctccattagtcccaattacagagctgttagagaatttatctttgtcctgtgaaatgtatcaagtcattgtgtggaacaaaatatttgttgttttttgaaattcctagggactaatttgaaagcaacatttatgtttgtaaaaccaatacagaatatggaagggaagtaaatattcttgaatgtagaacatgtaaaacctgtcttttgagctactaataaaagaatgtattattaggaaaaatatcatacagcattttaaagtgacatggcttatgctgattctatcatagttttttatgctaagaaatgatgatttaataatatcttcaaagaaagtaagtaaggttgtcattatcaaaataagcatctgaccatgtaaatttaacagaattttgttcccacttcagctgtacttccaactaccttgagttgcgggatggagtggattcggatgcaccaatactttccaaattttgtgggacatctttgcccagcagtcagtggtcctcaggagaggttatgtatttgagatttcgatctgacaacagccccacacatgtgggattcaaggccaagtattctataggtaataatttttttaaaacttttattttaggttcaggggtacatgtgcagatttgttatataggtaaattcgtgtttgggggtttgttgtagagattatttcatcagccaggtactatgcctagtacctaatagttattttttctgctcttctcccttctcccaccctccaccctatcaaatgaaagaaaattccgtgctcatggataggaagaatcaatattattaaaatggccatactgctccccaaaatttacagattcaatgggattcctatcaaactattatgacattctttgcagaactagaaaaaactattttaaaactcatatggaccccaaaaagaacccaaatagccaaggcaatcctaaacaaaaagaacaaagctaggggcatcacaatacctgacttgaaactatactacagggctacagtaaccaaaacagcatggtactggtacaaaaatagacacatagaccaatagaatggagtagagagctcagaaatacggtctcacacctacaggcatctgatcttcaacaaagctgacaaaagcaagcaatagggaaaagattccctatccaataaatgatgctgggagaactggccagcagtatacagaagattgaaactgtaccccttccttatatcatatacaaaaattaattcaagatggagtaaagacttaactgtaaaacacgaaactataaaaaccctgggaaacatttttatattaaataagagttattatagaatgaatatgttaaaacttttttaaaaaccatgactttttaaaaataagtctatttgcctaattttaaaaatattttaatgctagaaataagtaakgagtgtaaatgtttgaaactacagtcattaatcaactttaatttctcttttaattttcattttaaaaagtaatcttagtaaacttaaatattttatattttctctaacttatttgtgaagaaatatatgtggttaaatcaaactcctgtttcttcagcttactatgaaatacagtagttctctcttatccatggtttcatgttccatggtttcaatgcccttggtaaacagaggcccaaaaataggtgagtacagtacaccaagatattttgagagaccacatttacataacttttctaacagtatactattatgattcttctattttattattagttattgttgttaatctcttatgtctaatttatacagcaaactttatcataggtmcatatatagagaaaaaaacagtctatatgtctgtatagggtttggtactatctgaggctttaggcactcactgggggtcttggaatgtatcccccaaggaaaaggaagaaatgcagtatgtttattactttaagtaataaaaccatttaagaaccagrtaactctatttagcacagtgtctttgaattcctcatcaaatataaaataattaaccttttttttctctgagtctctagtgccaaatcagtcactggataaaaagcaaacatgtcagtggggcatggtggctcatgcttgtaatcctagcactttgggaggctaaggcaggtggatcacgaggtcaggagttcaagaccagcctggccaagatggtgaaaccctgtctccactaaaaatacaaaaattagccaggcatggtggtgggcacctgtaattcctactactcaggaggctgaggcagagaattgcttgaacccaggaggcggaggttgcagtgagccgagattgcgccactgcactctaggctgggtgacagagcaagactctgtctcaaaaaaaaaaaaaagaaagaaaaagaaaagaaaaaaagaaagcaaatatgcctcttcagcattttgatttccttatttaaaaaatgagcggttgaagattcactataatatggtcacaatagcacataatttggtatctaataggtttagacacaaaccaaacaaatatttaataccgcgaaagttcagaaagcctagtggtaacaatgtttaactacaccatagatcgtgttatatcctgagtcaagctgcatataattcaattagctatcacacccagctaataagacataattgaatagtaattttcaaggccctgagatatcagttactgtagtgaactgtttagttgagagtaaaactaggaatggcaggtgtccccacagtaccccttccagctgagcttgggttcagtctttaggatcaacacagggtactaggcaggccagatcagcctatcagttggttcttgagatgaaacttacttgcgactattagctcttacatagtgtcccaaaagaattaatgtgacattacagaatattccatttagtcatcatcttctgtttcccattattgtattggacttgtggtatcatttctgtttacatcaacagtagaattcaaataatgaggaaagcactaaccgttttcaraatttttaaaacttcaattcagagtcacttggcacctaaaagttttcaaatgtgctggtgaaatgaagaaaacaaaatttgtaatagaatcaatctttcttgcttgcttgctttcttatttatttatttatttttattttttgcagctcagtgtgggggaagagtaccagggcaaagtggtgttgttgaaagcattggacatccaacacttccatacagagacaacttattctgtgagtggcatctccaggggctctctggacactatctcaccatctcttttgaagactttaaccttcagaattcttctggctgtgaaaaagacttcgtggagatctgggacaatcatacctctggttagtaaaatatatctgctctcttttgggtgtttattttcacatgtacttattcagcctctgaagtttcttcacttccaagaaaggcaaaagcacatctatactctgcagagaagtgcagactaatgagctttgggcagtactggtgattctctccctcaattctaccattaacaatggatgcccagagcccaggtgtcatatagcccaccctggaggccacttggggagagcaacggtagtgggaaggcacctcttgctgctgagacatcccattgccacatgccgttatttgaggggtgttctatagcttgagatggggaagggatcatgcatgtctcctagtggtagcataaggcagatacttgtcactgttgtctcagatcattttttcaaccaaatgagcaagccttcctcattgtgctgagatatccttcccctaattggttgcatttttttcacttcttcatgtatttgaatatgttcatttttattcatgttttcctgttgtcttgacagagattaacgtttcttcataggcagggtcttgttttttattattttctttgtacacacaggacaccttgaatagagggtaaaggaaatcaatcacttggacatgtatatttaattatttgtctctcacaggaaacatcttgggcagatactgtggaaacaccattcctgacagcatagacacttctagcaatactgctgtggtcaggtttgtcacagacggctctgtgactgcctcaggattcagactgcratttgaatccagtatggaaggtgagttcattgattcattcaacacaacattgagcacctgcattggacagacactatgctaggcaccagtgttaaaatatttgaaaaacaaaacaaaacatgacccctattttcttggaccttaatcagaaattcacagtgataaatgaaaaattacagctgtgatcaatgctataagggaaaataactagtatcacgagagagataataagaggatgagagttatactgtaatgcccaccttaagagagtcctgtagttactcagaatttgtcttactgcaaacccaacaaactcaaatgaaataaagatcttgttcagaaaaactgggtacttaacattaactttctgattttcctcttttttttttttttgtgaacatggggtcttgccttgacctcccaaagtgttggggttacaggtgtgagccaccactgctggccaattttcttgattcttttttttttcttttctgagacagtgtctcgctctgttgtccaggctggagggcagtggcatgatatcagctcactgcaacctctgcctcccgggttcaagcaattcttctgcctcaggctcctgagtagctgagattacaggcgcacgccacgacgcccggctaatttttgtatttttattagagacgggatttcaccatgttggtcaggctggtcttgaactcctggccttgtgatctgcctgcctcagcctcccaaagtgctgcaagtgtgaaccaccatgcctggcccgattttcctgattcttaagttcattacattcattggtctctcatttcttgggccatgatgataactaaattgctgcctgtggactatcacccatggaaggcagggttaaatattaatagagataaaaaatgaatgtatatgttcactaaaatcctcatgcacataaataaatatggagactaattttatctagaaggataatttttaaatacctgaattttgagagctttcttgatggaaggaaacattttgatttgattgaaagttttcttggctttttccccacgtcagagtgtggtggggatcttcagggctctattggaacatttacttctcccaactacccgaacccaaatcctcatggccggatctgcgagtggagaatcactgccccggagggaaggcggatcaccctaatgtttaacaacctgaggctggccacgcatccgtcctgcaacaatgagcatgtgatagtaagtgttccctgccgcctgagatgttatattccatcatttaaagagtttaccgacccataaatcatagtcagaaaactaggtcaggaaaattgccatctatgcaactataactcagacaaattctaagtattgttgaaagaacaaaatcacagtaacctgtcaaaataattgtaaaagttgtttgaagagamtatcagctatcactctgtgcatcagggtcatagaataaattttaagagtgaatgatcacgacaaatggcaaaaccggagaggctgtgggaagmtaagcctacagcagcacacagctgaatgggaccagagtcacagcacaagccaccacgaaagttctgagcaggtgggtggtcctgcataagcactgctctctccaggggtacagagggactcttggtgggagagcactgctacgtgacctccatgtcaccaacctccagtggtttcacatgtgtcttcagcactctcagcttcctgcagtgaaagaaagcaaatgagatccctgagtgtgaataacaaatagattgttaactgtgaagtgctgtgcacacatatgtgtgtgtagataggaagattggattaatattagtaaatttmtccacccaacttgccccttctgcagtgtttgttatctcagtaaataattccaaacttctggttgcttgggtcaaaaatcttgatgtctattttggaatccttcctctcacaccctatrtggcatctataagcaagtcccattgggtgtatctttaaaaatatccacaattgaactatttctcatcatatctgctactaatacccccaccgttcacttggattattttagaaagttccacctcgtccccctggttcmgttctcctctccctacgttctcaacacagcagcatgtgatggttttaaacctcaatcggatcatgttgctgcctttgaaaatcctctaatggcttctcatctaactcagaggaaaatcccaaattgcacctgtggcccacctggctgacattatctgctgcccctccctcttctacctgtttgtcttatctcaaactcctctcttctttgctctctgggatccagccacctggcctccattcygttccctgaatgtgctgagatgctccccatctggctgttgccttcatctggaatgcccctccccagatggcggcctgctccacaccctcacttcactggggtctctgctcgaatgccttttaatccataaggtctaagtaccttatattacagaccccaccctggcctgacccttctctgccatgttgttttgcagcacttcacacctgctgccatacatcattttgatttgttcatcagtttattgtctgcttcccccactagaatgtgagctccttgaggtcaagccacagtttcattcactgctggggattcactgaatccccagtgcctgtacataatagagataaataattgttgaatgaatggatagtagaggtactatcattatcccttttataacaagccacttttgttttcagtttaatcgtctcctgttgggtagtgaatttcaaaaatatgaaatatctttgtatcttatgaccactttgtattgccgtaaaatgatctyattcaaccttcagattttatttccaagttctaatatctgaaggactgaactgttttctttcagatcttgaaaataagaaaccaagtgtgttttcttttatttgagagccaggaaattttggactaaggttgtttattataaagaaacttttttcctattattgattgaattatataaacaaagatgaagtagaaaaaatactaaccactcccactataccacattttgattcattttctcatctcttcttggcaaagcatactttatgtacttgtaatcatgtgatataaatccacttgaattctgattttaatctatttttctggttataaatataatggatgcttattgagcaatatttggagagttcagaaaataaaaaatataaagatatttttaattctactcatgtattactaaaattttgatgtatgtgctaacagttgttttttacctttgaaattattttcatagtttaaatcatactgaatataatgattatcaggaattttacaagcagagtattcacatgtcctttaggaaagagaatatgaacagtcatagttttagatctcaaataaaagttacagtcacaaccacaaattccaaagcagatcttacttgtcatctccctatcccttaattatcaacttataactcttgcagctactgctggtgggttttatgtcattatttctaaataatattcctattctactactccttgctttttttggacattatctatccacatcctactctagaagatgagacttacccctttgccaccacaaacacacatggggtatgcaatgtttatatactttcccaatcgtctcccaaaatacgtatgtcacgcttttgcttaaattgctgttcagttgacattaccatgattatgtaaacaccattcacaactgagccaagtagtgtagtatggcaacatttgcttttgttttcctaaggaataataataattgggtcctctttacattttcttgggttttatgcattgatcaccaattcgtccacaccctctccaccccagatgtgcatctctaccttctgtagtaaaacatatcagttccatttcttttcctcagtaatatccttccttgagcctttgtacgtcagctgcaagcctgatgctagctgtcatttcagaatttccctttgccatcaaatgtgcaagttccttcattcttctcctgggctagagagctgactttgtgatgctatgcacgtccctttcttggttaatttcctcttttggtgaggcataccctcttgcggctccccaaggaaatgggcaagggcaataaatcttttgaaaaatggtatacctgaaattatctttattttaccataaatctttgaaaagtatatatttaaatattttatatgtttgatatattaatatatatgaatatattaataataattttgaagttttgtgttgctcatttggggtcagttttcttcatgttcctatctcctgtttactaatattggtctctgccttttacattagtcacttccctaaatgtctgctgatccttggctattcattcgtatttaagaatgaattactgaaaggatgactggtatctctgtatgcatgagggggccctgactctttagcaaaacctgcaaacctacaaatgtcatatccacaggtcttttctctyggggaggttaaaactccagcgacgaatcactttcagaattaatttttcttctgagtctttagttctaatgtccacattcctttttttgaaatgtatttttatatgttcaatgtttattttggttcctctttaccctgctccaaacaagggcatgtgggttggcctttgcccctactctatttgattgagaacttgccgaaaagaggaagaagaaagatgaaagaggaagaagaagaaagagaaggagaaggaggaggagaagagggagaagaagaagagggagaagagagggagaaggagaagagggagaaggggaaggagaaaaaaagaagaacaataagaaggagaaggagagaagaagaaaagaagtagaagaaggagaaagagaaggaggaggagaatgagaaggagagggagaaagagaaaagaagaagtaaaagatgaaagaaaaaaaagaaaagagtgaagaagaaagaagatctgctggtgcagaggaggcagctttaactttcattgcactgcttcctagctaataccttatccagctggaatgagcctaaaatttctctaaacccacctgcctatctgactctctgtacagacagagaaaataaaaagctatgccacccagtgtgtcctacaataagacctgtgtctgatgttgtccctgctcatagcagatcctaaatctcacgtgcctgcttcctatccatttgtactctgagagttgtagtttctaagtacaaaagggattagaggacaatgatgggaattgcattctggttgcttctaacagcagaagtccatgtgataaatggatgactataacatgttcagtcattgtgattctatgccaaaggcagactcagaggcaggataacagccattgatcacagtttccgacatgtcccattaaccttatggttggttctaatcccttttgattccatcaatgtggtgcccattcctgttttcagcattatagaaatatttttcctcatctgtttctttatgcattacttaatggtttggaatcagagggatggtttgaatcccagttctattattacatcatctttctggattctggtatcttaatctggaaaacagggatactgttatctgcctgggagggtgttttgttgattagataagacaggctgagtggatgataagcaaagactggcatttttgtctgctcagtaaatgatagcaaactcttcttctggtccagtgagccagaagacactttacaccagaagcccccagagagctaaatttgattaattatagtaaatttaaagagatgacatcttggccgggcgcggtggctcacgcctgtaatcccagcactttgggaggccgaggcgggtggatcatgaggtcaggagatcgagaccatcctggctaacaaggtgaaaccccgtctctactaaaaayacaaaaaaaaatyagccgggcgcggtggcgggcrcctgtagtcccagctactcgggaggctgaggcaggagaatggcgtgaacccgggaagcggagcttgcagtgagccgagattgcgccactgcagtccgcagtcccgcctgggcgacagagcgagactccgtctcaaaaaaaaaaaaaaaaaaaaaagagatgacatcttttgttgtggagtgcattctccttctgcataactgttagtgccatagtctgagtcattatttctaatcttgagtcattcaaatccttttaaaaatgggaatatcaaccattcaatcaatgaattattgttcagttatttcatctagattttttttgaactgtgaaaaccagtcatgcaaattcatttgattttataaagcattggaagaatagtttgcgaattattgtaactatgtgaatgactacagctattatttaatattttagagtcaataataatccattattggaaattcaaataagtaagaaaattgaagctttgaatccataactaatgaggaaagaactattatgtttaattgcagatggagattgatttttcaaattacttttcaaagtatttaaaaatatctgcttgctgggtgctgtggctcacaccagtaatcccagcactttgggaggccaaagcaggtggatcacctgaagtcaggagttcaagaccagcctgaccaacatggtgaaaccccatctctactaaaaatacaaaattagctgggcgtggtggtgcatgcctataatctcagctgcttgggaggctgaggcaggagaactgcttgaacctgggaagtgaaggatacggtgagccaagatcacaccgctgcactccagcctgggcaacaagagcaaaactctgtctcaaaaaataaataaataaaaattaaagtaaataaagaaaaatatctgctttattatgtacatgaaatcatcagaaactgatatttaagcttcccttccwagtaacaaatgtcctgatgcattgttaagaaaaactgcccatcagtgagctctgcagaccacattgtaagcacaatggctcatctcctttacattgagagcacagtttccagttgcaaagtgtatagcagcttttaatctatcaccacatggcaggaaggcattactgcaatactttcattctagtgaaatcaccctgaagtcacaaaatgtgctcggggtaacagtggcttgtggcactgcgatagaaacctgcattgttaggtcattcattttggggcagggttcccataaaaggaagtgggtctgggctggaaatatcacctcctaggaaatatgcagtaagatggattgtgtgcctgaaggttaaactctttttccaacaggtattcaatggcattagaagtaactcaccccagctagagaaactgtgtagtagtgtgaatgtaagcaatgagattaaatcttcaggaaacacaatgaaagtcatttttttcacggatggatccaggccrtatggcggcttcactgcttcctatacctccagtgaagatgcaggtaatgtaggatgttgtaaatgccccccattttaatcaggggcactgcagatgcccccakctactgccaatggcagcagagccatccattttccctttagtgatayttgaaatctttgacataagacaaacacacataagcagatgaaaaacgcactgcagacagaaaaaaagctttctgatttcagaaagaaactgccatagtgaatttaaaacttttaatgctattagattagcttctagcacagtttcaggtcatgttaccatgagggttggtgacctgttccgtagtccctggtcaattcttttgtgctgaaagaaaccatctacctcctagagggtaacttagtctcagagagtaattaattttgctggggacagaacaggctttattgtttctagtcatctatccacacacatatttccagtgaaaataaatgggaggtttgatttgatatagaatattccaaaattaagcaagatatggcctctaattataaatatcctcctatttcctgaattgggttcaaaattttaaagggttttaaattttagaagtgggagtgttttaaaatttagaagttttaaaatttagaagtgggagtgaatattaaaagaaaaacgctaagttatttcattggtacaagaagcatctgttcctttattaaaagggggcaaattaatggcaaattaatgtcctattatckgtttgatttaaaataatttattagatcaagtggagaattgctaatcaagccattaggacctgccaccattatatttatgtattcctctaaagtaaatattaatgaacagtaggcctcaatatttggacctattgatacagagccaaacgcccaccacttaatctacagcaacaggaaaatagagaagttgttgatttttgcacatctttcctttataaacttgcagaaacttccataatttgcatgccttttacccataagcttgactgcatctagaaaaacaaatcaaagcagtaatgttgatgttttagttactgttcctgtattgtttatctcttccgttgtggcctgaatcttactactactttctctgttgccttctgttttcttagtgtgtggtgggtctcttcsaaatactcctgaaggaaactttacttctcctggctatgacggagtcaggaattactcaagaaacctgaactgcgaatggactctcagcaatccaaatcagggaaattcatccatttccattcactttgaagatttttacctagaaagtcaccaagactgtcaatttgatgtcctcgagtttcgagtgggtgagttctatctaagaatgcgttytcccatttatctacaatattctttttatcttttttgttgttgtcgctgctgttgttgttgttttgagacaggagcttgctctcttgcccggactggagtgcagtggtgtgatcataactcactgcagcctcaacctcccaggctcaggtgatcctcttgcctcagtcccccaagtggcttggactacaggtgtacatcaccacatacaactaattattaaaattttttgtagagatggggtctccctatgttgtccaggctggtctcaaactcctggcctcaagtratcctccctctttggcctcccaaagtgctggggttacaggcatgagccaccayggctggcctacaatattcttcatatgcttggagactactaacaatgaagggagtcaaatggctctaacataggtacacacgatccaaaagaactctgttcgaagccataattctgtgtgtgcccagctgaggaaaacgaaccccaggaacagtgagtgaggcggatcactgtacaactagactctgtgttacagtcacttcgtttcccggcatgtgacttttgccgaagcgagagtccactactatcaagactcctttccaaggagactgggacttagcatgctcagcatgtgttggcagtttcctgaacttccaggatttatgaaggggctgtgaaattctcctgaggccttaggagttaaaagaagttttgcaatataccagatggagaaacacatggaagctatttggggaaataaccccaaagcagtcatttgtcttggttttcgtgatggaaaaggattgcggtgtactcaataaaccataattctcttaagaatttttaaaactctgtattcaaagaggatgaatcaattttctttctttcccatagtcaaggtgtaggttattcattaggttgcttccatgattatgctgacacgtttttctcagtaaataaacaagtagatagaggaagacaataatattgtaaatagtacgtaatcatccatactgtaaaagttttgctgagttctgtgtaatcccaaaatttaaagaaaaggaggctgaaagcagcagaagctcatcagttagttggtggagaagtccttgggaaactgagaggtcaatgttaattacctttgagaacgtgagcgacagaattttcaggaaggagaatttgatagagcctgtacccacgggccaagggcctcagccagagagtcctccaacctctctgaggctgaagagtctaaaaaggcttataagggaaagggaagttgtggtttgagaatgttctccatggaattctgataaaccctcaccccctctgcctgtttcaaaaccaccggcttgtggtmttaagcagaacagctgtatctcaaatttcagtcagctaaatgctgtcttctctttatttgctcaggtttagaggcagttaaaatactatatatcattgatttagaagaccagtgatgtttatctgacagaataaaaagaaagcagataaatgagagctctgttggtgctctgtacatgttcatcaaacccacgaaatgtaatcttcatgaaaaatattaggctcagatctgacagctcttggcctgaatgccgaatatggagtccatttcagttgattgaatatagtgaagaaatctttcaaattttaggcaatgatcactttatcttgaggatatattttatcactgttggtattatatttcttacaccctacaaaaggtgtgtccaaaagtgctattttaattcattgtatctctgtttagatatgctgaaataactatgaaaacacaaattggaacaaaatggtgtccatcatagaggttcatttcaaaattgctttgatttttttgtgtttgttttacccccttggagggactttctgttgcagttaacagagacacacaaatattgtgcaatgtctgctactaaatcagaatttaagtgtgtgtcaatgaatatcttgaaatttgtttttatcaaattcattgaatgtatttctcaaaagctgtatcaatgatggcacttggtatattattttgttcaggtgatgctgatgggcccctgatgtggagactttgtggtccttcaaagcctacattgccattggttataccttattctcaggtatggattcactttgtcaccaacgaacgtgtagaacacattggattccatgcaaagtattcctttacaggtaagaattataattaagatcttgataaaattacttataaagattaatgatttttttccataaagatttcatatatattttgttagatttatttctacatagctattagttttgttaatattatcaatgagattttctaaattacattttttaattggttgtggctgatatctagaaattttataatttgcataatttaaaattattatttaattttaaaattattcaataataaactgcataattttaaaattattaaattttaaaattatccaataattatttaataattaataataataaataattawtaataataattattatttaataattttaaaattattttrtaatttgcataattattataaattttataattttgcatacatgtaactttagtccaaagatctagctatcctcttattagttttaatatgttgtctatagattctctttgatctttctgtgtaaacttctgcaaatgttagttctttatgctttcagtcataatacagaatttcattttcttgcatccttttgctagctagggccaccatcgaatattgaacagaaggaatgatagcatcttgtttctgacctggatgtgactatgacattttattattaaatatattggttgctcttaagtttccaataaatatcttttgttaaagaaagtcccttccatccttagtgtgaaaaagctttttttaaatgtaaatgggcataggattttatcagatgattttctgcatccattgagatgatkcaactttttctcctttcataagttaatgtgatgaattatatgaaagatttatttctcttggtaaaccatccttgcatttctgggataaatcctattttgtcatgatgtgtgttttatacatataatgggtattatttgctagtgttttgtgttggatttgcatatgcaacattcagagtttgtgctggaaaacccagccctacwcttgactgcttcccttggcaatgggaggttttctagtcccttttcacgagcatgccagtttgtttagattcccaacttcttgtaaaagtctcaattccagtcctgccttctgtggagacccagagccctatcttctcctcctacccagtcatcaaaacctcagagcccaaccctgggacccaaacctgcattctttaccctctcagacttcactctttcactttcactcctctcactttgagtacacttactgcttctagattttggggagctgcttttctttccattgagtttgctatgaatcaaaatatgttttagttatggttttatctaacattcctttgtgttataaccaaatggctggttgaagaaggagtgaaattgattatctactcactcaaccatcttgccagttgattttccttcatcagattcaaagaagagtcaggtttcagtaaacagtattatttgtattgaacatcagaccatattattcttcagaaatgtatttktttttcaattttcaattttctatgctaataccgtatggaattttgttattcctaaacttttacccaattttacttttcttctatttaatttcatttattttatacatatatatacataaaatatacatacacaaaaaaatacaaaatatatatatacaaatatatatactatatatacacaaatatatatgtactatatatatacaaatatatatatactatatatacaaatatatatagtatatatatacatatatatactatatatataaatatatatactatatatacaaatatatatactatatatagtatatacaaatatatatatactatatatagtgtgtatatatatactatatatggtgtgtgtgtgtatatatatatactatatatggtgtgtgtgtatatatataccctatatatggtgtgtgtatatatatatatatacacactatatatggtgtgtgtgtatatatatactatatatggtgtatatatatacacactatatatggtgtatatatatatatactatatatggtgtgtgtgtgtgtgtgwrtrtatatatatatatatatatactatatatggtgtatatatataatatggtttttttttgagatagagtcttgttctgtcaccctgactggagtgcaatggcatgacctcggttcactacagcctccaccttctgattcaagcgattctcctgcctcagcctcctgaatacctgggattacaggcagacgccaccaagcccagctaatttttgtatttttagttgagatggggtttcaccatgttggccaggctggtcttgagctcctgacctcgggtgatttgcccacttcggcctcccaaagtgctggtattactggcgtgagccaccatgcctggccttactatgtttttaatcacaaaatctgatggttatgattactacttactttggcattatcggttcttttttttacttctgttttattgagagggttaccaatctcatttcagattgtggcggaatacagataggtgacagtggagtgatcacaagccccaactatccaaatgcttatgacagcctgacccactgctcttsgctgttggaggccccacaagggcacaccatcactgtgagtgctaatgactgggtgaaatgcttctgagacaatagaaccacaatagcctgtcctgcatgaaaatggagctcttttattaagcaagtgattagagaaggctttgattctacaatgagatcactgtttttccctaacattttctcactagagcacatacattggcatttattattcatgaagagtgaaatctcttttttaagcatagggaaagatatacacagaagataattctgcgtcttagagagaagtgtattcagtttcttaatatgtgttgccatcccaaaccagggaaatgtcttttctcaaaatttccaagagaaccttcaataaggaaaaaaaagtagaggggaagggagaattaaataagagacaaaaatacaaattataaaaataaaaacaaaattaaacgatttgtaagggccttatcttcgtaacagttgataaaagctcactgacaaccattttcttttttctcctgcagctcacatttagtgactttgatattgaaccccatacaacttgtgcttgggactctgtcactgtcaggaatggtgggtcccctgaatcacccatcataggacaatactgtggaaattcaaaccccaggacaatacagtcaggttccaatcagctggtcgtgacttttaactcagaccattcattgcaaggtggtggattttatgctacgtggaacacacaaactttaggtaaaagaaatgtttgctccatttgattttctttttagtgatgtatagtatgaactcataatatgtacattttgtacctactttacatcaggcttagttctaaatatttgcacatgtcatctcatgcagcaaccctggtgggataacacaatatcaatacctggcatctctattttgcatgggcagagactgaggaagcatgggttgatcatttgcctagatacatagccgataattggtagagtcgggatttgaataaaggcaattcagtccagaaactttgatctcaacacttcatgatgctgccttcatcggcaaaagggtatggcacaacctgggaatctcaagtaatagaaacatgagttggaatcccaagtgcttgaaaatatctggagcctaaaagcagaatgctgagtggtgagctgagggcaggaaaataagtccacaacataaagagccttggtttatatgttatcccttgaacaatgggaaactgttgaagagttttgaaaacgaaggtgacaagatgagatttgtaatttagaacaaatgctgtagtgaatgggtcctgagtcaaaatatgacagatttcattttaaaagaatagtttttgtgcatagaaagtataaacattgtgaaaattctcagaaaatacaaggacttgtatcacatactttattagggatttctgtaaatcttgtatatcacacaagacaattatttctggtagagtcacagttattatgaagctctttgttgactgagtcagacttcccctggttaacaaccactggctgttattgaagtgagaagggagttttaggtgaatccctgatttccaggggtttcacagcaaaagattcggagaatgcctctttaacttcattttgttttgtatgaaaattctagatttttcttcctttgaatctacataattaattttgatccatcagtcagtttcaatatgaatcaatcagattgcttaataaaagaattttccccaactcaaaatcactttctctagtccagttagagtaacgttgcaaatggagtgtagagtaatattctcatgtgtgaatggtaataaaatacagaacttagcattgccaggttacatatactacataggctcaaagagaataaaaatacagctcttgtttggagacaggatggaaatctatcctctctatggcacggattagtgttcttggttgaattcaatatcattgtaacacaactgtaacagctgaaattttctctcaatttaactcacctttccatttatggagagagcttgctgtgcacctgactggaagatgatcacttgtaaaaaatgatgaattgaaatctcacatttggaaatgttccttctgtagcagtcttgagtttccaaaattactttccttgctgattgatggctttttacatggcaatatttcaggttgtggtggaatatttcattctgataatggtacaatcagatcccctcactggcctcagaattttcccgaaaacagcagatgttcctggacggccattactcacaaaagtaaacacttggagatcagctttgacaacaacttcctaatccccagcggtgatggacaatgtcagaatagcttcgtgaaggttagtacacttgttcatttaattggagccaagttggttttgtgaacattagtgtttaagctagaaatgattcattgtcgctcaaagtaagaaaattttgctgcctggattccttggatgaaaagtgagaaagtgagaaacctcaactgttaggagctagaatttcttttctttcttacttttctaatagatcctaaagggaaaaatgccctttataatatagggcactaccacaggcaaaatttaaagcatgccacaaaaattacggaacgttgaaggagcagctaatgccagccttcaccttgggcattaagaccccacagtctgaaaaaaccgtgagaaagccatgtaaaaatgatgggaatggggcatcaggagagcaaakytctttcaaaatctaaagttataaatgctgctcgtgtggcagtggcttgtcactttccactgacttgtgactatgatgactgtcttagaaattcatttcatctgtactgttttgcatcttccaagttatatctctaaaagtctgtgacttttagagaaagagtgccttatttccactgtgcctttccagtggaaataacactggtcacgttagcccctccattcatgtctgtcatacctaccacctgcatgttcttctctgagctacttaaacaattggcctttaagttattcaactgtagaatgaagagcatgattccttcttcagtggggctgttttaagcattggagataatacgatgtaataacataggtagtgctaagtacttggaatttaaagtcacttgatgagtcaaagtggcttttattgtcagtgttattacttcctatcaactctcaaatgatgttttatatctcattgacccatgcttactgtttaaatgaaaatctcatatgtgtataacatatatatatatatatatacatataataaaatacatttaatatacacttttcttaatggctttttccatgaactaaatgaactctcttctcatgaaatgaatcaatatmaagtattcagacttaagtaaaactttcaagtgctccagttgtaaaactggaatgtggaaaatggcctaggctcattccttstctggattgaatgggggtccctctgataacatcgggcaagcccaacgctgctgcygagtgggatgtattaggaaccctgccaaaaataagtggccgtgggaagcactcgtcttctcctaatgggcccgagatgcttgtttctgccaagaaatgctgtgtgggtggacggaaccagtaaagggacccagcttcggcaagcagcccccgcaggaagccacttaacacctgtaaagctgagattctctttacccacccagagacaccagggtaggtgggactggaaaaatgggtcccagtcacagaaaggggccagtctgggaagcctctttgtccccacaggccagacmtgctcctcttccacccagagacattgaggtacccgggggtattggtaggggaaaattastataccctttgcyttcaactgagaaacacacagagtccctcaggtagcaccagcaagaaccagtgagagccccggtagcaccaatgtaaaccaagcagaccagaattccaccacacagattctgaatattgaagagcaactggaactgtaacccacaaaatgtgcaaggcacgtggtaaacataaacagggtgacagcctgctaaaataaaagatttgaataggacccaaagttcccyaacataataaatgacatgtcctgggtacaatcagaaagaacacgttgtatcaggaatcaagaacatcacaacttgaaagagaaaagaatcaagtgatgtcaacagtgagataaatcagatgttgaaatatatgacaaggatgttgaagtagtttccattaacatgcttcaacaatcactgacgagctctcttgaaacaaatagaaaatatcagcaaaaaaacaatggttacaataaagaactaaatagaaattatagaactgaaaaatacactaacataaataaagaacatgctgaataggctcaatrgtagcatggagatgacagagaatagaatcagtgaacttgaagatagaacaatagaattcacccagtctgcacaataaagagaaaatagactgaaaaaacaaacaaactagatcaacacagacttagggactcatggacagtaacaaaagattcaacattctctcaaagggagaggagagagtgcagctgaaagaacaatcaaagaactagtggctgtaaactttcccaaatttggcaaaagagacacacctataggttcaagaagctgagtgaacctaaaccaagataaacacaaagaaatgtaagttcagacatatcttaattaaacttctgaacactgaaggcaaacaaaaagtcttgaaagcagtcagagagaattgggacattacctagagaggaagaccrgttagaataaaagcagatttctcatctgaaaccatggaggccctaatgaattgacaatatattcttcaagtgctgaaacaaaggaattgtcaaccatacattttatatctggaaaactatctttcaggagtaaagaggaaataaaaacttctcatatgaaggwaaactaaacaaaattatcactaggaaacctaccattaaagatggtcaaacagaagttcttcaaacaaaaatgaaattattaaagaaccgtggagcatgagaaaagaaaaaggaaagtggaaaaagcaaaaatatgtrtacatacaatagaatatccttttccccataaagcttgtgaatcatatttaataaaacaagaaattataatgccctctgttattcagtataatgatatggaaaagttgaaaggggacctaaatggaaatcacatttccacaagtggtcagatgtggatggtggtagactactataatcacataggcacattgtcacacacagaacaaccactaccaaaactgtgtgaagaaatgtacagaaaaacgctaatatcaatcaaaatggaatccccaagatatcaagaaaagagaaatagaggaccaaaaagcagataaagtaaacagaaattatataataaaatgtagacacagaactgatatatatcagtataattgtaaatagtttagttagaccaatcacaatacaggttatcaagccaaaacatgatctaagtgataataaactgatttccaattcaaccacgtaggtacatgaaaagtaaaaggatggaaaaggatgtcatgcaaaggttaaccaaaaaagcaggagtggatatatttatatctgatgaagtagactttagagtacagaaaattacaacagaaaaagaggaatcttacataatgataaaaggatcaatccaccaggaagacataatgatcctcctaaatgtgtatgcaccaaacaacagaggcayaaaatacataaagcaataactgatagagctaagaagagaagtagacaaatcttcggttatagctgaggacttcaacactctcctctcagtaattgatagaacaactagacagataattgacaaggatatagaagaactctacaaaaccatcagttaataggatctgattgacatatatatgtgtgtgtgtgtgtgtatatatatgtgtgtgtgtgtgtgtgtgtataaatatatatatgtaaaatacaccacacagcaacatcagaatacacaattttttaggaactcttgtaacattccaaggtagatcatatcctgagacatggaaaaacctcaaccaagtcaaggaattgaaatacagagtgtgttctttgagtatattaaaactgaactaaaaaacagtaacagaatatcttattaagcactgagctgagctggagagaactgagctgccaattgttggagcagstaattaaaacaacaggccaaaakgtaagtaacagtcctgtctttcatcattttctgctgtggtgtaagaggccaaacaggagaaagctctgtctccctcaatcgtccattctttcccatgggaagtgcctggtaaggatcagatggatcagtgtagatatagaaatggtctcattgccaagtaagccccaaayaaatatgtgcaggatctgagtgctaaaaataatgaaatgctggcataracctaaatgaaagagacaattatatttatgaattggaagactcaacatagtaaagatgtcccttctccccaaaatgatggataggtttaatgcaattcctatcaaattttctccaaagtcttttgtaggcatagacaactttttccacaacttatatgaaggcagagacccttcaatggctaaaagaatcttggaaaagaagaataaaatgggaggaagaattctaccttactatttacctaggcttacttatctaagttacagtaatcaagacaatgtggtattggttgaaaacccagatgaaaacagagaacctagaaatacactcacacaaacatcctcaattgatttttgacaaaggtgcaaaaactttccaatgtaggaagaatggttttttcaacaaatggtactagagcaattgaacatccacaggcaaaaaatatgaatctcaacctaaacctcattattttgtagaaaacctcactcaaaatagatgatagactgaaaagtaaaatataaaacttctagagaaaaaaaaatagcagatgtcttcaggacctggagataggcaaagaggtcttagattaaacaacaaaagaatgattcataagagaaaaaataaaatgataaattttaccccatttaaattaaaaatcttatgccatgtgaaatattttcatccagtctgtagccagtctgttcattttcttcacataggcaatgtactactatgtaaaatatataaagaagtctcaaactcargagtaaaatacaaacagttctattagaatatggacaaaagacatgggcagatagtccaccaaagagactctacagatgataaataccagaaaagatgttcaacgtcattaacttctggagaagtatgaattaaaaccacagtgagctatcactacacacctattcgaagacaaatatttaccaattgcataatatttaccaattgcactctgggcatttatccgagagaaatgaaaactatgtttacacaaaaacttgtttacgaatctatataaatagcacctttatttgtaatagctgaaaccagcactaaggcctttcaacaggtgaatggttaaacaaattgtggtacttgcttaccgtggaatgtaactcctgaataaaaacaaactatttatagattaacaatctggacaaatcactgagggattatgccaagtgaaaaaaggcagcctccaaagattacatactctgctgttccatttatataatattttgaaatgatagtgttttagaaatggaaagcagagagccagaggttagagagaaggcaatgtaggagtaaattgtgtgtggttataaayaacaaaagcaacttagggattcctgtggtattggaatttcagtatcttgaatgcaattgtgtacaacttgtatataacttaatacacacacacacacacacacgagttcaagtaaaactaggaaactgagtaaaattggtgttatgtcaatgccagtaacctggttgtgatagtatactacagttttgcaagatgtcagtattggaggaactcagaaatgtgtacaaggaatttctccatattatatcttacaaatgtatgtgaatctgcaattatgtctgtaaacatttgtttaaaaaatagttgaatgataaaatataacctacaacctgactgaattatatagaacactaagaaaaatcagaaagtttttgacctgatgacagttaagtaacattttgtaggttcaatatagttttgatgagtcctctgtcatatagccaatgaaatgagttcttgataggcaaggcagaaatgaatattgaataactctttaccattgtcatcaccattatcatcattattattaaacttatgttcccaggccaaaaggtagagwtgtcgaatctataattaatgacttcagaaaagtataagcacttaagcattcttggattccttcattaaagaacttgaggctctttattaagttttagcccttcttactttgcctgtttagtaatgtttgtaaaaatatagtatatggcccaggcatggtggcttatgcctgtaatcccagcacttttggaggccaagacaggcagatcagttgagtccaggagtttgagaccaggctgggcaacacgggaaaaccccatctctgcaaaaaaatacaaaaaactagccaggcatggttgcacgcacctgtagtcccagctacttgggaggctgaggtgggaagatcacctgagtccagaaggtcgaggctgcggtgagctgtgattgtgccactgcgctccagcctgagtgagagtgagactgtctcaaaaaaatacatatatatataaaatatatatacagattatctattgataaattgtgtttataattttatgaaatgtggataaaaaactgccatatactgtttccttggatatattattagggggaaatctaattagagatcattaagtaaaattgagtaggtgcattttttttcctgacatttttattgatcttaggcatttggcagaatatctgcacttttgttctcagtaggtccagcgccaggcasctcccttatctaataaatggctaatataatttgtcttcagtaggatgactaacagctggatacccagtgcttaaaaatcaattgaaacaatacrgctttaaakwgctgagaattattaaaccaatgctatgaatcagtgctatttcacatctcttgctatggactgatttcccaatagaaatgtttttaatgacttgatgttttattgctgtgggtgaggaatatccttsagaagagatgtgtttggaatgagtaatttggtatcattccatgtgaaraaaatgttgaatagtcaagtaagattaatacacatccaactacatccttgtttgagatagttstctgttgakagaaagggcatattgggtattgcasattgyktagcaatagtcctggcccctacccactagatactacccatcacaccgagtgtgacaatagaaaaatgactacaaaccttgccagaggtcccaaaattgctcctagttgagacctctgaactaggacgagcttctctggttaatatgtttaatgtttttggggtttttttcccccaagttttgtatattcattacctaatatgcatactttccttgagtgactcagcattgtagataaccatgatctctcacctgaactagggcaaaacctacctgactgttttccggcatcctttctgactcctattttccgaattgtaatgttttccaaaaaccartcttcytggtggctccttgctgtattcaggacagtggcccgagtctctaacgtgtcctgcagccccctctgcaggcttcctcaccmcttcctccttggttttctctctcttctctgaactagccacggcctttcctgccatcggggttcgctcggggcaggctcacttcccccagttaggtaaagccaccaattatatattctcaacagccccatcataatgccttgtttatagctggaawtttgcatgtaaatttatgattctgtgattcatgtctctgtttttccctggactgataagaattggtttgatttggaattttggtgctcaccgtttatttcctagcaactgttttttgcatgagtatataaattcagtcattcgaggtggccagaccaattaagtgacagcccaggtctacttgggagttgccaaccaratttttggtgaatagcacacactgactggatgtcagcttttcatcaaaatggaccctacaattccacacagccaagaagtgttctgatttattccatttcatgctgattatacgtatacttggaattcatgcccactttcttcatgcaccacgatgtgcctcttgcttgctggtgttgtccagctgtgaccacaatctgctatcttcccaggagcagggctgagttccacctggctgctccgtctccctcagcacccgggaagctcggctaggtcagggcaactagaagttatgaggaaaccgaacagtgatccaggaaggtggatttttaaaaaatcaccacccagctatgcaaaaaggaacaccatctccttagagaagtcaagaatgggacatgctattytaaaaacagctttaaaaaaattattctcaaaagaaaatactacagatttgtccatgttttgtttactcttatgcttagttctgtatacgtgtgagtgccattattttgaaacctaagtgcattaaaatattgatgggaaacccttgagcattaaagttctgtgtatgtccgtgctaggtgtgggcaggaactgaggaggtggacaaagccctgmtagccactggctgtgggaacgtggctccgggtcccgttatcacaccaagtaacacattcactgccgtcttccagtctcaggaggcaccagctcagggcttctccgcgtcctttgttagccgtaagtagccctaagaaccaaacccagaggtctttgcgggagtgtggttgtcacaggcaggcagggttggctaaacctgggggtctaggggaggagtatgggggtctacggggaggatgagtcacctaatcccaagaagacacctttcttccaaatagcagtgagaasagaactgaattgagaagtgatataaaagccatgaggggcactaaccaacgtctagaaataagcctggcatccagagtgggctgatattgggcagaagcgcagatggctagttcgttagcaacaaccagtgtggctggcctgtggcaccttgaccacaaaatcccgtggggggcttgaaacacatgcagattcctgagcctcactccaggcccawytgaattcagaatttccatgacgaagtctttcmtgytttttttttttttttttgasacggcgtctcactctgtcgccaggctggagtgcagtggtgcaatctcggctcactgcaccctccacgtcctgggttcacgccattctcctgcaacctccacctcctgggttcaagctattctcctgccttagcctgccgagtagctgggactacaggtgtgtgccaccatgcccagctaatttttttttttttgtatttttagtagagacggggtttcaccatgttggccaggatgatcttgatctcttgacctcgtgaaccgcccgcctcggcctcccaaagtgctggcataagccaccgtgcccggccggtcttgcatgttttaactgtcatccagagggttctcatgctaagtcaactttgggagccagtttctttgggaatgttctttcctaattttgattaggaaggatggatctccttttctagctattgtacactattagattcgtgggaaatgtagcakttttcaagtcagagaagcaatggtgtgtgcctgttggctgagttaaatcaagtgtagccactcatggcaaaccactgtttagggaaaagtttgaggaaaggaattagaggaagtaatacartagacaggtttttcagactgaatcagagagtgctggaaaggaartactgaaagacaaccctagaccaaatcttaggtctgcaggtggtycactgtgtaagtgtgcacgtgtgtacttgtgtgtgttttaatgtcaatttaaaaggatagagatattttcgtgcttgatagatcagagagtgaagtggattaactagtcaatggttatatgaaaacaaatcattttagtggtgaaaagatatttctttctgtttcgaaaaccagggatgcatgtaagaatttgataagagttgggattaataaatccagctagttttaaaaagcaaccattgttktggctagattacaatggtaatgaaaatagcagttttctaataataagacattttaaaaacattaattgtgtaaagtactaatcagatacaaatcattttttatctgttttatttctttatctgcatgaaccatattctatcattgctcgtttatcctttcttaatatcttaatattaagggatttgcagtagatttgtsgtaatattacgaggactcagtccataaaactctgcagcattttctaaaaatgtataatattcttattaagcacatatgtatgtttttaaatcagagctttattctcttcattcttgcttcttccatttggaatatctcagggaactatgtctatagataatttaggaaaatgcctctttccttcatggacaaaatagatacacgagaaataaatgatctgatgatgactttttgttcccacataggatgtggaagtaatttcactggcccttcaggttacatcatttctccaaattacccaaaacaatatgacaacaacatgaattgcacctatgtcatagaggctaatcctctgtcagtggtcctcttgacttttgtgtccttccacttagaaggtaagtttattcttttaaaaaaattacgtttaattgacaaacaaaaattgtatatttatggtgtacaacatgttttgacatatgtacatgttgtagagtggctaaatccagttaattaacatgtctgctcactcacwtacttagcrctttttgtggggagagcatttaaaacctctcttagcaatttttaagtattcggcaagtaatcaagtatttcaggtattcaaccttgttattcgctattggcaccatgttgtacagtagatctcctgaacttattcctcctagctgaaattttgtatcctgtgaccaatatatcctaaatctccactcccacataccctaccagcctctggtaaccaccattctactctctgcttctatgagttcgacatttttagattcyacatccaagtgagatcatgcaatgtttgcctttctgtgtgtagcttatttcacttagcataatgtcctccaggttcatccatgttgtcacaaatgacaagattttattcttttttaaggccaaagagtattccattgtgtatatctaccacattttctttatccattcattcactggtggacactcaggtccattccatgtcttggccattatgaatcatgctgcaatgaacacgacagtatagataatctcttggacacgctgatttgatttcctttggatctatgcccagaaatgaacttggtggatcatatggtagttctatttttaatgttttgggaaactgccatgcatttttccataatggctgcactaatttacattcccatcaaaagtgtaygaggaagagttcccttttctccacatccttgccaaaacttatctcttgtcttttgataatagccttggaagataagttcattcttaagtaaactctaattggttcttcagaaatgaatgaggagtaagtagaggcagaagtctaaaactcaccatttaaagaaaatattgaaaatatgttacagagtagatttaatgtaaacgtgattaaaatttcatccaatttttaaagaatacaagtattattctatgtattccatctagaagtaaaaaaatagtgacagaactttaacaacacaagtattgcataaattgcttaaagaaaataagtctgaaatgtttcatgttaacatagcttttaatttattcacttgcatttaaagtttatagacatacgtgtgcacacacacacccacattcatgcacacactattaaccaaaccagtgagagaaactgtcttattgagtcaacataggtgttcgacaaatattgaataagtaagtaaattaataaaattaatataggctgggcacggtggctcacgcctataatcccagcactttgggaggccaaggtgggcagatcacctgaggtcgggagttcgagaccagcctgaccaacatggagaaaccctgtccctgttaaaaatacaaaattagccaggtgtggtggcacatgcctgtaatcccagctactcgggaggctgaggcaggagaatcgcttgaacccaggaggcggaagttgcggtgagcctagatcatgccattgcactccagcctggscgacaagagcgaaactctgtctcaaaaagaaaaaattaatatatgtgccctgcttttagtaaatactaccattgggcgttctttcttctgctccatctcggtcatcttcatcttctcagtcctgactcttcagtgcctgagttcctggccacaagtgccctctgtgttcattctcccactctagggaatgggccgttggcagagggaacagtagagatgccgatttgggctgggctttgactgacaatagacaccacttggtgtttaatggaggctttcacacagtggaaaggaaattccttcaaatagatgggtattttcaaccactcataaccatattaattttcttgttacatatcagctttctatttctaaaccacaatttatctgcaratttgtcaagctacctcggtatattcgaaatttcttactcttgggttagtctctcatggcagtgaaaagttacactttgcaaaatgttctatagcattcaacatctgggaaatgtatggtttataaaaatgacatgtcagaactcataaatggataaatttaacaaagcttgtctcacttaatcctttttcctatgacctcactgccttttcatacatctctgcagttgtaattttcagcacatgtgtttgcttaaaaaaatgccaagtgtaaatcaatgtatgtcactgtaaaaatggaatataaagtaaagtgtcatcttttcagcatttgctagcccaaaatcccagtaccataaaaagatgcccatgatatatgaaggcttgagggagggtaaaatagtttgtataagatgatccaattttctttctaaaataatgtgtgtgaataaaatctataaggctattaaccagtacattaagagttgtcaccactgtgtgatagatttattcgagatgcttattttcttctttatagcttttatgttatttttataattaggacaattattttaatagcaggggaacaacatgtggcttggattttgtgtttgtggtcattaagttaaataaacagtgcatctcacaagaccgtatcactcagactaagaaaggagactctagtaattgtactataaagccacagaaagcaatgctgataccagtggtatatgtattattataagagactctatcatgacctgagacagctccctgagctcagttgatcaggtgagaaaaaggggagcagccctggaatatctcagtatagtacagggaaagtgagcacagcatttaggatggatcttaatgccaggtcagccacttactgctattcaagtgactttgtgcaaattacttcacctttatttctgatacttatatatatatagcactttgctatatatgtgtgtatgtgtgtgtctaatatatatttattatatatgtataatagtagttctgaaagtcagataatgttagattgatttctgcttccgctaatggatttgccaatcctcactcagttgaagactgattcttttctaagatggtatccttacaacaatgccttgtgacatttccagtgtttaagtgttcagcattttcaaactgctgcctgagtaatttctggctatagattcatctaattatgatgattccccaaaagggtgactttaatcaaatttattttataattagcttcttatccttaaccatatcaatgctgacatttattgaataccatcaccgagctacagattcgctagctacagtaaaagtaacctttccccagcccttctaaagtgagcctgagggattcatgtgcaatatattgggatgaaaccgagrattgctctgaaggaaggtcatagctttattgagggagccttggcctttctagctgctataggcacttggaactgtttctgagagactctgttcaaatggctaagyatttctgagcccaggatcccagcagagccagtgttgacttaggtggtgatgaaggttctagatctgtcatcttggtggaccattagcacaaaaggtgggattggcaaggaaaagatgtggtatcccaggctacaaaatactgtgaggaaacacacttgtccctatatggcgtctactaaacattgacamctgcttagggagggttttaccatgaagggaaaaatacagattgttgaaccacactcaactcttaggttacaaaggctcagtgacctactttcygcttaccacaaagtaagttgctccaagtttaatgttggtctaaatttctctaactttctcattacttttacatttccagtactagacattccatgaactacagaccattgatgtttgtcctcattttggaatcyggtattattaaataactgcttattttattttcccaaatattaaacrgtccaaaattttgtgttctcattattcatgtggccaactagawgccctcaatctgctaaaaaaaaaaaaaattatagatccagttttcttayttcatagataaagcacttcttgaggcaaaatgaagcaagccagtgccttctaaaccttgattattctttcattaaaattagatagtaggccgggcatggtggctcacgcctgtaattcccccactttgggaggcygaggtgggcggatcatgaggtcagggggtcgagaacatcctggctaacacggtgaawccttgtctctactaaacaaaatgcaaaaaattagccgggcgtggtggcgggcscctgtagtcccagctactcgggaagctgaagcaggagaatggcgtkaacccgggaggcggagcttgcagtgagccaagattgcgctactgccctccagcctggacaacagagcaagactctgtctcaaaataaataaatacataaataaaatttaaaaaatgaaaaaaattgggtagtaacattaattcaccttggtgataatgaggaatttagaaattctcaatttaaaaattctacacgcmgtaaactgtaaactcagtgtttctcagatccrgtaattcttgacaagcattggagggtgcagcagcgcttagctcgtgaggtggaaacaccaaagggacaaatgcctttgcttgttgtcctctagagatggcttcaaagccccaacaggagtgggcccagattcacacctaatatttgcctaaattctcttggattaactgaagtcccagtttatggsttatatctaatagaaagcttaaagaaaaaaagtaaaaaaaaattagttttagatttttctttttgacatttttytccccatcaagaagcacaataaatgagctttgtcagttttctttatttcctcctatttaaattttttaaaaactggtattgctcaactgctgtttcttctctttgctttctcagttgtttctaaagaactcagaatgtggtcgcattccacattactttagaaaaaagtgggcagtggtccttttgaaatgtttcctattgatattttattcaactggcagagcactggagcagatggtgtagtttctgtgaaatccctygtttgcctgtgttacactccaatttgctttaatttgtttggccttcgtgcgcaatggaacttagctgtatactagtacatgcttccccctcctctgaatcatgcctccgtagaggagaccagtctcccagctactcagggtaaagttaacaagacagatgataggtctcagtcactgctgcctggtaattcatgtgcctctgcctagaacccatttctttcttccttccttcctttctttttctttctttcttcctttcctttcctttccttccttccttctttttccttccttcctttcttttcttttcttttcttcacagagtcttgctctgttgcccaggctggactacagtggtgsgatctcagctcactgcaacctccgcttcccaggttcaagcaattctcrtggctcagcctcccgagtagctgggattacaggcaccagacaccatgcccagctaatwattgtatttttagtagagrtggggtttcaccttgttggcsgggctggtctcaaactcctgacctcaagtgatctgcctgcctcggcctcccaaagtgttgggattacaggtgtgagccactgtgcctggcccctagaacccatttctatttcctgaaaatacttgatcttatctacaacatggaaatatcccaaacaaagggttttccctcatctctagtcctctttggtgtctcggcccacgccctccccccactttggagaaaaactgtggtccaactctaaatcccacaagtttattctatttgtggaattactcatccttagttttccttcagttctctcatagttcttagaactatgatgaagtttggaattagacattgcccagtaataaatccyggaaaaatagaacaaaaaattaaattttactgcatggtatagagccttgcccattgcaaacgatgaatatgttttaaagtttttaggaaggatggaaaatagtcataaaaacaaatgatagggaatcgttttgcagctcagagatttcagtagtaaatgtctatcaaatcacttgttgaagacagagttaagaattactgagttcccggtcccatgacgtggactctagtccacggagaaagtattgttcaatttcagggtgcttctcttcctcacaagttcgcatatgtctgatcgaatgctgcctcttggtcataaactcaactgtgatatccatcttgcttcttgaagaagtttttccaaacctcaactaagtttccttctctccctagaagacagtcaccccaattatgagagtgttgtgtatattttgattatacatacaattggctcttccaataatgatgagaaagtgtttaatataattattttctgatgcctttagtctgtcaccaacaccttctcactgaagaatcaggctgatatttttgatctaatgcagtgatgggatatatagaactttagaatatgatatatgtgtgtaaagtacttaatgtctagtgacacacatatccattttcttgcatattactttgttgatgttaattttttatattttcttagactttagctaattttaccagcttctaatattatgtacatgtttgatttcttttggagagaatttgaaagggcataacatcctaccttaaacaaacgactactagaaaggatacaagaatgttttaatccatgaaataagttgccagatattataatttctacattttactgaattaggctttgagaagcagactgtcttacataatttgtttagttagttgatattctattgccatctacaaaaaatctaaaatcccttgtcaacttcctctgcatttccccaacaaacttccttattgttcaatacagacatttaataaattgttgatgagttttgattatgtctcgtaccactgccatttcatgaatgaactttctgtatttcarctagttcctttaatcaactatttgtcaacataatcaagtataagtgacactataccttatgtttcacagccttttcactgttttctaagacaactgccactgtgatcatttatatcattagcccacaacttaacaactaactctttaatacctaacacatgcatagcagcctatttgatcaaatgtgggaccaagatttcaatccagcatcagcaatttttccctacattctgtgattttggttttataacttgatatattgttgctaaataatttctataactaatgcacmatttttttattctcaaactcatctactttgaattttttaaaattccagtggagcttttgatgtcttaaagacaaatactgaggttataactaaggtacataatttggcaatattcaaaccatgaatctgagtttaacttatttcttttttgtcctctttttccacatcatattgcttctaattacatgaaaaggccattgaagttcagtctttcactctttcaacttatagatttatgcccaattagaaatatttctattccagcattttcaaaataagggaattctttgaggttaatttaaaaatgtatatcttgaattgatacctcaagatttctgcaggctgaatagaaacttagcgaaggagctgaatgtattcttaaaatgatttaagaatgtgtggtaactctttaatgcacagagatgctttttaaaagtatttgtcaagattctttgawtggcaagttatcttcaaaagttagcttagatacaaagtagggtttataagaaggatactgggtgatttcatctcatcaaaggaagggcttctagaacaaaggaaaccagggacaagaatctgtcagcatgctctctcttccccgctctttttgctgattgctgcacaacttctttttcccttacggcagcctggcttccttaatgtgtcaggaaacatggctgcagacattttttaagtttagtatctttggctcctaccattgactcttactcagttgcagtttggacacatctgattggcctggattgggtctgatgccatgccttgccattgattgactggaattatcaatcagtcaatcaatcaaccatggtcaggatggtggggttgtataaacaatagcaacagtgactctaatcatgaaaatatctaccatatccattaggaggttttatggcacaattaacaggaaacttgattcaacctggtttaaacacaaaggagcaattcattggtttttaattctggaaggtttcaaagttgggtgtgcctcaaatctctcaattcagcattttaattatgtcatcaaatattcaactgtttctgtttttactttgtgctactccagtgtgagcctcatcctaaggctggctcctctcattgctgtaggggtgctgctctcacagtgggtactcctcacccacatcagaaagagagatggcttcyatcctgtggtaagctagagttgggttgcaccatcttgcaagagtcaattttgctcatctattcctattctgcatttaatgacttgttgttaatagcttgaaattggctatcgtgggagtatttatacgatggaaattggcaaatgccacaaatctctcggagagttggttgttatatttaccagcatactactacctctattccaacttccaaatatcaaacaagggtgttgaaattcacctttattggactggattgggtcacacacccacctttgaaccaaggtctatggccaggggacttggaattataaagtaagtgtgcataacgattttgtcagcgtgctcttgtaggaagagtattctaacagcaaacagcaaacaggatgtctgatttcagagtccaccgtgccatagcatgtgcttatataaaataatgtagtttgggtcattcccaatggggcatttgtaagtaagtaaattttgtgtgttggggtgatgtggatcattagatatatgttcaagttagcatcgccatgaaatraaagcattttgttcttgtggcttgtaaatgaaaatgggaaaatatttcacattgttaatcatcagagcaattaaaattaaatatcacaatgaagtttcgtttcgcatgcaccagaatggctaaaattaaaaagactgacaatgtcaaatgttggcrtccctgcagagcactggaagtcccacacatccctggtgagaatgtatactgatgtaactactatgagatatagtttggcagtttcttgtaaaattaaatacatacctaatttgggggctaataatttcactcccatttatatacccaaaggaactgaaagcatgtgcccacacaaaatctcatgcatgaatgttcatagcagcattatccataatagccaaaaggtggaaacaaaccaaatgtctgtcaactgatgaatagataaacaacatgtgctatcactataaaaaggaaaatattcagccataaagaggaatgacatactgacacatgctactacatggatggactcaaaaacattatattragtgaaagaagccagccacaaaaggtcacatattgcatgattttattcatgtgaaatgtccggagtagacaaatccatagaggcggaaagtagtttagtaattatgtagggcaggagaccatatacaggaaggatgagactggagtgattgttaatrggcataacattttcctatgggcaatgaaaatgtagaattgggaagaatgtcagatgccaaaaatgttgtgggagagtaagtcggcaacaccaatctagggatcatttggtaacctgaaaaatagtcttaccttagtgccagtatctaacttctgaaaacttattctgatgaaatgatgaaaaacttcctcaaatatttatgtacaggaatgtttgtttcaacaatatttttatttacagaaatgtggagaatatagaatttcaagcaatagrggattgatggaatgtggatggcacatctatatgttggaatttgatataggcattaatatattatgttggtgcaaaagttaggctggtttttttcctttcctttcataataatataatgttttattttatttgagatggagtcttgtgctatcacccaggctggagtgaagtggcgcgatctcagctcmctgtaacttctgccttccaggttcaagcgattctcttgcctcagcctcctgagtagctgggactacaggcgcgcaccaccacacctgactaatttttgtatttttagtagagacagggttttgccgtgttgcccaggctggcctcgaattcctgaactcaggtgatccgcccgcctaggcctcccaaagtgctgggattataggcgtgagccaccatgtctggccctaatataatgttttagaagaatatttaatcacatacaaatgcatgatggatgtaatttcatattgatacaaattaggttaccatatgggtgtcatttcctattaatacaaattaggtatgatccaagttaatattttaacagtatgtgttcacctacaaaaatcactggatatgttgtagtggacacayatctttttaatttcttgtttattttgttttatatttttctttgggggatggtaggctggagcatatattcacattataattggcaaacaaaacaataatatatattttatagtccttaaacactaatagtgtttgtgtgaacatctaaaatggttgttcaataaacattaaggagtttctaatgatatctccatgataggagtcccttatctggacataagcttggagcaagttttctcagtagcagcgctattgacatgttgggctaggtagttttttgtgggtcccagagggtccggggtrtaggtgctgccctgtgtatagcagcatcttcaggagcawccctggtctctactccactctacagtgtgacagcaaaaatgccttcagatagtgcyaggtgttcttggggaggcaacayggtccccagtttacagtcactgagttaaaggaaccgttatctaaagaaaggaaattctgaattgtttcaaggtggaaagtgtctactgtgaagtcctacctgttttatcatacctgtgcttgttttgtagttagagtaaacattgtttcaacaggaaactaagttaaatayctcrtttctcattttaatttttatagcaattgcatgagtcatcatcacatttttgtttttatttttatggccttaattgtttgtgtaggttctgatcataatgcggttgttccatgccttttccagctcgttccgctgtgacgggaagctgtgtcaacgatggcgtgcacrttatcagaggttacagcgtcatgtccaccccatttgctactgtgtgtggggatgrgatgccagctcccctcaccatcgcygggccggttctgcttaacttctactccaacgagcaaatcacagacttcggattcaagttttcctataggataatctgtgagtagccataatgacagagtttggaattttcttcttttctgagtaatgtatacaaagagttttcactgcgattcatacagcactaacttgaagattcagagaatttaagggaaaaagattgtcagtgaggttcatggttaaaaaatacatatacacattttttcttaaaaagaagaggacctttttcakgaactttggctagaactactctgaaaatcaaatgaagaattgacatttgttttgtaatttaatttaaataaatactactgctatttttttgtttttcttaccttacacaaagttgcctgttggtccaaattatccagatgcctgttttgtttccccaagtcattttgctaatacaaaaattaatattttatatatttagaagaaatataagagaatgtctttacagtctgataggaaagacttttttaaaacactatgcccaaaacaaaagccctaatggaaaagattgatatattcaactatgctataatttacaacttctctgcatcaaaggcaaagagaaaagaggagcaatagactggacagaggcatttgttgctacccagaaaattctaagattgcatttcctgatcttgaatagtcttttcccctcctgcctggttagtttgctgacaatatttatgcactatctaatagacatctcagctgcagtcaaactggcacacaaatcttgtaacatctttcttgagtctatttcatctttgctccaccaaacccattgctaaaggtagaaagttaaatagtttcccttggaataaattattgttcccatctccagagaagactaaaaacatgtatttacttctgaaaaggccctccataatttgttcacattagctgctatcggcatcctgactcccacagtttgtaaagtatgactacatatggctgtgtagctctgttggctctagcagaatagaaccacgcaattaacgtttcctctcccgtcgtcttgttgaataaagagaaggatggatttgttttattcttttggcacaactgctgctttggagaggtaaactcctgctttatattcttcttctctttaatctctcattttcctacaaggaagtagtcaagattcaatatattctagtataagagtcccacttaaagagtgtcgttgatgtgaagacttcaaatgctgatattgtgcaaagatgggagttatttaggccttgataaacttccagagaccacataattgtgtataaagtgaaaaggagtgattgctacccttatctgacatgtaattcacttttacagatggacctgggggtctgaacacacaagtwcttacaggcacatagagaagagtgctccctgcaaggtgggctcagttgaggcaaaaacagtaaagaaataaagagcctgacatggcagccycaatttgttcctcatttctgaggatgtaaagtggaacgtgtccactgatagygkataaaccatggaaatacttcaaaatgcgttaaccccattataattttagaatcataaatatacatagataggtctttccactgcagggagagtgatcatcaggaggtacaatctgatcctcatatgtaaacccaagcaaaaataatcactttatattgtggataagaaggctttattacatttttatgtctgtcgttttattgactaatggatctagctcaaggctctgagctgttaattgctggaatcctggagaggaacgggcctggcctcctcctgcttgttgaggattgaggatcagtgatattaatacaaactggggcaagtttagtccttaccagtctcacaactgactgcaaatccaccagactggagagctatacatttgagcccacagaaggaactaaactggaaagctccaaaaatgatttccagtagtttaccatataatattctatccctgacaggagagacagggatctctattatttcagatttccagatcacaaccttcctagatctgtacgcccagaacatcattctggccgccttttccgtacttcgttactgttgtcatccctctctcaacctgtcaatgaaatacagctaagtgatggtgaaatgttcctgctcgtcattttcactctggccattaatttgactcagactgattcctttccaagatgagcctttaaatattcttccctgtttctaccctcttgctgtctttcatcttccttcctagtggaaaaatcagaattatgtgtaaacacaatgaagggagatataagtcactttaagaaaaataattattacctcttttagggaaaaatgtacaatagtatagaatctcttaaaatcatttttccatgctgggactaatcgttgttctcttcatattcccttgtcttctgttgcagcctgtggtggtgtgttcaatttctcttctggaatcatcacaagtcctgcctattcatacgcagactacccaaatgatatgcactgtctgtataccatcaccgttagtgacgacaaggtgatcgagctcaagtacgtaagacaaattggctttcttaagaaaatcctttcagcattatttatagaagagccattcgtttattgatggagggcactgattctcatcggcagtctggagggaaatctacacagaggagtgatgttcctagatgacagttcaacctgggaaatgacgctccccctctccacacaagccggtagtaactaagggcaaaaaacaagcactcaccagttaaaacagtcgttatagtttcccaacaattgtgaaggagcatcataacatggattgtcaaggtataataagcccatcttgaaatcaaaggagagaggaagggcaagagaaagcagttgccatgtgttgggtatttattatacacaaagaactttgattcacacgtgccgtaattgtctcattgtattcttaaaacagtcatatgaggtatatatagattctagattgggaattgtatagattattcccatttcactgatgaggaaactgaggctcagaaggatcaaattgctttccaaaagtaacacacacataaagagtcaaaatgtgtattcatgccaggcttcctccaaacaccacatcctcaatgtttcccaatactgtctctcaaagkatacattttcttttttcttttcttttttttttttttttgagagaaggtctcactttgtcacccaggctggagtgtagtggcacaatctcggctcactgcaacctctgcctcccaggttcaagagattctcctacctcagcctcctgagtagctgggattacaggcaggcgccaccatgccctgctcagttttgtatttctggtagcgacggggtttcaccatgttggtcatgctggtctcgaactcctgacctcaagtgatcctcccgcctcggcctcccatggtgctgggattacaggcatgagccaccgcacccagcctcaaaggatacattttctaactacttaagaaatctatttttatacctgtgtcagaacacctctaaactgatgctatgagagatagcttgagtcactggtcaattttcttcccagtcttacctattcccaacaagactgatgagggcaatgcaacctcccactctccagaatgataaagttcaagactgttttcacctgacagcctatttcagtgatatacgtatggcatgtggtgggaaactctgacagtaatattgttcatggtcatgtaggactttccatacagaagcctgatgggctaagaccacacctacctacctacctacctacctacctcccctctatttgtctgtgatcattttctaccctaaagattctgtactccctgcagtttacttccagaggcctcatgtatcagttggctctccaagtgaacaagagatgtcttgatgaaagacatctctcatcaagcctgatttggttcctgtatcaggcgttctataggctggacctcgaagaaaactgcagctcttacctggactatttgtaggaaaacagagtgtcttttaggtcttggggacaaaagaacagaaactgtcagatggccaggagcaggagttctgtgaagtatgcctgcacaggcgtgaaagtgtaagggggagccatttgctactgtgactcactatttgtttctcatatgtgtaggattgattattgccttgttctgttcaggttgctttaacaaaatatcataaactgggtggcttataaacaacaaaaggctgcaaaagtccaaggtcraggcagattcgttgtctggtgagctcctgttttctggcttatagaaggtaccttcttgctgtgtcttcatgagctggaagggcctcttataaaacactaatcccatttgtgaggggtcctcccccatgacctaatcacctcccataggccccacttcctataccattagcttagggaacatatgaatttaggggaacacaaacattccaaccatggtatacataccaactcatagaggtatgttatatattctctctctctttatctgtctrtctatmtatatatmtatrtatgtatacaatctaaatgtattttttcagttttcagcctggatcctggagctcaccataatgaaatttacatctgcrtgtttattttattttacttatttatttatttgagactagctctcactctgtcgcccaggctggagtgcagtggcgtgatctcagctcactgcaacctccacctgctgggttcaagcgattctcccaccttagcctcctgagtagctgggactacaggtgtgtgccaccagcctgggtaattttttcttttgtatatatatatatatttagtagagatggagttttgccatgttggccaggctggtcttgaatccctgacctcaagtggtccacctgcctcggcctcccaaagtgctgggattgcaggtgtgagccaccacacccagcctacatctgcaggtttagaaaattatttattgcgcactaagagcctacattctaggaaacagataagattctaggtgtggtagaagatgcagacattaataaaaggctctcaaaagattgtggttacacaagcttttctgtcaatgggcttttcagatctcttctgtgctctcctgggaaaatgatgtaaaataaaaagccaaagcagatttaagtcctcttagaaactcagattttatctctctttgtggattctttttgtgaaaaataaatgtgttgtctgtagagaattaaaatgaatacagtgttgttggaaattatctagctattgttcttccctgatcttttacaataacattaaatgttaaatgtggtaaaagaaaatcaatacggttttcatcttgttcctcatcagtctgaaaaccttcaaccaaccaaaaccttttagaaaaaaaaccaacaattttttttctcaaggctgttgaaaggaagcatttattatatattttatatataaatatatattatttagtctatattttcaaaattattccatattatgrattgtttattagagctactgccaaaataaattgaaaatgcaggctgggcatggtgtcccatgcctgtaatcccagcacagggaggctgaggcaggcaggtcacctgaggtcagaagttcaagaccagcctggccaacatggcagaaacctcatctctactaaaaaatatacatgtaattaaaaaaaatagccaggcatggtggtggacacctgtaatcccagctactcgggagggtgaggcaagagaatcacttgaaccagggaggcagaggttgcagtgagctgagattgtgccactgcactccagcctgtgcaacagagtgagactctgtctcaaaaaaaaaaagaaaaagcagaagaacctataaaaatgaggacaggatatcaaatattatttttttaaacaagttttaaaaataagctataataaacccaccacaaaactctaaagtaaatccatgtaagaagccttgcttgttcaggaactctagaaatcgttatttgaaatgacaaagaayaagacctgaattaaacactgtataagacagagaaaagttagggatgcatctgtcaggataggttatgcacatagtaacaaacaactccacctcacagcagcttaactcaacaagttgatttctcattgtaatgagcatgttcagtgtggcctggcatggaagctctgctcatcgtggtcatccaacaacccaggctgatggaagcttcgtttttacatttgcttccatgatcatcactgcagtgggaaggcagtgtggcaaagcaagtagtcatttgtaaagcttcttccgtaaagtaatatgtatcccttctgcttacatttctgtggtcaaagcaactcctagcagccatgtcaagcctcaaagtgtgcccctagggcaatcctaccagtgctggggaggcagagagctgggaccatgtgcagaagtgtcagtgaccaccacagaggtcttaaatgtaaatttcctgttcttcacctgaccttaacataaacttcattttaaaagaggaaaatgagactgtgaggagaatggagctgtgattctaaaagcagcatttcttctattatattaacatgcttcccataagttctacttcatctcataaaataacaagggaagagtaaatatggtatttttaatgagacctaaaaaactaaagtattgctgggatagtaaatatcagttcaacttgtcaaaagttgttctcagatggaytttaatatgcyctagactgtgaattccttgaaaagtaagactgtatcttactcactttgacatccccagctgctgtcacagtttttgttgtattgtaattactaaaaacaaatttggctaaacttttgaactgatcagtaaagtactgtttgatttctaatatttcatatcaagtgagttttgaatgctctactggtagttttttccttgtcattttttttgcaagagctaaagctacaatttaatagaagtccaaatggaaacatcagtattaacaaggtacatttcacaggttcagtgattttgatgtggttccctccacctcctgctcccatgactacctggcaatttacgatggtgccaataccagcgatccccttcttggcaaattctgcggttccaagcgcccaccaaatgtgaagagcagcaataatagtatgctcctggtgttcaagacagattcatttcagacagcaaaaggctggaagatgtctttccggcagacattgggtaagaattctggacttgtaaatctatttktcaggactgttacctttctgctttatttaatttccccrccccccccccacccccacctgattatgattgcttttccttgaagcttagaagaatatgccatgtaagggcttggttttaaaacttacgtatgacatattttaatgttgtaaaaaaatcactcaacaaatgtacccagcactttgggaggttgaggcgggtggatcacctgaggtcaggagttcaagaccagcctggccaacatggtgaaaccccatctctacaaaaatacaaaaattagctgggcatggtggtgtgtgcctgtaatcccagctacgcaggaggctgaggtgggagaattgcttgaacccaggagatggaggttgcagtgggccaaaatcataccattgcactctagcctgggtgacagaatgagactctgtctcaaaaaaaaaaaaaaaaaaaatcactttggtagcacagtggaggaaggctagaagaacctacaacatggraaggaagaagcttatgatagaaatctagatgggaagtgtcaaagccttgaacggacccagaggggaaagagataaagkgaagggcagaaatctgagagacggaaggcagaatacattggaagcacagtgtttggactctgatgatattttaatgaggacatgaattgaggatgactttctataggtaatttgttggatgatggtggcttaggagactaagatttaagggagaaatgttttatttaatttggagtattttaagttggaagacctgtttaaatggagctgtctagttggaagctgatgcttgagaaggaatttggactggagagggtgatgtagcgggggtaggtaaagttaggtgagaggataaactgaaaatatgccccagattactcccactgcatgtgagaaataaattatccacatcaaacaccactggtgagaaatacccatatcaaattaactcagaattttgaataatttaaaataaaaggtagttaatcaattacctgtttggctattctaacagcatcagtgacacagtctaagatcattaatattcgactctggaaagtgttttgatccttttccttttgaatatagatgtgattaatgttctaaaaatgcacaactctccaaacaaatctcatactctgtgaagactcagaaaaatccaggcagttttctgtaataataaccctgattcacttttcaaactttctgtttcttccatagtgtggataaacttcgtttctctgatgcaaaacggagtttaccttcaacttcttgatattgggcatgtgaatttttcyatgcagtacttgaggaaagcaattagacattgtgttttgaaggcttcccggtaaaccacacacctcaagacaaattgtatcagaaaatccctttgccacctcccctacttagctgtctcaacagtaacttgaaagcaagtctcacgggcagtgagagagtgttgccttaacagaattgtgtaggtgaagtagcatacaaaagccagaaggctattttgaaagaaaaattaattttcctttggagatttttttttgcacaaaaaagggatatattcttgcctttagcacagactttagaccaaatgtcctatgtctgcatttgctttgctacctttcaagttgtttttctttttcctaatatagtctcacaagaaaatggtaattgttgtgttaacaatctcctcactgctatcatctgcatgaagcttctcaagtgagccagggttccctagcctcattaaattaccatgtctttccaagccacaaagaagacatttttagacctattgtgatttaacagaaggaaaagtcttacactgtcagaagcattctctatgcacgagtcattgaacaattacagtcacttactgttttcctctggccacagttagggaaaaggtttaagtggagaatgtagaaacggaactccttgccagcattgtgttacccctgtatttcatgaagatgatttttacctctttttcatctgcataaatgccatcagccacttggaaatacttcaagtcattgtaactactctttgatggtaatgtttaagtgaaaacctaagtattatgattttgcattgcagtggtcttacaaagctttcaagaccacacactgacaagtttattgatcattctgcataactttcaaattttgtttcattttggtttttattgtttgtagtgaggagagggggaaggaacaataagaatagctttgactgtaaggtttatagggtcgtttagttatagctttggatgaagacaaacttggctaataggatgccccttttgcctccaactcatttatgtaaaacaactctgtctttcccctgaagagagggaaatcaactttgtggaccagatagtggattttcatttacaaagctgtttgctcagcctggaaaacaatatcttcacttagtaaataattgatgtgaagaggagaccattttagtctawgacatttccgtttcgatcttaactaaaacactaagtagggttttgcagatttgctatttagattatacacttggcaatgttttatgtacatctgcttcaatttttcaggatgaagagattggcttatataattatgtgactattaggttcaattcgccttgtgcatttgttatatttgtattgctagcgagtcacagcaaatttgggggaactatccctagttgctaattactaaatatgtagtgaaattgggtctcctttttcctcggaacttctgctgctggaggcccatatgcatggatgcaaggtaaggagaaagcacatttggcaagcatgagctgatctctaactgcaatggaaatgtgcctgcttgtctcccccctgtgctccaatgctatatgaataattgatcctgaatggctgacaaccagcaaaatgatcacactgggctgcagcaatctgtgaaactctgaaataatctgcaaatcggagcatttttcctaaccgagttcatagtttgcatcagattgtcaatggcttctatgctcctataaagtttaaaaagctgttggttctgtggatttggctaagtgggcatggcctataggcagaacggatgcttttaagtaccttctgtcctgttaacttctgctagtttagttgctgccccttcctttaccagcagggtcgtctcctgccttgactctgtttatgtgtgtcctgtacaaatcacttcacacttgcaaacgtatttttaaccatcagagcctccagttcttcctgagggggtctcataccagagagttgcttggcctattcacaatatgcatgtcacactacacatcaaacttctacacatagggttagatcaggggctttcagtaaacttatttatttactgtgcagtagcatcattgtttcattttttttttctaaaatgatgtattctataacacttcagcaaaacttcagtgtagaaaatggaacttggctctattagatgggaggtctgcaggcatttcaattagtgagttgccaaggagagactgaggggtgtcccctgcaagacagcagggggacagacagcacaggaagacagatggggaagacgcaccctcagggacaagtggtggcagtgcctgtgtttctggagttggttccttctggtgggtttgtggtctcactgacttcaagaatgaagccatggaccttcgtggtgagtgttacagctcttaaaattggcatggacccaaagagtgagcggtagcagggtttattgtaaagagcaaaaaaacaaaacttccgcagcgtggaagggtacccgagcaggttgcggctgctggctggggtggccagcttttattcccttattgccccctcccatgttccatttttgtcctatcagagtgcccttttttcaatcctccctgtgattgggtacttttaggatcctgctgattggtgcattttacagagcgttgattggtgcattttacaatcctcttgctagctacagagcgctgattggtgcattttacaatcctcttgtaagacagaaaagttctccaagtccccacttgacccaggaagtccaactggcttcacctctcacctggactcaaagctcccagccagcccctgttgcccagagcacacatgctgatgacgagggccactgtctgccttcctccacctggggtatttgtcacatggagactgagtcaggttgcattaaggtcagttcagagacctttgytaagagaccaaggcaaaaatacccaagcacatatataacaaggacagaatgaattacagtccaacaaatgtataaatatgttcaggtaggctgggcacggtggctcacgcctgtaatactggcactttaggaggctgaggcaggcagatcacttgaggtcaggagtccaagaccagcctggcctacatggtgaaaccccgtctctactaaaaatacaaaaaattagccaggcatggtggtgcatgcttacaaacccagctacttgggaggctgaggcaggagaatcacttgaacccaggaggcagaggttgcagtgacccagtgacccaagatagcaccattgcactccagcctgggcaacaagagcaaaactccgtcccaaaaaaaaaaaaaaaaaaaaaaaaaaaaagctgggcatggtggctcacgcctgtaatctcagcactttgggaggccgaggtgtgtgaatcacctgaggtcgggagttcgaggccagcttgaccaacatggagaaaccctgtctctactaaaaatacaaaattagtcaggcatggtggcacatgcctgtaatcccagctactcgggaggctgaggcaggagaatcgcttgaacctgggaggtgaaggttgtggtgagccaagattgtgcccagcctgaggaacaagagcaaaaaaatccatctaaaaaaaaaaaaaaaaaagaaagaaaaaaagacatatggccagatggaaagagctgattgatgcatgatatcattgcttggtgatacggctttaraaaagccctataacgttttgaatctcaatytttatctactaaaaaactgatcaatttgaaatattacaactrtttaagaatgtgatggggataaagcagataatttctggaaagcaccttagctgtcagagtgaaagactctatgtattagaaagtaatattgaagtcccaaattttcaagccccccgcccaaccctatttccaaggttggagggtggctgagggtggggtgggcagsgatcaacattctcaacaggaccacatcatgctacagtgatttttcgttctttcctacccactttgcagtgacacctaaccgtcaaatcctaaagtacattttataacctaaatctgaaatcaaaagctacattctgattaaatccccaggccttgcacaattgttactccatcgatattgtccatatgagtgatttacagaataaatggataaattgtgcctacttcaaaatcatattttataatgagatataataatataccatatagaacacattagattttatctagattcagctcattctcaaaattcaatcctggtttatataattgttgggtaagctctacacagggaggtaaattgaatcactttcatcttcagagaattaggaataccggatcacactcaatatttaggtcatctgtgtttctctcctgtgagtttttgcctgttaccttaacatctggaaaatgtctctcaaacacgttaaatgaagacagtgggagtggcagaaggaagttgaaggggataaaaaagaaggaaacaggaaagaaagaaagaaggagacagagaaagctgaagagagtctagggccacaaagatggaaaacatggtcacaacaaatggaaaaaaaaatctaacatgtccaattcagacttctgcttctagttatttttaagtttcccagttttggtgttaaatttaaactttgtgaggcattctaaaatagctaaacaatacaagaataaacttaaaaattcaatggcataaaaaatwtatgtatatgtctctaggtacctcttggtggcctgattgaagttgtcagctcacgttactgttaraagtacaaatgtaataaggaagttgaattataacttgaataattggataaatcactgatcaaacaactctcagtttagcaataatgagggtattgctccaaagcaaccrtggaatgtcatttttctggtttcctaatgtcatttgctccctgtgatgaagtctgagaatgagatgagctgaaactgtaaacccatttaaagaaaaacccaactaagcttatttccgctctttttaagccctgtaccttttactggtgattagacttcccttgggggatgatcctaaagacaaggttatcttcacgttattctttgtgggttttatggggaaaggttttttgctgagctgagaatgtgggaacgggataaagaaaccaacaaatgcttagttcaccaaaactttacaaaagcaagtagacaggagttaaataccaaatcagcaagaagaaaggaaaggttcttaataaacatatttcaacactggagtctgtgcccccaccaatgactagattgccactcctggtcttgaaggatggggctgtccttgtgaaaataaaaccacatggtattgtggagaccaaactaagtgataaaattgagttaatggtaaattataggataacattttgaaaaacactgaagggaacaggtgctgggaagaagcacttattatgtgtaatctaaaacacaagacgcgacctagttttgtcgcaggtaactggttattttgggttaaattatttgtacccataaattccctataataatcaacatccttactcagatcagcctggctttgttatagcattcccaggaacataaaaacaaaatatatgcagtgagcaataaaaatttkaaaacattcttttgttataaataaactgttaggaaatataatagtgggaccgtgttcttctcttcattctaatatgtgaaaagtctgttaacattacatggtagctgtacattttgctcactcacaagtaaagacttgtcaggaaatcccagggcatcgtgaaaatcactgcttgtccctgaacctgtgccctaccagatgtagcatgagctgcttgatgtatattactttatctaatcctcagagctaccagatgagacaggaattaccccattttacaaaggaagaaagaaaaatttaagagattaagtaatttgtctgtggtccaaagrgtttgtaagaggtaaagccaggctttgaacatgagtttgactgtcccccaaactcctgattttcttagtaagccttcattgcctctgtggcaattgataaaaatacccagrgatgtgakgtgtgtgtgtgtgtgtgtgtgtgtgtgtgtgtgwgagwgagagagagagagacggagtctcactctgttgccaggctggagtgcaatggcgtgatctccgctcactgcaacctccttctcccaggttcaagcaattctcctgcctcagccccttgagtagctgggattacccgcgcatgcaaccacgcctggctaagttttgtatttttagtggagacgggctttcaccatgttggtcaggctggtctcgaactcctgacctcatgatccaccctcctcaggctcccaaagtgctgggattacaggtgtgagccactgcgcccagcccccagggattctttttaacagaaatgtatgcaaaagggcactggaagcaagaaagaagggatctatggtacttggatgttccgtggaagaaaggacacaggactgttagaggatgcacctcagagaatgtgagtcctgaattatggtgcagtgggtaagagggtaaacgtggagcatcacatcccagattcaaactcagtttgtacatctcattgaggtcgatcttggacaatttacttatccactctgagtcttgatttttttttttatctgtaaaaacagtacactaataataatgaccttatagggttcagtgattaaattagaaaatacttgtcactcatttcacatgcgagaatttttagctataaatagtattattttggaaggataagaaggcattcattggccaggcatgctggctcacgcctgtaatcccagcgcttgggaggctgaggcgggctgatcacctgaggtcaggagtttgagaccagcctggccaacatggtgaaaccccatctctaccaaagaatacaaaaattagctaggcttggtggcacacacctrtagtcccagctactcgggcagctgaagcaggagaatcccttgaacctgggaggcagaggttgcagtgagtggagatcacagcactgcactccagcctgggtgacagagtgaaactctatctcaaaaaaaaaaaaaaggcattcaytgggaaaatggacaatctatggagaaataaaacacatgcacaaagttacaggtgcatcccatttcaatggatgccrgctaacctgaacattggtaatgctttggggcataaggcagagaacaataggtgctgagagaggagagatatgcaaaggccaggcatggagggctctgtatcatgtgcaaagaggagccagtcattgttttgagctggagcgtgctatcatctggtcagatttattttagaaagcacatcccagcacctgtggggatgatgttttgaagcagcattccagggaaaaagttagaaaagtattgcaatagtttaggcatgggatgataagagcagtggtaccatgaaaataaagaaagagactgaaaggagaaatcctcaagatatagaatcaataacacagtgttccatttgagagaagcagcttgggaagaagaaataataatgctcctaaggtttctggacaatgtcttgtgacaccactattcaaatagaaaattactaggagaggacagtgctttgcagaataaaataataaaaatgttgggttttgtctggagaatttgatgcctttaggatatccagctagtgatcagtaggtagtcagataagagagttagaagctcagtagaaacatcttggctggagttttgctcttttttattttgaagccatataatgtggcacatgtacatttataattattatatctttctagtggattgactgataccattatgtaacaacgtttttaaatgctttttgccttaatttctacttgttctgatttagtataacttccatagctttcttttgattcatatttgcgtgatatgtttttaaacccttttattttcaacttgtctctatcctgaagaatatatttggcttttgtttggctatgcctttctattgaagaatttaatgtgtttatatctgataaaattactaacaatattagttttagatagacctttgtactatttgtgttttgtttgtcccacttctttttgttttcctttaactatcttttytttttaaaattaatcacttttttattactccccttttaaaattattatttatacatcctgtgactcttgtttcagtagttaccttagagattacagtattcaaccttaatatgttagaatctaatttaaarktgatacttttatcatgttataatcaataatcaatccaaggaccttggaacattttaaacccacttacccacttcctgtctttwgtgctatctatgccaagtattttaattctacgtacataataggtacacaaaacatttttattgttttatacaattactaataatgtaaaattacccttgctgttatttttcttttcttcctgaaattctatgcttccatatgggattaatgtatttcttttggaagacctctcttttatgtttctttcattggagatcttctggtaaaaagtgttctttgtttttgtttttcgaaaatgacttgattttcttaaattctgtgggattcttgctctgagtatagagttctaatttggcatttattttcattcaggactttacgatgctattccatcatgctctggcttgtattattttgattaggaagccattgctttctataactggggacccccatccctcccctggtcatctcattgtagagtactgttattgttgctgttgttgttatttaattttattttagccattctggtaggtgtgtattaatatctcatgtgattttaatttaatggtgaacaattttcacgtgcttttcgtcatctatatatctattctctggtgaaatatctatttatatcttttacccattttctaattgaattgtttatttttctattgttgggttttgagagctttttatctattctcaatcaatgatcctttgtcagtatgtggtttgcaaatgttatttcccagtctatatcttgccttttaattttcttgccttatattggcctttcactgaacaaaagtttttaatgttgaagttcaatttatcgactttttcttttatagatcatgtttttgataccaagtctaagaattctttgcctaccccaaggtcccagagattattctggtgttttcttttaaaagttttatgattttacatttttcatttgtgtctatgatccattttgagctcattttggtttagatatgagatttaggtggaagtcagttttttgcctctggatgtccaattgctctagcaccattggttgaaaaggctgtccttccttcattgaattgcattggcacatttgaaaaaaatcagttggacatatttgtataggtctatttctgggttctgtattctattccattgattatgtgtctaactcctcaccaatatcacactgtcttgattactatagctacatggtaagccttaatatcaggtggagtgattcatcccacttcatttttctttgtgaagttgttttagctatttgaaggcctgtgcctttccatataaattttaaaataaaggctgggggcagtgtctcatgcctgtaatcccggagctttgggagaccaaggtgggaggatcccttgaggccaggagttcaagaccagcctggccaataatagcaagaccctgtcttcaccaaaaataacaaaattagccaggcatggtggcatttgcctgtggtcctagctaactgggaggctgaggtaggaggatcccttgagcccaggagttcaaagttgcagtgagctgtgatcacaccactgcactccagtctgggtgacagagcaagcctctatcctaaaaaaacgtaaataaataaaaataaaaataagttaagctttttgatgtttgcagaaaaaccttgctgagatttttataggaattgcattaaatctatccatcaatttggggaaaactgatgtctttactatgttgagttttccaatccatgaacatatatgtatctagacttatttaggccttcttttatttatttcattattttgtaattttcatcacataagcctgtatctgcttcattaagtatatacctaaatatttcatttttttgtaatgattataaatggtattgttttttaattttggtctccacatgttaatggttagtatattaaaatttgattgatttttgtgtattgttcctttatcctgagttcttgctgaactcatatgttagttctaagaatgtttttccatattacttgggattttctgcagctaatagttacttgcaaaagtggaaattttatttcttcctttccagtctctctatatattttttcttgctttattctggcaagaattctaatactacgctgagttagaggggtgtgaaatcaatatcgttgccttgttcctgatcttagggagaaagcgtttagtatttcaccattaattatgctgttagctstaggtttttgcagatggtttttatcaagtcaagaaatttctcctctattcctagtttgccaagagtttttatcatgaatgtgtgttggattttgtcaaatcctttttcagcatcaactgacatgatcatgtcattttgcttagtaaattatttttttaatttccaagttggaaagaatgattctcataaaatgccctggggctaatgatgtatgcatagagcattttcagtgatatctaaataatgcaagataaattaaaagataacgataaaattttccttctcctaagttctttatacaagtattgctctttttctattaactacagctactgattagcttgctgaaattacctttcttttagtaaattaccattcttttagttttatgattcctaaatattaccagactaaatacacattttaatttagattaagctgggtttcaaattaggataactaaagtgagtsaaattaagtgaagcaactaaaaacaaacaaaacaataaaaaacctcattacaaaaactactaacttttttcttgtaaaacataaatattatacctgaagtattgtacacattggagattagggagtaaaataataaacactgtttacttttagagaaaaagacaaaacaggttcgtctgaaacctagtagaatgtttttacatgaatacactgctttggagcaattgtgtatctgcagctttataaattacagtaaggctgattccaaaaaaggataatgcatttctagccctgcatccctgggtggtagaaaggaagctgtctaggtgtgctcgaatttccctaaggcaccagctttaaatgtctttgtattctgcttcctgtagtttccagtaaagcttccttcagctgcagcctaaagccacagatggcttgctggaaacaggagagsgcctgaagtcaagccagtctgtatctgctsgtacagcacactgtgcaccttctcagtagtggtcaaccagagacaggcagagatactatccagacaacctcaggaaaatgtcagccgtatagaatgtgagccacaaaaatgtcarttctccaaataatgatttaaaaatrtatctaactccactgaagccttcgagatgttttatccaagagaatgtaactattttttcccttatcagattgatcttggcttaagcttcactctgaggtttagtcattggaaggtaataattcaggattcggttaccgatttttaattaagtagatttagacctggatctcactccttattatggggttatatttccaatatttctttagccaaaacatgtattttctctgaagaaatggctcttttgtgtgagagagatatttccaattcagggaagaaagagtgacgtttgttcttggacgcagggtgtgtcatcagagagtgactracacacctgattgatgaggcaggtgctgatggatgagagctgtctaggtggccccaaaatgtgtagtaatgaggaaatgatggattggtgatgctaaacatatcaaggttaagatggcttatacattaaaaaatgcaatttcaaaatatcagtatggtaaatatatatgactttctgatgcgtgggactctattgcatagtcacagaggtcgcccttgtttatatwccyccaccattgaaacacagaaagagcaatgtggcaatakctccttttgggaaagaacccttcttttgttaatattgatcattacrttttctcaaagacatatacacttacatttcattttgcatggagcagttttgctatatttaagcactaaagagggggaattagagcaattgctattccctgcactacacaaataactgttcactcatgtaatatgatattcacttcaaatatttgattattttggccaggattatctcatgatatttttctccatgttctttattctgtgtgtatattttgtgaattgaacaatgagctctattatagtttgatagctcaaacaagctattaatattagttgtgygtattagtctgctattaccatgacagtgctacttaacaaaccatccaaaattcagtgtcttataatgaaagcatttgtttttatcacttatgggtccacggactagcttgcctgcctccgttccaagctgcgggttggctgtagttggctgtaaagttgagtctgggttcaagtctgctccacatgaatccactttttctttgaaccagcagttactcagcacatgatatcttagtggatcacaggagcacaaagtcctagacaacaataaaaacaagaacaaaacgtaagcacgtttaaggcctctggctgcttcatgaccactaacactcattctaaagcaagtcgtagggctaagcctaacatcaagtgcacagaaaaatatactctccattttagtgcagtgcaaagagagatactgaagaattaaaaatcagccagttaagctgggcatggtggcatgcayctgtaatcccagctattcaagaggctgaggtggaaggatttgcttgaccccaagaatacgagaccagcctgggcatcatagcaagtcctcatctagaagaaaggaaggaaggaaggaaggaagggaaggagggagggaggggaggggaggggaggagagaggaggggaggggaggggaagagagatagagagaaagagagasagagaaagagagagagagaaaaaaggaaaggaaaggaagaaaaaagaaggagtgagggaggaagagaggaagggagggagggagggaggaaggaaggaaggaaggaaggaaaggagggaggatggatcagccaatttaccwctcaatccatggcaaacacatcagtgatttaaggatgcttgttctggggttccctggaatgtgggtgtgctgctttatggcattagtcatagcagtagtactacataataagtgtgtgtaatggcattcactgggcccaagtacaattgccatcttgcccttatgaacttattagtaacagttaataaacaagtagtgataaatatagcttgaatgtttaaaaataacatttagtttttgaagctgatgattaatagaataatgcccagcaacagcattttcctgtctacctacctccaactcttcagtgctcctacctgcagccctcaccacagcaatgtcctttcacctggtctcatctycttcagtctcgttcccttgcatgtaaaatgctggttctggatcaatttttagatcagacttrattagcaagtgcatcctgattctaccacttatttgattaaaaatctttcaactgaatcccattagccamagaacacagtctgacagccaaactctgtataatccagcattgaaggccctctgtagaagaccccatcctgttttcccaatcctaattctcattattctccttcatgtgccctattcttttctcagagttatgcttgcccatgcatataatgtaaattcttgcccatttagccttggatcaagagattctttcaggctggaattgccaatgccaattccatttctacatggttttattctatttatgcttcaagacccagatccaaatcacctcctccttggaacagttgagatcctcatagcccaaagtaatcttcatctttttgcaaaactgtaagacgtttctgcctcttttactgaacctatcattttctaaattgcgtcatcattatttatctatgtcttactactaatggactatcayttatctttttctacttaaatactaaatatactttcttgaatattgaaacaatatgtaataaataaatttatcaatccattcataccctcagtcatcgttcttctgtgctacgcatgccaataagcttaagtggtttccttaagtaacagtcagttcacactggaatcaaagctgctcaaactccacaaactccaaccctctcttgagtttgcaggcccatttcagattagcagaatcattagcaacatgtggtgaagcactgcgtattgcttacgtttcagaataattttgtcctatatgacctctgtgaatatatcagggactgggcctttggaagcatttcaactttgggaaatgtctgactatgcaaatactctatagtttcrcctgacttagaagctatggacaggccaagcctgacctactaagtaatgtgcctgtaacaaaaatcaccctgcacgtttgctatctatccattggatttacagacagggttcaggagagccaccattgttcatgtttactgccaaggtccaagtacaaaatcttagcaccccctaatgttgaaagcagtcttttcaccgtgagcagaaaatggaatgagaaaaatagactgaaggccaatcccagcgaagtttaactttggaactagccatgacctatatttgtgtagaatacaagctttatagacattaatttcagcaccagtttaatccctgttcctactagggctattttgagcttatttcaccatttctttcaaaattgtcaataaattgttcatccctttatgctcttcttaaatcatttctgagctgtctgcttaggccatggagtagacaaaactaaatcttatgttctgaggattgtttttttgtattcttttatggtagaccgtttaatcatcttgagattattctttatctctcctttgtatttttattctgaattataaaatttttatctgaaagaaggcctttttcttctataaagattttttcctttagcttctcatgttttggaaaagaaaaagttaaatatagagtgtggctgaatataaactggactgcagtgttaaatgcctctcagcctctttctatcacactgtgtaaataaaagatttgttggcagcaattttcttggtttgttgggtaaattcttcataaattcagttttcagtctgacagtgttcatgaaagcggaacataaaagtaaaacatatgcacattttccaccagctttattatgcaaagtacttgattttgtataaaactggatttttcaaggccaggaaaatcttcaataaatcacatcagcaatcccaaaaacgtctgtagaaccctatgtgttttcccacttctttcagcaactccgtgaataagaaggagacacctgaaggctctgctatggaagcaaagagcgagggaggcaaagatagagtgaggaagggaaagatagactgagggaggcaaagatagagtgagggagggaaagatagagggagggagggagggaaagatagagggagggatggaaagatagagtgagggagggaaagatggagggagggaaagatagagtgagggaggcaaagatagagggagggagggaaagatagagggagggagggaaagatggagggagggatggaaagatggagggagggaaagatagagtgaggaakggaaagatggagggagggagggaaagatagagggagggatggaaagatggagggagggaaagatagagtgaggaagggaaagatagagggagggagggagggaaagatagagggagggagggaaagatagagtgagggagggaaagatggagggagggaaagatggagggagggagggaaagatagagggagggagggaaagatgatggagggagggaaagatggagggagggaaagatagagggagggagggaaagatagagtgagggaggcaaagatagagggagggagggaaagatagagkgagggagggaaagatkgagggagggaaagatggagggagggaaagatagagkgagggagggaaagatagagtsagggagggaaagatggagggagggaaagatagagggagagagggaaagagagtgagggagggaaagacagagtgagggagggaaatatagagggagggagggaaagatggagggagagagggaaagagagtgagggagggaaagacagagtgagggagggaaagatagagggagggagggaaagatggagggaaggaaagatagagggagggagggaaagatagagtgagggagggaaagatagagggagggaaggagggagagatggggcgggtggggggaaggaagaaagaaaagaaaagagggagggaggaaaggagggagcccaggagggaatgatctgatcatgttctcagagtgtgacagaaaatggaaactatgttctttttaaaaaccctccatgtacaatgtaaggtcggttctgtttggtctgcatagtgatgtctttgttttaatgcagggcctcagcaaggatgtggtggttatctgacaggctcgaataatacctttgcctctcctgattctgattcgaatggaatgtatgacaagaatttaaactgtgtatggatcataattgcacctgtaaacaaagtaattcacctcaccttcaatacatttgctctggaggcagcaagtactaggcaaagatgcctttatgattatgtaaaggtaaggctgttttatttttttaacagagtctattcatcccagactctaatatagtgtattccagtttatatcgttacaggaagtcctgctaattttgagtacaggtgctactgctttttaaaatgaccttttcttcagtgatgctacatttaatattatagatgctctatcttcatatcaaattaatctttaatatgggtgactcaaatattttgtgtgactggcttccaacattagcatttaaatctcctattcatcaatgtcttgcaaaagacgatctataggaaggtcggttttctggagagagatactcaaaggacctttggcaaatcctaaaataaacaatgtcagtgacacaaataatcacctcttaatttgtctatttcttaggcttatagatttgcttatcacattatgtttagatattaaaatggttctgaaatcccattaaaagtaaataaaggctgggcactgtggctcatgcctgtaattccagcaatttgggacaccgaggcaggaggatcacttgaggccaggagtttgagaccagcctggccaacatggtgaaaccctgtttctactaaagacacaaaaaattagccgggtgtggcggcgggcgcctgtagtcccagctgctccagaggctgagrcaggagaatcgcttgaacccgggaggtggaggttgcagtgagctgagatctcgccactgcactctagcctgggtagcagagcaagactccgtctcaaaaataaataaataaataaaataaaaaagtaaatcaagaaacttctgttcaatttttaatgactttaatattaaattattatacctatcaggttatataggttcagattacaagtgttaagtagcatcaatcagtatttactactgcactctcaggggaaaaataaaaagtatggcaagatttgtatttatgaggagcttaagtctgattagaaaattatgggatgacacatgcaaattaagaatgcatagttcaggatagtcagcatttaagcgctaatgaatgcattcgatgcaggcttgaagcaatgtgcaagsttagaaggaaagaaagttcatgaaactcgtgtgatcaagaatgacttgatagagcgagggaaaacttactcaggtcaggagagaattcaggcaaggtgaacattttcaaaaaggcataggaattgatacgtgcatgttctcgaaagcgtaaagaggctggctgtgttgaagcagaatagtgctaaagagtagcaagaaataagatggcctacatagagaaataccgagattacaaaggatcctgaaagtcaaactaatgactttagactctgtgcgggtgaaaataaggagtggttgaaggttttccaatgagtgaggtgacaacagcagtagctagggaagactaacctgaaatcagcagctgtgggaactggaaggagaggaggctgggagggctccagagagaggtccctcctaggtgagaaggtcagtcttagacctggatcaggggtgcagccatggcggtgatggcaagaggggtgcaagagaaacttaagttctaggattgcaataaactttagagaaaataattttaaaagaaaaggaaggaaaatttgtggagggaatacccatttgagcacttagttacatgcttttgtttttactatgaaaggggctaaggttgggaggccagaaaaataacagtgtggtttggtgagagcaagacagacaagtgagactgcagtgggcagagaatggaacrgggctccggtgagaagacagctccacgaatagagaggacacagcaaagagccttccttccatcaggagaaaggatgctttcttagagggagtcagcatagattttcagagagtcaggctctcagctccaggaaaagtacccagggaggcaaytggagaaggcaaaaggcacaggaaaagaacagacgcgtcatgaaaagataaatgtgaagaccaggaatagtgtagtatccctgaagtcaaggggcagggggattcttttacaaagcatgggtggtcaatactattgaattgtaaagtagaggccaagaaagggaaagatgaagaacagcctcattgcactggatgacaaccatttaaataaagtattggcacagaagctggatcagaggagttcatgaaagactaaagatagcaaggaatgtcaattccagtttaattctcctttcctaaaatgagacctggccggccgagtgcggtgactcacgtctgtaatcccagcacactgggaggcagaggtaggcagattgcttgagctcagaagtttgagacaagccctggcaacatagtgagaacccgtctctmcaaaaaatacaaaacaattatctgggtgtggtgctgtgcacctacggtaccagcttctcgggagactgaggtggaaggatcccctgaacccagaaggtataagctgcagtcagtcgtgattgcatcactgcacaccagcctgggcaacagagtgagatactttcgcmmaaaaaaaaaaaaaaaaaaaaaaaaaaaaaggctgggagagaccaaaatgactagagcagtcctaaagcygaattcaaaactgtttgagagctctcctggctttacagaaaggtaataaggtttagagacggasagtatggggactctaacccaattttgctgtcagacaaatttcctaatctccccgattcctcatcatttcgtcaatttttctttaaatcacataatagtacctactgtgaaaggcagttttgaggattgaaattatgtgtactagagcgtttagcactgtgcctgacataaattgtaaacaaatttacctccctttttttccccgttggagtaattccaaataggcatgggcactatggaatttctttttcttaaaaactaaaaataatggatttgcatataaaattacaattttaaattcttatagaatgatttgagtatggccctgctaggagagttgactggatttactctcaagatccatttttatggagtgtgatttgataatgtcatcaaaacagcctgtcattgtctgaatttccgcaattcattcaggccagaaactgcaatatcaaaaacaaggagttattttcttgcttcaaaataaaatatcgtttttttcaaataaattctgttcagaactattcttgttttcccccttggaaaagcaatttccttccattggcaacgtttccaactaccactaaactggcagatcaaagaatagcccttggaatgtggagcttggagctttctttattaaagagatttttctgtgataaatgggacggttgattccttttagatttttttttagagattataatcaaatcactttttagaaaagctaatttaactgaactctgtggtagatacacaagtaaaatcataccaattccattattcattcataattctatcatgatcgtttgtgaaagggttgacttggagagtaattacggtaactgaatcacgtagtgaattgtgcatgtcactgagcagtctcttttgaaatccacatcgcatccattgcaggagttagttggcaagggtatgtgccaggccctgtaccagcatcactggagatgtagagagttaaagacatctcttgaagagttcaagcttcttgaggagctgctagtaaagtgtaggagactgacatgtaaacaaaaaacatacatttaaataattacatttaaagtacaaataaaatacatttttttttttagttggagtcttgctgttttgcccaggctggactgcagtggtgctgtcttgcccaggctggactgcagtggtgctatctcggctcactgcaggctctgtctcccgggttcacgccattctcctgcctcagcctcctgagtagctgggactacaggcgcccgccaccacacccagctaattttttgtatttttagtagagatgaagtttcactgtgttagccaagatggtctcgatgtcctgaccttgggatccgcccgcctcggcctcccaaagtgctgggattacaggcatgagccaccacgcccggccaaacacatttaaataacggacatttttttcacattgtataacrtgttgcataacatgacaaaaatcataaatagaaacaacatagaagggcagagcagaagaggctctgattggctttgttttggctaggaaaggctttctagagggtgatggctgagctggaatttacaaaatgaacagaaactcactcccttttgttatcctttacgaaactgagaggagcatgaacctagctgactttttctgccaggaagtatggaaccagcagagagaggtcctcatcctaacattgcccagtttttcctcaaccccatccgtgccccttttctttttctttttctttttcttttcttttttttttttttgagacagagtttctatcttgtcacccaggctcgagtgcaatggtgtgatattggcttactgcaacctctgcctcccgaattcaagtgattctcctgcctcggcctcccaagttgctgggattacagacatgcaccaccatgcccagctaatttttgtatttttartagagacggggtttcaccatgttggccaggcttgtctcgaactcctgaccttaggtgatccacctaccttggcctcccaaagtgctgggattacaggtgtcactgccccttttcatagccaatattttgtaatccttcctttcccacctgaagtgaatgtcatctatgctataacctacccataatgtaatttcagaaaatcactgtactatcccaaaggcaatgaaaaggagaaataaaaggaaagtatataaaatagtgtgtcttcgtatatgtaaatactctaacactgctacacaaagtcacataataaaatagattccttttatatgtagaatggtggtgaataaaaagtataaatgtaaacaaatacgggtgggttrtatttgcaacccgcatgccaatagcagcatcaccatctgcaagataagtttccagaatggtggaaaaactcaaaacaaacatttctaaaccaaacaaagtacagtcttccctcagcttacacaataattgcatttctggaaatttggtgcatatcaaaactgtgcaaaaatatttttgtgtttatatataaaatggacttaggttctgggatcaaataattataaacaagtttttttttacacaaatgtctgacaggacattcaaaagttatgtgggacaaaaatcttcactttgcaaaactgtcctgtgaattactaaatgccagttataggcccaaattrtagtgatgacccaaaaaccaccacacttgtgcaaaacactccctatggggtggtattgacctcattgagaaggtctgacttaatgcaccgggcttaaccattcagtctgtgtcagacactggagctgaggaggggctgtccatctttggggagaggatcagcagtctatggaaggcatcacgttcctatccacatgaggtcgtacctactattcattcattctttcattcagttcagtgttaattagcatacctactatattctagacattgctgcaagaactagagaagaacattgagattttagaaaacaatactaggaaaactcctgctcttgtagagctgattctaatcattgcttctttgtggctttttcccagacatctgggactagtataacttttttctccagaagattctgaaatgggtcagagtttagccccaaactggaaaagtcactctctattcttcttcccatactaaattatgccctggcatgttgcccagcagacctcatcagaggttctgcaataagatcaaagaattcatgaagatactctaagattctgctcccagtaagaatatcaaaatcctcttgtgatcaaattcccaggaaaatattaaaagataaagtcctaaggatattaatgtatgaaattattacctttgaaaagaattgtagtccaatatcaaagtctattgmccttgtgcattaaaagttcatagaaattaaaatccaaaaattttctttcccagtttttctaactgctcaagtcaatagctgggtgaaatgtgggattttgccgtggttgtagcagagcctgcctgccactaagttatttgtacaatgccttcaggatctttagcagattctaaaatgatcagatttctaaaagttgagaaaatataacattcttctcagcacttacccacatccacaagacttagaacgtaattcaagctccaggtccatcgcagttgtgccaggaaatgtttgctcccagaatgtggcccgtagctgcgtataatggtgtagatcctaaaggcaccatttatatcccagtttatatatgattccccctcctcatcattggatagggcgtcccctgcaacgcaytgtagggcaacctggcaaaagtctgtagtgaaggtttagtgttatcagagaacaagagagcagatagagatcttgggtttgaggcagaggagtttagagcctcctatgtcagttatcccgaggccacaagctatttcaactcacttaggagaaatcttactgtggcaatgaatgaactaacacaagaccagcttggggccaggtaygtatgtcatttccttccatccagccctggcttctgcctcctaccttccttcacatttaccagttatccatttaaaacccaaatctgatcttacatcacgtaggatcagatccagactccttggatgaaatgtatggaacttcacagctttgtttgttggacttcgtcatttctcctgttctctcaccctggcctccagggccaatgaagggggtcagaagttgttgacacgtgccatgcatttcacacttccatggcctggcatttattactgtctggctgggatacccttcctgttttgtaggtctggaaggtcttttttttttttttttkgggacagagtttcgctcttgtcgcccaggctggaatgcagtggtgcgatcttggctcactgcaacctctgcctcccgggttcaagcaattctcctgcctcagcctcccaagtagctgggattacaggcctgcgccaccacatctggctaatttcgtatttttaatagagatggggtttctccattttggtcaggctggtctcgaactcctgacctcaggcgatccgcctgcctcggcctcccaaagtgctgggattacaggaatgagccaccacgccccgcaggtctggaaggtctctacttacatttaagggccaacccaaatgtctgtctccatcacgtgggttctcatgatacactcccattattttattgtagcacttatttttctctattttgtatataatttatatacacatatatttatgtgtatgcatagtgtatgtgcatattacacaaatatatgtatttgtatatttaatttgtagacctttactctcctttgttcatgaaggggtcttatgtcttgaagatctggaaagggctttacatgtccttgtatgcctgggatctagcacagaggcctggcatacaggtcccagaataaaaatscttgctaatataaatgtgatcataaagacagcaatgattatcatgaaattttaacttgtttaccagaaaaagtgcatgacctaaaacttggcaaatgtgctcttccatgaaacaaaggggtgaagattagaaaactcgastttcatctgattctgaattaactaaaatcatgtttaagttggaaagacagtgccatctagtggtgcatttctttttcttttacaatgactggttttagtcattcctgtcttacataatcctagcactttagaataatgtcagtggwcatggtcatggctgttctgaggccttgaacacatagctctgttatgaattgaatatttggagttagatacacacagacactcattttagaagtacaatggagattactcagaagaaaacattttctagttatgtgtttcagggaaatccaagcacccactatttcgatggatgtttctagaagggagccatggttgggaattgttctgggtgctggcgacaccacagtgaagaagtcagacagagtctctgtctccccacacgtgggacttacatccttgttgggaaagagaccggacaaagtaaataaacaataaataagatcagttttgattataataggaaaataaaacaggatgatgctatgggagggcaacattcaatagcattggcttctctgaggaggtgacatgtcaggtgagggcccatgacagggagtccttagctgtgtgggttcagcttcacctgaggaaggaagagcagcaggaacagggctgtggacaggagtcctcctgggatgaaggaagtgcagctagcagtgaggtgtgggcagcctgggaaggaggcasaggccagagcagctggggcttgcagactgtgggagggagctggaattttactttaggtgcaatggggatctgccgaagcattttagacagagcaggagcatcacctcattggagtttgcagacatgcaggcagttcagtggagaacactatggctgctccggaattaggcctattaagaagatgtttcagtgggaacaggtgaaggacgatggagatcacctggagatggagccctctgggatatattttgaaggtagattggagtagttgtggagtgaagagagagagagaggaatcagagatgactaaagttgtaggcttgaaacattgaggtaaagatggctctgggagaacagttttgggagggctagtgggacagaggaatcaaagcacttgtttatttatttattagatatttattgagagcctstcacgtgcagacacttttctaaaaactgggaacatggcagtgagcagaaaagaaatctgtacattcatggaacttgtattgtcttcagagagaaagccaatgaaataagcaagtttagcctggacaacataggaagaccccatctctaaaaattttttttaattagctaggcatggtggcatgcacctgtagtcccaggtacttgggaggctgaggtgggaggatcacttgagcccagaagttcaaggttgcagtgagctatgrttgcagcmctgcamtccagcctgggcaacagcgtgagaccttatttcaaaaaaaaaaaaaagctaaatatgtagtatatagaagaaggtaacagttgctgtggagaaaaatcaagcaggaaaggagatgggaatgttgggagagtttacatctggaaggccttattgagttggggatatctttttttttttttttttttttttgagacagtcttgcactgtcacccaggctggagtgtagtggcaccatctcagctcactgtaacctccacytcctarattcaagttattctcctgcctcagcctcccaagtwtatgggattacaggggtgtaccaccacgcccggccgagttggggatatgtgagtaaagacctgaagaaatgcacgaggacaaactatgtggatatacagggaagagcattccaggcaaagtgaacagcaaatgccatacccaagaagcagcaacacacctggtttggctcaagaagcggaatcgaacaaagtgaagacaataagaaattarattaraaaggtcaggggtgggagaggagagaaagccattgtgatgcctttggctgtttgattgagtggatgggaagcagttaggaggatttcagcagagcagkgacatggtgtgacttacattttaacagtatcctctcgatgacattttgaggatacactaaagaggaacacgagcagaatcaggggcttcatgggaggctgcagtgatcatctaggcaagagatcagagcagttggggccatagtgtgagtcggtgcagaggttaaagtagcagtgggtgagcggactctcataacaccttcttttaaaaatcatatatttcccaaagaggaaaaaaatgttaggcgtcataacaggtttttcctgaaagtcataatataatcaatccaattataattctgttcctaaattaagactacctctaagaaaatcaatgtaaaaatgtttaccgtgacctattgcaacttcgcgtccaatttagtgtgaaatatgcaattttttgtaagtaatggagaagtaatgaattgtttttcttctcagttatatgatggggatagtgaaaatgcgaacttggctggaacgttttgtggttccacagtacctgctccttttatctcttctggtaacttccttacggttcaattcatcagtgacttaacattagagagggaaggatttaatgctacatacaccatcatggacagtgagtaaatagaagcatttttatatgttatgaaatacacatgtatttatgcactgaaaagaatgccctgcttattatatcgaaatttcaatgttaattactaaactcaatgtcaattactatctaaactcaatgtcaattgctaaacaccatgttaattactgtatgtttaatctgtggtacaaatttgatacaatctttagtcaaggatataaaccctgaattcttaatagagtaatgaaaatatagctcctccggggtgggaggcagggaagacagaattgcaaagattgcctgagatgagacatgaataaaatgtctcctgtgttgctttttcctccctctccagtgccttgtggtggaacrtacaatgcaacttggaccccacaaaatatttcatcacccaattcatcagacccagatgtcccattttccatctgtacttgggtcattgattcccctccgcatcagcaggtcaagataactgtgtgggcattacagctgacctcgcaagactgcacgcagaattacttacagcttcaggactcaccgcaggtaacaattataagatgaatggcagtcacatctagtgaccttttcaccagtatttgcaaaacacttgaagtaatgaagccatgatgaaataattttcttttttttaattatactttaagttttagggtacatgcgcacaatgtgcaagtttgttacatatgtatacatgtgccatgttggtgtgctgcacccattaactcgtcatttaacattaggtatatctcctaatgctatccctcccccctcccctcttcccccaccccacaacaggccccggtgtgtgatgttccccttcctgtgtccatgtgttccgattgttcaattcccacctatgagtgagaatatgcggtgtttggttttttgtccttgcgatagtttgctgagaatgatggtttctagcttcatccatgtccctacaaaggacatgacctcatcattttttatggctgcatagtattccatggtgtgtatgtgccacattttcttaatccggtctatcattgttggacatttgggatggttccaagtctttgctattgtgaatagtgccgcaataaacatacgtgygcatgtgtctttatagcagcatgatttataatcctttgggtatatacccagtaatgggatggctggatcaaatggtatttctagttctagatccctraggaatcrccacactgwcttccacaatggttgaactagtttacagtyycaccaacagtgtmaaagygttcctatttctccacatcctctccagcacctgttgtttcctgactttttaacaatcaccattctaactggtgtgagatggtatctcattgtggttttgatttgcatttctctgatggctagtgatgatgagcattttttcatgtgtcttttggctgcataaatgtcttcttttgagaagtgtctgttcatatccttcgcccactttttgatggagtggtttgtttcatgatgaaataattttctaagttacttccagcttaatgtgtttttcatccatacacaaagccctccaatcaggtgtgtcgagaaacttgaacttggtcctgcaggtccagagctctcaaagcttcatgtgcctaagaatgcattaagatgcatcttaaaagtgcatcctccctggcccaccctcagagaccgaatcccccatataacacccatttatctgaatttttgacaaacacctctggtgttttggtgccagtaccagaactccatggaccatgcttggagaaatacctctagttagtgggatttatgtataggttgaattgaaagggtcagtacagaacacaagagaatcagtgaagaggctgtttggcactagtctgataggtttatattcatggtaatataagagagataaaaagaaaagggctgggtgtggtggctcatgcttataatcccagcactttgggaggccaaggctggtggattacctgaggtcaggagttcaagatcagcctggccagtgtggtgaaaccctgcctctactgaaaatacaaaaaattagctgggtgcagtggtgtgcgcttgtaatcccagctactcaggaggctgaggtaggagaatcgcttgaacctgggaagcagaggttgcagtgagccaagatcgcgccactgcactccagcctgggtgacagagtgagacttcgtctcaacaacaacaacaacaaaatccattttgagctttaaaaaaggctgagtctgaatttcctctggaataagatgttgaggagacagttggacacaaagtgggttgttgaccaaaggcccaaagatttttgtgcatcatcattatcatgataggtaattgaaaaatgagaagaatgagattatctggggaaaatatgcaaagggattggccacgaactgaggatggataccaggagaacatctgagaatacctggattgtctttctgcagtttggggagcaactaaccctccccagttcattccagtaaaawgtcatggtcaaagccccatatgctggactagtagagtatctgttgtcttctgagttttcagggtccccttcattataaatctggggtcccctgcttctcatgtggtcttgctggggaaagaaaagtycaggttgtgtgactccagwgtggagaggcgtgagatgtgctggcagctgaatagaccctggacttgctgagtttggtgcaaagcatatatgctgagatgagctcccaaggtggacaagatgctagattatcrtcattccattggtaatggttttcaggacaaaatctctattacccattggtaccctagaggacttacagccaagtggaacaggccctttgggtgaaagctctctcaattttccctggcttcacgaagctaagacaatggggatcagggtggaccactcagcggggcacagaatggcactttcagggcacgagacaccgtctgaaacataacagcagctggagcagcctcgagtaagacccagtgtttgtcatgactgaataatgttttccactgaatgaatacaggaaacaatcaagggtttcggactgggtaggtagggaggaaagacaaacattgacggatgagctgggagaaactgggattctcggggtatccaagagtagacagagcagccctaattggcagatcatgaaggaatgatgtgtagggtggttacggaggatgttcagtggttagctggcactggagatgaacagagatgcagagatagaaggccctaaggttaagaaayatgaagttgagggtgtttaatggcttgtctataaaaacacagaaacctctaaagggttcagaaaggaaatcaggggcaggagatgactatgagctgagacacctcaagtctttcataaatgaagggaagtaactgggagaaaagtaaatgagagtgacgataatggtaagaatatctttggccagatgtagagaccgtcgaaggagaaccagctttgagacgaggatggaagctgcagtgaggaatgtggagcctccctcccttcccccgaggctggccccccacccttcccactcaatgaactgtggagcatgggtaaagaacagcctctaccaggaggctgctggagaaccaggttttgctaaggccacaaagtggaaaggtgggggatgtataccgagaatgactgacagtgcagttaaagttcacaggatacagcaaagttagacaaggaccaagagcaggagacagtggggaagaggggtggaagccccgagcagttacaggagttttgcaagcagagacgggtggggtgtttcagtaggttcctaagaactgcagatattagagacattcctgtgacagggaggctgcaaataccctgactttggtacaacttgtttttacccaagaactgatgggcattcgactgcatttactccaggcttttgagaggtgatgagggctgccctagtgttacaaaggggaaccggtacctcatgacaggccccggctggcttgggggatgtacagtggaaccaaaggctctgattagatttgctaaggggtagcaagggctggatcagggtgatggtggttgttagtcccatggagctcaggacaatggcaaaagccccaggaggagagatccagtgagctctcaaacagcctagatcctcagagcaatggcacaggcctcagctaggaagttgcataaaaggcgagggatcttattttcagcagggaaatgtctgtggtttcagcagaagctttgcctcccttcctcctgcccctctgggaaggtgcaacttgcatcaattccaaggccaacgtgagtcttcttgcagagcacttccaacagcagagctggtttccatggctaaatatttacaccatgcttttatatgcagtctaatttctgttatggcctgttctcttctaagactaaatctaacatgatttggctcccatttcatttcagggtcacggaaattcaagatttcagttctgtggcagaaatgcttcggctgtgccagtgttttattcttctatgagtactgcaatggtcattttcaaatctggagttgtaaacagaaactctagaatgagtttcacctatcagattgcaggtgaggccaggaacttcatcttttattcaraaaagctgccatcattaccattattcgtagaataattacaattatttctagaattgactcctgtgagtaaattaggatttgttaacaaaaaccacatccctctcttaactagaacccagcccaatttagcaaattactacagttggtttctaaagagataaagagaatataatactatccaggatggttagaatgctagcattttcttcaaagtatatgtagttgattttaaaaatatgccaattatcttattaattatacacttaaccacattgaatatacatttttatttacaagaaatatatatgtttatttacaaaagctttatcaaaatataattctcatatcatacaatttacccatttaaagtttatatttcagaggtttttagtattttcacaaaattgaaaatcttagaaaattattttgtaaaaatcaaaaagccttgaaagagttacctgattattataagaagtttattttcacagaacactttatttagtacttattttgaattgactcaaatgaaagcttcctttggttaaaacaaacgaaagtacttttggtatttttttaccaaaaaaaaaaaaaaaggtaaatracgatttgccacaaataactcaacaatggatttaaaatccttgtgcaaaactctgtcttggaggtagcatccttgtcgaaaagagagtctgaatgctacttccacctcaacgtgatcagaaaagttcaaaggatgctcgagtattcgtctttaaaggagaagcctcctgtgtcatgcttcctgtaggcgtgtttgtgtgaacgagctgttgcrttgcacctgtgtgtgctgcttgagcaattcacttcactgctcagggtctcaattatctcaaaggtaaacgaagaagctggattacttttttctaaagtttatcaaatgcaatgatctttttgaatgattcctgtgaagttgaaagagcactaaatattggaatgcgtacattaattatgcctatttttcctctaagattgcaacagagactatcacaaggcatttggcaacctgagaagccctggatggccagataactacgacaatgacaaggattgcaycgttactctcacagccccccagaaccacascatttccctcttttttcattcacttggcatcgagaactcagttgaatgcagaaacgatttcttggaggtgatatgcatttgaatatcgtttgaatgaattatttaaaagatggtggatcacttaagattttacaccttttatctagtgctgctaataytatatgattcttatttgtttcattaatttattcattaccctttcattccctaaacatctacagagcaccagtccaaacaccggaaattgggaaccttagggcccgcaggagactcctagtctggcaggaaggacagatggggtatagccaattacagcacaatgtggaaaggactaactgagtccagcatgggttggggttcctaactcagtctgggaactagaaggctcaagagggcaatatgtaagttgagacctaaaaggatcagagggaagtctaaggacaacatgctggttctgtaaaatgaarctcaatgatactaaatagctcacctaattttcctgacagctacagtaagtttggggcatcgtcaacatcctctaaagacaagtgtttccttgaataaatgctccctggtctcaggggggtgtggtctgtcctttcttcaccacaactccagagcttgaattkgggcacagaaatgacttcactgtttgcccatcgtccacacacccacccyccactcccaccccaggacacactgagaragaagcccccttgtgcctggagcaggcagaaccatgcgcctcgtgggcctgaaactttggggtcctccagtgcccccgatgagctccctctgtgctctttctgccccatcgctgcattgggcatatgagatggaacatgaacatcatcgctcataggcaggagatagtctgaataagcctcatstgatgtggacccagtgtgtggaactcagcccctgtgttttgccagaaaaaccccagagctcacggggtttgagctttgcaagytctgtcgaaaatgcattcatccttaggaaatatacttaggtggaacctaaaaacmaagagcataaagatgctgagttcctctgtgagtggagtttaaatctaaacctcatcctgaccgtctctaaactggctttgtaccacacaagagtcttcagtaaagtttccaaaaagtgtgcttgttcctctacccctgatctggagttgtattttttattttattttttttctcactgcctctttaatcaggtcttcattcaaaataagctgcccaagaggatttgacctttgtagcataaagaaatgtaccggtgtaggcagcgggctcctttcattctgtgggacgattctttctagcgggcctctgctcagctgatagtttcttggtagcttcagcctttgttcccaacaaaacatcttctgcttcttagcaccaagggctttctttctttcttttctttcttcttctttcttttctsscctgcaayccccctcatccgatttggctcctagggctgctggcaccttctgcccagcctggccaggaagggtgttctggcatatggtctttgcatatgggtttagcttcaacatgattcctgatgcggagttttatcatcctggaaagctctcccctttggaattcatctaaatcctttattaatcaataaccttaacatatagtgccataaataacactcggaggaagctcatgccttttctaaaggaatactcgccacgacaggagaccgaaagatgtatatagcagggaggaaatgaagaggcaaatacagttattctttgtgccggtcaggttattcaacttggacctgtgtacctcccccaccatggagatccaaatatttatatgaagtgtaaagcagaaagaatgaggagagtgggatctggaggaaagawggaataatcccgttaggttggagtcacagygcaactaactcttaactcactccagcttgaatggaccattattgatcagagtcaacgtttgccrtttgcctgatagatgctgggaagcaaagccttgctttccagccgtggagagtgagaattcctcctcctagctgtccttcattactccacagaatggatctgaaacttcctgtcccataagcaaagaaaggaaaccaccgcttaggcctgtaaaatgtagctccatctggctctcagtgggaaggctgtgggcatagtttcttggcagctgtaccaggaagcctcagcattccgttcttgtgaactgcggtgggaacggaaatgtctgactgagaattctgactgtgttactaccaagcgagggccgagctctagaccatgcttggaatctgttttcatgccttcacctyccctttcaagatcctctgatgtcccagagatgcccactgctctaggtggccccattcttcctaggagaggaaagtgaataagacaagttgtcagcagtgtcagtggaaattagyatcytgctgctcctctcagagcaacggcattttgaaagaggaccctgagggaaaaacgcccaaactcaaragcgtggtgctggctatggcagccctcccatctactagtggatgactggctactctgtcatggcaaggttactttgtttaaacacttagcagaataatccccaaagcactagaaaggcattattctctcccatgggctactacatcgacctaaaaggaatctcacctgatcaacacagcccagcaagatgtcttaactttgtgacttaagataccagcaattaaccaaagtttaaaccatggaattatatagggaacagaggaacttccaatattttgaatacatagatcagtaaaatcagcatttccgcatgtcaggctggktccaacatacattgcccgcgtaacgtttccgtaagaagcgtcgagagccctcctggaagcagggctggttgtgaatgcagggtagcagccaggctgggggacagaaagtggttcagttcacagtgtagwtctctctccccataaaacacaggctcatctcctgtttttatatgtgtctactcaaaaatgagttgaaacaaaaaagcaacaaggcctcggaatgtgtttgtaaaacacatttaacaacagacattgtatagatttataattctgtcctttgcccatacagaaattcctttcgttctgaactttattatactttgcattgtattttttcatagcctctttacagccaagtaattttcaatgggaaacacgtgcacacacmcacatacacaaacacacacacaatgagaaaggtgtaayagttgactggaagcagagcaggcaacattgcccccgcccatctccaccttttaaaaattcactttacctacrttctccaraatgtttccccaaaagcaaaggctgcaggatcacagcacaaactacggtataaaaaagctgcctggtgttttaattgctgtaggttaacaggtatttctgaatccaaatgcaaatgttttttgatctacacgtggaacatttttcccctttgcaagtgaaggtgacttctgcatgtattttcagaaaaygcttcattcttaactgtataaaaagacaaagcttttccgaccaatgtcatcattcaaattgtctccattttaatgtatataccttagagaagaaagtgtaagtttaataatgaatgactccttcctaaaggtgagaaatggaagtaacagcaattcaccattactgggcaagtactgtggaactctgctgccaaaccctgtcttctctcaaaataatgaactatacctacgatttaagagtgatagtgtaacttctgatcgtggatatgaaatcatctggacttcatcaccctctggtaagacatttgcactttgtacaggaaagcactgtgagaaaaacatgaggtgtctaatagtaaaaggcaaagtaactttatatttttagctacctgtgtacctgattagtttatgttaagaatagagattttaacattgaaagtacagattacttttttttttttgaaatrgaatctcgctgtgtcatccagcctggagtgtagtggcgtgatcttagctcactgcaacctccacctcccaggttcaagtgattctcctacctcagcttcccaagtagctgagattacaggcaygcgccaccatgcccagccgatttttgtrtttttagtagacagagcgtttccccatattggccaggctggtcycaaactcctgaactcaggtgatccaacctcccaaagtgctgggattacaggcatgagccaccgcgcccggccagattactttaaattytacatttattcattatttctgtttataaaagaatatatattcatatatgaaacatatataaggtaaggtaggaagattcaaaaattccttggtaaattaaattttgttagactttttgacttttggcttgaccatcaaggaagttctttgagaatttaaagaaaaatttttaccaaaaatccaacttatgaacacattctggcatatatatgagtagttgtgcttctcgcaggccctgacatttcttggcggttctggagagaaattgctttttttagggtagtaagtatcttctcacatttttggctggctgtttatcaaacaactaaagaaaatttaagtcatgtcaatacatttaattcaagagaggaggaatacctttataaaatatcccaaaataccaaaataccttcaaaataagaaagataaacagaactcactttaaatatcttaagaaaakcgttctataaagataatcgtgggtaatggaatcttggcacccaaaggaagcttaaaggtgacctccaatgctcaaattttatcaacgagcaaataaaacaccaagattaagctaggtgctgtggctcacacctataatccctgggagaccaaggtgggtggatcacctgaggtcaggagttccagaccagtgtggcccacagggtgaaaccccatctccactaaaaatacaaaaattaactgggtgtagtggcacatgcctgtaatcccagctactcgggaggctgagactggagaatcacttgaacttgggagatggaggctgtagtgagccgagatcacgccactgcactccagcctgggtgacggagcaagactccgtctcaaaaaamaaaacaaaamaaaaaaaacccaccatgaacccgggaggtggagcttgcagtgagccaagatcgtgccactgcactccagcctgggcgacagagcaagactccatctcaaaaaaaaaaccaaccaaacaaaaaaacccaccaagattaatgagttgcccaaaatgctccactagactgaggtgaaggtgagattagacctcagtggtcagaggcccagccacgtgctctgtaactatgccagccagcttcttcctgtcccagagatgacctggatctccacagatatatagtytaaatcatgacagccttcatatacagattaacaaattgaacaaattaacaccaaaacttgaagtatttgaccttaagtatgtcagttattagcctggtaaagtcacttttataatgaagtcattcctgccgtcacctacaataacgcactccctcttggtttagtgctgaattttacttctaattttacttcactcayatcactggcgtcaactctgggcatgcaaagatctctacaccatcgaaagcacacagacaacaacttgattttctcccacagttactttatcaagtttkttttttttttttttttycattctgctctcaacccccmattttmaaagtacagtcctggaggaagttatccctgggttgtgatatgcaggcaaaggcacgtgtgtggaggatggaagaggtggaggtggcagtgggaagagaggggaagagaggagaaagggtgtagcccaaagaagaggaaaaggaaaagggatttctgcctccattattcttgcagagtctcagcaccttaagaaaataaagtcttattgcctaacaagccagactggacggcttatatgctgttgaatcaaacttcctgtcctgttttccttgcaggatgtggtggaactctttatggagacagaggctcattcaccagccccggctatccaggcacatacccaaacaacacgtactgcgagtgggtccttgttgctcctgctggaaggcttgtcaccatcaavttctacttcatcagcattgacgatccaggagactgtgtccagaactatctcacactctatgatgggcccaacgccagctctccatcctctggaccatactgcggaggcgtgagtaaaacaaacattttatattcccatttgttatttttagacaataatgagtcacttagtgtagactttttttttttttaagatggaatctcgctcttgtcacccaggctggagtgcagtggtgcgcgcaatctcaactcactgcaacctccgcctcctgggttcaagcaattctyctgcctcagcctcctgagtagctgggattacaggtgcctgccaccacactcagctaatttttgtacttttagtagaaacagggttttgccatgttgaccaggctggtctcgaactcctgacctcaggtgatccacccgcttgggcctccgaaagtgttgggattacacgcgtgagccactgggcccggcctagtgtagactttcaaaggcagacacactgcagaggaagaagcacagcctttaacaaattgagcagttttccaacttgcctttctattatgggagcatgagtgccatctggtgggcattgcattaaattactattaagagttmcaaaaatcagccctgcgtcagaatcacctgtggagttacttacatyagacttccagttcccaccgaaacccactgaatcgggatttcccagggaggagtcacagcacgctgtttttttwaaaaaaagctccctctgtgacgtcagtgcactgcctagggttgaatacccatgtttatttctgcataaatagaactgtagaaaatttggacacgtggctctattttatctacttcttgctgaaaattgcagaaattatttgaagaaatggtgaccgatagtttgtttttgtaaagctctgatatcttccctaaaaaaatcagaatctgacgttgattcaatattgcaggcatctgtgcttacgatcctctcatttgatgtgcaagtagatacttaaagagagtaagggctcacacctgcaatcccaacactttgggaggcccaggcaggtggatcacttgagctcagaagtttgagactagactggccaacatggggaaaccccgtctctactaaaaatacaaaaattagctggtatagtggcacacgcctgtaatcccaagtactccggaggctgagggaaaataattgcttgagccagggaggcggaggttgcagtgagccgagatggcgccactccactccagcctgggcgacagagccagactccatctcaaaataacaagagagtaagtaagggaaaattggctgttggcaagcgggtatctgtttctgatttttctgccctttaatcacttagactttgtaatcaaactagacagagaactgtatcagctggaaatctagatggtttttaaaatataacttactatttataaaattgataaatgctgttttcagaagtatcagaaaataggctaatttttctaaaaccctgggcattctcatatattcttaacacctttctttgaatatatttgcatatattttacatgcatattttttactgtttgatggtgtgttttttctacttaccaatatatcattagtaacatatcaataaaaacactgttgcatcatatttaagttttggagagtattccgttgcacgagtgtggcctaatttatttaatgaagcccctctaagtggacatttaggtctcttgaactttttgcaactrcagacaacacttaataaactttttggtagtgatatctttatacatatagttacattacttggtgagaaatggtaatcacaggaccagcagacactgtatcacggggatgcacagaaggcccacagagagagagaccccagtaaatgtgccacacatcagatttagaagctaatcagctcttagacattgaattgaaatttacaaacatttcaaaagggaggaaaagaggcaattttaacaataccatgactttatattggtaggggtttttttgtgggcatggttttcagtggcttgcaaacatacaaccccatttgatccccacagtgacactcccataaggtggaaagaacaagtatatcctggacttgtataaaccgagttcaggtttatactgaacaagtataaaccgagtcactgagagaagtgacggccatttaatccaatgccacgttaagttgaagtatatagcgagataacatcaatttttttaactgttggtgtttacggtattttcccagttttacatttttttataaatgtggatataatttcatgtgtaattgttttttttcttaaaggtaccactgatttctttaacactttatcaatgttaaacataaatgaaraaatgtaaaacataagtataaaacatgaagtacagaggtagctcttgttttgctaatatttacatacaactttttgtaagttgtaatattttactaatatttacatacatactttcacatgttacatacatacatatttacatgcatawttacatacatatgaaagttgtatacttttgtatgtatactccttaagtatacaattcaactttttatgyatgtaaatatgcatgtaaatatgtttgttaaacttgtaatatttatatacatacagtatttaaatacatacagtgtacatacagaggtagctccttattttgctaatataaacacaaaccctgatttggagatattttatattacggtaaataccattgttcacagggaaatcctatatcccttgcagctgcagaaaatgaagatctagcaaatgagagaataacgggacaaacaaggagaatcaaaggagattctaaaacttctgttgaccgtctgttgacatactagtttgtcaaaataaaagaagttattgaaatttggaagcagattaaaatgggagtaaaaagtagatgtgtataggaataaaaatattgtatattccttgatgtatctcttacagaaaaaaaaatctacactcacttgagtaagtgagtatcttggaaataagcctgtgttttgatgacttggggtagggctgaggcaggagaagccagtcatgtaagcatcatgagagcagggctttttgcctgttttgctcattttttaatgtcttaatacctgcagcgtggcagtgccttgatcaatatttgccaaatgaatgaatagaaagtgagagacaacggggacccatgtatccccccaacacmcacacacacacacacacacacacacacacacacacacactgttccacagaagtatatgaaaataaatctcaagaggaaaaactataaacactgaggatgaaaatactatattttacttaataggatcattttaattatatatgtttgtttcagaaaaattaaatttgcagtaagaacttgaataagaagttcaagttttttgataacagttttattgagatacaatttcaataccatccaattcatctccttaaagtatacaattcagtggtttttcgtaggttcacagagctgtgcggccattatcagcacagccaattttgggacactttcattaccccccaaagaaacccagtacccatttgcagtccttccccattttccctcaactccccacgcccagaaatattcctttgtaaagcatttgcattcattctttgcaaggttacttcaagaaatatatgcaggttcaccataaattctataaagtttctttatgtggtacttygttactaggctaacattcctagaaaaacgttcaaatatgtgaaatatataattggatactttttttttcaattttaggacaccagcatagctcccttcgtggcttcctcaaatcaggtcttcataaaatttcatgctgattatgcacggcgtccatccgcattccgattaacttgggacagctaagtgggtaacaactcgtgttcactcagcactttccctctgcagcaygctggacagcactctgccatcctgatacatgacccctgctgatgccacagagaataagctgaacttgtatggtttttcaccaaaccatrgatagaatcaatatttgtaggccaggcgtggtggctcacccccctgtattctcagcactttgggaggccgaggcaggttgatcacctgaggtcaggagtttgagactagcctggccagcatggtgaaacctcatctctctaacaatataataattagccaggcgtggtggtgggtgcctgtaattccagccactcgagaggctgaggcaggagaattgcttgaacccaggaggcagaggttgcagtgagctaagatcacaccactacactccagcctgggcgagacggcaagactccatctcaaaaaaaaaagaaacaaaaaaaaccagaatcaatatttgtacattttctcgaacatagaatatagcttctttagtcttgagtgtgcatttcattmtaatattttgagctgaaatttaaaaaaactttgaaagagttggaaatgattatggcatatgtgacatacrtttttaaaagttaataataatagccaggggcagtggctcatacccataatcccagcacgctgggaggccatgatgggaggattgcttgaacctaggagtttgagaccagcctgggcaacaaagtgagacctgatttttacaaaaaatcaaaaaattagccaggcatggtggcatgcacccgtggttccagctacacaggaggttgaagcaggaggatcacttgagcccagtaggttaaggctgcagtgaaaccctgtgaattaaccactgtactccagcctgggtgacagactgagaccctatctcaaaaatgacaacaagaacaacaaaagttaatgataatatagaagcataaatttcctgtgaatgttcaattacacataataaacattattgaattgtacacaattatgctgcattaattttttgacttattaaaactctgtctttcactatgggacatatataaattttcaagtttaatttttacattttggcaaagaattcaatatatatatgaatcttccagagcttcatttctggagccaagctgcctgagtttcaattttaactgtactagttaagtgcttacacaatctctctgtgctcagtttcttcatttgtataargggattattttacctgtctcacagggttgcaataattaagtatatatgtgtaaagactcagaacaatacctggtgcatattaagtaattggtaaatgctagcttctatgtcaattagtagtagtatgactctcctccttaccatacagatgtacctgcttttcccatactcctccaaagccaggcccaagtctcacctgtgtttaccttttgccatgcccctaggtcaatctgagcttctccaaagaccttgccttaactacagagaagtttgccgtaacctctgaattctctatttccctcccatttgactcaaacttctgtttctcctggccacgcygaaccttttcttcatttatccccaggaccctgtactctcctggttatttaatttctctgagtattctccactctcctgtagaatggtggccctcttcacacagctccactaggcagtgccccagtaggaactcagtgtggggcctccgacccacatttccctgctacactgccctagtagaggtcctctgtgaggattctgcccctgcagaaggctgcttcctgaaaacccaggcttttccataccacctccaaaatctggggagaagctgccaagaatctaccactcttgtactctgtgtgcctgcaggtttaacaccccgtggaggctgccaaggcttatggctttcattctccaaagtggcagcccaagctgtacctgggcccctttgagccgtagctggagctggagtgaccagggcgtggggagccctgtcttgagcctatgcagggaagcagggccctgggcctggtccatgaaatcattctttcctcccaggcctctgggcctgtgatgggaggggtttcagcaaaggtttctgaaatgcctttggggacttttctccattatcttggatattagcagttggcttttrgttatgcaaatatctctagcaagtggatgcctcacagcctgcttgaattcctctcctgaaaaagctttttctttctctgccatatggccaggctgtaaattttccaaatttttamactctgctttcctttttaatataagttccaattcgaagtcatttctttgctcccacatctgagcacatgctattagaagcagccagcccaaatcttgaacactttgctgcttagaaattttttccaccagataccccaggttgccactctttagttcaaacttccacagatccctagggcatggacagaatgcagccaagttctttgctaaggcataatatgtgtcacctttgctccagttcccactaagttcctcattaccatcgaagaccttggcagcctggacttcattatccatatcactatcagaattttagttgcaacttttaaacagtctctaagaagttccaaattttccctcatctttmtgtcttctgagccttccaaactcttccaacctctacccattatcttgttccaaagtcagttccacattttcaggtatctttataacaaaaccccactcctggtaccaattttctgtaatagatcattcttgcattgctataaagaaatacccgagactgggtaacttataaagaaaagaggtttaatctgctcacagctctgcaggctttataggaaacatggtgctgacatctgcttggcttctggggcagcctcaggaagcttataatcatggaggaaggcgaaggggaaacaggcatgtcacayggtgaaagcasgagcaagacagcgagagtatgggacaggtgccacacacttttaagtggccagctctcatgtgaactcagagcaagagctcacttatcaccaagggtatggcccaagccattcatgagggatctacccccacratctaaacacctcccaccaggccgatctccaacactggcttttataactcaacatgagatttgagcagggacaaatatccaaactctattatgtatttaygctcaggagtacaaagtttccataagcaccaccattgcctattccttaacacaatatgttaagttataaataaacaatatggtttgccacttaacaagaagtagaaagttcagtagcacatcctyatctccaatgctgccagacatgtaactaagtgaggtagttattagcttccttttcataagaaaattcaatgcttttataaagtttttcagtgcctctagaaaagcggaagcctttacaaaggagatttgctttatgttaattatgcaaaatcaagggttattaacaaaagaccatgtgaatgagagaagctgaggaatgtaacttcatcttactctaatactcaaatggcagataattatttctggacagagtatggagccacagaaataaaatactctaaccttgaaaattcagctactcaggaggctgaggctggacaatcacttgaacctaggaggcggaggtttcagtgagccaacatcgcgccacttcactccagtgtgggttacagaatgagactccatctcaaaaaaacaaacaacaacaacaacaattcctgctccctttttgtattatggatagacatatcaactttatgggtgacaattayattggaaaggacagtgaatgcgataagtaacaccatcaaatmcaaaaggtcttgataagctacaacaatgggccaattgtaacagacgaaatgtgacagatataagatcttcctcttttatcaaaaaatgaattgcaaaagtacagaatacagggaaagtttaacaataacatgaaatgacatagtacttttctgaaagaaagattaacatgatgtcactgtcaaaaaaatgatgcttagagcatggactgcatcattagagtaacggtatcatttccactcagaagggcatgcttttctaggaggcatattggaatatctgggaagtgtgtacctgaaattgaggaaagcatagtcaatattattatgtaattttaaaattaaaaatacagaaaaaaagagacaaaatgaagctttacaaaatcttccaggctgggcatctaggaaataagcagtgattttttagtgggttagggatggtcaggcttgggagcatgacattttcgtgtatagccaagggaagtagttattgagtaattcagtttttgagtaattcagctggaagaaggagaaaagagtcaastgtactctcattcgtaagacccaccgtatatcctctggttctgctttacatttaattcacttgtttccaaatgtttattgagcatcagctatgtgatacgtactcagcgcactgaggataaagcagagaacaagacagccatacaagactatcagctgatgtctcccagcttcacaaagcacacttcccagctccatcttgcttgatttcctgagccagtcctgaggcaaaaaccttaatattcttatctggtgaaacatacattgagccaacttcccagatctagtggccaagggayaagtttcctgattccaaattgtgtcaccatgaagtttcactgctagcaatcaggaccctggacaggctaaccatcatcctagcaaattaatcaaacctgagaagggggtgtgggaaccctgatttatagctggtcagtcagaagtgtaggtgacagtcaacctaaagtcttgtggaaatgaacccttaacttgtgggatttgactataagttgaggtagacagtgtcagaattaagttaaactgtaagacaccgagctggtgtctgctggagaactgtttcatgtgtgggggattctctggtgtcagaagtgttgagccagtggagagtagcaaaaacagtttggtttttcctatctcaaacaggagtgaaaacaaattcctatgaaacagaagtgaatggaggcatgcagctcaraataacttcaagagagacatgcaggagggctgggactctctgttccaggtgtaacctggatgtggggctggctggtgcagtgtgaggggctaaaaccaaagtcagggagttgccctaactggcactcacaatccaccatttccctccacctgcaaaggtagccgggtgatgacctgcaggcataatactgggttcttgcctctgaagaaattcgactatcagtctagggatctaggaggaaaacaatacaaacaaacaagagaccactccagctatctagaaaaaccagttcagatcttcacacttgaactcaaaagaacaaccaagaatcaatcaccrgagaggggaagaatctttcttttctagggaaaagactagataaatacacgtaagaatggacccttgaagaaacataattgagtgaacagaagagaggtttaaaaactattatcctcggtgatacytgagaagagagtacattcatgaaacaaatgcagggtgttattataggccggcagtccaataggactggtgtccttagaagaagagacaccaagggtgtgactgcatagagaaaatgccctggagggacaccaagagaagacagtcgtccacgaggcaggggagaggccacaggataaatcaaatctgctggcaccttgatctagaacttccaggattgtgagaaatttctgttgtttaagccatccaggctgtggtatattgttacgacagccctagccgactaacacaggtactgtatgtcttcagcctacctaggcaagattcactattagaaattgatagaataagaaaaattctgattgcttcaaaacaggacttttgctttaaaagagttaatgattcaagaaataaatgtattaggagattacctactaatacgtattgatgaaattatgaagttagaaaatcatcagtggatgctaaaacttgtgggtaaaaattagatgaggaatggggtgtaatcaagtagcacctccccccagcattatttttaatcataaagaaaaaaatagtaactttatggtgaagaaacctggcagacactaccttatttaagtgaacatcacctatactgggagaaaccgatgccatctgtaccttgatatcatgcactggaaaagacacatcgctttagtggtgtttctccaaaaattcrtaacctgaaagggaacatcaaacttactttgaaggatattccacacaatacctggtctgtattcttaaataatgtctagttcaataaacataaaagccaaggacggttccagatcaaagaagactaatggaggaataactctttcatctggaatgttttttaagcaagaaatacctgctttcgaatttaagagtgcagatcctttttttatccaattggttcggagatataattacattattttaccacatctccttaaggctttgatccctgctacaatctacaatatataaatgcatatgtgtggcatccgtcttatcatcaatttaggtgaccagtagaagaaaagtgcctggtgccaatttttattccatagtataaaatagtctctcaggacagggtttttggtgagagaagcacaggatgtygctgggtgactgagacygggtcaggaaatagggaggcagagggcaacagtttctctagaatttaaaatttggttgcttttggaagagaaagcaagagattcctggaagccagaacgtcatgtttcacaaatgtaaaagtcctagttgggaaagacacaycgctttagtggtgttttcaaatgacttttaaaatagtagggttttacttgtaggttctagctacaagtaaaaaggctaaaagccagccttagaaacctgtcaaaaaagatttccagcagggcgctgg

SEQ ID NO: 13228 - DNA, 30258 bp, Homo sapiens
atgggtggcttgaagtaccagttgaacctcagaaaaattaaattctttaggaggaatgcctttaattagaatcagaagtagactctgtcatggaagtcctggaaactccattatttcacagatttgcagactcatagactttcttatttattgtcagaaacttctggaagtctctcaatgaatctccaagttactgggtgagaccacacctagcccaggattccagatgaactgcctagtccatattattggtgaagacacccaggaaatatttcacaacctatctcagtaacattccaatgtgttacaatcctcgcttttaggaaatccttcattatttccaaagatactgctactgctctacatcctttgtgaaaataacaagatcaaaacctttataatctcaaaaaaaaaaaaaaaaaaaaaaacaggaaaagaattaaggaacattctctcttcttttttttttttttttttttttttggaaatggagtcccatcctgtagcccgggccagagtgcaatggcgtgagctcagctctctgcagcctccgccttccgggttcaagcgattctcatactcagcctcatgagtagctgggattacaggcacccgccaccatgcctggctagtttttgtatttttagcagagacagggtttcaccatgttggccagcctagtctcaaactcctgacttcaagtgatccacctgccttggccttccaaagtgctgggattacaggtgtgagccactgcgcccagcccacattctcttcttctgcaaactaacatgtctatacctttttcagkcctttaatgacctgtgtggaccctgtacataacaacgtgctctgtgggcccctccgttgtgggtcgaacaaytaaacacctcactctggttggtgccagccagatgagttgatgaaacctgagaggccagattgcttccagttctgtaaaacctgtttgagaattaaaagagatgctccatcatgtcctaggctgagtaaatatgaaggaacagtgtaattctatggcaactgacaatcccaacagtaagccaacacagcaccacccccaggagcaacagcaagtgtttgagtgggttcaaaagagakttggggaactagggggattggggctgcacgtgacgaggagaaagggtgtgggataacatgggttggccttggttgataggctatgtccagtctctgctgcctctgtctctccttcctcctccttacctcactcttgagccccccacctttctctgtctccctatctgaaacacataccctgctcttaattgggaaactagtaaacatttctgctgattttaatcctgaaacatcattgagaccatatgaaatgagtcttaaggatcagaaccatatgaagggaaggactgtgggctggcagccggcgcacctgtgctgtcttctggacttccaccaccaacagtctccaggacctgtttcaagttgcttcacctctttgaaccgacttcatctattaactgagtggktgaactagatggctctttctggcttaaaaattctgtgatttcatttctggaggaatttcaagcatgggtagagagagaagaaactgagaggcaagaggtatggtttggactcatcaaattaaatcacaggtgactttccagtccccccaccaccccgatctgtaaggctgcctttgggtgygtggccttcctgcaaaatggcaaacacttgaaaaagcttccacgctgaaacccaaaccagaccatatttaggatgccccataaggtggcattttttactaagatgataaaggataaacattggtggagccagagaggctgctcccaaatacagtcctccccatcagcaacactgcagtagcctgcacctatcgtccagagtatgaaaaagacttttgccaaagacrgcttttggggatttatcattattacatgttaagagcctgttctccatgtcctcaccttcctaccttgctmatcttccccatttccatctttcggcccagtgtgagacctcaccatctccttttcccatcttctttcctccatacccttggtttcctagcaggtcaatgcccctgccccttcactggaatccatccatcctggttattcttttctttatgaacctgctggactacatctcaaagttacccaaaagagggatacaaagacacaataaaatcggaaataacgctcacccttaccagcctgcagttaagagtgtgtggaactagggtggctgcaggcaaagagatagggggaagggctgcctcatgccatgggcaggacagtaaatggtgcaaattttctggaaagcatcttagtaatataggtgaagagcctttacaatgtgtttatcctatgacctatccttacttctcttattctaaaggaataagaagaggtttaatcaaagcatgagtgaaaaggccatccaaacacagggaaaggggccgttatgatgtctacggttctaagaaatagaaaacaacaacttggcttaaataataagcacataaccaaagaaatctagaagtaggattcccttaagagttgagagatttagcagctcaaaaatgtgacctgacatacgagttctttctatgcttttgttcttcctcctccaacactggtttcacactaaacttggctccccagtggccaatagcaccaaacagcacttatcggcattcttgttggtatccaaaagagatggagaaagcctgatttcacatggctcttccttaaaagcaacaaaggacttttcccggaagccttcagcaaacctcgtcagatttgaatcacatgccaattcctaaatcagtcactggcagggaagtgggaaaaaggggaggaggtgtttacccttaaccaatatgcctacccctgcccactgagatcaattccataaaagtattgcttcagttctttgaagaggagtacaatgtttgtgagtcactcaccacatttacccaccaagagctaagggataactgagtaaaatggtagagctggtaggaaaatggtgagtagtcccgtccttctgtgccataattgacttgtacacaaagagatttggaaatttaaacataagaactctctcttcccaagcccagggctttgggcacttcaagtctggtccttgcctgggcacagtggctcacgcctgtaatctcagcaatttgggaagccaaggagggtggatcacctgaggtgatgagtttgagaccagcctggccaacatggcgaaaccccaactctactaaaaaatacaaaaattagttggatgtagtggcacacgcctggaatcccagctactcaggaggctgaggcaggaaaatcgcttgaatctgggaggcaaaagttgcagtgagctgagattgtaccactgcactccagcctgggagacagagcaagactccatcccaccccccaycaaaaaaaaattctggtctttacatgtgaaaaaataaaagctaatttttaaaaactaaataataaagagtgttaggtgataagttttatgatagagataatgtgtgctttaaaacacacagcataaaacagatggaaaacacctcatggagaagsgagagcttgaattggtgtttgattgaaggacaagaaaaatctgttggtaacttcctcctggctctgacctctgatgcagttaaagtaaagcaacttagaattatgatctagggaacatattcagagagaaatgaatttatgatgtcttcaatttgaagatgctatgattttagactattctagaatacaatgatttttcattgcttcacacttstaagaaatgttccactactgaaaatttgcaacacttaaaaaattcctacacaaaatcacagcccaccttgctgttctatgctaaataaacaaaatattttttctcaattatgttgctctccttaattacacgcaattttaaaactagctgtaactgacagccctttcctcacacttactgccaatgtatttaggtcaatcccacctccaattagagaawcttagaaaarggaaatcctacggtgaaatgccatatgccttacaattttcagtaactaatcctcaaggatgacaacttggcaaaaaagagaactggaccagctccctgaaaggtccatcacttcggcccatgttaattgattgccttaaaatcacagtgcttccaggttgtagagacacactcaaaatggactattgccctcacattaaaggggataggttttcttttcccttttcccatccctgcttctctcaaagctgcacagaggtatatgaggtttggggaatatttgcagcmcatgttggctggcaagaatgtgggtgaattcctgttaaggggcgcagacactccctcttctatgacctttcctttccacccagaacaactgaagtatcatgataaraggaagggctttgtgtttgagataagcagctcctatacctgtcagctttctctaataagaaagctctttcctgccaccgtataggtcaccttcttattggtaaagcatgatgaagtttggaaactgttgtccttgttttgttgaaagaagccaagttccaagaaatctgcagaggcattcctacaatccctcagccatggcagcatgaatcctgaaggggcagtgagygctggtttctactctgtctgcacagctaagcctaggggagataatcttttcatacaagatgcattctgcttttgtgggcctcttgcagccctcaagcccccatctgatttgtacacaatgatccagtgggccagaggagcccagagccatgagcggcccatccctccaagaactatttctgactgtccagtatcatggagcaagtggaaagaagaaaaaaaaaacccaattacttttcgaagagcaagatgaatgctgtagaaggagaaggaaggggagggagatggatgggtgccgattccagaatcttcagatctgcttggatgaatcattacctatgatttgcgggacaagaatctgattttattcatcaaccagtagaaacttttctttctgcctcccaacatctgaaatccaacaaacatgtgccttaggaacataccggtcatcttttagaggcattttatatacatattgagtaactagaaaacactctttccgtaatmcacacacacacacacacacacacacaccatcttgtcatacaacactcccacgcaagaaaagcgaaactgctgtttgatgaatgtaaacacttggctgtttgcagcagtcgggagtcctgccaggtttaagtgctaagatgggaggtgaaccccaggggtttccccctgcccgtgctgagatccttatttggtcaagcttctacctatgccctggcctcggagcsagcccgatagcgctggaycacagcagagggagcgaggcggctgacgtcccatcccgaagagatgaatggaattccaggaagctagagtcatgctggcttgggacagtggcttgkagaccagacttcaatgacagaagcactaggcagcggcactcatggcaatgtgtgcacccacagaaatgtaacccacacctcgggttcaggagccgaaaaatgaaaagaacgtttagggaggaaaaagggaaatacaataataggcagagagtaatttattactctatgggtctgctctgtaaatagctgaagactctggagccagatggttctgcaaattctccaaacaggagtcacgttaaraagcacgagtgggcacaaaaactgtttttcaagacacaatttcaatttggcttgtggaaactggatacgagtaagtttccttaaaattcgagtagaaagcagctgtcctccccgggccccttgatgagaatacgcacaccgcccccaagcggccggccgagggagcgccgcggcagcgggagaggcgymtctgtgggccccctggcagccgcggcaggaaagggcccgaaggcagcgaaggcgaacgcggcgcaccaacctgccggccccgccgacgccgcgctcacctccctccggggcgggcgtggggccagctcaggacaggcgctcgggggacgcgtgtcctcaccccacggggacggtggaggagagtcagcgagggcccgaggggcaggtactttaacgaatggctctcttggtgtcccctgcgccccgtcggcccatttttctttttacaaaacgggcccagtctctagtatccacctctcgccatcaaccaggcattccgggagatcagctcgcccgaaagcccctgcgccaccccgcgggccctcctaggtggtctccccagccccgtcccttttcgggatgcttgctgatcaccccgagcccgcgtggcgcaagagtacgagcgccgagcccgtgcgcgccaaggctgcgtgggcgggcaccgacttttctgagaagttctagtgctcccaagccccgacccccgcccccttcactttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccrctgcgcccgagctggcctgcgagttcagggctcctgycgctctccaggagcaacctctactccggacgcacaggcattccccgcgcccctccagccctcgccgccctcgccaccgctcccggccgccgcgctccggtacacacaggtaagtcgcccccggcggccgccgaggaccaaagctgcccgggacatccacctggagcgctgaggcttcagtccctctggtggaccccggaacctacactctccccgctcgcctaccccagcccgctcctctcagccgctggaggactcttcagggcaaggctccagagccatcctctccagccttgaggttcacaaaccaactcatcaggacaccccaagatttccttactctctgaagtcctccttaagcctttgtatcagcactccagggaagagtctgtacttccccgtgccctccctgcaaccccaaactacagttcctgatcttgctcaccttcgacttcccaaaagcccccaaattgttggtcttgcgccccccacactttaaaaccagcatctctttcctccacctctctctctctctctctctctctctctcatgctctctggaaagtaatcctgttgtccttcatttcagcaaacgcggggtcaaagagggatggtcccggccctgtccccatgcccagccccgtttctgcgcaccgtccctccctgcctagctgatctctgaccctcggctcttgtgcttcctgctacaggatccctgctgggcaccaacagctccaccatggggctggcctggggactaggcgtcctgttcytgatgcatgtgtgtggcaccaaccgcattccaggtgagtttgtgtggcacctttaggggaaggagggacaaggaagaggtgctggctatcccaggtgtgcccyctcacgtgctgtcctctccctcttgagcctgactggacatcaggacgcagcttcactctgatcctggtatttattcacctctttcagtggttgccaggagttttcaccccaaccctttgtctccacccctaaggactcagccccctactgctggtcccagcctagaaagctcactttgtgttctctcctgtctaacagagkctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccaggtgaggcttcttctctgagccctgctccgtgggatcatctgctagacaggtgacctgccaggagggctacaggaaatcctgtctgtaaactaacgcagcagttctcagattttaggcagcatgagcatcacctggagggcttgtgaaagctcaccctgctgcaccccagccccagagtctgggattctgtaaaactgcaactctaacaagtaccaggtgatgctgatgccggtggtctgggaagcacactttgaaaactactcaaggaaacaagaaatggttttcctttagcagtcagcctgttcaagccttagatactccttaggctcttaagaaaagagcttatttcaaatgcattcccccaattttaatcttgtttgaaatggatactttctatgggcagaatcagtaccactttgctattggattyctcatggggatgcagctggtctcacataaaaggttaaaatagcagttagttgttgctgttacagcttcatctgtgccttaacttctagatctttgcaacggtggctttgaactcccacatttaactctttgacactggaaagtgtcattatatcctctaggcttaggatcagattccatttcctgtgtacccaagtaggctgataactgaattctttgtaaaatactcaagacttggcagaagtcacaattaagattttgaagttgtttggcgattaatgttgctgtgttattttgacatagtgatcttaagacagctctttgaagcttttagaacatctattgtatgcttttcctagcatacagacagtctcccccaaccccatccccaccccgctctgcattctacaagtaatgtgtgtcctctgcccacagggggtgctgcagaatgtgaggtttgtctttggaaccacaccagaagacatcctcaggaacaaaggctgctccagctgtgagtacccctctatttttagggcacatagggaatcagggggaattccaccaaaaacaaactgaggaatttagcaatagtggttatacataaattacccccagtgagatcatcaagaggcatacagaagtgactccaaggggtattatacacacacacgtatacacacgtgcgcatacacgcaacccctctacctgcatccttcacaccaaatgaaacgtcttctaccactaagaactcaagaggctggttggtaagagtatctatttgaagttttcattttgtttcttgccagctaccagtgtcctcctcacccttgacaacaacgtggtgaatggttccagccctgccatccgcactaactacattggccacaagacaaaggacttgcaagccatctgcggcatctcctgtgatgarctgtccagcatggtcctggaactcaggggcctgcgcaccattgtgaccacgctgcaggacagcatccgcaaagtggtcagtggcctctgcacccagccygttagcatgaaccctggaaggtttatcgcagatggtcccaaatgactgaaaatgcggggggacactaatgatattctctcccatttagactgaagagaacaaagagttggccaatgagctgaggcggcctcccctatgctatcacaacggagttcagtacagaaataacgaggaatggactgttgatagctgcactgagtgtcactgtcaggtaagggaccttcaccagccagaataagaatcgacggcttttgtttgaacctacatctttggggaaataccctaatcgccacagagattctttttatgttccatggcctgataacaaagtgttttttttttctttaagatgcaattatggcatctataagttcttctttaaactctcagatggtttatcaaagtattaattataccccaggctaagtatctaagagaatgaatctactaagacatctgaataatttacctaccttagttcaaagactaagtgttgaatgtcaggtaaataaaacctggttggaacattcatttttttttcccaaccctgatttatattcagctttggcataggttcttttagtacagtagcaattgtttttcaaatcacttagtctgacactgttaggatgttactgtctgctttgctcagatggcactgccaggtgtgtgattcactctagcatccccgcatgccagtggccagtgagtttggaggttcacctggcttatctattaatagcaaagtatttgaatttgcttaaatacaaatcacagatgactggctgtgggaaccaacttcattaaattccctttcttttccaatataaagacagatcacagatctatagatgaggaaaaagtgcttatagatcttccttcctccccccaaacacataatataaaaatgtaaaagtcctggctgaattttctgagtttgatttcagacatagatttgacccatgatgtttgttggttcctctgctataaattctttgtactgtaacttccacccttgactaagtagcaattaaaaagaactttccaaggaatggagtgacacgtaaactagcactagaactgtctctacgatagtggtggctgcaaatatgacagagacagatctatgaaaatcattccactagagcattgacagccctgaccatgttttggcttgtaaaggaaatgttacaggatgtagacttctgtatgcaacatgctcagcagcctgttcccctctcactctcttgccctgcagaactcagttaccatctgcaaaaaggtgtcctgccccatcatgccctgctccaatgccacagttcctgatggagaatgctgtcctcgctgttggcgtaagtttctcaaatggcatagctattcttcagtgactaggtcagttctacatacatcctagacagccgagcacaacactggaaccccacccccatctccatcatgcttccattcagtttcttgctgcagcagctggttaactgacagcttatctgctgtacagagccaaaactccattatgagtacatcgtaattacccatctggattgcagtaatggcagtgaagatcttggtatagctcattaattctgattttttgctttgaggaaaagagatgaagacgtggcagcaacagctctaagttgactgcttttagaatttgaccttagtggcacagagttaagaaaaatctgctcaccagagatattgacaggcttactgtgtaagcattggcctgatcgggcctggaagttttgcccctttcatctgtagggataagagggcctaagagaatagcagcaatctgagctctagagcaccaaaagaaataaggcacgatatygttccatrgcacgttatccctggcttttgttaccagtaaaatgaatgactttgctgagacaatacttagtgtagcaggtacaagttataaaagtgattcattacaactaagataaggaagaaaacaggaaaacagcacttgcccttcacacacacagaaacacacatgcacacacacacaaacacacccttgtcacagctcagaataaccaattccatccagggatcatattagcgatattggcactgtaatggtcgtttttacatttattttctgttccgcattcacttaacatgtgcgttaaaaggaacaaagctagctggaggtagcaaagttttgaacttgaatcagggattgctaagaaaacttacaactaatgaccacagaaagtaagttctttgtcttctgtctgatacagctagatgtgattgtagccgtggtgcctgggcagatggtaaacaaacatgctgtcctcttatgacaatatgtgcagagaaggccccaaacgctggggtgagaggaacaacaaactgactaactcacggccgagttggagccagaaccaacaacagctcggctgccttcacactcatctgtcaaacacatggtgtatggctcccctgacagaaatgactcctataagcttcctcatactcgcgcattcttggaagtctgagactggaaatgcctacccagatatgttaagtcagtaaaggaaaactcatttgcaatgctgagaggagaaagaaaatcaatgaataggagagcatacactgtgggaaggctcagctgtactgagccaggcaaagcatccgattaccccactgctgtacacatcatgacctgggataaacccctgggccgttggcctaagaaatatgttgcttttcatcctgtataactgcaactttgtgccggctcatattatgttctagagagctcatgtacaccatggtgaccatagttaataatactggattgtatgcttaaaatttgctaagagagtagatcttaagtcatcaccaaaaaaagtaactgtaaratgatggagatgtgttaattagcttgacggtggtaatcacaatatatgtgtatatcaaaacatcacattatacaccttaaatgtatataatatttgtcaattatacctcagtaaagccaaaaagaaataaatatattgcttttcaccctctggcaagtggagggccctgaacagagccctctaaagaacagcttgtcctaatcatcaygtacctgatgaacctctgtttcccctgcagccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaaragatgtaagcatcttagcctctcagggacrtggagaactgacctgtccttgttgtcgtcaccaagggcagctccacagcatgtatattaagaacacgggttctaggatctctggatcccaatcccactgcttagctgtgcacccttgaacacaacttaccctctctgaggctctttcctsatttgcaacttggagataataatagttcttgataagtttatcttgagcattttatttagatactkcatgtaaagcmgttagcaytgagttttggtttatggtaagcaccctgtaaatgttaggatattaacagcaacccataaaaacagcgaacttatccgttctctggtagaaaacattccatgttgacatttgggcatgtggccaggagccaatttctaccgtacactgggtttagttgccattgaccatttcctggaaatacttctgcgtgctcctgatgggagcctctatttggctgtctctaagccaaaaccatttgtgaccatcaactctgtactttagttaaacaggatggtggctggagccactggtccccrtggtcatcttgttctgtgacatgtggtgatggtgtgatcacaaggatccggctctgcaactctcccagcccccagatgaaygggaaaccctgtgaaggcgaagcgcgggagaccaaagcctgcaagaaagacgcctgccccagtaagtgtgaggtccgctgcaagggtgagcatgggcagcagctctgcccagctggttgcctggcatctgcagcctgcagttcagtgggtcatagagcaggaaggttacctactagagaaacaaacagaagcaaagtcctgcaggctcagcaacttcttttaatgaaaaacaaactcaccctcttccccagcattctttccatgtgtcagagaagcagaggtttcttgaacgggcttaggagagtctatgacaagggagggatttgaaagttgatcttaattgttgcctgtggttcatcttcttacagtcaatggaggctggggtccttggtcaccatgggacatctgttctgtcacctgtggaggaggggtacagaaacgtagtcgtctctgcaacaaycccrcaccccagtttggaggcaaggactgcgttggtgatgtaacagaaaaccagatctgcaacaagcaggactgtccaattggtgagccacgcagcccaggatgaaacgacccaggagctttkctcttttactgaatgctgcagtcagcattcgaggagattccagcttggttagtcctgagcgatttgattgctctaagatgcaggtggacaacataatcccaacaagttatcrgttccctataccctataatatcttacactgtgttaagtgcccagcatggcagtatggcagcttagaccaaccatttactgtgactgtctctctctccttgtctcagatggatgcctgtccaatccctgctttgccggcgtgaagtgtactagctaccctgatggcagctggaaatgtggtgcttgtccccctggttacagtggaaatggcatccagtgcacagatgttgatgaggtgaggaactgatggggctccgagtttctggatctaggaaagcagctaacctgtgcagtcgcttccttatggcagtgacttctaaacatgawgcacgctcttatttcctccatagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtacagtcaactagacgagtaaaccagaggacaggagagctgtccttgaccaaaataactgggagcgggaggaatgtaatttcatacccttcaccaaaaaaaaaagggcgaggagatgaatgtacggtctagttttagaaacgtgattagaaaatccatggtaaatcctgcaggggaaaaacagtcttccatatttaaaaatgctgctctggaataagttgtgagcagatggacttgtaaacgcctaggtgctgagcaaattcaagaaaaataaacataaagcaaagtttgcttatagcctcagggagaatggggagggacagaggtaacccacactcttccaaatggagcctctgtctactcagagatgacagggatctggattcttgtttccatgatatctgaggattctcaaaagctctgtgtaacagcagcatggtgtaccctcaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccartgagaacctggtgtgcgtggccaatgcgacttaccactgcaaaaaggtagagccaggtcctttgtgtgcctccagaaagagggcccatcaccttatcaaaacacaggctaaggaattttaaatacttaaagtttggacatgaaactgaaagattaaatctcccaaagggagaggggcactaattcctattaaaattaaatcacttggtgccaaaaacatgaacagggctagctctttttgggcaactgtgttccatagtcaactcttctgtccaaaaaaaagttcagtactctatccaaataccagcaaagyatgacttgtgttcacaacatctataaagcctagagcatttacacaaattctgtatgtatatcccccaagaaaagttttattttcttgtcttcccataaaaaaaatatgctgttactgagccaaattctgttctttttctatttggaattccaggtacactccctcgtgcatgagctcagcatgaggaaggcaactgaagcagtgatatatatcttctctttcctaggataattgccccaaccttcccaactcagggcaggaagactatgacaaggatggaattggtgatgcctgtgatgatgacgatgacaatgataaaattccagatgacagggtaaaaacagttttctatccctttttcatcttttcagttcagcaacagcctgaaacactttgggattcaaggaaattacatggctatagcaaaaaatataccaaatcaatacacaggataattagaaattattcattgtgttccagtagtttaaggatgtagatgttgccaagagaatttttaaatgagggttttgtttttcatcagaactgtttttctctgtacttgagaaattataatgcataaacaaatgccactttgttccctagattcatttcaaatgtcacatcgaaattacagtaaaattgactttgggcacactatgaactgagatgatgggattatattctacatctcactaacttctaacccacagggatccatttttttaactatgtccttttaacttttgtagtgatcgttttacactgagtgatcaattagcctatccactaggtagaaagtattgctgattttcacagttttagacatattatgcacatggtttgaggcttgagctgttttcaaggacaacattgttaagtgctccatttcttctctttgcaggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtaaggtgctgcctgatcagagggcccgcgggagacagggacatgcacagctttccaaacgtacttctgtctagtcctggctattagtrtgcactttggtggaaacatccaaggctggagagcccagctcttatttgtcccttgttctcttcaggtatcctcaatgaacgggacaactgccagtacgtctacaatgtggaccagagagacactgatatggatggggttggagatcagtgtgacaattgccccttggaacacaatccggatcaggtaggtggatggactcctttcagagtctttcagtaaactgttggaatatccctttcatggcctttgaaaaatgagcttaacaaagttcaaacactttcattactgtggctccctggcttctcatagccaactggaatacgttcatgtaaataatttgcctgatgtgagctccttgcacagagtctcacagatctttagcatgaagatctggtaacttcagtcttaccttctgtaagaagggctactggacttgctcagcatcgtctaccattgttaagacaaattatacaaagcagacatctgtgactgacaactgtacaataatattaatcatatgtaatactaagagatggaaaaataaatgtgcataagcaaaataaccattttcatggctaatgatgtaatctagctataagaaaatcatcaaactaaggatacatccaaaaccaaagtaatttatccctgtcataaacattacccagacagtatacaacacagggaccagtggtctgtttccatcttttcaggacttttcagagaagtcgacgtgtcaacagttttacaactgaaaccttctaaggaaattctctgttataaagtatccagaaaatttcatttaacattaagatgtaaacagttaacatttcatttcatctttagtaattaaatatcactctatttgaccttatttagaaagttttatatgtaaaacatttttaaattatcccttctcagatttttatacgaaaacaaagataaaggaaaaaaacttttaaaatgtaattgctactattgctatctttctgcaggagtgtgtaaatagacatgacaccccactggctrtatcaaacaatggagaattttccctgtggtgggggcataagttatctttaacatgaatggtttatactgcaatttaccctccatttacatctctctttcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggtgagtcatgggagccactttctaagacagggactgctggcacagctgtgtagattgaagaaatgaaaccaaggctcaaagcatttgacaggatgaagggaccaaatgccaacttagacaagatagtgacatttctgacaccagtaataataatagcactttagaattttgctgaactcttgcttttttgacctcaggcgatggtcgaggtgatgcctgcaaagatgattttgaccatgacagtgtgccagacatcgatgacatctgtcctgagaatgttgacatcagtgagaccgayttccgccgattccagatgattcctctggaccccaaagggacatcccaaaatgaccctaactgggttgtacgccatcagggtaaagaactcgtccagactgtcaactgtgatcctggactcgctgtaggtgagtagcgagttcttagatcctaagagactgatgcatacrtggggaaaaacaaatataaaacctggcagttgtacctatccctgtgggtgctgaggatgtctrggaacatgatggagaaccttctgaaggctgcaggttttaacctggctctgggctcttcttccaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtaagaagcaaagccctggaacagagagagagcttatgggtgcctgactagcactggggatgctgtgctttgaccaagactctgaccagggagtcttagaaagttcccagcatcaccagctgcagcattgaactctgctttgtaaaaacataatagtgttgaaaagggagcttgaccaagaattgccctgcaaatcctaaggtgccttcagccttttcaaacaaaaaaacctccttccctcctctctgtctgctttatatgtgtgctcagtggcacacaacaaatatgagaggacttggaaaaattccccattgcagccctctaacttagatcagctcagtacctttcaagcattgtttctgatggaatgaaatagaaatctttacctgaaggagctgtgtttcaacctttccttttccttttccttcaggtgcgcaccctgtggcatgaccctcgtcacataggctggaaagatttcaccgcctacagatggcgtctcagccacaggccaaagacgggtttcattaggtacgatcatactgattcactttcacttacagtcacactgagggacaaaaagacaaaaagtattaaatagcattgtcactaaacaagattttttttccctgcagagtggtgatgtatgaagggaagaaaatcatggctgactcrggacccatctatgataaaacctatgctggtggtagactagggttgtttgtcttctctcaagaaatggtgttcttctctgacctgaaatacgaatgtagaggtaagagcaacatcaccatgaatgtacactggacatctctatttcagactaatatcaaggatgacggttatgggggagtccagtgtaaagactgttttggagacagggttatttctattttgcttttgaggacacaaggacaaaaatggaataatgcctaggcactgtggcttatgagttcctgagtccttagctataatattagtttgcttagcaatctctgtgctcctcatacacagtgcaaaggtaagctgcagaaaagctcctatataatttggacttcattaataayactgttctttacaattatatatttatatatcttactgcttattgttttatgcatgccatcacagcacgagttagcattcccaacttttccctgtatacaaagaagggagaggaatgttgctttcatattggcatgttaaattaatgttcactattaaacttagcattttttttcctcattcttttttacttagtcattacttaagctcgctgagtccaacactggctctaccacaaaataagtgcttaatatatatttactgggccaaggccagatacctaaaagatcaatgacagtagagaaagatggttgattttactcaaaaaaatctaaattattaatgtaatttttgagtccaaatttttaaaataagactccctaaactgttaacattgaaagcctttggaaagcataatatatgttctggaaggttcacgctgtgtcggtctcctagcatcaatgtcagctaataaaattaaatgctaatgtgcttgaacaaccttaaaattaggcttttgtcattagaaaagtagagctattcctatgtggttaacttattaactaagatgtctatgcttttatgaattagttttcatttgtatatttatttatatttgtttatttaacagatccctaatcatcaaattgttgattgaaagactgatcataaaccaatgctggtattgcaccttctggaactatgggcttgagaaaayccccaggaycacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttrggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagawaatatggaggaactgttacatgttcggtactaagtcattttcaggggattgaaagactattgctggatttcatgatgctgactggcrttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttgktttgkttttttttttttttttttttgcttttgacctcccatttttactatttgccaatacctttttctaggartgtgcttttttttgtacacatttttatccattttacattctaaagcagtgtaagttgtatattactgtttcttatgtacaaggaacaacaataaatcatatggaaatttatatttatacttactgtatccatgcttatttgttctctactggctttatgtcatgaagtatatgcgtaaataccattcataaatcaatatagcatatacaaaaataaattacagtaagtcatagcaacattcacagtttgtatgtgattgagaaagactgagttgctcaggcctaggcttaraatttgctgcgtttgtggaataaaagaacaaaatgatacattagcctgccatatcaaaaacatataaaagagaaattatccctaagtcaagggcccccataagaataaaatttcttattaaggtcattagatgtcattgaatccttttcaaagtgcagtatgaaaacaaagggaaaaacactgaagcacacgcaactctcacagcgacattttctgacccacgaatgatgccttgggtgggcaacacgattgcatgttgtggagacacttcggaagtaaatgtggatgagggaggagctgtccttgcaatgttgagccaagcattacagatacctcctcttgaagaaggaataataagtttaatcaaaaaagaagactaaaaaatgtaaaatttggaaggaatccataaatgcgtgtgtgtctaaatacaaattatcatgtgaagaaaaggcccaagtgtaccaataagcagaccttgatttttggatgggctaattatgaatgtggaatactgaccagttaatttccagttttaatgaaaacagatcaaagaagaaattttatgagtaggttaaaggtctggctttgaggtctattaaacactagaaaggactggctgggtgagataaaatcttccttgttgattttcactctcattctataaatactcatctttctgagtagccatgatcacatacaaatgtaaattgccaaatcattttatagtaccaaggtgaagaagcaggaactagaaagtgttgataatagctgtggagttaggaaaactgatgtgaaggaaataattctttgaaatggcaaagaattaaataccatcattcattatcagaagagttcaacgtttgaagtgctgggagataattctaattcattcttggatagtgaagcaaaactgattgaaaataccaagataagacagaaaaagtgactggaaagaggagcttttcttccaggcatgttccagtttcaccctaagactgaccttcaaataatcaggttgtactgaaataaaggacttgttaaaaattaaaattatgtcatcgagatgatagcttttttcctcctccaacagtttwttgtcatgtgttgtgggagagctcgagtgaagagcaataaactccaggtcttataagaatgtacatacaataaaggtggtgccagcagtttttttttttctaaagagtcacatgtagaaaagcctccagtattaagctcctgaattcattccttaaataaattggctctctctctcttctataatttctttttctttttatttttgagatgaagtcttgctctgtcgcccaggctggagtgcagtgacacaatctcggctcactgyaacctctgcctccccggttcaagcaattctccctcctgcctcagcctcccaagtagctgggactacaagcgcccgccaccaagcctggctaattctgtatttttagtaaagacggggtttcaccttgttccggacaaacactaagccctaaagggaaatccaaaataaaaacatctatttttaataacactttctatmtaaatcagggtgactttttaaaaaaaatccggaagctttktgttgaattacgttacagacttagttaccagtccttgttagagttaccttcagttgacatgctgtgaatggtcccacctcttttatggcagaattcattacttaaaataactctattttcttcccccttacctaaataacagaaaggctcactatgtcccaaatatcattggcagaagcaaactataaagtcataagccctttgcagtgcaagtctagaaataattttactctgtgtttctttctgtctccctcttccctcccctttttccttcctaccctcccctcccctccctcctcyttctttctctctctctctctctctctcatacatacaaacatcaaataccagaaaagcatagatttagaaagctgaactcctctgaaacgctgacggacaacactggcccctctctgccccacaacaaattctcacccatatcacctttgccctctgattcttcccacccaaaccctaaaacacagagtgtgcctcatggcattcctatgagaatctaaaatcacaacttttaacttatacttccatcccacagcaaaactcttggcatcaagataaattatacgtagcacattgacatcagcatgaacaattgctattttaaatgaacaaatagtaaactgaaatagtgtctggaaaaagaaactgcctatcaatacctctgaaaatagtagctatagaattcctcattttaaaaagtcaaggaaattccatataaacaatcattaatgttattcagtatcagtggatgaacatgtgccagcaaaaacaatgttatgtatacatcactcaaattttattaaaggcagcacaatagcccgctcattttttgattcagaaataaactggacttccaattctaatgccaactcatcttatggaatgtcaacacaaaattttctcatgaatctaagttactgacttgtaactaaaccatctctcttmaaatagtaccgcagactgtcttttaaagtagctcatctttatttgatgcaatctaaaaggcccaaactctgaaagaaaataagaaactattgttaactattattaacaaagtaatatatcaaataattcactcaaactcctacttaagaaacgtgtcatcaccaataagatagtaaaggctcttctaatattgctttgttgagacaattcatttcatcttatggcaggttgtaccagtttcacagacatgagacaagtgggaagaaggaaaagcagggccacagcaaaaattcccagtgaccaccatgatctgtctgaatcacagtagaggtgaaacatacaaaattgaatacaggacaatcacagcacttcaacgagttttaccctaacacgtatacattaaaatgttggtttttataatgaatcctaatactgtaagattagcaataaatttataaacaatggtcccagaaattttaatgagcaaaaaccactgaacaattacaccccaagtctcaaaaatatcaaggaaatataatccacaaagagcgactccaaatgtcaaaatcaataaagaatagtctctgcagtgcattcattgaattcaaataattcaataagaaatttaatttaacttcattaccaactttctgaaaagcacacccagcaagtccttgattagggttctttacattcttctgctgcatctttagtctcctgctcatctgcacataaaaacaataaccacagttattagagattcagaaatgtatgcataattaagaaaaacaactcagcctataaaatattaaatccctttacacatgaggcaataatcacactctcatttaatacttactgaacagtcaccacgagctgcagacaaagtttacgagaaaaatagaaagatcagggcgcctactctcattgagcttacagctcagggagaacactacaggttttggagctaaaatgattatggatgtggagacacacacagaagttaatattttgctttctactaagtttctgggaagtacagtgagaccaaaagtaaatgttatatgtagaatagataagagctgatcgcctttcatttcttgaagtgagaaaaaaaattgtgacattaacagaaaaggaatggaaatatttttctacccttggtgagaaggttatcagaaaatgcagaattgacaatagaactaaattttaaaaagacaaagagaaacaggagaaactggaaccttcatgcacgactggcaggaatggaaaatggtgcagtagctttagaaacagtctrgcagttcctgagaaggttaccatagacctggcaattccacttctaggtataagcccaagagaaatgaaagcatacatccatacaaaaacttgtacacaagcgttcatatcaacattatatgtaatagccaaaaagtggaaacaacccaaatgtccatcaaatgatgaatggataagcaaaatgtgatatatccatataattgagacttattcaacaatagaaaagagtggagtatggatacatgctacaacatggatraatcttgaagacataatgtaagaagccagtcacaaaaggccatatgccgtatgattccatttatatgaaatgttcagactaggcaaattcacagagacagaaagactggtgattgcctagggctggggttggggaaaatgggaagtgattactaatacccaaaatgttgcgttgtcgggggtggaaaaaataaaaaattgatagtggtgatggaggtacaactctgtaaatatactacaaacaattgaattgcacacttttaatgggatgaattgtaggaagctggtgaacagtggctccccaaaactcacatcctcatccctgcaacctgtgaaaggggtctttctagatgcaattaaattaagcttctcgagataagaagatcatcctggattctctgggtgggccctatattcaataagaagtgttgttatacaaaaaagacagagggagattaacacacacagatggagggaggcaatgtgaagacggaggcagagactggagtgacgtggccacaaagccaggaatgccyatagccaggagaagctggaagaagcatggaagcgttctagcgttctctcctagggcctccaggtggcgtgtggccttggtgacaccttgatttcaaacttctggcctccaaaactgtgagagaataaatttctgtcatggtaagttgttgtgacaaccataggaaactaatacaaatatatgaattatatctcaataaagttcttattaaaaaaagactcaaccttgtaatgaagggcagatgacttgcagtttcagagcaaagtgataaatgtagtggtactgtcaacacatggagaagaaatattaaacaggatgtagaggcaggtgggatgaatgaaaagtggatcacaatacccccatgcatgaggtgggagatgatgggacataattccacgccttcgtaagtgctattctctcactatggagtgttctttttgcccacccagcaaataaccattcatccttggaggcacaacttaaatgccacctcccatccctctatagtgttgtctatgtactttgtcctgaagctcttactatgtttgtcccaccctactgtaattaagtgtctgtctttaggcacttaaaaattttcatcaatagaactagattgagtaacaaaaaatttttcatcaatatacctagaacaacggtcctcaactgggggaaattttgcccccaaagaacattttttgcaatgtctggagacatgtttgtctgtcataactgcagaggacactactgacatcaagtcagtaaaagccagggattccattaaacacccgacaatgcacaagacagcccttcaaatgtccaactcaaaatgctaacagtgctgaggtgaaaaactcttggaacttagaaaagcatctaatacacaggagaatctcatgaaatgtttgtggggtaaatcgatgaatgaatggatggcagatggatgatgaatgaatagcatggagccttggggttttaaagcatggctgcacagcagaatcacccagaccctgwtctcagaaactgacttaaatgactgctgccagaacccacccctagaaattgacttaattcatctgggatggaaccaagctgctaatctgttttaaatctcaccaggtgattctaacatgcagccagaggtaagaggcagcactggctaaggaacagactcagtatagcttaaatgccaggccggctcaaggcagacggaagtagagagactgggcaatcaaaagtatgcaaagcatagatagttccatactggttatatgtgtctccaaacaaaatattaacgaagaaagagtagagaactcaagggagggtcccagggcatgcttgctctaagaggaaggttgcccaaaagaatgacaagatggatggctggagagatcacaagacaatgtggatgcagcagtatcttcgttaaaaagaaatttaagaagaaaaaagcagacattcagcagatgggaaaaaaggtactttctgtacattattttcactaccaccatttatttttgataatcctaaagtagaagtaagtagtaaaccatttagtccggagcttctcactctktaacatgcacacaaatcacctgcggggtatcttaaaattcaggctctgattcagtaggtctgcagtgggcctggcactctacatttctttttgttgttgttgttgcccaggctggagtgcaatgtcatgatctcagttcaccgcaacctccacctcccgagttcaagcgattctcctgcctcagcctcccaagtagctgggattataggcatgcaccaccatacccggctaattttgtatttttagtacagatggggtttctccgtgttggttaggcttgtctcaaactcccaacctctggtgatctgcccgcctgggcctcccaaagtgctgggattacaggcgtgagccacagtgcccggctgagactctacatttctaacaagcttccagttgatgctgacaccactagtccatagacctagtttacagtcacaatagcggatcttcagtaactttttactttacccaatttgaatgaagcaacagaaccagaagtttccaataactgataaagtgataaggacattacaattaaatatcaaaactctcaagcatgcctttgttcattttatactgctaaaatgatagagaaaatgatcaacagcaaatatttatatgaaaagtctacctcaagaagaattaaagaaaattagttgaaagtaaattgaagatgtaaattaaccaaatataaacttactatacactaaggttttatattaaaaaatgaattcacattagaaatttctaatatggcatctctgatattttgaccaaataaactctggaagagcattggtttgactagacaaag

SEQ ID NO: 13229 - DNA, 31973 bp, Homo sapiens
caaatgttaatctcctttgacaacaccctcacagacacacccaggaaaaatactttgcatccttcaatccaatcaagttgacactcaatattaacaatcacaatagattacagacttaaatgcaagacacgacactttgaaccagtagaagaaaacatctgggagacacctcaggacattggtctgggcaaggattttttttttggtaagacctcaaaagcacaggcaacaaaagcaaatagacaaacggggtcatacgaaaccaaaaagcttcygcacagcaaagaaacaaatcaacaaagtgaagagacaacctacagaatgagaaaaaatatttgcaaatyatccatctgacaagggattagtaattagaatacataaggaacttaaacaactgaatagcaaaaaaaaaaaccacctcaaaataatccttttaaaaaataggcaaactatctgaatagacatttctcaaaagaggagatacaaatggcaaacacatacattaaaaaatggtcaacatcactaatcatctrggaaatgcaagtcaaaaccatgataagatgtcatctcacccctgttaacatatgtaattatttttatacattgttggatttgatttgatattttcttgaggattttgcrtctaggtttgtgagcaatattaatctgtatagtttttttgtttctttcttcttttcttctttctcttttcatttcttgtcatgtctgtctgtatttgscattargtataatgctggcctcataaaatgaattargcaatatttcctctgcttctgtctttcaaaagacatggaagaaaattggtataattccttccttaaatgtttagtagatgcaacggcctacagcattatgctgccctgggccgcgacagcgtgggcgccgcctcrgtcaacctggarccctcggatgtgccgcaggacgtgtacagcrgcgtggccgcgcaggtggaggtgttccgtaggcaggacgcccagcggggcatgcgggtggcacaggtgctggaagscttcatcacccgcaaggtggtgaagcagacrgtgatgaccgtggtgtacggggtcaccygctacggtgggcgcctgcagattgagaagcgcctccgggagctgaacgactttccccaggagttcgtgtgggaggcctcccactacctcktacgccaggtcttcaggagtctacaggagatgttctcggggacccgggccatccagcactggctgaycgagagcgcccacctcgtctcccacacgggctctgtggtggagtgggtcacccccctgggcgtccccatcatccagccgtatcgcctggagtccaaggtcaagcaatcaggaggtggaattcagagcatcacttacacccacaacagagacatcagccggaagcccaacacacctaagcagaagaacggcttccggcccaacttcatccactcgctggactcctcacacatgatgctcaccaccctgcactgctacaggaagggcctgaccttcgtctctgtgcacgactgttaccggacccatgcagctgatgtctccrtcatgaaccaggtgtgccgggagcagtttgcttgcacagcgagtccatcctgcaggacctgtccaggttcctggtcaggcggttytgctctgagccccagaagatcttggaggccagccagatgaaggagacactgcaggtggtgcccaagccaggggccttcgacctggagctggtgaagcgttccacctacttcttcagctgacacccggcgggccttgtgccagtgtgtaaataaagctcttttgccaccccctcaaaaaaaaaaaaagtctagtagaattaatcagtgaaccaattggggtcttggctttctgttttggaaggttattaattattgtttcaatcgatttaatagatataggcctattcggattatctattagcacttaccttttattcttttctttccccttctcgtatcttttggatggatggaaggtaaatgatggtatatacatgtgattcaaaattatgtagctggtaaaaattataacattgatagagaaatataggacccatatgcattatttaaatacctatataataatcataaaacatgtttatgccataagtgcaagrattgaaggacaatatgaaaagtgtagttaggtgaatcttacaaattatttaaagagactgtttaaggttagtcaagcagagtgacatacagaaaagaagactactattaaatcattggcaatatccctctgtattaggccactcytgtgttgctataaagaaatacctggctgggtatggtggctcatgcctgtaatcccagcattttaggatgccaaggtgggagaattgcttgaggcttggagtttaagmccaaaaaaaaaaaaaaaaaaaaaaggaaatacctgagactgggtaatttgtaaacaaaagaggtttaactggatcacggttctgcaggctgtacaggaagcatagtggcatctggttctggggaggcctcagggagcttttactcgtgttagaaggcaaagtgggagcgggcacatcacttggcaaaagcaggagcaagagagagagggtcaggtgctacacagttttaaataaccatatcttgcaagaactcactaacacgaagaccacatcaagccatgagggatccgcccccatgatccaaacacctcccaccaggcgccacatccagcattggggattacaattcaacatgagatttgggaagggacacagacagacccaaaccatatcaacccctaatgccagcagaaccactgagtagctttaggatcttcagaaaggattttaaagctcgaatagtcccagcactgtaataattacaagagaaaatgtaactacaatgtagcatctacacaataattgtgattctcttctccgttcttgttcaatccaatgtttaatataaaaattcaagtgaaggtaaataaaagcattggggaatgaccttgccatgtggtattaagaagaagattctcaagcacaactgcctaagttgcaattaccacagctacatctagaaggaagatgtgagagttttcattccacattaactagaaacctagcatgaggcagatggctgsaagcagtcgagggagtgtccaagaccttacacagaaaatcatgttcagagaggaagcttgttgctcattccttttttgtgcccagctgcctgggttcccttctccaccattttatttggtagtaagctatctagagaacttgctccctacgctgagccaataagcgaaatgtgtgagctttgaaggatacagtttcatttcgaggaatggagaatatctgtgcaaagttggggcagttcagagcagagtgagctgcagactgttctgcaggtatggggctggaagtcttcacacgacctcatagtcctggcacccaaacttactcagacaatggtgtgtccggaattggtgggttcttggtctcactgacttcaagaatgaagccgcggaccctcgcggtgagtgttacagctcttaaggtggcgcgtctggagtttgttctttctgatgttcagatgtgttcggagtttcttccttctggtgggttcgtggtctcgctggctcaggagtgaagctgcagactttcgcrgtgagtgttacagctcataaaagcagtgtgaacctaaagagtgagcagcagcaagatttattgcaaagagtgaaagaacaaagcttccacartgtggaagggggcctgagcgggttgccactgctggctcgggcagcctgcttttattctcttatctggcyctacctatgtcctgctgattggtagagccaagtggtctgttttgacagggcgctgattggtgcgttyacaatccttgagctagacacaaaggttctccacgtccccaccagactcagaagcmcagctggcttcacccagtggatcccgcaccggggctgcaggtggagctgcctgccagtcccgcgccgtgcgctcgcactcctcagcccttgggtggtcgatgggactgggcgccctggagcagggggcggcgctcatyggggaggctcgggctgcacaggaacctacggaggccgggggctcaggcatggcgggctgcaggtcctgggccctgccccgcgggaaggcagctaaggcccggcgagaaatcgagcgcagcgccggtgggctggcactgctgggggaccgagtacaccttcccgagcagccgctggcccgggtgctaagcccctcattgcccggggctggcagggccggccggctgctccgagtgcggggcctgccaagcctacgcccacctggaactctagctggcccgcaagtgccgcgcgcagccccggttcgtactcgcgcctctccctccatacctccctgcaagctgagggagccggctctggccttggccagcctagaaaggggctcctacacctataagtgagaatatgcggtgtttggttttttgttcttgcgatagtttactgagaatgatgatttccaatttcatccatgtccctacacaatgagaacatatggacacaggaaggggaacatcacactctggggactgttgtggggtggggggaggggggagggatagcattgggagatatacctaatgctagatgacgagttagtgggtgcagcgcaccagcatggcacatgtatacatatgtaactaacctgcacattgtgcgcatgtaccctaaaacttaaagtataataataataataaaaaaatccaaaaaaaaagaaaagaagagaaaagaaaggggctcccacagtgcagcggtgggctgaagggctcctcaagtgccgccaaagtgggagcccaggcagaggaggcgccgagagcgagtgagggctgtgaggactgccagcatgctgtcacctytcagtgggagcaggtgtgacaagagttgggcaaatcagacctttaatccaccctgataggctggagtgtgggcttatggcatttytcctttgacccaattaacctccactcccaatgtatctctgtgcagaaggctcagctaggtgtatcagccattgtaaatcctcaacataaattataatttaacctagaatacagagactaggtagcaggaggagaggaaatgtagagatactaatctcttctcccttatcagaaagaaacctagcataagaaatttcacgcttaatgggccaaagagtaaatcagaaaactccatgggtgatggtatgctcatggtggtggtggtggtgwtggggaattatttgccctcctgtgacctcccttggattaatttctccccaggacaatgggaaaaatcatttaatccttggagtttttttttttttttttttgcttgagagtgactctgatcctgtttctgatggtcatgttcctcagcatcatactgagtaagtcactggccttgtagcatctggagtgattggagtgayccaagatccctagttcccatgtcacaaatgaggatcccacatatctgggacagagatggaacattatttctgggtgtgtctatctaatctattcaycctatctatctaatttctcatctatatatatatttgcctacccatccatccatcaatccatcttagctgtacgtttatccattccatctatttatcctattatctatgtatctatctatcatctattaatagctatctatccatctgtctaatatatmyattatmtatatctactttatctatctacctaatgtatccatcctatctactctatctatctgtgcatctacccatccatctggaccctgagctgattcctctgcacccagctggcctgacgccaggtgttgattggctgcccaggctcmggagacacatccaggctgcagggattggttggcccagcccaacccagccagccctcccacagcctttgctatatcaagggccagggtcaaaggcctcccagcagacagagagaggaggttrtytgggacagactgctcctgacagaaggtgccaggctgggkgtggcaggcctggggggggtcctggcctgggatggagaggggcactgcccaaggcccacgcagctcctgggtgctgscctggaggatgggtggtttccgagtaactgaaaccaagcccctggcaacctcacagtgattcaggctgggcctttctggactttaatcagtctctctctctytttcccattctaagtgcttactagggaactggaggccacttggctgctggwtttggttgggcctttctggactttacctctcagcccctttttacccatccctgagccctccctgctctacctccggcacygcccgtccctgccyctccactgtccctggaggtccctgggccsttctytgggcctcaggatctcaccrtccatcccgyctgccctgcaggatgtcccagctgagcctgtmctggctgggcctckgscsagtggcagcatccccttggctgctcctcctgctggtcggggcctcctggctcctggcccatgtcctggcctggacctacgccttctatgacaactgccgccgccttcggtgtttcccacaacccccragacggaactggttttggggacaccagggcatggtgagtgtggcagcaggatgggtctaggtctcaggatggatggacttcctgaggggtacgaggcttagggagtgggggtgaaggggtgggctgggatctggggtggcagagaagcagaggaggcrtcttactcattcctctgcttattcatttctgtgaggtgcctacgcaagcccttctcacttcctwgtcctcccactccaggcctgcattgaatccttttcctgcctgtcttcccacattaatgcacctctgcggggctcctgggcagagggttggctgcacagagaggcgagtccctggcattcccacattctccrttgctggactcgaggcttcttatgcccactgtccagggtcctctccttgcctggactatttcctgttatgagggtacagctrggccagaggagaggcmtgggccgtctcccacttccacyacacccgaaggcayctttctcttatattcttcttcttatctccctcttatcaatgagacctgttgccaaacccagataaaagttggccactcacttcacctttcagaagctttccttggcckttmtcctccccgtgaccttgccctctgacttagaccgctctcctctttggggaatgtggtcttagtctgctcatttgcaaatggcaggattgatggatgtgtccacagataaagtggaagggtgcacaggacacactagcacagagcctgctgcagaagctgctcccaggtgggagccattgtcctgatggacagttagagtcacctctgctccactagtggctgctgaaaagggaaggtctcccatgtgcagaaccttctccatgggaggaactggagcctctgtggatcagccaggacatgaaggcatgtggggaccagccttagggacatgtcctgaggcgatactgctccccacaaatctcccctgtgaggacctccccatatagctgcctctgggctgaaatgactcccagaaaaagaaaatccttcctctcaagataactgggcctctgtgagtggacagtgcgtcttctccctctgccctgggatgcacccttgggacttggagatggacccaagagagatagagcaggaggaatgtggatagatagatagatagagcaggaggaatgtagatagatagatagatagatagatagatagatagatagatagatagctaataggatagatagatagatgcacagataggatggatagatggatggatggatggatggacaggcrcgtaggtagatagataatagaatagatggatgcatggacacatggatgcacagatagcatggatggatggatggatggatggakggatggatggatrgatagatagacaaataataggacatatggatgcatggacacacggatscacagataggatggatggatggatggatgatggatggatgggtagatagagtagataggatggatagattatgtagacagatggagtagatatatatgatggatagattagacggatagatggctattaatagatgataagcagacagacagatgaatatatggatggatgaaagcacagataaaatggattgatggatagatgggtaggcagatagatrtatagatagaaaaattagatagataggatgaatagattagacacacccagaaataatgtttgaccractacctgggcatcccttagcccagtcaagtagacacctagaattaactatcacagaaggtaatgacccctgccttgcttgcaggtcaaccccacagaggagggcatgagagttctgactcagctggtggcyacctacccccagggctttaaggtctggatgggacccatctcccccctcctcagtttgtgccaccccgacatcatccggtctgtcatcaacgcctcaggtaccatctggaacagctggtggggcagtgcatttgaggcctgcacttccgctatccccaagctcctgtgtgggcccygcagtactctggcctctsctttccttccctctcagctatcttcatctttctttcatgtaytcatcaattyccatctcagcgtctcctctctcyattgccatctaccccctgtkctggtgttctgggctgccctggarccctaagagacctcaacccaaggcccwgtcctggaggaacccccaactttaaggagatggacctggatagagatatccccaacttcatgggatcaggaaagggccagagggagatggatcacagcccagggaagaacaaggtctctgctggggcaggctggaaggcttcctagaggaggagttactgsagctgtgtctggaacaatgagtaggaatgtttgaaaggagagtgcagggtgaggcaattggacatcgttagtattcaaggccccttgccaggcctagcatcaccttgcctgtcccaaagcctagaacaatgaggaggacttgtggctggtgggggatctgggctgctacttccatgatgtccacctctggtgggtcaattccctttaccccatcctatagcttgtctgccctaagttcgttgctctcctgctgcaggtcccggggatctccaagaggagactccaccccagcttgggwccctttccttgacccctgtgcttcccatcgttggacgggcraggctgagcagggggaatgggcagcatcctacagagaccatggctctgacctmaaaatgctgagtgactctgggctggtacccagctgtctctggttattgaagtctctttcagttgtgagtggtggaaacccaacctggtgtggtctaagcaaagaaagataatctattkactttaaagtccagggagggtggccttcaggcatggctggatccaggtctcacayaaggtcactggaaatctgtctttctctctwggctttagctttctccaygtcrcttttcctatcaaggtggmsttttcctcatgatgtcaacgatgagtcccagaasctcagttctyatgggaaaggccacctttcccctagagttcccagawatggcccatgrtttacttctcctggcctggatcacrggaccaatttttcacccaatccctgtgtctctgattkcccagtcttggtaggcctrggtcttccagagctactgttttgggggcacaaagaagtttgttggttaaggattcaggccatgggtgcagacagacctagtcttrggcctcaggcttgccrtggtctgggactgtgggcaagtractttattgttcagagcctcaggctcttcatctggaaaatgggatgaatgagagcccagggaacatggtgtgtggatccacatggggaaagaccttttctgtctgtgtaactgaaggactggagagtcctgcatggaggatgtgaggaggcagggggtgctcagcactgacaggaggatkagatgctgcttgaaattctcagggagagggcttcgacctcttccctgcagatccttctctctcacagcctaggagagcatgaattgggtcctgtgtgtttttctccagattcacagctcagaagaaggtctcctatacacacaaagcctggcgtgcacctttggggatatgggctgctggtgggtggggccctggcaggcagtcatccacatctttctccccacgtgcatcaagcctgtgctctttgctccaggtagacatygcactggccaagctttgcccacagctggggttgctgtgctgcctccagctgaacaygtgaccgatgtgcagacaggwggggctgtggtggagatgccattgcctccatygcccctggacttccacctgtctaacctctgttsctgtttgctcatgtctggggcgtgwctctacaatggctgttatatggccaggtctgccttgtatatttacacctgggtcctggttacacctgaaatatgttatacctggttacatctggtatataattccaactggggtcatgtagagctggtcaagtttggggcttatctgtggccaaggacatttggggcatgtgagggcctgtttggttcttgtctcaggtgctgtttgacactgccgttttctcctggtggtccaaacatctgggcgttgtgwgaggtctgggggttgtgtgaggtctgggacccagggtccctatgtgaactgtctgagacattatttgagtcttgtctgaggcatgtgttatagtatatttgggtcatgcctgaggaacagtctggttcacatgttggctatgtctgtgacattaaaggtaccatatttatattcaacccagagcctgtatgtggaacacgcttttaagatcatgttagaccatctcatgtgcatgttagagcacaccatctcatgttaggaattgtcatgtattttgtggccatgtcaggacatgtgaacacatgtcagggtcatgtctcatgtccaggtccatgtcagaagatgccatrtsagaakatgtcagagrgtgctgggacagacagggtgtcctaggtccttgtgaagcattctgtagaatgctgarctgtgctcaggggttgcggaacatgttggatcgtgtaggaggcatgtcaaggcatgctggaaccctgacatagctcctacacgccatgttaggcagtgtcattgctgtactgtgctgctgtagcctggtctggtcttccctcccctccccatcctcccttcttcctctgcccttggccctcttcctgctatgtggggctcagagtgggagaagtgcaaacctcttgctgggagcctccacccacccccaaagtccctctttcacctgcctccatggcccctgattgtcctcatttatgtcagctgccattgcaccaaaggacaagttcttctacagcttcctggagccctggctgggtgagtatctgcaggtgaacagggttgggaaaaacgttggggggccaggggagggagasgtccttgcccatkgcccttkgctgccctgctaggggatgggctcctgctgagtgctggtgacaagtggagccrccaccgtcggatgctgacgcctgccttccatttcaacatcctgaagccctatatgaagattttcaatgagagtgtgaacatcatgcacgtgagttatttgaagscaaggtcccacttgcagccttggggtgaaaggacaacagagagatctagtctggmgttttggctctgctgggtgccattgggccattgctctttctcactgagccttggtttcctcatctgtaaaatggggataataatccctacttaaaagatggtcagagtaatgtaatggagtcacrtctctggtgcatagcaggtgcccagaaggtgtctgtttctatgtttccatcaccaaagccctgtaaacacaagagggtcatgacaacaatttcatagtagctrttgctgataagaaaccacctgaaaactcattggtttaaaccaataagtgtttatgtttgctaataagtctwtgggacagttggcaggttcttctgtatatggaagggaccactcatggtacatgagcagctgggggtcaggtaggcagccttgcaggtgttgastgaattctgccacatgtttgggttttggctgggacatgtttgggttctctcacrtgtctaggtttggcctcatctgggacccctggatgttcctccctatgattgtctccttccagaakgcgcgccatggttcayaatgcaggcagggttcyaaggagtaagacaaggcttagcttcgttagttattaactcatcattttcaccacattgtattttgacatcgaaagccaaaagtccaacacagaatcaaaggcagggggataaaataggctctgtctattaatgggagttgcygaaaaatcacattgcaaagggtgtggatatggcaggaagggaagaattgtggcaaaggttttgcgaagtatctaggattttttttttaacttgcaaattgataagttagcttgttactgtttcataaattcttccagaaggacgagagactcctgggtcagagacaaaggatagtttactactcatgacacagacagcagcatgtgtttcttgttagattgccttttttccctccaagcttcccaaatcccatgggctgacacaggtgggcttctataagtgcctgctgacatcatatattgcattacagaagaggagctttaagcttagggaatctgcttttatagaaagcaaaagcaacatgtctagagggagtctttaccttatccctcaaagtttttcttcgcaaacacaactctgagaaattttccatgttaaggacatcagtgtcttgcattcatgacatgcccagaaagaatgctcaggactcaacgaaggactacctccccmaaaacagggatatttttgaaatcaatttataacaatgcagayggggaaatccaacatttatygatcacataccatatgccagaaacaatgccatgtgcccattccatgataygagtaygtattgtctaatttgattttaacagctctgcgaaggagagattatgtatttttgccccatggtagatgatgaaactgcaggtctgagagattagggaactaacccaagttcacccagctaataagtgagcatggygaggtggagcagagtttctaatgtgaattatatggctccaaagcacatcatcttaactgtttctgaagatttgacaggcaggatataggggagggtaatgagttgactaatggcacacagagcacaggggacagagctggaacttgaacctagttctcctaactcccaatcttgggtcttcatctcttaatagtaacagcttttgtttgyaccakaacctggtgctccctggggaggggtccctggggagaagatgaagaggcttattctggggagcccatcttggcagttggggttggagaggtgctcaagggagcaaggagcctgccccagctctgtccccttctctggctaggccaagtggcagctcctggcctcagaggdtagtgcctgtttggatatgtttgagcacatcagcctcatgaccttggacagtctacagaaatgtgtcttcagctttgacagccattgtcaggagtaagttcttgcccaggatctgggatcttgggctgtggacccaaagtgggtaggtgggagagggaggactaagcagggaaaccagacaaaccttcctggaggagttttgttatacctgatcattgaaggactggtatgaactttatcttgaggtttccagggagccattgaaggggtttgaactggtgggtgtkgtcagagctctgtaggggactgactaatgtagcactaaatggagttaacactgatgcaaagaggctagggtgaaagctagaccatggaccagttgcaggaggataaagtctgagctttgtggacagtttcaaggagacgggtcaggactgtatactgggagggaaagagagaataggagaataatgtgcaagctatgctctgggtgcctagcggcatggaggcatctcacagagatgggatgcagggagagaagagagcttggagaatcaatctcatgctgatccccaccctgtatctgtggggtcatctgttcctggwtactctgtttactgataggaggtagatcctggctgctggtgggaggtgatcctggggcttcaggtatattaaattgttgcctccctttctgcccttatcctgcaggaaacccagtgaatatattgccgccatcttggagctcagtgcccttgtatcaaaaagacaccatgagatcctcctgcatattgacttcctgtattatctcacccctgatgggcagcgtttccgcagggcctgccgcctggtgcacgacttcacagatgccgtcatccaggagcggcgccgcactctccctagccagggtgttgatgacttcctccaagccaaggccaaatccaagactttggacttcattgatgtactcctgctgagcaaggtgggcctctytgggatytgaattcaagaagtagaagggagcttcatgtgaaatgtcagatgaaagratttgaacttgattaagagggcactagggagccatggaaggtgattgaggaagggagggacaggtcagagataggttttagagatgactgtggagtgcacctagcagggagctgctaggcttgaaactgacaagtctgagagtttgctctatttacaaactaatgagttaattgtccacatttaactccatacatctacatctatatctatgtctggtctatgtttatgtttttgcctatgtctttctatatctttgtctctgtttgagtttgtgtctctatgactgtgactatgtgtatgtctttgtctttgtaattggccatatctgtatgtctttttatctatgtcttcatctttgtctatgtctacgcctttgtcctgtcttttctatgtctctgtttatgtctttgtctctgtctatattttcatccatgtctatgtgtatgtgtatatctgtgtctgcgtctatgcctttgtcttttttctgtgtttgtgtctttgtctcagtgtatgtctatgtccatgttttttgtctgtgtctatgactatgtcttcgtctatggctatgtctatgtcaatgctatgtctatatctttgtctgtgcctgtgcttgtgtctgtttctgtctatgtctatgtttatgtctatcagtagttgtgtctgagtgtgtgtcatgtctatgtttatgtgtatttttgtgtctgtgtttctaagtctgtgacttagtctatgtatgtgtgcgtctgtgtctatatctgtgtctatgtctatgtttatgtgtacttgtgtgtctgtgtttctaagtctgtgactttgtctatgtgcgtgtgtgtctgtgtctatgtctatgtgtatttgtatttgtgtgtctgtgtttctaagtctgtgacttcatctatgtgtgtgcgtctgtatctatatctgtgtctatgtctatgtttatgtgtacttgtgtgtctgtgtttctaagtttgtgactttgtctatgtgcgtgtgtgtctgtgtctatgtctatgtttatgtgtatttgtgtgtctgtgtttctaagtctgtgacttcatctatgtgtgtgcgtctgtgtctatctgtgtctatgtttatgtgtatttgtatttgtgtgcctgtgtttctaagtctgtgactttgtctatgtgtgtgtgtctatgtctatgtttgtttatgtgtatttgtgtgtctgtgtttctaaatctgtgacttcatctatgtgtgtttgtgtctgtgtctatgtctgtgtttatgtgtatttgtgtgtccatgtttctaagtctgtgacagtctatgtgtgtgtgtgtctgtgtctatatctgtgtctatgtctatgtttacgtgtatttgtgtgtctgtgtttctaagtctgtgactttgtctatgtgtgtgtgtgtctgtgtctatatctrtgtctatgtctaggtttatgtgtatttgtgtgcctgtgtttctaagtctgtgacttagtctatgtgtgcgtgtgtctgtgtctatgtctatgtttatgtgtgtttgtgtttctaagtctgtgattttgtgtatgtgtgtgtatgtctgtgtctatatctgtgtctatgtctatgtttacgtgtatttgtgtgtctgtgtttctaagtctgtgacttagtctatatgtgtgtgcctgtgtctatatctgtgtctatgtctatgtttatgtgtatttgtgtgtccatgtttctaagtctgtgacttagtctatgtgtgtgtgtgtctgtgtctatatctgtgtctatgtctaggtttacgtgtatttgtgtgtctgtgtttctaagtctgtgactttatctatgtgtgtgtgtctgtgtctatatctgtgtctatgtctatgtttatgtgtatttatgtgtctgtgtttctaagtctgtgactttgtctatgtgtgtgtgtgtctatgtctatgtttatgtgtgtctgtgtttctaagtctgtgwttttgtgtatgtgtgygtatgtctgtgtctatatctgtgtctatgtctatgtttacgtgtatttgtgtgtctgtgtttctaagtctgtgacttagtctatatgtgtgtgcctgtgtctatatctgtgtctatgtctatgtttatttgtatttgtgtgtttgtgtttctaagtctgtgactttatgtgtgtgtgtctgtgtctatatctgtgttatgtctatgtttatgtgtatttgtgtgtctgtgtcagtttctaagtctatgactttgtctatrtgtgtttgtgtctgtgtctatgtctttgtctatgtgtaggtctattgtgacagatgcattaaacctctagatcagagcagcccatgtcttgctcacagcaatactgttagccagagtgggattgtggcactggctcttcatcctcaagtcaaatttctccaagggtaatgttttcacttgtatgtgcagcagagtttgcatcctaagagaggggccctacattatgagtcttggcacattttctatttcttcccaagaaagagaatgagagagacagagaaagagagagagagagattgagtgagaatggtagctttgtgagagatggtgtgctttgttctggagcataaacaaatcytcttcagtgagatgccatagtccttagccttacaacccaaacgtctccagggggataagattctctagatttatcactctagaatgtgggcaaatctttgaagcaatacttaatctctaatttccaagggaaattgccattkaattctcctgtaactcaggttgccagtaactttttctcagaaacttttcattaaaatattcatgggtcattgagtcttcccagtaggaacccaagaggaggcaaggaagccagagaggaaggccatgaggtgagggctctggccatggtgaccaagaggggtctaggagtgcaagatgkacttggatttctggaaaaaggatgaatcttcagagactgtctcagattagactcaagagcccttagagctagtgtgactttttatgggggtgggggttgggggggggttactgccttctctccaggatgaagacgggaagaagttatctgatgaggacataagagcagaagctgacacctttatgtttgagggtgagggccccagtgtggggctagagaggggaccgggatctctcccttccaggaacagggtgggtagacccccacaaccttcccatcccccttcccccatcctccctgaggccctcaatgcatgggtgctgtctaccttcgggtrctgaagcagcccagagacccaagcctgcctkgctgccccccaggccatgacaccacggccagtggtctctcctgggtcctgtaccaycttgcaaagcacccagaataccaggagcgctgccggcaggaggtgcaagaacttctgaaggaccgtgagcctaaagagattgaatggtgagtgcargtgcttgtggcctcttcctgagaccttctcattggctctgctcyccaggtggggaggggaggaaaagctgtttttgttgattctgccactattgcctagtgggaataggagcagaggaccacaggcaggacttagtacmcatcctgactgtctggggaaaggttataggcccttaggacagaaagacctgggcttctgagagagttggtgatgatatgtgaggacarataacgccacttagcacgtgttcagcaaatgaacttcccctccactctcttcctttcctcccmgraatatcattttttttgaacatcttcacttcttgaatgtttgctcttctgttccctaattcctactctccagtcgagtccagggwtttataagggagacctaggggtaaaattcatccattcttgtccggaacacttgcacygttcatccgtcccatccttattcagcaaacactcccacactgcattytcacccccacatctgtgcacagcatctttctgtgctctggagacctgggaaggaaccaacccagggatctgttttccaggtgctcccagcctggtggtggagctgtccctgggcaggacactcccagcccacatgggcagagatgggatttacagtaagagaagcaggactagggggtatagaaagtgtctcagttgagagcctaaataatgatcagtagataattgggtacagttvgggggcagtgctctaggtcaagaagactgcctgkggtctttgggggaggaagagagagggaggaagagagagaggagagygagggagagagagagaaggagagagrgagagagcagggtcaggacagaaaggaggagaaggggagagagagggagagaytgagttgtaatgagatgataaaaccggagatggtagcaggggctggctgtggaagccttggggaaaatgttaatggcttcagttttagcccaatrgcaatagggagccatgggaagtgtttgagcagtgtagggacaggtcacatctgggtaccaggaagatctttctagggctagtgtggagggcgtactggagaggaccagctgtagaatgaaggcacagtggggacattctgagaccagagccaggccaggggctggaggaaggagaggaagcattggaatggacggatgtcttggattcagtgtcctctcgtccacacctttgcccagcacagcagtccagtgaggaggagaaacatttttctgcttttaaaaccaataatttttctgcatttttaacaaacaattttttattgctgcataaatagatgcacatakatttgaaatacatgtgataatctaatacattcatataactggtaaagatcaaatcagtgtacttgggatatctgtcgcctgaaatatttagtcttttctttatgctagaaacawaactaacataagctaactatttaggaatatacagtacatatcgtaaactatagtgwacycactgatctatcaagtgctaggttttatttctcctatcaaacctcttatttatgcccgttaatcaacttctcctcacccctccctcccttctaccaatctaccttctactttcatgagatccactttttcagctcccacatgtgagtgagaacatgcgatatttgtctttctctttttggcttatttacttaccacagtgacctccagttccatccatgttgccacaaatgacaaaattccagtgtttttaatggtgcatagtattccattgtgtatacatgccacatttcctttcttccttccttccttcytccctccctccctctctctctttctctctttcttctttcctttctttctttctttgagacagagtcttgttctgtcgcccaggctgaagtgcggtggcacgatcttggctcactgcaacctctgcctcccgggttcaagctattcttctgcctcagcctcccaagcagctgggactatgggtgcacaccaccaygcctggctaatttttgtatttttaatagggctggggtttcaccatattggccaggctggtctcgaactcctgacctcatgatctgcctgcctcggcctcccaaagtgctgggattacaggcatgagccaccgcacccggccgccacattttctttatccattcagttgatgggcacttaggttgattccatattttggctgttttgaatagtgctgcaataaatacggaagtatagatatctcttcaacagwtttattttctttctttgggatagaaatttcttctctttcttttcagtagtggaatttctgggttatatgttagttctacttttagtttcttgaggaacctctgtgctgttctctgcagtggctgcgctaatttatattcctgccaacagtgtgtgagagttcccctttctccatatcctcaccagtgtctatcgttgcctgtctttttgataaaagccattttaactgggatgagatgatatctcattgtggttttgatttgcatttctctgatgattagtgacattgagcatttttccatctatctgttggccatttgtatgtcttattttaagaaatgtctattcagatcttttgaccatttttaaataagatgatttgagttctttttcccctattgagttatttgagctccttatataatatattctggttattaatcgcttgtcagatgagtaatttgagaatattttctgccattctgtaagytgattcttcactttgttgactgtttcctttgctgtgcaraagctttttaccttgatgtaatctcatttgtctattgcctgtgcttttgaggtcttaacacagaaaatctttgcctggacccatgtcctggagtataaaatccagatttcaagcaaaattatggatgtggttaaaagaaagggtccaaaaaattttatgataaaaatgagcttccttattaagctccaccttagcagtgactatggtcaacagttttctgtgtattcttccagaaaatggctatcccaatgcccacatttatatgaattcacactgtgatttttatttatatgaacacatactgtgtttttctttgtaaagaaaactatacaaaatagacgcagttctgracattatctctgagatctatttttcttaaaatacgagttttcaaaaatgagtttgtttttaaattgttctttcattgataaattttaataatcaaggtaatgaacaaatccatcacttcatatatttatcatttttatgttgagaacatatatatattagaggtacaatgtgatgttatgatgtatgtatacaacctgaaattattaaatcaaggtaatgaacaaatccatcacttcatatatttatcatttttatgttgagaacatttgaaatttactctcttagcaatttcaattaatacattgttcactaaatcaccatgctgtgcagtagatctcaaaaactattcctcttgtctaactgaagcttctatcctttgaccaacatctcacccttctctatccctccctcagccctggcctctggtaaccatcattctgcttctatttcttttcttttctttctttcttttttttttcatttttgagatggagtctcrctctgtcacccaggctggagtgcagtggcacgatctcagcttactgcgacctctgcctcccaggttcaagtgattctcctgcctcagcctcctgagtagctgggattacaggctcccgcaaccacgcttggctaatttttttgtatttttattagagacggggtttcaccatattggacaggctggtcttgaactcctgaccttgtgatctgccgcccttggcctcccaaagtgctgggattacaggcgtgagccaccgcrcccgacctccactcctgtttctatgagcttgactattttaggtcccaagataagtaagatcatgtgtgtttgtgtttctgagcctagcttacttcacttagcatamgttcctccaggttctttcatgttgtggcaaacaaaataagttttctttctttttttttttttaaggctgaatggtattccattgtatatacacaccacatggaaaatgagcattaaattayaaaaccagtgataagaacagattcttcttgcaccaaatgagatattacagataagactagctttttccttgacaatcctgccaccccacctaatcctttctcattctccaaaggtgtctccagagccatagatttgttatctatctatctatctatccatcatctatctatgtatctatatacctatctactatctatatatcatctatgtatytctgtttctatcatctatgtatgtatctgtctattctctatctctctatatctcttatttattatctgtcatctatcaatctatcatctatctctgaatcattaatttcataaatatatattcatatactttttgccctttttatgtgcacaaatgtatatatttgtaacttgttttcactcgacagtgtgtcttaatgctatttttttctgaatgctaaatattttattccttatttattcagctcattcctatgttgaatgcacataaacattttcagttatagtagatatttccaatttgccttccacagtgtctgtactgatttaccttccagcctgcagaatgtgatgagactagtgatccctatttcctccttttgtgtagctgtatagtattccatcstgtggctgtttatctaaacatcttcccatcaatgtgtatgtggcttgtttccaaccttttgctaaaagtggacatgaggcagtcagcatgtgtgcacagtgaccattccttgcatgtataagcatctctgcaggacaaattccctgaagtgcaattgctgaatcaaagaacatttgcactgtacaattttaattatcattgcaaatcctttcctattagctgagtttgatggcacaarttttcccataactttaccaatactactaatgtattattaaattttaaaatctatgccaatcttcatatttcttcttttgatggacattgttttaaataagagtgaggttgaacatctctttcacgtgttgatgtttgtttctttttatggaagtggttcctttatttttttgctctttttctttggattctttaaaaatatttacttttaagaatgtgtattaaaattgattttttttttttragatgcagtctctatcgcccaggttggagtgcagtggtgtgatctcagctcactgcaacctccacctcccaggttcaagccattctcttgcctcagcctcccgagtagctgggactacaggtgccctccaccataccccgctaagtttttgtatttttagtagagacggggtttcactgtgttagctaggatggtctcgatctcctcatgttgtgatccacctgccttagcctcccaaagtgctgggattacaggcatgagccaccacgcccagccaaaattgatttttttttttctgtcttgggttgcaaaatattgcctttcaacttttggagggtacttttcattactatcctttatctgcaaaaactaccatcttgagcatattcaacttctgtgaagttaaattgatccacttttttcttttacaactgtaaaatccatcagtttcccaggattttggtttgagcaggggctgtctttatcaaatgtgaagttttcacttattctcatgtctttttctgagctctccctcatgttccatgggtctgttttctcatttttgccacagtgccacactatttttattcttgcgactttgtaacaattcttgttaaaagtttattttattgcggggagaaaaggtctcacttgcaaacagagagaagctggagaattgtgtctttgctcccttgataaggattggggctggggtgtttccttagggacgacctggcccatttgcccttcctgaccatgtgcatgaaggagagcctgcggctgcatcccccagtcccggtcatctcccgccatgtcacccaggacattgtgctcccagacggccgggtcatccccaaaggtgctcacagcctcacggggaggagtctcctgggtaggaagaggggcccctcagtgaaggaggmcttctcctgactgctcccttctctcccacaggcattatctgcctcatcagtgttttcggaacccatcacaacccagctrtgtggccggaccctgaggtgcggggcccctctctctgtttttgtccattccaaggctcctagaggagggggcagggttttgatcaggagtatccaacatcacctccctcaaagacacacacaactgtctgtctctccaaggctggcggactgggagaccccacccaacaacccttcttggtctcacctccaggtctacgacccctttcgctttgacccagagaacatcaaggagaggtcacctctggcttttattcccttctcggcagggcccaggtaagggcggcctgtgtctgaggygggdacgggttgatgggtgcaggggtctgggcatgacagtggggaaaagggggacattgtagatggtccaagttccagctctcyttccctcacctcctctggagtttataggaaaaggtccatagagtacggttgggttggtcctagaagggtctgtggtgtgctcagagccccctcctaccccaccttggtctaggctgggggttggagctcggctaggcttgcaggatatgcaagcccgcatggggatccaggcacggwtacccccttctctattcctcaaactgctctaggtggggttgggtgtcccaggccaggttaccggcttgatggggccaggatggggctcctgggtgcagtcagagttyccacctccctcccctaggaactgcatcgggcagacgttcgcgatggcggagatgaaggtggtcctggsgctcacgctgctgcgcttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgargcctagaattaccctaagaccctgttccacagtcctgtattccatcctagatatctactcaaaataattgagacaagtgttcaaacagaaagacgcttgtgcgtgaatgttcatggcrgccctattcacagtagccaaacgatgaaaacaaccccaagctatatattaccagatgaaaggataaacaaaatgtggtccatccatacaatggagtattacacagccataaaaaggaatgaagcagtgatccctactacactgtggatgaaccttgaatgcatgatactgaatgaaagacgtcagatgcaaaaggtcacatagtgtactgtccttttataygaaatttccagaacagrccaatctgaagagatgcatagcggattggtggctttcagcagctgtggggaggtgggactgaggagcgactgctaatcagtatggggtttcctcccgggatggtgaaaatgttccggacctagatastgacgaaggtagcacgacactgtgagtgcactaaatgctattgaattggacactttgaaatggtgaatttcgtggtatgtgaattctacctcaatcaaaaaaatttgctattttatctcacatacattttttttctgtccaggttgttcatataataatatgctgtgagcatctttccatgacattaaatcatcttaggaaacattattttgtggtcctcaaaatgtgtgtgttaagtgttcaaatcagtcttaatttaaaaaaagacatcatattagaaaataaaagtgttttgtctcactttgtaagaattagcttcatatacattgactattagtaacaaattgagttattcttcatcaagtaacttttggggtagagrtctcattttcacagcaatagatgcacaaatattcatgtaagatacaggtgtggttagacacctttcatagaacagytatgatctggaaattccacagacactgaatattttggtcgtattaacagaagtagatcactgagaagggagaaggtgacttttcagctcccccaggtaaatgctgatttcatcctcacatcgatcttacagattgtagatgaactcacttgttcaaggtcastcagtgaagggtggagtcrggggtgaatctgagcagttggcatcagaggtcatgccttatcgtatcaaggacatgattttcaaagcgagtctcagccctaggcacatcagattacctgggaacccctacagactctagactgagtagatgagactctttgacaggtggtgcctacatttgctttgttttgttttttgtttctttttctttttctttttcttttttaattcattttgtctttttgagacagagtctccctcagtctctcaggctagagtgcagtggcacaatcatagctcactgcaacctcaaactcctggccaaagtgatggcattaaaggtgtgagcccctcctcccagtcccgattttttttttttgagatggagtctcactatgtcgcccaggctggagtgcagtggcacaatcttggctcactgaaacctctgccttcyrggttccagcgattctcctgcctcarcctyccgagtagctgaaattgcaggtacgctctacygcacccagctaattttttgtatttttagtagagacggggttacaccatgttggccaggctggtcttgaactcctgacctcagatgatccacctgccctggcctcccaaagtgctggggttacaggcgtgagccactgcacccagccccaagtttttaaatataatatygttgaccagaagtacattcactcgtgtaaaaaataaaatrcccagtgagaagtaatggtgctacatatgcccttcatctgcccagtttcttcatgtgtataaaggtaaatactttcacacctagtgcatyctttcatagtatatttagccaaacaatatatgtaattagtcaccctaattacatattagcatgcctacattacaatgagtgtgcttacttgccactcctgtattttcatggctcatcttaaaatcacattaaattttcagaatttgttttctttggtgcttagttcagtttgttttttgagacagagtctcattctgtcacccaggctggagtacagtggtgcaatctcagctcactgcaacctccacctcctgggttcaagcggttctcccgcctcagcctcccaagtaactggaattacaggtgcacaccaccacacccggctaatttttgtatttttaatagagatggggttttgccatgttggccaggcwggtctcaaactcctgacctcaggtgatctgccccctcagcctcccaaagtgctgggattacaggcgtgagatagttcagagttttgacacatggctagagtcatgtaaccactactgccacagccacccttggtggtcaaaaacctccttccactcctgacccctgaaaaccactgctgttttctgtcttcccatagatttgctttcttcctatagttgtgtgaatggggttatgccattgggagcctaggagtcttgctgctttcacttagtataaagcatctgagagtctcccatgttgtctgtatcaaaaccttgtttcctcttattgctgggtagaatttctgggcatggataggacactctttgttcagtggctgaagggcaagtggattgtttctggtttttggatattatgaataaawctgttatggatatttgtacacaggttcttcagggaaactaaattcccattgctgttagaatgggatggctggggcatattatcagtgtatgtttaccatgatgagwaactatcaaactgtttccaaaaggtccatgtcatttttaattcctatcaggaatrtattgaagtggcgttgwtgtctggggtaaatacccaatgttcatcatctcacatcaaggaaatcaaggacaccgacacacaagaagtaagcttaagagttgaggtttaggctgagcgcagtggctcatgcctgtaatccagcactttgggaggctggggcaggtggattacctgaggtcaggrgttcgagaccagcctgaccaacatggcaaaaccctgtctctactaaaaatacaaaaaattagccaggtgtggtggygcacacctgtagtgtgctactcgggaggctgaggcaggagaatcacttgaacccaggaggcagaggttgcagcaagctgagatcgcaccattgcactctagcctgggcaacaagagcaaaactccatctcaaaaaataaaaataaaaaaaagagtggaggtttaataggcgagagaaaagagaaaagctctctcttctgcagagaaagaggggctcctgaatgggtcttgtggttttgtggtgaaacgcatggggttttatagacaagcttgaggaggcagtgcctgatttacatagggcatgaaagattggtcagaccaggtgtgctgtttgcatagcatgggaggaagctggctatcccaccctgatcttttattatgcagataggggtctctacctggccggtgctttttctacctgttgcctgcttttcactacacacatggtgacaaagaaaagggaagaggaaacctccaagttgaatacacctggcttccagatatcccttttctattggcacagctgccggcatttacccatgtaaacttccagcttgcttatctgtgcttgcagcttgatatttcaggctgctttttgttagaaaagaaatgacttgggggctgctttttatgaaaaggaaaccttactgataactgtcttatcctcactatctgccaaaataatttctttctagctcctgtattggtatgagaattctagttcctccaaatactcacctgtacttgatagtgtcagtttttttttccagtcttccttgtgggtatgctgcggtatgtcacagagattttagtctgcatttctccatcttttcatgtgccttctttgtattttctttggtaaagtgtctgttctaatcttttgtccattaattttccttgggttgtttgctttcttatttttggattttgagagttctttatagattatattttgcagacaagtcttttgtcagatgtgtgatttgcaagtattttcccctagtctgcggctagccttttcattatctgtttttttttcttttctttttttttttcctttttaagacagagtctcactctgtcrccccagctggagtgcagtggcgccatcttggctcactgcaatctccatctcctgagttcaagcaattctcctgtctcagccttgggactataggtgcctgccaccatgccccgctagtttttgtatttttagtatagacgaggtttcacgttgttgaccaggctggtctcgaactcctgacctcaggtgatccacctgttataagtaaagttttggtgccgcaaaagaaatatcactcraatataaaattttctttttaattctcagcaaggaaaggtacttctatagaagggtgcrcccttacagatggagcaatggtgagctcacacttggacaagggaggggaaggggttcttatccttgatgcatgtggcccctgctgctgtgtcgttccyctattggctagggttagaccacacaggctaaactaattccgattggctaatttaaasagagtggtgggatgagtggtttggcgggaaaaatggttatgacagagcaggtaatcagaatgagtcacggtggagtaggtaataggaatgagtcagggtggaacaggtaatccgaaaaggctgctttatgaggaagttaaatttaaaagtagaaggcaaagaattgaacatcctgacatattgattswttgaaaagaaatttagaactcatatctaacacacctgcctcagtctcccacagtgctgggattacaggtgtgagccaccgagcccagccctgaagtttcttttatagagcgaaaggttttaatgtttatgaagtaccctttatcaattttgktttttrtggattacttttacgccattatatttaagaactctttgcctaatccctatgtcccgggggttgaaatatttctgtatccctgggatatacaggttaggcaaacaggtttttgtttgtttgtttttttgtttgtttgtttttgttgttgttgttttggtgttttttttttttttaagacagattctcgctctgtcacccaggctagaatgcagtggtgcaatcttggctcactgcaacctccacctcccaggttcaagcaattcccatgcctcagcctcctgagtagccgggattacaggggcatgccaccatgcccggctaatttttgcatttttagtagagatgaggtttcaccatgttggccaggctggtcttgaactcttgggctcaagtgatccgccagactcggcttcccaaagtgctgggattacaggtgcgagccaccatgcccggccaaagagttcttacctgtaacagtgaaatatgtgggatgtagaaatataattgagttttgtttattgaccgtgtatcctacaytctatttgatcattcctgttggaatacatataatgctatatttcctcaatcttaaaacagttcttctcttagcctcactttcatactagctgatgtttgttattttcccatgtttagattccagccatcctaggggctgtgaagaagcatcacactgtggttctgatttgcttgtctctaatgacaaataatgttgagcaccttttcctgtgcttcccagtgtttaaaacagcaytttcaggctgaacgcagtgkctcacacctgtaattcattttgggaagccgaggtgggtggatcacttgaggccacgagtttgagaccagcctggccaacatggcgaaaccctgtctctactaaaaatacaaaatatgtagccaggcgtggtggtgcatgcctgtagtctcagctggttgggaggctaaggcaggagaatcacttgaacctgggtagtggcggttgcagtgagccaagattgcgccaccacattccagcctgggcaacagagtgagactgtctcaaaaaataaaataaaataaaataaaataaaataaaataaaataaaataaaataaaataaaataaaayaaaatataaaatagcattttttgttttagatagagtctcactctgtggccaggttggagtacagtggtgtgatctcagctcactgcaacctctgcctcctgggttcaagcgattctcctgcctcagccttccgagtagctgggactacaggagtgtgccaccacacccagctaatttttgtattttttgtagagacggggtttcaccatgttggccaggatggtctccatctcttgacctcgtgatccacctgcctcagcctcccaaagtgctgggattacaggcatgagccaccacacccagcctaaaatagcatttttaaacaaaaatattgcacgtaaatgtaataaatttagatattaataagcattttcccagataaaaagattacatataaataaaaaacctggacgtgtgagagaatatttacagtgmttattttgacatgggattgtggataacttctatttcttacttttgcttacttgtcttttttatgggaatattcatcattttggaatgaaaaatttaactatgaactctaaaggca

SEQ ID NO: 13230 - DNA, 159138 bp, Homo sapiens
  misc_feature (1)...(159138): n = A,T,C or G, or insertion/deletion polymorphism (see Tables 1-2)
attgatgaggagagcaagtagaaatgaaaagagaaaaccagtattaggagatctataaagaaacaatagtcagaaaaagagtggttaaagaggcagaagaatcagaagagaaccagattcatgaaataaaagagaggaatcagtttcaggaaggaaagtgtggtcagtagtgtcaaataccagagactgaatagcctaaggatttaaaagaggtcaacagcaccaccaattaagcggtttttctgagcttaagatatttttctttatttttctatgttaaaaatattttataaagaaaaagaaaaaaagagatcacatttgcccccccaacccgtccctggcctctctctctctaaggaagtcgttaatgaatttgggcagaatagattcagagctgtgagagtgaaaatttgactgcagtgggtgaggtgttaataaaagggagggggtagagatgaaatctttccagcagtttggctcttaaggggatagcttgaaggaaagagggttggaagggtggtttttaaaaagaattatcactcactaatcaactagaaatccagtggaatatgcagtayttgtctgtaatccagcaggctaacttytttttttttttttttttgagacggagtctcgctctgtcacccaggctggagtgcagtggcatgatcttggcttaccgcaacctctgcctcccagttcaagcaattctcttgcctcagcctcccaagtagctggaactacaggcatgcaccaccatgcatggctaaattttttttgaatttttagtagagatgagtttcaccatgttggtcaggctggtctcaaattcctgacctcaagtgatcacccgcctcaacctcccaaagtgctgggattacaggccrgagccacagtgcccagccaaggctaacctcttgatcccaatgacaaacagaacaaacatcttactcaagtccagaagcaataataattttgaatcttgcttgcatgtcaacaggagccacattaatacagaagaggatcacaytggtccaattaaattgaattgattgagagcctctgcaatacayggtctactgcacaaataatgatggttcctggtacatttttatttgaccattgattgctcgatttgtttctgtgtctaactgtgtattggaattaagctgactcaatttgaactgcaggtccttttatccctcttattttttatttatttatttattttattttaaggcatttctcactctccagaaaatctctaagatttcagctattaggcatttgtctttttttttttttttttttttttttttgagactgagtcttgctgggtygcccaggctggaatgcagtgtcacaatctcggctcatcacaacctccacctccctgattcaagtgattctcctgcctcagactcccgagtagctgtgactataggtgcaaaccaccacgcccagctaatttttgtatttttagtagagacaggttttcactrtgttggccaagctggtctcaaactcctaacctcaagtgatctgcccgccttggcctcccaaagtgctgggattataggcatgagccaccgtgccccaccaggtcttcttaatcataacaaattcatcttaaaacatcattttaraatatattattttttattcttcattgacttcctgcattactctattttttcagagtttctagcaaccagtatcattggtattttaaacaatgtgtacatgtacatttatgcagatgagttaacatatatcaaagcaacctccaaacaatgccatttaggtaatctccaatttaaaagcctcaatagaatgataagattgagcttttctgtagttccatgacctccagcagagtctgcaaggccacagctgcctgaagrttgattctgtaattagaagatgccagggtcatctcagaatagaacctcaagccacccaggctacatttacagaatcagcctctccagaaaaacagcaacaaaggaggrccttcctatgtatttggaaggagtcacctagaggagggacttggggttttggtgttggtgtggggggcagggatgggatggggagggggaagcttattgaaatatactaaaagacaaaccaacctaagggctggagggaagaaaattcacacttgtaagcttctttttyaaggggcatctcttaggctctagcttttgagattcagtatatatatwtttttgagtcttgctctgctggagtgcagtggtgtgatctgggctcactgcaagttctgcctctcaggttcacaccattcttctgcctcagcctcccsagcagctgggactacaggcgcctgccaccatgcccagctaattttttgtatttttagtagagacggggtttcaccctgttagccaggatggtctcgatctcctgatctcatgatccgcccgcctcggcctcccaaaatgctgggattacaggcgtgagccaccgygccyggcccagtatttttgttttatgaagatattacatttgtaaagtatgagcttggtgtcagcaaacttatatccctgtgtacaaactggccgaatcacttagccactttgggccaaatcacttagctcttctaacagtaagaaatcaacaagaaaaataaacatttcaaacattacaatgtgttcatgtattcactgtgggggatgaccagattctcgaaaccacaggttgttcttagtgaaacaagtttgggttggggccatagacttgtgtatttagaatcaatggctgttctctctctgggactttgatttttttcttgggctcatcccctttttgtagtatcttatctttgtcttatttgtataggacttaactgttcccattyccttattagagcaatctaagtgattaccttcataccttttggaattatatgcttcaaaattccaaaaagaatgattttgggctgggcacagtggctcacacctataattccagcactttgagaggctgaggtggatcgcctgaggtcaggagtttgagaccaacctggccaacatagtgaaaccccgtctctactaaaaaatataaaaaattagccgggcatggtggcaggtgcctgtaatctcagytactcgggaggtggaggttgcaatgagcccagatcgcaccattgcactccagcctgggcaacaaaaggtgaaactccatctcaattaaaaaaaaaakaatgattttggtggtcgacttcaaataggtaggagaagaaggagagaggagatggagggtyagggagatctaattactctctaaaatcatgctaggaaagataacaccttttaataacactctctgcttttataacatcattctgccaaggagctcaaaggtttcaacaaagttcactttcagaaaacccctttgaggaagacagaatatacatcttctctccattttaaagatgaagaaacaggccgggcacaatggctaatgcctgtaatcccagcactttgggaggctgaggccagaggatcgcttgagctccagagtttgagaccagcctggataacatggcaaaaccctgtctctacaaaaaaaatacraaaattagatgggtgtggtggcatgcacctgtggtcccagctacttgggaggctaaggtgggaggatcgcttgagcccagggagtcaagtctacactgagccatgattggatcactgcactccagcctgggtagacagagcaagaccctgtctcaaamaaaagraatgaaagagaaagaaagaaagaggagaggagaggagatgagggkaggkgaggggagsagggagggggggaggaaggaaggaaggaaggaaggaaaaaaagatgaaaaaagaaaaaaacaagatgaaacagaggcagaaagactttacgtaaattgctcatcatgtggttgtcaagtttgaccccaaaacccaatttattgaccaaggttattctttgactgaggcaarggggtccgctctcctgggccttgggctttagaaagctcatctctggcctttctgagatccatccctttctttttatttttcttgacacggagtcttgctctgtcactcaggctggagtgcagtggcatgatctcgactcactgtaacctctgcctcccgggttcaagcgattctcctgcctcagcctcctgrgataacaggcgcycgccaccacatctggctaatttttgtatttttagtaaagactgggtttcatcatgttggccaggttggtttcgaactcctgacctgaggtgagctgcccaccttggcctcccaaagtgctgggattacaggcatgagccactgcgcccrgctcagatccatccctttctaagggcaaacagtccatggtgcaaaggggccatgccacccagagttatgagtacctgggactccagaattccttgcctggtggcctccacatgcacttccagggcctgcttgggcctcttctatgsgtctgtcctgagtgttgatagaaccactgatgtgagtacctgggcttgagccgtggcctggagatcctgttgactgtagcatggagggggcttgtgcagctgaatgtctgyatgcaggtggtgggagttctggaatatgatggagctggaggtgggaagagaagtaggcttggggcagctctctcatgccacctcattctggccaaaactcaggtcaaactgtgaagagtctaaatgtgaatctgcccttcaaggtggctacaaaggtatctttgtcaaggtaggagaycttgtggcctccacgtgcacttccagggcctgcttgggcctcttctacgggtctgtcctgagtcttctatgaatctgyccttcagggcagattcatatttagactcttcacagtttgacctgagttttggccagaataaggtgacatttagtttgttggcttgatggatgacttaaatatttagacawggtgtgtaggcctgcattcctactcttgcctttttttttgcccctccagtgttttgggtagttttgctcccctacagccaaaggcaaacagakaagttggaggtctggagtggctacataattttacacgactgcaattctctggctgcacttcacaaatgtatacaaactaaatacaagtcctgtgtttttatcacagggaggctgatcaatataatgaaattaaaagrgggctggtccatattgttctgtgtttttgtttgttkgttttgyttgtttctttwtttgtttttgtggcctccwtcctctcaatttatgaagagaagcagtaagatgttcctctcgggtcctctgagggacctggggagctcaggctgggaatctccaaggcagtaggtcgcctatcaaaaatcaaagtccaggtttgtggggggaaaacaaaagcagcccattacccagaggactgtcygccttcccctcaccccagcctaggcctttgaaaggaaacaaaagacaagacaaaatgattggcgtcctgagggagattcagcctagagctctctctccccyaatccctccctccggctgaggaaactaacaaaggaaaaaaaaattgcggaaagcasgatttagaggaagcaaattccactggtgcccttggctgccgggaacgtggactagagagtctgcggcgcagccccgagcccagcgcttcccgcgcgtcttaggcyggcgggcccgggcgggggaagggsacgcagaccgcggaccctaagacacctgctgtaccctccacccccaccccaccccacccacctccccccaactccctagatgtgtcgtgggcggctgaacgtcgcccgtttaagggrcgggccccggctccacgtgctttctgctgagtgactgaactacataaacagaggccgggaasggggcggggaggagggagagcacaggctttgaccgatagtaacctctgcgctcggtgcagccgaatctataaaaggaactagtcycggcaaaaaccccgyaattgcgagcgagagtgagtggggccgggacccgcagagccgagccgacccttctctcccgggctgcggcagggcagggcggggagctccgcgcaccaacagagccggttctcagggcgctttgctccttgttttttccccggttctgttttctccccttctccggaaggcttgtcaaggggtaggagaaagagacgcaaacacaaaagtggaaaacaggtaagaggctctccagtgacttacttgggcgttattgttttgtttcgaggccaaggaggcttcgggaagtgctcggtttcggggactttgayccggagccccacatccccaccacttgcaactcagatgggaccggaggcggtgttaaatggggagackatgtcctagtacgagctctggtgaccccaggactctgcgctgctgcgcttggggcttgcccgacggtggagaccggggagcatctctgggcgtggagacccgggcgcagtaccccgggctcagaggggtcgggggttcccgggcgtgctgagggcgctgctgccgggtggggagagctgcaggtccggcaccgagcgctgctttgttcggagggccctgagctggctagaaacccttctggttgcaggtcggccagtacctacggagacaaatgccagcactgagtcttcactcggttcttaagaagctggtctgttctgacctgggaattggctatatgctccccsggactggagcggcacagtcccggactgtgaatccgggaactcgagttggaggtgtcccaaacggtccgtggtgctattgctcactagaggccttgggtctttgtttgacctgaggggtagggaggtcctgcctacagtctccgtgcgctcagctgagctggtgtccctggcgcagagcgcggacgagttttgtttccttttctttttyttttttttctttcctttaagtctcggtctgtcgcccaggctggagtgcaatggaacgatctccgctcactgcaacctccgcctcccgggttcaagcgattctcctgcctcagcctcctgagtagctgggattacaggcgcgtcaccacayccagctaatttttgtatttttagtagagacggggtttcaacttgttggccaggctggtctcgmaccctcgacctcaggtgatccaccggcctcggcctcccmaagtgctgggattataggcgtgagccaccgcgcgcggccgagttttgtttcttttaaaaacaagacttaggagagcctgcggagacccggaggtggggtgcccaatcctccctctcccacgttccctgcagccccatcttccagaccgttgctgctggtctctcggggcagcttctgcctgggcgcagatggggaagctgggccgagktggtgccgtggaatgaccgggagtaaccccggcgggcggcgcagaactcggagctccgccgcggggctgggctgggctctgccgtgagggtgggggtgctgggcgcgcgggctgcggtggcccccggagactggcccgcagcgcctcctggccggaggacctaggaatcggccggctctactaggtgtctttgctcgcggttccgactgtgaatccggtgaagaccggtggttgcagacggggaggaactatgaggttgaggcgaaagcccrttttktttttttttttttgtttttttggttttttttttgttagcgtgtttgccaactcccaggccattggtaaagcaggaaggttcttggggcggcggacggtgccagggttatgtgtaggtgcctctttaggtatatcktttatcaaaaagaagcaaagaaataagattaaaaataaacaaagaaaaaagttgtctggcactggcagtaattggcctgcctttgcagcactgataccattagcttttaaaatccgacttttcattgacacttcaagaagagaatgggtagtatatacacattcatctcatagtggacaaatttcatatttaaaaaaaccttctgggtactgaaatcagcaagtcacttgccctccatggccgaatccctgcttcccacgaagagaacctcacaaaaatttcccccaagttaaagagkggaattttcttgatttttttttcttttttttttaacggccgtagtttagaacccagacttaaattatgatcttcttttcaaacaaaacttaaagtccttaagttttcatctccccttttatttcaacctattcttctcatacctaccacaaaaataatggaggctttctgttgagaaactttccgtttctgttgagagtatcattctcttgagaaactttctcctaaatcagagaaagtatggaagcatggaaagtattcctgagtagaacytctacagatattacaatatttttcaaatacaaagtttccattgtcagcctgtttcccaagtgcttccacaaaccattaaataattccacaaaccattaaaataattaatgctagggaattttaggaaaacattggtttacaatcagaaggacmggggaagtgggtcttcagccttcacgatgactacaagccatttaagggactagaattgctactgttgtcagagcaatttaggagtctgtatttgagcacccgcatagtgttccagaatgacatatctgactgtaacctggacacgtgtgatatgttgtctcccctgcagatgagcatttgaaatctcaaccctcrtatttctacgagwgcaggcctataatggaccctgggcacattttttttttttttgagatgcagtctcgctctgtttcccargctggagtgcagtggcacgatatggctcactgcaacctccacctcctgggttcaagagattctcctgcctcagcctcctgagtagctgggactataggcgcacgccaccatgcctggctagtttttgcattttyagtagagacagagtttcaccatgttggccaggatggtctcgatttcctgacctcttgatccacccgcctcrgcctcccaaagtgctgggattacaggcgtgaggcaccgcgcccgacccctggacacattttgacttagaacatattttcggtttgtgtgagacagtgcattagtgcaggattggaaaagagtgatcaggaattgattgttttcaaggattggttccttctgctcaaggaagtcccattgtaaacataaaaaaatgaatgaaactgaagaagttcagtgacttagctttttaktatcttctgtagtacttacctttttggagaggagttggttgggatatttttccatttaaattttttttttaaagggatcttctctcccrtaagccgggatacttaagctatatatgtagtggctacaaattaaggtcttcactgttttcatttttagctsctagaataagtgaacattaccttagatagactcttctaattatgaagatatctagatgtctagaaaatatcaaaatgcatgtggtttttgcatttctaaaatacttttaaaaccaaatactttttyttttttttttttttctgagatggagtcttgctcttttgcctaggctggagcgcagtagaatgatcttggctcactgcaacttcygcctctcaggttcaggtgattctcctgcctcaacctcctgagtagctgggattacaggtgcgtgccaccayacccggctagtttttgtgtttttagtagggacagggtttcaccatgttggccaggctggtctcaagctcctgacctcaagtgatctgccagcctcagcctcccaaagtgctgggattacaggcatgagccaccacacctggcctcaaatacatttttttaagtatccagatattaaataaataataccattatagtagttgttatggtcatttactctagcatcaaatgttaaaagatcattctgaacacttgttttgtttatgctgagagaaggcctactccaaaaaatgcaaccatcttcgtatctgcatgtggatacaaccatgaatggccaaagttattgcartgttgaatagacacttatatagcactgtgtggcaagtactgtttgaaatgyttttcacgtgtttattcattgtatttattttgagatagggtcttgctctgttgcacagggtrgagtgcagctgcacagacaaggctcactgcaacctcagcctcctgcgctcrcgtgatcctcatacatcagcctcttaaggagctggggccacaggcacgcaccactgctcctggctaaatttttacaattttttgtaaagacaaggtctcactatcttgcycagactggtcttgaactcctgggctcaagtgatcctcccacatcagcctcccaaagtgctgggattacaggcataagccactgtgcaggtcatcaaatgctaattgaattttcacaacaaaaccatttattgtccctagtttacaagattaagtaaatgagaagctaatttttctctggctatataccttgcaagaggcagagctaagacttgaacccagccagagttctttaactccagcactaacatttcagctgctgcaaccagggagcttttcaaggatgatcaccacattctctacattcatctgctataatccttatcagaatctacagcctgtatcatattttccttgttgctgtgagtgggtcagccaaattctctttaacttgaaaccttggttgcgtagggattgcaacatcctggaaagaatagaataaaatttactcaactcaattttttacttggttcataatgaaaactatactattgcttcagtcagatgtttgcgaatagctgtgtgatctcaaaatgttttcctrtgtgatctatakaaaatggaatgatagagtattaggctgtaagggcmtaagaaacaaaggaaaaagagaagtgaactgttagtttagttgtaaaacctaactttggtgaattgtaaaaatttgttataatacaatatgattcttgcttgtcctgtccttgatgaagttgtggaccttttgaaataagctatttctctgttactgctgttactgtttagaaatcaaatttagttttttcttaagatatacgtatttttggaagataaacacagtttcaaagtctgccttgttggctgggtgcactggctcattgttgtattcccagcactttgggaggccaaagcaggaggatcacttgaggtcaggagttcaagaccagcctggcaaatatggtgaaaccccgtctctactaacaatacaaaaattagctgggcgtggtggtgggtgcttgtaatcccagctactgggattgggaggctgaagtagaagaattgcttgaacctgggaggcggaggttgcactgagtcgagatcgtgccactttactccaacctgggcgacagagtgagactccgtcttgaaaaaaaatgtctgccttgtaaaagtgaaataggatgagaaagtgcctttcttattaattggtgtaatgaattanaaataaactctttgaagacacctcttggtaaaaatagttacatttactgttgatttatggtatgttggatatgtttttaagttttccgtgtaataactcagttcattctcatgagtgaaataggtgcttttattgtctttatagatgggaaactgaggtataggcaggctaggtacattattatggagttcgtaagtagtggagctgaagtcgcatcccagacagtttggcttccgtgagtttaccaatctcatggtaaagactttgtcagactatcaaagttttgacaaatgaaatattagcaaaagkccaaaagggattctctattttcatttgagtatcttcacctgaaaatagttgcctgaataagtagcctgcatagaaaggtacattttagaaatacttgaggccagagaatgaaaagcttacataaaattgatttccggtggggccttcagttactctccattctacgaagaccacaaatagcattcaggcaaagagcatttattccarcaatggaggagcaytggatttggttcctaaaacaaaataaagtttgaaatcctgtctttcccatgttgaaaacaaagttggtacaaaaccctttagctttkgcaaacctcctttaagacccgatttaaatgcytccctcctcrtgaagctcttctggatccactcyttcccatcamtaagttgaaagtmagatccccttctctttacttccattagacttggattacagcactctttgtatcatgtatttaattctgttttttaattacagttaacatttatttgtcttcctcttgagtgtatgcttctctagaggaaggtctttgattcattctcccctggccttaattcatcccacttaatatggaaaaaatttaataaatgctgacttgaataagtccaacaaggagaatgggaagctcatgtttgcttcctgtcttctaaaagactacttaagataacagggtaatcacagaaaagcattagaaatagagttatatgagaaacaactgtagttaakgctaggtttatgttagactgagaaattttagtgcatacttaagttatttaggccaggttactttttgtagaacaaacatttcagtttcgctcagtttcatttccgtttctgaggcagctgtgatttaagaaaatgctctagtctgtggcattccatattcaagtactttgagttgtatattaatttatttttgttaataagagtgasatgactcactaagtaatttagagatttaaacacttttttaaaaaacagtaacttcrtatgcattggatctattcttctataaagtcttttcttggggkgtgtttgtttaaaattccccggtgttttctctgccaaatccaacttccaagaagcatttggaagtcaaarcattttatctggttagtcttaaagtccagatattttgtgatagctggtatttagtttaygatatttcccaggaagaactttttagtagttgaaccatttatgaaagacttccttgaagctaccttagagagttgatttagttcttcctaaataagtaaatagaatattagtattaggacatcttggagtatagatgcaaatattggtgaaaaagaacatggatatcagagtcaaattaatgtagattggaattctggttattactaawggatatctgacattaggcaagttgctgatcactctttgcctcagtttcatcatctgtaaaataggtatttgtgtttgtgtataatgtgaaccgtataatataatgcttggcctatagtgaaatttattcataygmgtgttttcagtgattttaaaagcttgctttaggccgggcgcgatggcttctgcctataattccagcactttgggaggccaaggtgggcggatcatgaggtcaggagttcgagaccagcctgaccagcatggtgaaaccccgtctctactaaaaatacaaaaattagctgggcgtggtggtgcaagcctgtaatcccagctactcaggaggcttaggcagaagaatcgcttgaacccrggaggcagagattgcagtgagccgagatggtgccactgcacagagcgagactccatctcaaaaaaacaaaacaaaacaaaacaaaaatcttgctttatagtttacttccacatcaaattgtctttatcccatgttacttgcattgatatcccagacatgaaaagaaaaaaagatgataacaatgacagttattaaattaggttccactcttattctagatcaccaattcatattactattcagacttggaacattaaattttagttaaactttttttcaaatatgcatataattgtcagtggttactatattttggggaagagattgttgacttctttgaagaaagatacggattttctcttcagaaraaatacacatgggctcatataatccaaattttatgtgtaattacagggtgttcatgaatgcccacaaatccattaagccatgtgaccttggacaagtcattttacttttctgttttttaggttgttggtctgtaaaatgatactacttgacttttaaagagcccttcaagctcttatstcctctaaccccaggtctgtattcagaagaaggggtggtcctttaattagagccatctagagatctgaggaacatgctgggcattagtgtaacataccatgtggattttgagaggtaaagaaaaaataaccagggaatgcctcagagcattcctgatcagatcgatgacagaagaaaggaatgagagggaggagaggaagctgttgaaatttcctatttacctgctttgagtgaatgaagatttgaatcatagaaccagaaggggttctcatctgaaatgcaaaggaaggaggagttggtttaattcaataagtttcagttgagtamacatgatttagtgagayactgttcttgcttctgactcaycatttggaaaatctctctaaaataaaattggactctccatctcggacatcattttgggtgtaggttttgcttttttttttgagatggagtctcgttatgttgcccaggctggagtgcagtggcgcaatctcggctcactgcaacttccgcctcccagattcaagcagttctcctgcctcaacctcctgagtagctgggactacaggcgtrtgccaccatgtccggctaatttttgtatttttttaatagagacggkgttttactatggtggctaggctgktcttkaactcctgaccttgtgatctgcccaccttggcttcccagagtgctgggattacagatgtgagccacagtgcccrgcctaagttttacttcttataatggactcctgttaagccaataggtgatgaaaggaaaccataaccaactcttcaggctcattcatccttcaagaatagcatgctagtacccatcctaggaggagaattggactatacctcatgaggatagtttgaagtatctcagaagaccctcactgggggtaggtsggtaagacacaaagctttctaaagcactgtaccaaatttgttgtttgagagatcataacaaattagaagtggaaagaagaaggagtaaaaggaagaagaggtttctggccaggagcagggagggggaaggagctgctaggaagatgtttggttgtcatatccctgttcacccttgctttgcaaaattcttgtaggatgccaggttgggagtaattgtttttcacaagagtcaaaccacgcttgttttcttgaagaagcaagtctttggagggtggtggcttgaaatctgttggatctggtatttaggtgatacactttgacataaaggcaacactgatgcaagcagcagctttccttggaaaggcagggagaaagtgaaggcccagactgatgagcttacactgacctgcagacccttctccattcccaggcatgtttggtggcagagtttaccttagttggggttaggctgttgtctggtactgtgagagagaaggaagaagaagataygatattaacaacaacaatacatatttatatttgaaaattaaatgcactaatacacctatagtgctattaaacaaatttatttgttcagcaaatgtttgttaaacaccatgtactgtggaaagtactaggtgctggacagaggtcaaaagacttttaagaatctgccaccattaatgatctctttytgcttggcattcaaggctctttgaaataagactgtgacscactttgatagttttgtcctggattataagacacatgctcgaaggaactatmgctggttttctcaccagactgattaacatatagtatggtttggtacctgttaaatgagtctctctctacaggttttcatcttctaytttaagaaccccttcctggcattgtttggctcctcattgttctggaatctcatgtccatctcatgtatttgccttggttcacacttgatcttctrctcatattcctcacctactgaaattttacccatcaaccagaccgtgggtgatggaacacagcatgggctagttcttcttatatatgatctcatttaattttcwctggaactctgagataggtagcatttcagcccactcaagttgactcaaatttttgtaatcatcaatatattttaaaataactttatatttgacctgtaattggaaaaccaatatgagttatcataaatgaaaggtaattttaaaaataattaggatgaagacaaattatttttctcacagtctatgtataagataaactattggttcccaaaggccccagctgacaatgagacttctcttactttgttgaaaagggaattagcaagcattaaagaggtgtcaaaaagaagactaaacaaaagcttactcctttttttttttgagacgagtcttgctctgttgcccaggctggagtgcagtggcaccacctcggctcactgcaacctcttcctcctgggttcaagcgattctcctgcctcagcctccctagtagctgggattacaggtgcatgccaccacacccggctaatttttgtatttttagcagagatggggtttcgtcatgtyggccaggctggtctccaactcctgacctcaggtgatccacccacctcggcctcccaaagtgctagaatcacaggtgtgagccgccgcacccggccgcttactccttaatgtactaagaatgttatatataggctgaagaagtgctgaaaagaaccatattttctcatgatgtggttcaatgtttaatactgtgcttgttcatctcctaaaatcctctgaatatcacttaaattcatcctgtgtaactctcccacatttggggaaatactgagcttgcctattattatattagccccatatttcagatgatgcacctgagccgaggagaagttaaataacttgttcatgkttccatatttggctaatggcagagccagggattcaaactcttgtctctctgactcccaggtttgtgcttttcccmcttggctgaatttctcatgctacctcctccataacacctttcctagaacttttaaggaatgcttcccctgttctctcatagcattttaatgtaagttgccaaagtgtcccagtttgcacccctaccagcaatgtgggagaaaatagcaacatatttttgatgttggggtctagtgttacggtttcttctgctctttgggatgtatattccatggcwactgaatamccaagtcccaaacagttttcttagactcagaaggtcatccacttcagcttcttcatcaraaagacatattttctggctgggcacggtggctcacacctgtaatcacagcactttgggaggtggaggcaggagaattgcttgaacccaggaggctgaagttgcagtgagcccagatcgtgccactgccctccagcctgggtgacagagcgaaactctgtgtcaagaaacaaaaaaaaggacttgttttctgttccattacccacagtggtagaatggcgtgctaratttattctccagctgccattaactgcaaattaaaatcttagtctcttgcctctttaatccaggcttcttcatactataccagaatttaggataactattacagtgccctttataggaragaaagaagaaattgtgtctrtagatgtctgttcctttcagcttaaaatggacactgaaatgttaaatattggactggcctcatttatttctcctgtctgttggtccaatttgaatcttaaggcgtctttcaactggaattttttgtttctctcaamtaaaaattgttctttgtaagtttgaatcagaacaaaatcctgaatgttgagggtttcctaaaggctgtttctttatgcaaaagcctgaaacccgatgttgatgttggctgcttaaaattaactgtgaatcaaggcagggtttttatttttattttttttttactttaatgattgtgttaattatagtgaaaacyttgagttcacgagaaagaaagcctttggtcaagtattgtttattaagttgtcagtcttgttgcaggatttgcaaatttagtggaattagtgccatttttcagtttacaattccagtcacatttcacatgatcagagcatggctttcttctctgtggagcaaatagagrgctgtctgacacttggttccagtggcttccattaagcagagtggatatgtccctggagtctgcagagaagggcatggcactctgaccccagatggcactccgttttgggacattgtccaattctagttcatagcatatgtgaccaacaccagctctcacctgatgtaaacacttagcgcgttgttgcttgggggattggattgtgtgaatttttcaaaactacagttgacagaaggaggctaccaaaaatgaaacccaataattccmtttttgggaattattcccacttttgttccatttttcccactttgttctttggcacacagaatgtttgatttgtgaraawcttaataacagtagttttttctataaggaacactcagaatcttgataatattggaataatacagatccttttgtaggatcctctcagacctcatataatagagttcatgtagtcaatatttaaagaaaaacacccttaagtttttgtttttcagaatcacaagtaagtggatttaaacttgtgatcttattcccctttcttctcttaatttagtgaggcagccagcgagagggtttgttttggttattctaaagaaggagtttgcttgtaagttttggagggcaagacttagactctgtgtctctgtgcttgccctggaactttgattaaattgtcactaaccgagttagctggccctcgccgggctgcagaaatagaagtgtcttgcacacatgacatatgactgtctcaagagctggstggtgaaaggacgttctggagaaggctgcygatactgtatgaactagaactggacaagagcctggagattggataactcagtttggcgcaagtaaagggaataaaagtgttaaggtggcaaaattgtatccaggtgtttataggctccctgagttcctgacttgagcctatctatgggtttagagttcaaggctctttaccagtgctgacaatcttatactcyaggttgaacctccggggaaggtgcccttgcttgatggcatgtttaccaggggttctagagcctcaatcacagattctstctagctcacatgaagttaatgaaaatgaatgtgcttccctacaaattagagaggctttgaggaaaaatcagattaaatgcactcctgcttgaacttatgtttcttagaacacagctggaaattttgtcacacaaacctttactttcagtgacatttcttgactggtttgttactgtagtgaatctgctttaactatcttttcttatcgctgaggttttacttccattctacatgtgattgtggagcgctgcgtcattgtgggttcagtgyagtggagagtaggaagatggtgagacacagtagcttgttgcacattgcttaatttatcagggatcactgatgagttagtacactagagaagattgtaggtagagctgaaaagatggaggaattataaggctcagatttctctctttttttttttttttaagatggagtttcactcttgttgyccaggctggaattcaatggcatgatctcggctcactgcaacctctgcctccygggttcaagtgagacttgatggtctcacttgatggtttcctggctcagcctcctgagtagctgagattacaggcacccactaccatgcccagctacttttttgtatttttagtggagatggggttttatcatgttgaccaggctggtctcgaacttctgacctcaggtgatcacctgcctcagcctcccaaagtgcagggattacaggcatgagccactgcgtctggccaaggctcagatttctaatagagatttctaatggacatagaggctggaggaaatgggatggacaggaaaactgagtcaggtgccaaaaacttgtagggggccgggtgcggtggctcacgcctgtaatcccagcactttgggaggctgaggcgggtggatcacgaggtcaggagatcgagaccatcctggctaacacggcgaaaccccgtctctactaaaaatacaaaaaattagccgggcgtgttggcaggcggctgtcggtagtcccagctactcgggaggctgaggcaggagaatggcgtgaagccgggaggcggagcttgcagtgagccgagatcgcgccactgcactccagcctgggcgacagagccagactccatctaaataaataaatagataaataaataaaataaaataaaaacttgtagggaggtggcagtgtgctatggagrataggtgcaacctctgtgagaatgtagagaaaatagtataagtgagtggtgaggacccccaagagggggttttatagtaaaacaatggtcwgaagtggcaacaggataccgtataatgctttcacctctaccaatgcactgggtactggagagcgctccagtttgctctggaaaggccctttctgtggacaaagaatacagaaaagagattcctttaataaaccacccactctgtgtcccacccttgatgaatacttcactgtgaaattgccagaattaatcatggtaatagctactgtacacttactttgttccaggaactggataaatgttttacatacattatcagttctrttttttggagaagatacaggggctcagagtccctagggttccagagctggtgagtagcagagtcaggattcaaacccagctttctctgactctaaaacctcctttcttcctgctgaaacaattaactcaagacaacaaaggagttaaggatttggggagttttctgcatggtagaatagacccaaaggaaaagaaagaaagacagtgactaagatttgggtttgtctgccccaccaaatgctttgagcastttcataaatataaatccttcrggttgggagaaggttgaacatctgaagacactgattcttcagagatgtaatccaaacaaagtgatctttggtgatatggtcactaaaccatttatcccaaaattctcttggaaaaccgtcctataacagcagggaacattatccagccaagtttttctgcaaataaagggttgctgatagaggcttgcctgcttgtgtttctgtagctcagggtgtttatgaattcactaatcccttcccttcagatcccttttattctggtgttatgattgtgactgaaaaaaattgattttttttctatgacatagaatgttgaaaggttgatttcttttctagaggaaagattctttttttctatgtgctacatacccsccgaccagggaaaaggcaaatagtggtattgtttgctgaagtcttcctttgaaggttgcttggtgtttgcttagtggaaatcagcaggggaagagaggctatctctaacattttgttagagtttcttcgtagttctayagtgatgaaacaaggacttggggtacaggacagatctgctttcagaaatcctggctcttgtgaggtttagaagccctgagaccatttagctggtggcaacgggaatgttgagggtgataaataggatctttggttgtccaagtatcagtgacatgatatagatggagttaaacctttaggatctccttatttatttgtttgtttatttttgagacagggtcttgcactgtagcccaggttggagtatggtggcatgatcataactcactgcagcctcaaactcctgggctcaagcgatcctgctgcctcagcctcccaaggtgttaggattacaggcatgagccgccacacccggtcaggatctcctgtaaaattatattgttgacaacatgaagaattatgcttctcaaaagctagttatagatttgtacaatattcatagatttcttgtttcagtttttacaaattcatagcccttattttgaaaattagctattagcaataattttgtctaggaaattggatgtgtattcaagtgaaagaaggaagtacagttacctattatcttattgtaactaacaatcaagtaagtgtgatgcatttggtactttaaaaactgcacccaagttacagattattggaattaataaaattcactggatctatatatttttaaacggacagtgtgatagcagaacctcttatagaatgatagaattcctctggaatgattggataacttcatttcatcctygacttttaccttggaggatttcttaccccttttggcttctcaaatttgactattaaaatgttgcctttaaaaataggaacacagtttcaggggggagtaccagcccatgacccttctgcaaggccccctaactcaaggtagtttccctggaactgtggtttatggaatgtttcaggagtgtgaggaggtataatttaaggctgtcctagcaaggatacccttaaggatagagggcccagtagcatctggaggccagaaaagttaaactgaggcagtcagattagcttcaggctcaattaagctgatgggtcagcctgggagaaattgcaggatgactctcaatatcccctcccacccccacagcagccacgatctgtctgtctttaatcatgggtgcagtgaacctgttctttccaggtgtcttggccttcagtaaccttgttaggcttgtccctgaacgtggctaccgatccaaagacacatgatcagagaggcaattagagaacagaccttttccaaagcaagcatgttctgttgggcttagaagtttcatgtcctaatattataggaccctgtgcatctctctggagatgaggcacatgagtcatatctgtgattcttgcttttgtgtcaacatctcatgaataggcaatcagagctttggcaccaatgtattttcagttcatatctgatgtagttaaatccacctcctgctttgtagtttactggcaagctgtttttgatataagacatctagaacactgtaaatatataacatttttatttgtctattatacctcaattacgaaaaagacatctagaagcaacctcatcaagagagatactgaggccgggcatggtagctcacacttgcaatcccattactttgggaggctgaggcaggtagatcacttgaggtcaagagtttgaaaccagcctggccaacatgttgaaaccctgtctctattaaaaatacaaaaaagttagctgggcttggtggtgggcacctgtaatcccagctactccggaggctgaggcaggagaatcacttgaacctgggaggcagaggttgcagtgagctgagatcacaccactgcactccaacctgggcaccagagtgagattacatctaaaaaataaaataaagtaataaaaaagagagatattgatagctgttgttggaaatttcaacttccatctcacttctggtaactttttggaagtttgttgaacaaagtggaatacacgcacatacacacacacacatactctcttgtttgtttaaggtttaatgaaatagctgtcatataatcactgtttttgaaagaggagaattagttgctatctgtacattttgggtatgtgaactatttggatagaactctgagaaatgcattcagaacaacaaacaaaatcataggagaaatagctaagtgggaaggggcatataagagttgttgaaaaagttatttcttgagaaaccagctctaatgctaggcaagtcacttgctttgggggaggcctcagcttctctgtctataagattgcagcaggggtgtagtgggaatgagtcttcaacattccaagagattttatctactaatacgacmgtcaaatggagcatgactttgtggaagyctctcctcttccacccagaggggccaatttctctgtcccagtgagatgttgacacttgtatgatccctgcttggagacttccctcttctggaacctgccctggctcaggcatgagggctgactgtcacccttygataggagcccagcactaaagctcatgtgttggcagtgttcttgcgggaaggaaaaagaccagccagcccatttgttactgcacaagcaaacagcttctggtagctgtacagatacatgcactttctttcctcactgtgtttccatagacagatttagtgctgtagaagagtagagggcagtcacgggaaggagttcctgtttttcttttggctatgccaaatggggaaaaatcctcctatcttgtctttttagtgtcatcctctctccccttttcttcttctttataattctcatctctcatctctcctggaaatgtgcatgtcaagttcaaaagggcacaatgttttggtgaggaagaggtgggagaacacgtgccaggtgctaactagggtcatcatttcccccttcacagccagcttcctgtgaaygtgtgtgtgtgtgtgtgtgtgtgtgtgtgtgtgtgtgtgtgtatttcttttgccagcatcactgaatctgtctgctgtctggtattccaggttttggtttagggaaaagtaaaagtaattttataatcccagctgtcatttaagccacccctttgtgggtagcatatggtccactctctcagttcattgtcctaaagatgcttcatcagaaaggaataacttccaccccgttactctctgtccccttactctgctttatttttcttcgtcartcctaccaccaccacccactgtttgaacaacccactattatttgtctgtttcccatccctggtagaataggagccccatgaatgaaggaactttgcttctgttgttcaccactgaatctctaaggtatggaacacacctggcatgtgataggcactcgataaatatttgttgtggctcatgggcaccttgcagagttaaggctgcagttgtttgtggaatttataagtggtaatgaatatttatctactattcctcttccaaggcgatcacacaataatcaggctttacactatccagttcttaggtcttccaagttatgacttgtgaggtatgttaattatgataatagaaggcagtttatttggttcagatttattgatgtgtaatttaccacagtaagacttcccctttacaaaagtatgatgagttttgacaaatggatacacatgtgtatctaccactgccatgctccttttcagtctgtcgtcccctccacccrtgaccactggtcaccactgcagtgatttctgtccccttcatttcaccttttccagaatgtcatataaatggaatcatgcagtatgtagttttttgtgtctggcttatttttcttagcattaggcttttgggattcatccaggttgtcgcatgtaacagtagcttattcctttttatggctgagtaagtgtcccagttttatttatatatttatttatgaggaggtgtctcactctgtcacccaggctggagtgcggtagcgcgatctcagctcactgcaacctccgcctcccaggttcaagcaattctcctgcctcctgagtagctgggattacaggcacccaccgccacgcccaactaatttttatatttttagtagagatggggtttcaccatgttggccaggctgatctcaaactcttgacctcaggtgatccgcccacctctggctcccaaagtgctaggattacaggcatgagccactgygcccagccccagttttatttattcaccagttgatggtcttttcgacaactaattgtttccagtttttggctattctgtataaggcttctataaatattcacaaatacctaggatgggatgactgggtcatataatagtactgtataaccttagcagaaactgtcaaactattttccaaagtggctcttccattttacaattccacagtgtattgagtcccagtgtctccatacacatgctagcacttttaatatttaatttagtgggtatgtaatgatatctcattgtggttttaatttgcatttctctgcagctaatgatgagtgtttctgcttatttgggaaggttttaatttagcagtctgttgtattctgtagatattaataacttcaaaatatcagtggcatttgcagttaaaatttccttaaaaaattggccaaaggtttccagcagtcacttctgccatgcccaaactgtatgaaacaaggctgaggtgtggagattgtcacattttggcaaggagtgatccacttgggtgactgatgagacccagagagcgtacgcctcgggcttgagggtgaggacgggcgggaagtcgactgcatggccctgctggccttgggaggctgcccagtccttagctaaagctggcagttatgggaaacagacttagattctattacgtttttcaggatgtcccaggagtcacctgggaagctcagcagtcctttgtgactttcaagcatatggtagaagctgctgaacacagagmtccctctttggggataatttgcccaaatcatttaatcaggcttgagaaatgagttaccacaggtccaggagtgctgccacccttgaattctgacaccctatttctcctatccgtctcttaattaattaagcagacatccccaagtgcttacgacaagccaggacccttttgcatactaaggaaaacagggatgaaggaaacagaaatggtctctgctctgactcagaaggtagaaatcctctttcccagccaagtcttcctagggagcacgtaggaagggctctgaacccacgtgtcagttgcaggggaggatatcaggaaaggacattgaagaagtggagacctaagtttgagacctaggcattagccaggctagcagtgcttgaaaaagtgtcttaggacaagagaactcaccagtgaagtcccagtggtaggagagcgtgcagcatattctgagcctgtatacacatctccagggcattgcttagcaggtggggagtggcaagagagtaggctggagtcacagaagggaggccaggtagaccttggtgagcactggactctatgttcaggtgctgaggagctggcaaaaggttttaagtcggggagaggcatgttcagatatttggtctagctgagtaactttgggtgctctgtgacraatggttgggagaccagtgaggtggcagttgcggtcatctaggagcaggatcagagtggcctattgactgggatgactgtgaagtgggatcctttccagccagtaactggaaatgtgtatgagggcagaagtgagtgtactgcatttgaaacattgagaaatctagtrcatagtactgtctcttttatatcttttttttttttttttttgattttggtttgtttgttcactaacttggaaaactgatgtggaaatgtccctttggcttcagttacctgagcagaaggggccgggcattgccaaactctcctcttaggacagaattgctcccagtattgatcattgtgttctgagwtgggggagcaaattgtgcaggaggccaggtcagtgccaaggtgggtgggaggaattggagsaggaagcttgcctaagtgtgcccagcaaagccacggtagaactttctactgtggctctatgctacttcttagcaaccttctccatgtgcttcctggagagtccttggagtcagaacctttttcttgaaacccagacactttacttccaagaaaatgctgtccaagaaaactcatccttcccttcttctcatgaacgttgtgtagaggtgtgtcttctcttcctttgagcttttccactcagggtttaggggaggtgatattctatatttgggtttggctctgggtactgcaacactaggctattaagatttcatccttactgctttgcccctcctatctttccagaaacccacaatggatttgctagaaataatggaacgtcctgtttggacaggatataaccatttctcagctagaggatattgttggaatgaagaaagataaatggggagaagggaactcacattgctttggcacttaaattaagccatgtactgtgttgggaaattatttatattatctcgttgaatccacagtagaacacagttgaacaccatacaaggtaagtattgtcatccttattttaccatgaggaaattgatgcttagagagcataaagccttggccaggggcacatagttgggaagccggggctaattcatgcctgggctctttctgatagttttccttttttaattgtcccctcctcattgttaccttggggatttcaagagattcatgtagcttctaaatcaacgaastgattcctggagagcagcttctgtatgagaaaaatctagctaattatttatttcagtgtctctggaatgcaagctctgtcctgagccacttagaaaacaatttgggatgacaagcatgtgtctcacaatgctgctctggttgccagtgctgtgctgccagttgtcatctttgaacaaactgatgcagtgctggtttaactcttcctctttttggagtaagaaactttggaggcctgtgtccttctagaagtttgctgagcaaatggtaaggaaaagaaataggtcctaaggcttgactatttcagagaatttcttgatttattggactgtcaatgaatgaattggaatacatagtggtaggctgtcttttcttctcagacactgcaatttcctccaatctcttgacttttctagaagttttaatccaagtccttgttgggtggtagataaaagggtattgttctactagagactgaccttggcatggagatctcatttggactcacagatttctagtctagcgcttggttttgtatccatacctcgctactgcattcttagttccttctgctccttgttcstcatgcccagtgtcccaccctacccttgcccctactcctctagaggccacagtgattcactgagccatttcataagcacagctaggagagttcatggctaccaagtgccagcagggccgaattttcacctgtgtgtcctcccttccatttttcatcttctgccccctccccagctttaactttaatataactacttgggactattccagcattaaataagggtaactgctggatgggtggctgggatacacagaatgtagtatcccttgttcacgagaagaccttcttgccctagcatggcaaacagtcctccaaggaggcacctgtgacacccarcggagtaggggggcggtgtgttcaggtgcaggtggaacaaggccagaagtgtgcatatgtgctgaccrtgggagcttgtttgtcggtttcacagttgatgccctgagcctgccatagcagacttgtttctccatgggatgctgttttctttccagagacacagcgctagggttgtcctcattacctgagagccaggtgtcggtagcattttcttggtgtttactcacactcatctaaggcacgttgtggttttccagattaggaaactgctttattgatggtgctttttttttttttttttgagacagagtctcgctctgtcgccatgctggagtgtagtggcacaatcttggctcactgcacctccgcctgccrggttcagcgattctcctgcctcagcctcccaagtagctgggactacaggtgcctgccaccatgcccagctaatttttgtatttttagtagagacggggtttcaccgtattggctaggatggtctcgatttcttgacctcgtgatccgcctgcctcggcctcccaaagtgctgggattataggcttgagccaccacgcctggccgatggtgctttttatcatttgaaggactcagttgtataacccactgaaaattagtmtgtaaggaagttcagggaatagtataagtcactccaggcttgaggcaaaatttacaaatgctgctgactttgtatgtaaggggaggcattttcttagaraagagaggtaggtctctgggattccagtatgccatttccatcctcagtgtttttggccacctgagagaggtctattttcagaaatgcattcttcattcccagatgataacatctatagaactaaaatgattaggaccataacacgtagctcctagcctgctgtcggaacacctcccgagtccctctttgtgggtgaacccagaggctgggagctggtgactcatgatccattgagaagcagtcatgatgcagagctgtgtgttggaggtctcagctgagagggctggattagcagtcctcattggtgtatggctttgcagcaataactgatggctgtttcccctcctgctttatctttcagttaatgaccagccacggcgtccctgctgtgagctctggccgctgccttccagggctcccgagccacacgctgggsgtgctggctgagggaacatggcttgttggcctcagctgaggttgctgctgtggaagaacctcactttcagaagaagacaaacagtaagcttgggtttttcagcagcggggggttctctcattttttstttgtggttttgagttggggattggaggagggagggagggaaggaagctgtgttggttttcacacagggattgatggaatctggctcttatggacacagractgtgtggtcyggatatggcatgtggcttatcatagagggcagatttgcagccaggtagaaatagtagctttggtttgtgctactgcccaggcatgagttctgatccctaggacctggctccgaatcgcccctgagcaccccactttttccttttgctgcagccctgggagccacctggctctccaaaagcccctaatgggcccctgtatttctggaagctgtgggtgaagtgagttartggccccactcttagagatcaatactgggtatcttggtgtcaatctggattctttccttcaggcctggaggaatataataactgagacttgttttatttctgcagagggttctaagccattcacttcccagatgggccaataatgctttgagtaatctggagatcatctttaatgcgcaggtgaatggaactcttccacagagggatgtgagggctgtagagcagagtgaactccctgaaactcagacgtcagctctttgtctctctatctctgaacacccttccttagagatcccatctctaggatgcatttctctgtagttagtttctaagtctcttgttcctgttctgcctttatttttttttcctggattctaagccagtatccccacttggctgtcttaatgtagcttaacatgtctgtaatcaaaatgatcatctttctgagattcaaagggctataagggactttggagagaatttcattcagttttcctcaaactagaataatgcttgcactgtctgtaaaagaacaaaagtgtcaaagcayccttttgttcactaaatttccttttttattatagtgttacttaaatattaggaagtaaaagtaggtataaacttcttataggctgttattatacaactatatgacccatacatatttacaaattaagtgcagccaaaattgcaaartcaataccattcaaattaataccttaaatgtggtgaggcagctgttgttcaactgaaaccaaattataagttgcatggcagtaaatgctatcatgctgatcattttgagtttggccagtctatattatcatgtgctaatgattgaattctccacccatttttctacttgtatgaccttaatttgatggcacctgttccatcctcatgagtttgctacaattatactggtgccaacrcaatcataaacacaaatataaacttgggctttgaaatcttgtgccagaacttggctttaaagtaagcatttaaaaaatccatatgtgtttattagactttgtttagatgactgttgaaatgaaaacaaagtgtttaaaatcctcttagagaacttaaatataatccctcagcaatatgtatacagatcttcctttgagaaaaactgattgtgttcagcctctcatgttacaaatggggaacctgaattctgaggtctctagtgagagaacagggactrgaatctgtggatcctatctgttttaataataattgtaaagtataatagataatattatattaataaaataaaagcaaacacttagaatgagcttccatgtgtgaggcactaactgattaggcattattaactagatttattccttttaaggccccgcgatgtactgttatttccacatgttgtagctggggaacgtgctactcagagaggttaagtaacttgtctgaggtccacaccactaacaaggagcacaggtagggttcaaatccagataatctgactttggagctggcactctaactcaatgtgcctaatcgcttttcagtggtgtcattattttgcctattctccatctgagaatattgaagtttctgactccttccttgcctttctccctgcctcccgtgkttatccccaggtcttggtgttccagtcctctatgtccgtccttactcttattcctttgctacagtgtgatccagggctcctgccccttcttatcctggtagagggggcccacttgctgggaaattgtctccgccatggtttatccatgttgtgtgtccattagtgagtagtgggaagaatcatatcatgttggcaatgaaaggggggctatggctctggggtagtctagtctgaacctcttattttacggatgagaaagctgaggtacaaagcagggaagggatttcttgaggtcacccagccagcaactgagctgcaaccagaagctgagatccccaggactagggccgagcctcattctgtcccatcacagtgacttttcttccctcctccaaactatttttattttttatttttttgcagctgcttagcagcttgaagttagaagaaagggcagggaaaaggttttccgtgcttagccagggaaggaatcctgcaacaggatgtggggttgggtcattcaaattgggccagactccactggtcttgttgcttcttgcttggtattgcagatgggtttaaaagtgttaggattagagagataggcaggtttagccaaaggcagtttgtagccttgtggcagagttctttttaaagaaggaagtgggatgcaacaccctgacacaaaggggcttaagttgttataccactgcctgctaacctgttttccttaactctcttcctgatttctaaaggaagtatattttgctgaatcagaaagaaaagtgatttatttcargttgctgatgcttagattgttagagttgsaaagatctggcttgcatcttgtacarctgacagaactggggctcaggggggcacaggtgcccagagttggtcagtcaggaaagtagcaccagaaccagtctcctggtggccctacagttgcagacccttttttgctttgctctctgtgtatactaaagcttctatgtctctgaatctcaagttctgactggtagctactttccaatccacctggcttagatttctagattatattgtttagacgtcagaacctcttaagggttttggggccacttgttagctcacatagtgagaaccagccctgcccattaggtaggggaagaagttagcagtccatgatagctgttgcctgcagcrtayggaygttcattgcrcagttcctgtctcctgagatcctggagtgtatacgcttggcctcagagcccagcacagagcctggcccttgggacatgcttagtaagtatttactgaatgagtgggaaatgtcttaaggcccattagtttgcaggtcttgaggaggctcccttgcactaggaagaatagaaagcatacataaagcctgtgtgctgcygccaggaagactagaaacgctatgttcagcctggagctgaatggtataccccagagcaaccctgttgaaaggcagtgcttgccttttcattctgtgtcctggtttgctggtaactcctgggtcccctgcctctcctgtacccccattgtgcagactgaggggggaccatcagccagggttagttttccgctgtttctgttaggcaaagaataaattgaattgagttgtgaaagttgggtgcaaagctcagtttgggtccaaagtaacagttaacttgtgtgggtggcaggtattcagtacaaacagggctggggacaggaaggggaagagaacttcagagctttcacgatcctcatctggttttaggctgatccagaggccaaggtccccatggaacaaactggacaaagtgagggtggccacatggcctcttttcttttgcctttattattaattttctcaaatagatctgactagtcatgtggytgggaaaatagttaattgtgatttttttttttttaaactgagtctcactctattgcccaggctggagtgcagtggtatgatctcagctcgccgcaacctctgcctcccgggatcaagcaattgtcatgcctcagcctcccgggtagctgggattatgggcacacagcaccacgcctggctaatttttgtatttttagtagagacatggttttagcatgttggccaggctggtcttgaactcctgacctcaagtgatccacccacckcagcctyccaatctgctgggattacaggcatgagccactgcacccagccagagtaccactatttgggcattctttaatgaaaaagaatgaactatccaaaaattaaaactcctcatttatgagcttttagagaattttacagagtagatggaaactctctgcatcctttccccacttctastttcacctgacacatttcttccctgtccttactcctgggccggcagcagtggtcatgattccaatcccagcttggccaccatctgcctcagtggcctaggaaaactcctttctccagagctttagttttctcttctacggaatgaagaaagttaaaacaaatagacatttattgtttcatttggataaatatctattaagcatctattacttgtggtatggttagctgggtatatagtggtgaagcagctgggcatgagtactgctttcgtagagcttacagttcagtgaggccagcagatgtgaaacatatcatcacacaaataaaaatataactatcaactgtgatgaggattatgaaggaaaaaatccggcaaactatggtactggtgttagatactagcaggtgtgkgtagggatttcatttagattkacaggtygtcacattaaagctgagagccctgaagttcaagcaatggttagccaggcaaagatcagaggcytagagatagggaaatccattccaggcagagagactgggggtgcctgtcccctaggtcagggaacagaagaaagccagtggcactggtggagtgaataagactggcgggggatgagttggtagtagacatgaccagatcatttagggccaattctcctggggaaggagaatttaatttaatatttatttatttatttatttatttatttatttatttatttatttatttttcaagacggagtctagttctgtcgcccaggctggagtgcagtggagcaawctcggctcactgcaacttttgcctcctggtttcaagcgattctcctgcctcagcctcctagtagctgggattacagacgcccaccaccatgcccagctaatttttgtatttttatagagatgcggtttcaccatattggccaggctggtctgaaactcctgaccttgtgatcctcctacctcggcttcccaaagtgctgggattacaggygtgacccacagtgccccctgagaatttaattttattttatgtgcaagaggattccctgaggtagtcaggccacattgtctggtgactcttgggatagagggaacttgaatgacaaaggcccaagaaagcaattgtaatcattacatatacatggaccattttatgctgttttcttctttcatttaacattatttagtgtgcgtgttcacatatttctaaatcatcttctgatttagaataatgatttctgatgtgtaggctgtgttttatagttttgaaagtaatactttgatatccattactttcttgattctcacagcaattctgaggtgtatgcgttgcaatttctgtttcacagatgaagagagtattgttaataagttaatggccgggcatggtggctcacacctataattccagcactttgggagaccaaggtgggcggatcacttgaggccaggaatttgagaccagcctggtcaatgtggtgacacccatctctactaaaaatacaaaaattagccaggcgtggtagcacttgcctgtaatcccagctatttgggagggtgaggcaggagaatttgcttgaacctggcaggtggaagttgcagtgagccaagattgcaccactgtactcctgcctgggtgacagagcgagactctgtctcaaaaaataaaaagttgctaagaggagggctgggatcttttggctccaaatctactgtgggatgatgcctttgacattcctgatagctgtgcagtaatccattaacacagtttttataagttcaaaccctgttgccaacatttagattgttccatgtgtgctgttacaaataaattactataaagattctatacatttaatcttttattatttttgtattatttctgtaggccaaaatctgaggaacaggattactaggttgaagggaaatggcccttgaagtgtctgatcagatgtctttccagaggatccaaccaatttaaatagccaccatcaatgcatgagactttgtagttcagggaaggcaggcctggttttaaaaatcatttcccctctctagcatttttytgatgtgatccttaagatttcactttagttttcccaggtytcattggcatgtatgctgttagggatgggtytaaaattaatttttyttcacattcatatcatgtcatcccagtgattatttaataaataatcacttgattaaatagtgattccttttytagttatttttgggacatttattaaaacctggatatggtggctcatgcctgtattcccagcactttgggaggctgaggtggggggattgcttgagactaggagttcaacmccagcctgggcagcatagcaagactccatctytataaaaataaggaaattagtcaggcatggtggtacttgcctggagtcccagctacttggaaggctgaggtaggagaattgcttgagtyyaggtggtcaaggctgcagtgagctatgaccatactactgtactccagcctgggcaacagagtgaaactctgtctgaaaaaaaaaaaaaaaaaaaaaaaaaaaaaaaaaaaargatgtgtagggagcaattttggagttattcatttggtcatttgatatgtagttttagttttggbgctgatagagcccaraatktaccctgaatttgatgaacattctgatatatgggggagctcattgtcccccacttacctttttgcctctcaraatatcttttgatatttttatctgttttttccccattgaatgttattaccttatcaagctcaaaaaagtaccctatcgctattttaagttcagttgtgttaaatctataaattagcttgggaaatttggatattaaatgaactcatgaagaagcagagtttagctctccttaattctcatcttcctttatttatcctactacagttctgtggttttcttttatgtaagaagcacatgtttggctaagttaatgcctaggtttttttgtttatgtgtccattctcactgtggatagtattctcttttccccacattatattaatttaactggttttcagagactaatagcaatgctattatttaggagaatttaccttggttctgattaacttacccatacttgcaaatcatttgcagctttttagttaactttgtgagttctcttagatttaygaccatgccagaaacagaaaggatattttcatctcttcctttctgatgtttattcttcttgtttcctttttttatcccccattatattctcaagaatctctcaatactaagaaatagcgacttcatttttcagcgcrgagtgcattattttggctaccatgattcagaagcctcttgcctaaggcccaattttattctgctagttttctctgttctttgtacatggcccttgcgctgccctaaccttgaattaacgtggctaaatctcaagaatttaagagcaccgtgactgtgtcctcaggctagggagggaaatgggttcacagagtgactggattgtggtctatgaacttcggcagccagcagcaaaagtcaggcatgaataatcaagtggacagtgaacatctgtagtgtgggagatgttggcataactatgaatgatgattcaagagtggtttgatgcatattgaataacatgatgataagtactagactctgtgctaagccttctatgtgaaatacatttaattctcataataactctagagcagtggttctcraccggggccggttatccccctaccccaccccaccctcacccttccaccagggacataacatctggagatatttttggttgtcacaatcctgggaatgtatgtgctgatatttagaggttgaggtcagggatgctgctgaacttcgtagaattcataggagagtctctcacaacacctatctggccccaaatgtcagtagggtcactatcaagaaaatctgctctagcagtgcctgctcatattatccccatgttgaaatagcaagatgggaagtgcaaagtggtgcttcggtactcttggagcagctttgactttggtgagaaacgccttttawaaacaatgtttcttcccatcttcccaccccatggggaggtgtggggttgggtgggtaggcaccaaagcaagatttagaagagttttctgtaggaatttataatggtaaaggatcaacttcatttccaagctattyatgagggtttatgtttaggaaaagtgctaagcttagagaaggaggagaaatctgattttattaatgagtgtagccataatggcatatcctggcagaagtcaastttggtttctagagggaggctattatgaaaagaaatacctggaacattcccctgggtttggaaggtgagttctaggttcaatgatgggaagaattttagaggtccaagataaaagggcaaagattaaattttgtctctcatgagttctctggctcaggtggtgtgaactttgcagacagtctytttaattcactcatacatgctagtctcccagctcagcaagggctttgagagagcaggtgtctgtatgctctggtaagtgaaggcaaagtgcataaggaggttggggtccataatggcgaagagaaggagcccttcagtcagagtggctttgaatcttggctctgccatttgccaatcttggaccattgggcagtgtattaactctttgaatctcagcttcctcttctgtaaaatgtgtataacaagagtactaattggattgtttgatgattaaatgagttaatgtgtataaagcactcacaaccctggtacatagtaagacctttcattattattatcatcatcaattttttttaacctcttttcctgatctgcttacactcaccagcttcagctgctccaaatggcttgtaagattttttgtttgccctttgctgtcagttgccatggggaagatccattcatttttttcagtcaaccaacatattttgagcatctgctgccctacaggatcctagatatgggggctgcagagatatccaggaacataagccttgattaattgggtcagatcagtgctcagcagggctggcaagtgctaggtttcttttaagtggcatatcttaaaaggtatatgtcctaaacatagctttgtgatggcagcatgatgggtacaaaagcacacacttaagtgtcagtagatctgggttcaaacattggtgcagtttcttatggctcgtaacttgttcaaacctcagtttcttcacttctaaaacggtaatgatacaacctacctcacagggttattatgaattaaatactggagatgagatacacaaaacgtcttgagtacacagtagctgcccaatattggctgtaagtattataaatctacaagctgtgaattaattttacctctstggatcctgttgatatttctagaccatkccacctagtggggccatttcctacctgagtcacccgtggtgtcaaatagaatgtcatgtggcctcctgagttgggtagaattggctgctcatctcaaccccgctactgactatctctgtgatttacccttcctccagccttagccttgctacatataaaatcaagacaataatrtttcctatctcacagggttgtcctgaggattaaattaagtaattaatataaaatgtgccttgtacatattgggccctaaataaacagtagctactatttrtccttaaagtacaaatggtagtttcagagcttcaaggctgatggctatttatcttactcatactctttgtttagcttcatttttttcccctaatttcattagtattttcttttyttttttttgaggkgaagtctcactctgttgcccaggctggagtgcaatggagcgatcttggctcaccccaacctytgtctcctgggttcaaacagttctcctgcctcagcctcccgagtagctgggattacaggctcccgccaccatgcccagctatttttttgtattttcagtagagatggggtttcacccttttgaccaggctggtcttgaactcctgacctcatgatcaacccacctcagcctcccaaagtgctgggattacaggtgtgagccaccacgccmggcctcataagtattttctaaatttatttacagtcatgccatttaaaaggaaagttgtattcctgtctttgttaatatttataagtgattttattcagctacaagcttggaatggcatataattttgkattctgcttttttcacttaatattacatggctaatgatttctgtgtttcataaacattattctgatgatggcatgatatattgttgagtacatgtaccataattgaatcatttccctattgctatgcaattaagttgtttccaatattttgcaattataatgtttcaatgaatgaataactttatgcatatagctttttgatatcttaagttcagtttcctaggatgaatttccaggaatagtaattgggcaaatgggataaacatgactcttgaatacgtattgttaacattgctttcccaaagggctcaactgatttatatttccgtgttcattatcttttaaaccagctcatttactcaccaaacatttttaaagccattatcatgtggtaggcttagtaagaagaaagtgaccctaagggagaagcttatatataaatagggtccctggtgtaccaagtgctgatacagacacaaagtacctggggaaattgagatgagggagtcctggctcagctgggagaaaagttcattttcatagagtcatggttttgttctttggcagaaagaaaattgctttcttccccacccccacccccagctttattgaggtataattgacaaataaaaattgtatatctttaagatatgcaatgtgatatatatgtatatctcaacttaaaaaataagctacagaataaaaaggtgtttgctattaaaaaaaaagaaaaggctgaatgtcattcccaagcttggaaatttgagtatgttgcctctttgggattatttacagaaatattagcaagaccagccccatctttggtcttgagtactccactgtcagcatgctttcttccagagagggatccatttgcctttatttttcattctgttgtgccgtctatgcaaactattcttgatagttttatggtaacagtgtttttttgttccatgagataatttatacatgctcattgtggaaaatttagaaaagacaggaaagtattaaaaacatcacttttttttttttttttttttttttttttttaagagacagagtcttgctctgtcgcccaggccggagtgcagtggcgtgatctcagctcacagcaacctccgcttcccaggtttaagtgattctcctgcctcagcctcccaagtagctgggagtacaggcatgcaccaccacgcccggctaattttgtatttttagtagagatggggtttcaccatgttggccaggctggtctcaaactcctgacctcaggtgatccgcctgccttggcctcgcaaagttctgggattataggcaggagccactgcgccagccacacctacgttcttatcatcctagtacatccactgtcattatcttgctgtatttccttctgcccagtctcactctgatcatgcagtggcgtgatcatgcagtgatctcggctcactgcaacctaggccttctgggttcgagtgattctcctgccttagcctcctgggttcaagtgattctcttgccttggcctcccaagtagctgggattacaggcatacacccccatgcccatctaatttttgtatttttagtagacacagcgtttcactaaaattttgtatttttagtagagatggggtttcaccatgttggccaggctggtctccaactcctgacctcaggtgatccgcctgccttggcctcacaaagtgattacaggcatgagccactgcatccatcgccaaaaagattttttaaaagagtttaatgtagaaccatatcaaaggtctttggaaataaaaaacagttttttaaaaatatcagaaataaaacaacaaataaataaataaataaaaacacccaaaacaatctgaagcaygagcacctagcagaaaggttcaattatgatctattcatagagtggaatatcaagtagacattacaggacatgttttaagattatattttatgtcatgggaaatgctctcccagtatgatgttaaatgaaaaaacagaatacaaaagtatatatgctgcatagtctcaatattgtagagaaaaaatattatttatgtatgcatgaaaaaagacaaaagatgttaacagagatccattgttacttcagtttactagggattgtctctgggaggtaggattaaggtgatttatatttacctttttaaacttttctgtatttttttattttcaaattttccataaaaatataaggacttgaagatcaagaaaaaatttctgctttggctcagtgcagtggctcacgcctgtaatcccarcastttgggagccctaggggagaggatcacttgaacccaagagtttgacgttccagtgagctatgatctccggatcskaccgcctggacgatggagcaagaccctgtctcaaaaaaaaaaatctttgctttttttttttgtttgtttttgagacggagtctctctctgttgccccagctggagtacagtggcacaatctcagctcaccgcaacctctgcctcctgggttcaagcgattctcttgcctcagcctcccaagtacctgggattccatgcacccaccactatgcccagctacttttttgtattttcagtagagacagggtttcaccatgttggccaggctggtctcgaattcctgacctcagctgatccaccggccttggcctcccaaagtgctgggattacaggcatgagccactgtgcccagcccaatcttttgctttttttaaaaaaagaagacaaaaagggattttataccagtattatcttggctgtgtgactctgaagccacagttgtaagttataattactctgaaacacaaggccctrtgactcttttgggctctttggtgtttatcttgattacaacgttggaatatagaaatgaaaggaatgggagaggtgatagacttcaggcagtgtaactagttgtctgaacactactggctcaattatattgtgtctagtgatttccatcttgtccgtckgctaatttatcgcctggtaactcactgaggcagggttttcctttggagaaacctcattgttttaaccagtgtatcatgcttgtttagaagttcaatgatctttttaactcatcggagaagatgatgaccagacctggacagatggggaaggactttgcactctctctttacagtcctgagtgcacacaggtcaatatggaactatgtgtgaattttcattgtctttgagagccctcttctctgccccatagggagcagctttgtgtgcaattagaggagcaagggttgtgtgtatttagcacagcaggttggcctggtcctctcctctcaacatagtcaccacatacctggcactrtgctaaggctgggaatgcagacagatgggtgcctgctttcagagtgctcaatgtgctgaggaagccagcaacagaaacagatgatttcaggagctccaggaaaatgctacaggaggagtgtgcctgggttactggagtagcacaggaggagggcttctagctcaggctgagattttagtaaaggaaattatgccacgatgaatcctgaagaatgaatagaagtgaaccagataaagcacgataggaagcatcttcccttacctaagggaagacacagaggtatatggaatggtatgttaaaaggttgggactccaaacagttctgttaaagcttagagagtggtgggagagactggagaagttgattaattagtaaatgaagttgtctgtggatttcccagatcccagtggcattggayatccrtatyatttttaaawttacagtgttctatcttatttcccactcagtgtcagctgctgctggaagtggcctggcctctatttatcttcctgatcctgatctctgttcggctgagctacccaccctatgaacaacatgaatgtaagtaactgtggatgttgcctgagactcaccartggcagggaaaatccaggcarttaacgtgggctaaattggacttttccaaagatgctgtctttgggaaacatcacacatgctttggatcagaaaacctaggcttctaatttgttgrtaaggcatgaactcaggagrctgttttcagtcctagtgaatggtgataattgtaattrtaacagtagacaacatctcttttacacattttaaatcatgaaaatagaataaccktactgataattttagaaagtggtgattaaaagcacatttaagataatgccttaacacctagtcttttccatatgcatgatgtcttaatcacacattgcaaatcatggaacacagaattttaagcagcatttgtgtagaacttctcagttttactaatattattttattttattctcataacaaccttgaatagaactcagatcatctgtcaatcatgtattttgataacagcctttacagtgagcatagaaaatacagtagtggctaacaacacargctccagatgtcaggttatctgrgtatgaattctggtgtcagcattcactaagcatatgaccttggacaagtgatttaagtttcttttaaacagagaatagtaatacctacctcatattattattgtcagtgtatcatcttacaatcacagtctttctcttagggcygggctcagtgggtggattgacactgcagaaatggccagatctaaaggatcaacatttacgtagctgggaaatgtagctgggacttcagtttcactgcsctrgtgatttttcctaccactaagcagctcagtccatacccctacgagacccacaagcttatgagatactgttcttccaggaaagcagtggggccagggccaccttttaattgtgtttcttggcctggtcccatctttctcacaatayatagcaacagttatttacttgctgattttctaatgcacatcacacatagtcatattaaacacacacacacacacmcacacacacmcmcacccctcaagaaacattttctgagrcgtgatttcctgatttcatcaaaaaagaaaagagcgggccaggcacagtgggaagtcaaggtgggtggatcacttgaggtcaggagtttgaaaccagcctggccaacacggtggaacctcgtctctactaaaaatacaaaaattagccaggcgtggtggcgcacacctgtaatcccagctactggggaggctgaggcaggagaattgcttcaacctgcgaggctgaggttgcagtgagccgagattgcgccattgcactccagcctgggcaacagagtgagactctgtctcaaaaaaaaaaaaaaaaaaaaaagcataaactgaaatttatatgcaatttatatgcctgtgagataattctgttttctcttttggaaccccaaagagatttttttgattgatgagcaaatacattttagattttatttaagcattatgccaagcaccactgaagtataagtttcaagggcaaactcagttttttcatctactagacgaatgattttctggaatgattacaagcaggcaagatggtgtagtggaaatagcaaatgtcttyggcatcagacaagttggggtttgtttgtatcctgcctctgcccttcaccgaggttgtgatcttgggcagattgttgagttttaacctagattcctctgactccagatcataaattttcagaaaagttctgaaattcttgtatatacwgatgrtaaatgagacttttccttacatctatgcacttctttgtttgtttgttttgagatggtcttgctctgttgcccagactggagtgcagtagtgcaatctccgctcactacaatgtctgcctcccaggttccagtgagcctcctgcctcagcctcccaaatagctgagactacaggcatgtgccaccacrtccggctaatttttgtatttttagtagagacagggtttygccatgttgaccacactggtctcgaactcctggcctcaggtgattcgcccgcctcagcctcccaaagtgctgggattacaggcatgagccaccatgcccggccatatccatgcacttcttgcaaccttaccttcttttctcatcaccctccagggacctagttggaagagcagagttaaaagttaaggtgaaacttggagaggtgtcttgtccctaggaacaaaggactggtttgaaattctctgtaaatcttccccagttcaaaccagagttatcaaggtcttaaaaacttccctgggtcctgagagcccattatattatttacttgtcttcctgtacacccactgcctagtcctgatcctacttttgtttgcaaataggatggggcacaacgtacaaggaagggcctttgccrcccctgctaagggataacctgaaataccttcaccatcactgccctgtgctgcttttcacctatgccagtctgtctacagtgccagtgtctyctggcattgaaaggggagaatcttttggtcctttgagtatttggttgggttacataaatctccctgaatgaagagcagctgacttaggcaaggggccttgtttggttttccttgaactattaacaggaagatagggagattaactgtgtaaatgttcaataggccagagtccctgcagagggtggccacagtgatcagatcttatcacatccttgctttggrtgttgcctctctggttggagtatggatagaaaagaaagaaagaccctatattgaaaygcaaagtgcagcaagtcctgactttggattaacttctcagcccatttgcatgaaaataaaaagatgaataaaacarggttcccactttggagggaggtggtagctgtgagatggaaggagtgttcctgctgggcaayagcagagtaagtgctggggtagattcaytcccacagtgcctggaaaatcctcataggctcatttgttgagtctttgtcctacaccaggcactctgcaaaaacgctttgcctgcaaggtctcatgcgatgctcaccacagctctgtgaagttaattgtacttttatcaccattttacagatgagaaaactgagggtatggggtcaatgacttggctaaagtcactgcttagcaagctgcagggactggatgtgaattccaattggtttgactccaaagcctgtgaagctacttgttcttcaccacctagagctgtggttcttgataactgtgaactcttttggggtcacaaatagccctgagaatatgatagaagcaggagctctggcctttctgtccatacctgaacaggtccttgggttaagagcccctcgtccagggcctattaatcttgatcctcataagcagcatccatgtatwamggccgcaaaccaaactgtgccagaccgaatcctaggaccaagcccaaatatgtcccatcatccttttggtaagaagctcattgtaagaaagaaagaggagagcaagaggatgacctagtgcayggggcctcattgttttaattagtgacaaaacaacaataataacaacaaaacccccgaagcttcacagatgacatcagaccccaagcctgtgtgtttttcaggtgcccttgaggagctttgtagctggcagaggaggtgaaactgacaaatgtttggcagatggaggagagtaccagaggggtttgagatgagctaaattycaatctaaccgcaggtgtgaggaagaggcttggattgggaccatggagatgggggttctactcccagtcacgccagctgactttgcgagtgttctttgtcagtcactttatcttattttatttatttttatttttttgaaatggagtttcrctcttgtcgcccaggctggagtgaaatggcgcgatcttggctcactgcaacctccccctcctgagttcaagcgattctcctgcctcagcctccagagtacctgggattacaggcgcctgccaccaagcccatcgaatttttgtatgcttagtagagacagggtttcgccatgttggccagggtggtcttgaactcctgacctcaggtgatccgcccaccttggcctcccaaagtgctgggattacaggcgcgagccactgtgcccagcccacttcatcttaccrtagttacctccttagagtatgaaaaaataggcttagggcatccccaagtcccctctatgtctgagagctgaggctggctgtcaaagaggaactaaggaygccagggactttctgcttaggacccctctcatcacttctccaaygctggtatcatgaaccccattctacagatgatgtccactagattaagaatggcatgtraggccaagtttccacctgagagtcagttttattcagaagagacaggtctctgggatgtggggaatgggacggacagacttggcatgaagcattgtataaatggagcctcaaaatcgcttcagggaattaatgtttctccctgtgtttttctactcctcgatttsaacaggccattttccaaataaagccatgccctctgcaggaacacttccttgggttcaggggattatctgtaatgccaacaacccctgtttccgttaccygactcctggggaggctcccggagttgttggaaactttaacaaatccatgtaagtatcagatcaggttttctttccaaacttgtcagttaatccttttccttcctttcttgtcctctggagaattttgaatggctggatttaagtgaagttgtttttgtaaatgcttgtgtgatagagtctgcagaatgagggaagggagaattttggagaatttggggtatttggggtatccatcacctcgagtatttatcatttctgtatgttgtgaacatttcaagtcctgtctgctagctattttggaatatactatatgttgttaatgatatcatgcagcagacgtgcatctgaatgggctggctctaggagctagagggtaggggctggcacaaagatgcatgctggaagggtccttgcccataagaagctgacagccaaggctaggggagttctgtcttctctgcatcagrtcacctctctcacctctgtcactgccccntcagactacaatgtctgcaggtctttctcccctgaktgtgagctccctgagcaaagcaggatgctgccccttccctttgtattcctggctcctggcttcagtgcctggacataagtatgggcataataagtgtcccccaaatgagacattgaggattcttcaaatgcacaggaccgtgatgtgagttaggacggagtaaggacgatgggatgtggctcaggacaatcctgaggaagctgcagctgcggcaygcagggccacactgtcatgttcatggaccctagactggctttgtagcctccatgggccccttccatacacaaatattaaaaattatrtttcatgactgcattsgtataaagatgaatataatccagaccagattcatgattattcatacatttttagtgtattaacttttaattctgcttttaaaataaattaaaacattctaatatgcccttaagagtatcccaggcccaggccactgagcctactgtggttcatggataagttggccctgggggcatgtgtgtgcatgcatgtgtgtgcacatgcatgatgagccgggccttgaagggtggtragatttgggtgtgtagaccaatggagaaaggcatttggggcagtgatgatgggtgggggagggaacatggtgatgaatggagctgggtgtggggagccatgggagtgggttagggccagcctgtggaggacctgggagccaggctgagttctatgcacttggcagtcacttctgtaaagcagcagaggcagttggcmtagctaaagcctttcgccttttcttgcaccctttacagtgtggctcgcctgttctcagatgctcggaggcttcttttatacagccagaaagacaccagcatgaaggacatgcgcaaagttctgagaacattacagcagatcaagaaatccagctcaagtaagtaaaaaccttctctgcatccgtttataattggaaattgacctgcaccagggaaagagagtagcccaggtgkctggggcttgttcccattagatcttccccaaggrgtttttctccttggtggctggcctgtggggcccctctccaggaggcattggtgaagaaactaggggagctggttgccacaracagtgatgtactaatcttctctgggaagacagaagaaaagtccccagrgaagaatactacagacttggccttagggacagctaggggtgcagattgctgccaactgcattttttctgaagttggccatatggttgcagtgaatggatttatagacagagtatttctgtgcatataagagcaattacagttgtaagttgatatggataagtgaaagttaagcacttctttctaaaaagagaatgcaattcattttcccctaatcatttcaattagtctgatgggcatttgaacttgttrtctttaaaaagtgaaatctttacctctgatctggtaagtatccaggcaatttcttgtgtgccacccaggaggtatctggggagtgggcatttkctgactgaggcattggctgccatagcatcagagcagccttccaggcagtggcctggcaaggggacagaggctggtgggagcagctggctgagtgcagccagtaatggcatgtgcatggtctgtagagaatgtagaagcaataatgaagccgataaaagctggtctgcattttattattatcatgcgccggtggttctaaacaatgtcagtgataaattactcctccccatcatggaccaatggctgccactgctccagggaagtgctttttattccgtttggtgtttagggagggatggagttggctggcctttgctgaaaggcctaccagtttgttttctatttggcaaaagaagaaatgataaagttctagagtttaaaccagactcagatttgagttttttttttttttttttttttttttttttttttttttttttttttwaaggctacaraactgtgctttcyttgggcagtaaaagaggcaatgggcaatgkgggacctgatgacaaagggaagcaaagctgtcttaggggtggcatggaggaggtgctgcttcacagcagagagaggtatggctgtgcttggagtgtccacttagacaactcctggctgtgcagccaggccatsgagatgctgtttccttgacctgcaggtcctggtcttgcacatggatgtttcttctggtgcaggagacagaaaggtagcaacaacccctgatcaaagcctcagtccttccttatttactggagagcccctgctgattgaccagaggcacagctggggatatttcctttacctctgtagcaagagacagcgtggtgcagaggaaagtgctagcatacattaccctgtggctgcatgactttgtgaataggttagttagcaccctttcagccacttcttcttacctgttaatgagawaaaacatgtaattgcttaaraacagtatttggcacataggaagcacttagtgaatatgaattatgattttttttggagtggtgacatctcaaccaagccatttaacccctcagccttactttcctcaactataaaatagcagctaacttgaaatgtaaactataaaacctaatgtagtatctggcacatagtagattcccaataaatgagagccagtattctttctaagacagtgatgcatttctgagcacctggccttgttcttctgccttgcaatttatgcagcagttgaaatagactggctgatgggggtaagttgtcaagcagactttctgatcttagtggaggagactgccttaaaacaacactaatttcctttttcttttcttttcttttcttttaagacagagcctcgctctgtcaccaggctggagtgcagtggcgcagtcttggctcactgcagcctctgcctcctgggttcaagcgattctcctgcctcagcctcctgagtagctgggactataggcatgstccaccatgcccaactaatttttgtatttttagtagagatgagatttcaccatgttggccaggatggtctcgatctcctaacctcgtgatctgcccgcctaggccttccaaagtgctgggattacaggcatgagccaccatgcctggccttctttgagaagctggagacatgagttaaktggtgaagaagccaaatctgtatctaaaaaccctacagtwgtgtgcagagctctgaggagagaaggtcccttagattttgagtgtattattatgtcagtgcttgttttacatctctctgttcacgcagtatgtccccttttctgccttgcagctgtttcttaaattctttctttctttgcttgtcttgcagcacaaaacaggcttcagtatagggggaaatgcacagaaacactgccttttcctacaggaaatcagtaactttttactgattttgtttttatttacttattttatttgtttaaatttatttttagttttttttttttttagagacagggtctctttctgttacccargctagagtgcagtggtgcccttagagctcactgagctcactgcagcctcgaattcctgggctcaagtgatcctcctgccttagcctcccgaagggctgggatgacaggcatgagccactgcacctggccaactttttgytgattgcgaatagcactcttgtcaatttcggagagaagctgagactggcatatgtcagtatggatccccacttagagacctgtgtttatctgcactgacaccccatcacagcatgatgagcttggccctcctgtgctgtctctcccagggctgggaggatccttgaagctgatctggtttggagctttgtcctcattcacctcctttaccacacacccaccttcccagggcggggatctaccactcactaagtagcccattctgggtgttgacagctctaattgttagaaaatattcaccaccctgttatgctttctagagaacaagtctaattctrttttccttgaaatagtcgaagacagctctcatgtttttctttccctgttttcccaaagtccatgattttttaggcraaatggcctcctttcctcttatggaatgtttttcctccccatttctgcctctcctctggttgtgtttcagtatgtctgtgtgcttcttgaagtttactggaaattatgaaagtattctggcacagaggaggaagggatttttgcctcccttgttctgagtgctacatttccgttaatgcagtctgagattgtattaggcattttggcattcacgtcaccttgttgactcatattccatgtgcactcaaacaaaattgtgattattttaaataggcagaattgcaagttacgtgttctccatttctttgttgtattgttggctttttgaactaaagggaaaaatgtcttttttctgttttacatgtttagattccctatgctatcctatcctcccaaaaccattttagattctgattttgccatgtattatatctgatactcctttctcgtcatctagagatgtgataaacaactctctttggcctcattccagtcatcgataactgtgggacaaagacttgaagcttggatcagtccagtggagactaaccacccctgtagacccttttttcctcaactataaaatagcagctaacttgaaatgtaaactataaaacctaatgtagtatctggcacatagtagattcccaataaatgagagccagtattcttctaagacagtgargcatttctgagcacctggccttgttcttctgccttgcaatttatgcagcagttgaaatagactggctgatgggggtaagttgtcaagcagactttctgatcttagtggaggagactgccttaaaacaccactaatttcctttttcttttcttttctttcttttttttttttaagacagagcctcgctctgtcaccaggctggagtgcagtggcgcaatcttggctcactgcagcctctgcctcctgggttcaagtgattcttgattctgtagacactaccactcaggcctatattgtaatcagtgctgggccactgggctcctgcttctgtgatccagttgggaagtttatcttgttcttcccttcagcttgcatctgctaaattcgctggactatacacaggtgatttgtagatatggggatctctactcaaatactctcatgatttccttggctagagcatcattttatttccacttattggaagagaccttagagaccagttagttcatttatagataaattagttgattctgtcattcaacccttatatattgagcgtctcctatatgcgaatcactgttctaagtgccgagacacagaggtgtccaaaacaaatatggcccctctccatatggaatttctattctagagaagaatctgacccagaagggggaagtgactgtcccaagtctacacaaccacagaagggatattctgggaataaatcacggctaaahccccctgctgctccaggcagttctccttctacagtgctctattgtgctgttttaataatctttcaactgggaagaactcccatttcaggaattaagcygtggacaaatcttttaattatccttgaaatcatcctaataagaaatccaaggaggaagtcttacagggtgcctcacccacttttctcatcactggaactttttagacattttattattttcttcctaaaccagagtacaggcacacaagttgagtggtgtggtggctaaattaattaatgtttgcaaggcagtgtgagaagcattcattcatcttaaatacctatggtgactgcaactcagatgtaaaaattggataaatcctcagaaaccctagggaaagtgacatgtctgtattttgtctctgtgagatacagactggcagagataagtgtttctctgggtgagttttgtgtggtatctgggatgattttaggcagtacgtggatgagaacttttaattttaacccacatccaattgcaatttcatggaaattattgcttaggaggatgttcaacaggaaaaatataattaaagttaattcaaaagaaacattttctgtgaatatggtaaaacttgtgagagtagtttgtaaatgattgaagattggaaaacattggtataagagtgagtgtggggttttgtattaagattcattttgggaagaaatccatgctgcatccctcatgaagtgtgaactttgggcatgtgttgattctttctggcccagagtttacctgaagattagctgccctgagggtcactgagcattaaattagatgatgtctgtggatgactgatagtgaagctcatagcccacagttgacacataataaattcgagttgctttgcttccccttctgttcctggctgactgtttggcctttgccacttgttcggcctctctgggccttaagtttctttgccttgaaattggaactttctttggtgaaacaaccagaaaatgcttcagcccagaaacttggtcagtacttggatgggggatcacctgggactacccaaggatgtgggctgtctgctagactatagccccttgagggcaaggtgggcgccttgctcatggttccatcmtaagccccagcacagtagtgggtgcatggtgagccattagtgaatctttgtggaatgaaggtgggagaaaataaaatacctgtacttcacagggtattgtgagggtcaagtaaaagtgctttaaaaaattgtattatatagtttattcccttgtgttagcccaggtcaacagagcctacgaataataatgatgacagaagttcttcaaaaagtcttggccttctttctttcacaaaattgccycccagagctttctggaagggcagccatgaacccagaggcctaaagtagatttactgggaagctaaaaatatttactttatttttcatagctcctttcaaggtcctctctgggggtcttagcaatatgtttacacagtggtatgtttttgtaaggtttgcaaaagtaagattttttaaaaatactatcttgttttaaaaagagagccccctaccaacttgtgtcagcctcaggcccccacctgcatctgctcctgccagggcatggtggggcaagaagcactgctccccttccaaagcttccttccttgccctggagtcatcctcactccccactccaagccacctgccatcgctgtgccccctctctggtgaatctggcattcttaggtgggctgagaagcagactggcccaagctaaggcctttctgatggggttgttgctgctgagaatcatgactgggtgggagaaggaggtgaccctttgctgtcttatttttactgtgtatttccttttcagctacttaaaatgtattgcttagtgatacctaatgggttcattagcctgcttcctactgaacatttccgctcaggcatccacttggtcccaaggcctgctcctctcccatattctgaaatctggactacagactctcattcaactccaggttgcactgtggacacagtcccctcttgagcaggtacctccttgcagtggttgggacgtcctacttggctcatagttgggaagtgcatatgctggagctgaagcctcttgccttcccgggatagggcgtcctcacatcccctctgagaagttccccagcttccctctgttccccgtttccacacttagcgaggctcttgtccactgctacatcccccatagccagtccctcagccttgccaytgcttatgctggtctggaaacaattcctagacttgtggggcatctggggaagttctccatctttttttagctggcatgacccaagtggtgtgggcagggctgtggattctatggtgtggctggaagccaggtagcctctctctactgtacatggaactcagcaacttctgagtcaagcaagatcttagctctgcaggtgtcttgccctgtccaaagttatggccacaccagtaccttttaactctagaagcccagtaagtgttttgtgggaccgcaaagatcattttctagacctgctgaatatgcctagaacgggtagggatggctttcacgctgttcctagggctgacaagtcacacgtttctgggggtacatacacaccgcggtccctgtgaatggcactctccatgagaactgtgatgatttgagttgaatagtgcacagsctacatggttctctgccatggcctggagttccttatcttgccttctccagtgaggactagggctgcaactggcctactttggctcctgacttgggggattctgaaataccttttttttttaaggttgtggagctctctgaagcttataaggattttgccaggaaaagataagaaatatctttgggcattttgtcactgkgctggagatgaaccctttggaggacatatcaccttgttgaggtcaaggggcggaaagggacaggactggcagagagatccggggcagcagcctgccatcccgactgagtatggagtttctctctcccttcagctgcacttttgtgtggagtcagtggctcagctgccacttcccttatgttcatggcatgaatctggcttgttaggcctttcttttttttttttttttttgagatggagtctcactctgttgcccaggatggagtgcatggagtgtagtggtgtgatctcggctcactgcgaccaccgcctcctggattcaagcgattctcctgcctcagcctcctgagaagctgggattacaggcgcatgccacaacaccctgctaattttttaatttttatttatttattttttttcaaggcagaagaatttttcttagtacagaacaaaatggaatctcctatgtctacttctttctacacagacacagcaacaatctgatttctctatcttttccccacatttcccccttttctattcgacaaaactgccattgtcatcatggcccattctcaatgagctgctgggtacacctcccagatggggcggcggccgggtagaggggctcctcacttcccagaaggggcggccgggcagaggcgccccccacctcccggacggggcggctggccgggcgggggctgccccccacctccctcccggacggggtggctggccgggcgggggctggcccccacctccctcccggacggggyggctggccgggcgggggctgscccccacctccctcccggacggggcggctggctgccctgctaatttttgtattttcagtagagatggggttttaccatgttggtcaggctggtctcgaactcctgacctgttgatccacctgcctcagcctcccaaagtgttgagattacaggcatgagccactgcgcccggctctgtttttttgtttgtttgtttgtttttgtttttgttttgagacggagtcttactctgttgcccaggctggagtgagtggagcggcacgatcttggttcactgcaacctctgcctcccgggttcaaacaattcttcctgcctcagcctcccgaatagctgggattacaggcacttaccaccakgcctggctaatttttgtattttttagtagagacggggttttgccatgttggccatttgaactcctgaccatctttgaactcctgaccatgtttgccatgttgaactcttgacttcaggtgcgttggcctcccaaagtgctgggattacaggtgtgagccaccatgcccagcctgtttggcctttctgatatggctctgactaatctttttggaaattagtccccagggttatactggattttacttagggaaaagggtcatgcctctctggctgtcagatttactgatagtactaaggactcagtggggtggacctttgattctggtttgatttttgaaaatcaaaaagacgtgagctccagggagcagggtggctttggtgacatggcaagatagttggctgtggcagggagttgagggaagtgggtagaaaattaacatcttgtaaatattccctgggaaatataccttcgtgttaagagaacagacttggcagccagatggcctaggttcaaatcttggcttgatgcttatcagctgtgtaaccttggataattccatacatctctgtgcctcagtttcctcaaatggaataacaatagtacctccctcaggactattgtggcaaattaatggacgaataaggggaagcacttagtacagtgcctggcccagcataggtaccaggcttgttcttaagctcactgcatttttacaatcatcataaaatgcaggggatacacacatgaaggagccgaagttcagagaggccaagtaacttgcctaagaaagcacagctggcaaggggcagtaataggaccagaattccagtttctcrtgctctgttgttgttatatcctaaagagagcagctctgagtagccagaagcttccctaaagtcacaggacatggggcatgggctggctgggatgagaaaggagacaagagggcttctgaaagaaatgccagattcactccacttcctggcttcaggcaccgatggaatgtttcccaaggcccatctagaaagaacatcctgtgactcacagccacttctcattttctgtctgaaccccctcacccattcaggcagctgctaaagttgaggttacagcctcagactatattttctgtccttgtggaaccccagtgtgtcatcttgttgggagatctggtgatacatgtgtcaacattatgtcatcaaaatggaaattctttgaaatctttaggtgattgcaattcacgttctgtatgtatgcacttgtcaaaagttttgatttgaggccttagaattttatatttggaaacctttccactaccatgagttttcccagacctgtcaaagccaggctgcatctcagaaaccaggtctttgatttccatccagggcaagggcctgggcccagctgggctgtaagcaggtgggggtggggagcaacgctgcactgcaatgttgaaatattacttgaactaaatcaaatcaaagatcagctttactcagacaagaatagaaaacacaattgcattcgattacagaatagtgtgtatccccacaaatatcagactgcctttaaaaagttttgaattgttaacatcaagaacagtgttgcgtgtctcctgcttttccagcataaggtttatttattctgtgggtggcaaagagcaatttgggagtccagtttgtttctcattgaaagctttcccatttctggtcctcttgtcactgttgcattgaggcaccaaaaggcaatctcartgcgacactattcaacagactaagttgcaccggataatgataccattttacatttttcatatattattacattgaaggcttcaaacagcactagcaggggcaaattggtattattatctccatttcattgatgaggaaaccgaggctcgaaagggtaatgtctgttgtccaagattaaagagtaaagttgtacgttgaatcggggtctgactcctaggcttagcattttctccccacactatgctgccatgttgcttattccaacattaggaagcataggtgccatccccagcttttgaggccaatatcaygatgaagcatttttaaaacatctcattaaattgctgatatagtggaaagaaccaaagctttgcagtcaaagctgtttgggttcaaatttaccacttgtttgttctatgaccctgagcaagatattctccagatctgtttcctcatttgaaaaatgggaataataatacgtttctttataggctgttcttaaagattctggaaaataatgctaatagtgtgcctaatgcttggtaaatatgagtcacttttctgtgcccacaaagcactactatgtcccttaataaattttgttaattttaaaagttagaaaaaaattaaactatttatacattgtgtatgttaattcttccctagaccagccttaggaagaatctcatccccaacttgtaaactcatctttttccgttctttttgtgcctggacttctcagggccctgcaggctgattctagtcccatgttgtgtggtgtttgaagtgtctggtcccttttttcagtgagagaccagctcatccttgggaactgaatgcctcaaactctcttttctttttctctcttccccttctgtttgatgtagtctttcctgtttctggactctgtttcttcatacttcctatctcttaccttcttttcactccttttgtcttccagctgtcctctctcatttttctgcctctctggtcttcaggtagagttttcatctcagctatcttcttgctttttctgatgttggttctttgtttcttcttctcattctgttcaggtccaaaattcatttgggtcaatgttatgtcttagtgttatcttccatttccttctgagcttcaaagccaggctgactgtgcccttccacgccctggccaktgtgaccaggacatcctttccctctggggctgcactggctctttgggggaaktgttaccattcagggtcttcaaccctcattctagggacttccagtaacttctcccaccttccctcttctcagtaagacatgggtattgtcttattctgtttstgctgctagaagaaaattctcgagactgagtaatttatacacaatagaaatttacttctcacagttctggaggctgggaaatccaaaatcaaggtgttggcaggtttggtgtctggtgagggctgctctctgcttctaagatggtgccttgttgctgcatccttaggaggggacaaacgccatttcctcaactggcagaagggactgaagcctctccctcaagcccttttataggggtcctcattgtcaggcctctaagcccaagccaagccatcgcatcccctgtgacttgcacatatacgcccagatggcctgaagtaactgaagaatcacaaaagaagtgaaaaggccctgcctcgccttaactgatgacrttccaccattgtgatttgttcctgccccaccttaactgagtgattaaccctgtgaatttccttctcctggctcagaagctcccccactgagcaccttgtgaccccctgcccctgcccaccagagaacaaccccctttgactgtaattttccattaccttcccaaatcctataaaacggccccacccctatctcccttygctgactctcttttcggactcagcccacctgcagccaggtgaaaaaaacagctttattgctcacacaaagcctgtttggtggtctcttcacacagacgcacatgaaactcatggtatctgtgaggggccctaatgctattggtgagggcactgctcacataacttaatcaccccttaaaggccctgcctcttaatactgtcacattggtgatgaagtttcaatgtatgaactttgaggggggacacgttcaaatcatagcaggtgtgctattgccttactagcaaagtaatctgggggaagatgagtaatgtctcgttccacccctgattccagtgctgactgattctggagtggcagagagggttggaggctcaccgctctgctcacccsaccctctggccatctyctcttagaatgcaagggcagggattttgttacacagcgcctcttttgttataggctagctcctgccttcaaggagcactgagaaaaatattatccctttgaaccacaacactagtattttgggtactgtagccattcagaagtttgttgaactaatacaagtttatattatttgtaaaatactagaaggaatgtgtggttcctaaagttatggtattcccattggttgaaagagaagactctggcttcctaatgccttggaaggttcagggagcataagcctaaatatcctggtttctcttgggaattcttcacagcttgtcatctatgactttatccacatttattttgaacatgtttaattttcagcttgtattttctcaaggagtatgtgtgagtcagcattcagagtacttaacacacttagtgtcattagtgataacttaacccacacgtataggaagctagacctccatttacagaaaaayggaggctcagagagcctaactgactttcccaaggccacataactggaaaattctggaactgagttttttcaggtatgtcttggtatccctcggtgagccttctctgtagagaaggaagtgtctcctgggttggaaagcccaggccgggatgaacagcatgggtgtccttaggctgtgtgtaccacacacccctggcctactctcccctgctctaaggagtcacctgaaggagcagctgcatcaccccgcctcaccccttctcctcagcacccaacaaccaggtcttcccagagagtgctcagctattggtgaagcaggcatcgtctattcttcaagaagacagcagagcatcaggaaaacaaaacaccaaaaaaataccataaagacactggagtgtatttgttaccagcccttgtataacagagaagtatttcaaggtcttatttgtaaggctggacaagctcaggctgattaaaaccacgagttagaatttgtctcccgctcccaggccctgctcagttgacagctcctagcaggctgggaggccccaccccacccccaccccaggggtccattgaagaagaccatctgggcctgggatgctgatgtgattttccctacttctccttttttttcatttgcctcctccacccacttctaaagcagctgattgctctggttccttttcatgttgagcaaaagagaagacagatcttgaaacctgagctggggactggagggcactgaccgagagtaaccccgtctggctcagctcagctcagcaaagggctttcctcctccgccttcctgagctgctctccctcctctcctttcctccttctttcccagcctcccccaagctccttcacccctctcttccctctcctccctcctcccaccttccttgtcctctatgctcagagaactgaaggaacactgaatggcctggaaagcaggacctcgcccccaccccgcgtcatacccctccgcctgcacgtgcaaatgtgttcctcagcttggtcycagaggcctrgacctgggtcccagaggtcccagctggttccccggcttggtcycagaggcctggatgtgtggcaagaagctgagggttctgcttcgtttcttccagcccacaaacacacatgtcacctgttttttgttctttttcctttcctttgccccactttacagaagctcttggctaattggtaggtcactgtttgctcctccaggcaaaaccaaggaggctgagctcagcaggtcaagtattttggtctgtattgaagagactgtggtgggagagccctcttgaccttctgctggatagtgactttctcttctgctggcagcagtagcccagctccgcatcctgtgacagaggtcataccttccagttacccgagcgaacacttggagcaagtcagctttttcccctgaaacagcacgttcacgttcttgatctttggtttgcacaacaacctgtgaatgttattagccccgttttttttgtttgtttgttttttgagacagagtgtcrctcttgttgcccaggctggattgcaatggcgtgatctcggctcactgcaacctctgcctccaagcaattctcctgcctcagcttcctgagtagctgggattacaggcatgcgccaccacacccggctaattttgtatttttagtagagacggggtttcttcatgttggtcaggctggtctcgaactyccgacctcagttgatccacccgtcttggcctcccaaagtgctgtattagccccattttatatccaaggaaactgaggcttagggagatttaaataggggggaaagtatagcttcatgattacacagtcaggaaatggcagagctgactcttgaattcagaccctgtgatgctgtatccagtgctgattttgttttgccctgtgttcctttcagtgtcaggtaagaagacctcagagatcatcttctccaacccacacattttactgattataaaatccaggtccgcattaactcattggccaaagttaagtggctaaatgactctcctgttcaggaagtattccctgtcttgtgtggaatgattggtctttcgtccaggtcatcttccacctatatccatccttgcagtgactggtggatatgatcattcctggtgattccctgtaaaatactagatttatttattctttcataaagttatgagtagacaaatcagtcagcttcaacctttcctttaccttatagatagtatcagcagaaagaactcaataattctgtcttaggaactcagccaggctaatatgtattataatacacacatacatatgcacacacatacacacatgtgcataccttagatcacaaattcaacatctcaacttagccgccaaagccacttctgtgtcttgtctattctgaatatgctttaaggttaaattagccatgaatctgttcagatcagtcattcctgaaaatgatgatgatattagccatcctttaccgggcaccttactcagtgcccggcattatactaggtctgcaggtacatttgctcatttaacacctagctcagtccaatgaggtggatgccattgtcatctccattttatcatttaatcaactcagccttcctctctcctgttccccactctgcttctagctgccactcacctgactctcctcttgatctgggctgacgtggctgagtgggtttagcagaactcttgtgtcctctttacttggtttgtttcaagttcatgtcctgcttcatcttttccctaactcactgcaaggtgaattttcttctctgcaatcgrcaattccccaaatcacatcaggtcattaatttattcactcatttgtattcattcattcattagttcatccatccatctattcattcattcatccaatttactgagtgcctcctctgtgccaggcactgctggctttggaattaaaaaccctggccctcaaggaatttctattcttctgggagcaggatatttacatgggtgactgcagcttgatctgtgtggtactagtggraaacataggatgttgggcacaaaagagtcacaaaacgccgggcgcrgtggctcatgcctctaatcctagcactttgggaggccaaggcgagtggatcacctgaggtcaggagttcaagaccagcctggccaacatgatgaaaccccaactctactaaaaatmcaaaaaggaataatagctgggcgtgatggcgggtgcctgtaatcccaacaactcgggaggctgaggcaggagaattgcttgaacctggggctttggaggttgcaatgagccaagagcgggccacttcactccagcctgggtgaaagggtgaaactctgtattaaaaaaaaaaaaagtcacaaaaaagggctggccacctaacccagcttgaggatgggaaggccagggcaggcttcctggaggaggtgactcatgggccatgtcatgaggatggggtaagaggagaaggtatgtttcagacatctggctttcttaatattcttggctttccacccattttcctgccagcaacataggggagaagactgagaccagcagatacaaagccactgtactctgtcctcaccccctccttttttctccccttcctactacccagatctgaggttttgagaaatctcttctctaattatctgcttgttcattcatttgttgagaatctactatgtgcatagcattatgaccacaaaatgtcctggtcgttgtcatcatgagaggtcttaccccttcctctccagccacttctagggatttttgactctgtccttttccagaacttggctccagtctggttgctcgccatgaagcacttacagataaacctcatcttgggccagtgcttccatttactgtctccttttggcttgcttatccttccttctgccttcttgaattgatttgcctctttatctcycctttcagccttgaaagttcctcgaaggcagggactgtgtccccatcttttctataaatggcaktgttgtacattggtaaagttgagtgaaaaaatctttttgataatcacaaattattaccatatattgagcacctaccatgatgagtatctctgatcttcatatctttgaaatgtggatactattaccttcacttaattggtaagaaaatttgtgctcagggaggtraagtcactttctcacagkcacacagctatttcacaggagagtgcagtatcaaatttaggkttttctggkcccaaaccctgatgtttcccccacatcattgkttctcagacttggctgcaatcacctgaaaaattttattaaattctttttttttttttttttgagacagagtctcgctctgtcacccaggctggagtgcaatggtgccatctctgctcagtgcaaccactgcctcccacgttcaagtgatcctcctgcttcagcctcccaagtagctgggattacaggcacccaccaccacactcagctaattttgatatgtttagtagagactgggtttcaccaggctgatctcaaactcctgacctcaagtgatctgcccacctcacccagccaggttttattaaattctgatgcctgggtcttaccctagcagttctcattagttgctccatggtgtggcctgggctttgggatttttgtgaagcccccagctgagtctaacgggcagtcatgtttgagaaccagtatactacaccatgttgccttcctgttttcacacaggttggtgctagtgtgtgagtctaagcctacatgggtggatatccacgtgatcaggctgcaagttctttgtagtggaggatctttggccctccctgctgcttcccaacccagcgaacctaccacaccatgcacgtgyacagccaagggttgttgactgtttaatcagtctctgggttcttatgtctcatccgggggattcactgataggaggctggagcttgatcacatccagatgttctcatcttcagagcctgttaacataacagaagtcttataaacatgctgagcacactcactggtctggagagtgttgcargatgacctaggcccattgcaggggtggcctgggtcgccctcccacacttctgccaccctgcttgggaaggagggagctgttttgaagttccctggtgcaatatgatgtattgctctggctctgctcaggaggaagctatggcccacctagtcagtgagggttagctaatacgtgtattctgtttctgttgaggtttcacagaggccttttttgacccttcattttatagataaggcagtggaggcacaactacatgaaatgactcgacaaataaatggatttagaacccaggtttctgactcccagggtggtgctttttccatggttgtacagtgattaatgtctaccttttcacaccagtcctcaactgaagacaccagcttacaccttccttcctgtttctcccaagaacagaaagtgaccccggatgtcgctttctgttcctgggaaggcagttccagtggttagaagtcctgttcactcctggggtgtggcctggggatggtcctgacatccctgggctcttcctggacctgrccagctaaaaggaaatctcctatgatggtactcagatacttttggaaccttgtcagccctaatcccatctcctagtgtttagtattcagctacccttcactgggcagtaattctgtgccaggcctgatctgggcattggtggtactaagaacrcatattccctatcctataggcatagtctggtagagacaacatgcaagtaaaacaatgttccttaaactgtggttccacacctccctcccccaacattaaaagtgyaagggatgcttattcaaatgtagatttgtaggctctgcactctagacccactatttcagaatctctggggactgggcccaagaaactgcattttmgcatgctccctaaatgaagcttaggtgctctgaggtttgacaactgcagtagagagcctaatgctaacagtgtagagtcayatgtgatgggaagcatcaggtaggtagcagtttgcaggagcactgattctgagggacactaactgggcctaagaacagctactggctgtcatgaggaataactaggagctagccatagaggggtagcagtgaatcatttctctagcgatgtaaatcttgctcaatttattctgtcyatataactcaatattactgaagtttgcctaaagcagaatacacctggatcatacagcatttatgagagactggctgggctgtcaggccctcctgttactttatctctgcatgtgaccctcttagctccrcggattaactcctgtcctcattaagcctcacactgtagccccattttcagatcaaacctgtttctcttctggtaaatgatttcagtttgcaaagtttgccctctagaggttgcttagtgcctggccatgtgggctcagttcatgtggtcctgatgagctggttttatctttattacaaagaagttaggctgttaggagagtgggttggaaggagaagaggtagacagccaaatgagatgagtcagggaaaactatactgtttcggagtcatagggctcctaccaagcatctggtcagaaacctctcattttggagatcaagaaattgaggttcagaaagatgacatgaggtacgcagggacgccaccagacacagcctccaactctagaaactaaaattctggattcttagtgctgctttttctgttttgttgcactggattgaagccttttctaactgtactcagagggcctattatttagggagattcygtatgaaatcctttagcaatcaaatcatttaatagggctgatggtttaaatatatgttaatgtgttttcctaaagcctggcagacctgggttttggagctttgtatcacatgttttatgtttggaatgaaaatgagaccatgtctgtgaaggcactttgatatgcrtaatgcactctgccagtgtttgtcaaaacatggtccccaggtcagcagcatcagcatcacctgtaagtgattctccagtcgcatcccagggccgctgtatcagaaactctgggggtgggggtgggggtgggggtgggggtgggggtgggggtgggggtgggggccggcccggcccggcccggcccggcccggcccggcccggcccggcccggcccggcccggcccggcccrgcagtctgcattttaacaagctctccaggtgattctgatgcatacttaagtttgagaaccattgcttgttttgcattaaacaggagattagtctctgcagcttgtgggaataaagctttaaatctctccaattttagctctgtgaaaaggcagtggggagacaggaatgaacggactagtgccacaaagctcaggtggggtgggtgagatcatttagaagagaaagaccgggcatggtggctcacgcctgtactgtcagcactttgggaggccaaggcaggttggatcacaaggtcaggagtttgagaccagcctgcctatcatggtgaaaccctgtctgtactaaagataaaaaaaaaaaaatttgccagtcatggtgatgcatacctgtaatcccagctactcgggaggctgaggcaggagaatctcttgaacccgggaggcgggggttgcagtgagctgagattccaccattgcactccaacctaggtgacagggtgagactccgtctcaaaataaaaaaaaraaaagraaaggaaaggctgtgtgtgtgtgtatgtgtgtgtgtgtgtgtgtgtgtgtgtgtaacagcaccatcacactgtttgagttgaggagcacatgctgagtgtggctcaacatgttaccagaaagcaatattttcatgcctctccygatatggcgatgctcccctatctcattcctgtgtgtgtttagccaggcaactgttgatcatcaatattatgataacgtttctccactgtcccattgtgcccactttttttttttttttgagttacttactaaataaaaataaaacactatttctcaatagacttgaagcttcaagatttcctggtggacaatgaaaccttctctgggttcctrtatcacaacctctctctcccaaagtctactgtggacaagatgctgagggctgatgtcattctccacaaggtaagctgatgcctccagcttcctcagtagggctgatggcaattacgttgtgcagctactggaaagaaatgaataaacccttgtccttgtaatggtggtgaaggggagggaggtagtttgaatacaacttcacttaattttacttccctattsaggcaggaattgccaaaccatccaggagtggaatatgcaacctggcgtcatgggccmgctggttaaaataaaattgatttctggcttatcacttggcatttgtgatgatttcctcctacaagggatacattttaagttgagttaaacttaaaawatattcacagttctgaggcaataaccrtggttaagggttattgatctggaggagctctgtctaaaaaattgaggacaggagamtttagacaagggtgtatttggagacttttaagaattttataaaataagggctggacgcagtggcactgagttgagaactgttgcttgctttgcattaaataggagatcagtccctgcagcttgtgggaataaggctttaaatctctccaattttagctctgtgagatggcactggggaaacagaaatgaacggactagtgtcacaaagctcaggtgggatggacgagatcacttcaaaggtctrtaatcccacgtctataatcccagcactttgggaggccaaggcgggaaaatswcttgaggtcaggagttcgagaccakccwkgccaamrtggcaaagcctgtctctactaaaaatatgaaaattagctcagcgtggtggcatgctcctgtagtcccagctactcgtgaggctgagacaggagaatcgtttgaacctgggaggcggaggttgcagtgarccaatatcrcgccaytgcactccagcctggctgacagagtgagactccatctcaaaaaaaaaaaaaaaaaaagaattttataaaatcaggaaataatattagtgtttatgttgaattttaactttagaatcatagaaaacttcctctggcatcattattagacagctcttgtgcagtgggtagcaccagacccagcttgcatggttattgatttttcagagacactttttgagcttattctctggcagaaaggggaactgcttcctcccctatctcrtgtctgcatactagcttgtctttacaagaagcagaagtagtggaaatgtttattcttgaaaataagctttttgcttcacatgatctagaatttttaaaattagaaaaatgtgcttactgcgtgcccttctgaaactaggaaaatatgccttgtgtttaccaattgtgtggttaggagatgggccaaaggcatcaggcttttgaaagtagttgcatttagcataatttccattgccccctgccaatttcatatctgtcacatctaatcagtttaaaataaggggcatcctaagcatggagatggtccttggatggtccttggagtttctgtattktcagtattctttttyttgagcatacaagacatttattgaaaaattcttgggatcaatacttgtgtaaggaaaggaaagggaacaaagcatgattgggcagaggcagaagatgacatcaacaaaggccctccgttgtcagtattctttttttttttttttttttgagttggagtctcgctctgtcacccaggctggagtgcagtggcgtgatctcagctcactacaacctctgcctcccaggttcaagtgattctctgcttcagcctcctgagtagctgggattacaggcatgcaccaccacacctggctaattgttgtatttttagtagagacggggtttcaccatgttggttggccagactggtcttgaactcctgacctcaggtgatccgtctgcctyggcctcccaaagtgttggaattacagacatgacccactgcacccggcctgttgtcagtattcttaaacatagacactaactgtaggctgacagcctagcagcaaggaccagttaaagaaaygagtagaactgaagtgtgcttgagtatctctggcagtcagcaaaaacttaatgggratcatggtaggccaaatgttctgcagtatttcaaaagctgcatgggttttgagaggcttttggtccatcactcaccttaggttgttctacaagcacatcagcctgccccaatttaaacagggcagttagtaatggtgtaataaagagtctgcattgttcattccttcaacaaatactggctataatgtttcagcactgtggatgcaaagtgagcaggataaacaggctcttctttcaaagcttgtggtycactggaccacgtatgaagtagaatagtttaggyccagaaaggcaattaagtaaaatatgaccaagaagaggctctctagtgggtttggtataaagaaaagataagaatgatttagaattggcctatcaatgagataagaggcctggctttctggcactctgctctagggcaagtaaaatggagaattccaaattctgaaattgttagaacatarttctgtgtcttagttaaatatctacacttacagataaatagcataaatgctttctccccatatttcagcccagtcctacttaaagacaacataaattgcaaaatagtgaggatgttgttcatctaataaaagtggttccaggaattcagactctggattcctgtttgccaaatcatgtgtcccactcttaagaaaacgagttggactctggatttttctttgcaagagggacaagagtgtgggagatactgagttaatgcaacttgcaggttttaagtgtcctgtcattgtgccttgtgctttgatacattctgagkttcagtaaagagacctgatgcattggactgttgcaatggaacctgttttaagatcttcaaagctgtattgatatgaagttctccaaaagacttcaaggacccagcttccaatcttcataatcctcttgtgcttgtctctctttgcatgaaatgcttccaggtatttttgcaaggctaccagttacatttgacaagtctgtgcaatggatcaaaatcagaagagatgattcaacttggtgaccaagaagtttctgagctttgtggcctrccaanggagaaactggctgcagcagagcgagtacttygttccaacatggacatcctgaagccaatcctggtgagyagacttgctcactggagaaacttcaagcactaatgctttcggaatgtgaggcttttccttggacagcatgactttgttttgtagaaaagtacggctggctgggagtttgtgatataatttagttcagtggtattctaagtgttcttagtgttctttcagacttttgggccatctcccaaagggtgaatgggaagaataagctgggtgtggctgagtttaagccaaaagttttttgtgcttgtttcaatcagagaagacctgctttttcatgtttttactattataatactaagcaagagctcatttgaaaacagagttcttcatatttaaaaaaaaaaagtcttgaaaccattgatgggaagatggatatctatttatgtttaaaaacccatcataaagatgacattgtrggctgtcacagttggaaggccctggaattagatgagaccacactatttagcttayttagtaataacattgcaaagaaaaattccgacraagttttttcagcctaggaatcaatagttcagagaagcactctatgagaatacccattcattcttaaccaaaaaatactggtgagcctgagcagtttggtcatcagagtgttttatatagttccagaacaaatatgtctctaggtgttctgagagctctggtgaaattcctctcsctaccccaaacatcatcatttaatatccaggattctggttttctactcaccagatagattctcttaaaaccagggaaagattcctggaggaaggatgtatctggaaagagatgttccttattayaataaaaygaaattgtaatactcttggattttgtgcagcacgaattctttatagagagttggtcctcccagagaattaagaatactcagtttctggaccctgttcccagatcataccctagaatgtgaccttagaaacacacttcaggattcatacctttgattgaccatcaaaaagtttttgtatcrgccwggtgtggtggctcacgcctgtaatcccaccactttcggatgccacggcgggcagatcacgtgaggtcagcagtttgagaccagcctggccaacatggtgaaaccctgtctctacaaaaatacamaaaatagccrggcgtgatggtgggcacctgtaattccagctactcgggaggctgaggcaggagratcgcttgagcctaggaggtggaggctgcagtgagctgagatctgtctcactctgttgcccaggctggagtgcagwggcgcgatctcgactcactgsaacctccgcctcycaggcttaagtgattctcatgcctyagcctccgagtacctgggactacaggcacctgccaccacgcccagctattttttgtatttttagtagacatagggtttcactatgttgcccagctggtctcgaactcctgagctcaagtgatctgcccacctcgkcctcccaaagtgttgggattaaaggcatgagtcaccgtgcctggtcccatgttataattttaaagtaaggtatatttctctacrgggatctttgcaaccctaagtaactggcctaaaaagttagagaagctgacttgtgcagacatttgcagcctrttggtcttttttgtgctgtgaatcatagagggtgaaaggttattatgaatggtacaaaactttgttacaaaaccattttcttggactgttttgggctgcttcactgcatgacaaatgctcaccctttcagytggaatgattgaaattttggaaaagatgggtgtttttagaagacattgtaatttgttccggtgctgtgcccattcattccatttcacttctgtttactcattaaacacctattgtgtacacaacccggtaaaatccctccactcacacaatgcctgaattatactcatagtagaatgactgtttagccctcatcatctgataattaacagctcaggtttcaacctgacagtatctctctgggaggattagcagcgtgacagagtgcagggaaatgcaccttcagaaccgtcagctacactgtgtcccatcctgctgtgttgtggttgtgccttgtggatgcgttggtttatgaccaggtattgattaaggtggctactaccrggtgctttctgcatatctcgggtttgtggagcactcaggttctgcttctgcccctctgctgttaccaagagacctctcttcaaaatggggctcttgagttagagtagaatgagtgatcaggattgttttgtgtaaagatgatttctgaggaaggctttaggatgaaatgacttccaaacattttgaaatgtgactcttacttattgaattaagcagggccttaattggaatgctgggactgatacttgatttgcattaagcagcctttttctattgctgcttggttgaaatttcaacatttgtgatggtagatggatgtgacatgtgatgacattgcacatgggcagttaactgtgccaagaagtgcagcagtagcagcaaccggagatgcaaagcccaacatgatggggagagaaactcttctttcaatatgtgcttctgtaccaaaagtggaatttcacgagagacatattttgaaacatttctccttttgtgtgtgcgtgagtgtttccctgtttccagccaagggtattgtgagtttctcctgggcctccttcagaatctgggtgctctggaaagcagtgttttggcaacatggggaaagtatggcagtgtgggagggtcagctgggtctgggtttgaatattgcatttgaatattttaccagcattgatgtcggataaattatttagtccctgtaagcctcagttttctcttcttctacatacacataatatatttgactctttgttgtgattattggttacacatatgaagagcctggtgtggggcctggcacacaataggtgctcaataaatagaagttgataatttaattgacatgagtagtagaaattatgtccttgaaaacaattgcgtcaagatagaagttttcagccaggcacagtggctcacatctgttgtaatcccagcatattgtgggggccgaggcggatgaatcacttgaggccaggagttcaagaccagcctggccaacgtggtgaaatcccctctctactaaaaatacacatatttgccaggcaggcgtggtggcgcacacctgtaatcccagctactgaagaggctgaggcacaagaatcgcttgaacccaggaggtggargttgcagtgagytgagatcactccactgcattccagccagcgtgacagagtgagactctgtctcagaaaaagaaaaaaaagatagaagttttcttctgtagatcagtgttagaactcataccaagcraagtggtcctggtgagtatttcagtgaaaaactgcattcttgctcagatattgtcaagacttttcacccaaagattcttatttatgtctcagtccrtaccttgtgtgaaaattaatactggatgtcagaacgctgttgtgtttttaaagttccctggggttaagagcagtttccattaggtgttctctgctttttacttaaaaatcttactcatgcattgagcaatatttattcagttcttattatgtgtcaggtattttctaggagctggactcaactcaaaagatatccttttgatgagaacaaaggtgggtggatatatgaaatattatctgtgggataaatgcacttagtcatgagggagacttgttatggagtgcgctcattgtatttgtactgttgagttaacaacttctaggaggagctcagggccacctggcaggggcttcttttgtcttgctgctcagcaaggtgtattttgctgtagagtgtgctgggcaggtgaacttttcttaactttctcttgggtccttcctaaagcagcatgtacctttcccagagcgaggagagggccaccttcctgtctcacagaaacctccaatctgttttggactgcaggaaggagccatagtagtggaccagcaaattttggcccgagagattgatttgcttccgattgtactttttttttttattgctactataacaagtcaccaaatacttagcagtttataaccacatacatttattatttcataaggccagaagccaggatacagtagagctcacctaggtctacttcttagaggctcacagggctgatatcaaggtgtttgtggggctgtgtttttttgggggggctctgaagatgaatctgctttggagctcatccaggatatcagatgaattcagtcccgtgcagttgtaggactgaagtccatttccttgctggctgtcagcaggggctggtttttgctcctaaaggttgccatcattccttcttatgcttttcatgtgactcctctcccacaagtgggttgagtatctctcacactttaaacctctgacgcctcctgtcacatctgtctccagtcagagaaagttctttacttttaagggctcaggtgtttagtttgggcccattcacataatccaggataatctccttattttgaggttcataactttaattacatctacacagtgcatttgctatgaaatgtgcatattcacagactccaggaatagggtgtggacatctttgcaggggatattcagtctgctgtagctttcttgattggaaggaatagtttatcatatatttgaagtgttccctcagtgcctttggyttttgttgacccctctgcagctctctgctttttcttgcccatatttggaaagtgactctaaagcataataagcatcacctattagggtttttaatgtacaaaccaaacagaggtgactttgggaggagaacatctctgaactaggtatgagacattcatcgaaaaaaatccatcaagtgtttattgtatgtctgctttataccagcactgttctaggcactgaagttcgacyaccaacaaggcarttgtgatgcacttggagctttcattctgatgggcattgagatccaggctgaaggctgagtctgggaatttgaggaattctttgtaggtcctgggtctacagagtgagagctgtcctcgttccagtttcactgatgacctctcgaccagctccctcacagcagtctttgccaacacagacactgtgggctgtagtgggaggaatgtggggttgaatgagctaggtttgggctctgtccttgactcaccattgcctcagtgatgtgaaaatggtgtctgatccttaaggttggaagtccaggcatgcagatttatctccatctcaataacgtggggaaaaaaaagaagtggtttttgtggaaccagtggttccactgtccacgtgtcttccagtgtgcctagcacattcccaccaagtggatcttggttcatgagggaaagaagggaaagtgagggtgccccgaggctcccagaagacaagtaatgtcacagctgagctgtgtacagatcgaagaagcagatggataaggagtgaacaaagtcatccttgtcttgaggggtctttatttagcttcttcttgactcttagacaaggacccagaatacagatggggcttgttgttaccttcagcctcatggctttttagggctagatacttcagcttgttacatgcagtccttaaagcgtctgtgtgggtttttgcaggagagaacacttgctcgtgttctcctgtctggaacccggacattgttggaaagtatcagattttgtttggctttgtgtgatttgactgcccacctgtttacttgctttctcccagcaagcagccgcaatccccatgggttggtaatgggtggaatgacacactgtgtagatttactcttcagactctatgttcacctcattcttatgggaaaagaagagcactagctggtagatatagcagtgtgttaatatgactgctcaactccatttacacagacattttcaccttagttatactatttcttcattaaatattgttgccagatctaagatacaggtttaattttttcctctgaattatgtggtagtagatgtatttaactatgtttagaaacagcaaaaaatgaagcgtttgaatgcgttaaacacatctaatttgaaagttaatatttaggttgttgatttattttttaaaagattagaatattccttagaaatgtagtcttataatttcgtatttcaataaaaaatattaaaatgtttcccagaggaaatctttactgtcatagaaatcaccagaaagagatagcaattactcctgggtggtgatagtctttgatttgtggtttacttgttttcagtttgaactaaaacatactaatcccagcctgagttggattttgcatatggtcaaagtgaagtagagatttttgtctactttatgaagatatttaaaggacatttgaaatgtttcaatgaacacattgtaacatgcattcccaggaggaaaacaaaattgtgtattgtgttgaaaatactattccaatatatgtatacccacgtctcattttgtcatagaattcctgaaaaatttagatgtagatgagatttttataagttgaaaatattttcagttgcattttaattgcacagatgtgttttctacttctatttggctgtgactcctaatgcattgtaatattatcttccagtgttcatttcgtgtagtgataatggattaacaaatgcattcattcatttagtaaacatttactgagccctaatcagtgccatgctctggcccagggaggtagtcatgtgcaaggtccagccctctctgtttcattcctggttggggaatgggtgggacagaccaggaaaggagcagctgccgtatagagcaggagacgctctgctgggtgtgatacagtccctgatggggcctcctactgcagtctttccagtcaggaargaaacatcctctaagtggggacctaaagaatggatgtcagccaggtaaagaacagggagtagaatgttccaggtagaggacatagtatatgcattggtccagagaggagagggaagagaaggtggcatttaggggaactgtacctgattgagatagttcagcatggagcagatatagctgtggggagtttgatgggagaaggaacgatgagacgtgatgcctgcagaggtgggcaaaggtcggctgaggcaggtctttcttcacgagccatgtgaggatatagggccttatcctcagagtaaagggagccattaaaggctccacaggctgagtgacttgatgaggtgaatacgaaacagagcatttctgtgaatgtgaatggcctttggagcagaactaagttcatgaggatggaaagaatataatgaagccatctcttagacccagaaagaatggggcacaacagcctttatctttctggggccaatgtcacagaatgccatgcttttaggaaacatggtatgttgtgattaacacattttgcagaagtgggtgggagcttttgaataataacagtaagcatttgtgcattcttcctgtaatgacattacagttatgatctgaaaatattgagtcatacatgaattcctgttatcttaactcagaaaatatagtccctcactaaaggttttattttccttctttttcccatttcctttacttcgtataagaaagtcacttgtctcctgggtgcaatggagacctatgtgagttcatagccaagagaatgtttttggttagaaaaataatagtaggaattccaagctgtgaaytttttactgaagctctttggaaataggatttggcaagttttgtctgccttcgtcaagtaagcatgagcaggagagcacagttaatagcaggtgcagacacatgattctcagaccgtattttgtgttctagtttcaaggcatgaattctttcctggggttaattttattcaaggaagttatctgtctgttagatctgatatgtgctcaggccaacatagattctttacccttcctttcttcctgctcacctgtccttcctcttttatcttttcattgaattaaaaagaaaattatgaaatagtttcaacatgaaaaaaggtacagagaataacataaagaacactcctggctgggtgtggtggctcacgcctgcaatcccagcactttgggagtctgaggcagccagatcactggaggtcaggagttggagaccagcttggccaacatggtgaaacactgcctctactgaaaatacaagaattagccaggcatggtggcgtgcacttgtaatcccagctacgtgagagactgaggcaggagaattgcttgaacccaggagggggaggttgcagtgagctgagatcacaccactgcactctagcctgggtgacagagtgagactccgtcttcaaacaaacaaacaaacaaaaagaacactcctgtaccatcatccatcattttgccgtgctgactccaggttctatttaagaaataaaacattacaggtacagctgatgccacctctgtttccctagctcattcttcagagataactcttgtcttgcagttggatgttttaatcctctatatcatgtatacttacattctatgtataacaatatttggtactggcctaaatgtgttcacattgtataagtgtgcatattggcctgccacttcatttggaattatgttcttgagatttatcaatgttgatacatgtggaatctggttaatttttgccatagtattctatttttatactaaacttttaaaaatccatgcttctagtctttggcttattttttcaggttatggtatgttttggatgcacagaaaagtaaaattaagtcatgagcaaaatatctggataatccaagctttaaacttgatgtagaatttgaatcatgtgtgttttgttaaccctgtgatgtcaatccatgcctgattgtgtaactccaaccaatattcctttgaaaatggaaatttgtttatattgwctrcagattgccaatattattagtaaatgctgagcacttaatctcgaataaagaactagtttaaaaatgattctaacaatggcattgactgttctaccttattactcatgggtgggttcagccaatgtttctgttggagaccaaaaccaaaaacagtcaaattaaacaagcagtcaaacccaacatacagactactgataagaaggtcatatcataagatatggcattgaatttgtgtctgctaatgtaaaaatctgatgcccacagcaaacttaataaggacctatgtttacatccatgctcaattacattcctgggttaaacagtcatgctttaggccctgctgtgtgcctggagttttgctgaagtgtggggcttttaagagaaggagaataagcttgctccagagttaagaaatttaaactaaaagtcctaaagatgttggaaaaactattgcccttgaagatgtaaattcattaagttggagaagaccttttatacaaacaacagacccattcactgatttgtacccttcaggagacagatgaccggtaatggtgacaatgggtgaatgttgggtttggggtttttagaaacatctgcacttggtgactactgtatctaattggtgtgacaaacctggcaccccatgtgtttggcaccatcttgggtcctactcagggccaggtgaaccgagtggcctcttcactgcttcagagtctgaagcagattgtagtatgcggaccagacacagaatataccaccaagcacgttggcgcaaagcatactgggaagggaggctttgtgaacatggtgctggttctcaaacctcagtgctcaaaagagtctcctgaggattcctggatcacactcttaaacttctcattcagtaggtgttagctggttgagaatctgcatttttttttttttttctgagaccgagtctcactctgatgcccaggctggagtgtattggcgccatcttggctcactgcaacctctgcctcccaggttcaagcaattttcctgcctcagcctctctagtagctgggattacaagcacatgccaccatgcctggctaatttttgtacttttagtagagagggggtttcgccgtgttggccaggctcgtcttgaactcctgacctcaggtgatccacccactttggcttcccaaagtgttgagattacaggtgtgagccaccatgcccagcctgaatctgcatatttaacaagcaccacaggtgattctgatacagtagctccccaaacctcacagtgttagtgaatcccagtcatttacaattctgccatgattttggtcatattcaagtgcagctggtagcatttttagttaatatattttttaaattaagtcacttcttttggataattaaatttaattacaagggaagctataccactgctgtaaaaacatcacctgctttaaagagaaggtacataatgaatatacattaagataaagatgtatatgtgtgtgtgtgtgcacatataagtatacacatacctaccatagggattgagttttccttcaggtttttcaactgaaatgtcaactttgaggccagttaatatgtgtaagatatatgtgtgtatgtatgtctatacatatagacatatacgtaaaaacatacatggatgcatatagtatatctatacacaacctattatgcatatcatgtatatttcatccacttagtattatcttttattttgccgtttggcaaatgctcagtaaaagaaaagggttagaaggggagaaaggcattttatcccaagccttcaggaatcaggatgaggatgtcttcaccttgtggtggggagtaattatacaattagagacagcacattggagtgtggctgatatgctgtgtgatgatagctctagctctctgcctagcagaggaaggacatttcaatagaagaaaaagtttaagaccttgccgagaaacagagaaaggatgtttgtctttttaagaagttgaaaaccctgtttgcagacaaaagccctccagttttggcagtaaactttcatgcaagggaagaaaaaggcaggggatgacattgttgacaattgtgaggaattaccatgtgccaggcactgtgcgaggggctttgtacatatcctctagttttagtgcttataaaaactctgtgatatgtgcacagcattttaaactttgctgcatagtcgagaaaatggaaggatggggaatttgagtcatttgcccagggttctatagctaccccaggttcccatgactggagaattggggcacagggtggcgggggagagtgagtgacaagaatcctaacaatcttatttccattsagtccttataaaagaagtggattaactaccacgtttttaagtttttcttaaatttaggttatgtggatctggcgtttcttgttttgtcctgggtttgttttgtttttgctatgctgtcttgaacatctgtcatcttgtaggcctaacggtaaacacaaaaacactttacctcctatagctttcaattaagatctctcagtttgtgtttgtaatagttttccaggcaagttctccctaggttcggcttctagtgtgttaacctttagttataaagtgaacccaaagagagaaagtagaaacaaaacacctcacctgtttttgctcatgaattactctctatggaaggaacaatcatgaacacctctgcgtatcacagaggcctatctgagtctgacgtttaagggagaccgygtaggtccctttgaggactgtgaatgtgggagtcctgggactctggtgaagaacccgttccagaagagatgaatgagctggacaagttctttcatagaacctttaggcaggttttcttagaaatgcacattgaggattatgcttggatattgtgatgatcagaatgatactcaatcccttctgcatttggaattctctttgaaagaaaacatcccaggcagctatttctcagagatagtgagtcccagccacttctagacattttcttgtgtagtctacattataatttcacagcagtctctgatatgacaaatgtcaaaatagcccaaccttctctaaacttcagagatgtctgatatgatattgaataaaacaatgctcatagaaacatcaagaaaggtggattttccctggatacttttttcctgcttgacaaataacagtgaagaaactgatctcacgtctttttctctttggaagcctgaacactcagaacccaacttgaggctcctcagctatagcaattctgacttcacagtctgtaaattattgttctwttttttctttagcttatgctttctgccctaatttatcttttccctgttctaatgaattattgtcctatatctgctgtgcagttaggtgacatataacagcaattaaatatatgaattggtacatataaagatttgactaaaactcgatgtaaaaataagtgttctacattcaatttccagtgttagaaacagtgctgacttgaacagagtgacagaattccatctttccctatttttgacagctttaaactttatattttcttcctttcttgtgagccgtcattaacttgtttctcaaagccattcccgtattacccatcttgcagacgcagacagatttgggaatttgcggtcagagttgtattggacacatccccccagcccacatgagatccttttaatctattgcatattaactagttttaagtacaatattcctacttcatttaaaaccattaatcaaagaatgagtttgaaaatgaacaaaatgcaaacttacagttagaaataattgtagtgtctttagttttggttaggagtcggtttcttgtttgttaaactcaagattgtgaacagttttaattcacttgtttatttccaatagagatttcaggtttacatttgaattcagaaacaaagttttctttctcattacagagaacactaaactctacatctcccttcccgagcaaggagctgrctgaagccacaaaaacattgctgcatagtcttgggactctggcccaggaggtaagttgtgtctttccagtaccaggaagcggatcatccactgtatcagtattttcattcctgagtctggcaagaggtccttttgagttgaatatcacatgggatgtaatatcaattttcaaagtataagtgatgtaaacaataatgttttgatttccttattttagaaatgaagaaacctaaaactcatagatgtctcagagctaattggttagtggctaacagctggatatctagtttagaaccttctccattttttctttttgcccctaggtaatcatacatttgtaaagaggagaattatctctgccactgcccatgcactgcttttgtctgaccagcaatttctccatattgcttcttcagtagcaaggccaatcattttascaacacacatgcttgctaactaacaggaataacgtggtacccctaattcagccctttcccttgaaagcatctggcttctgaggttcaactatgggaatatggtctcttaatgaacattaagttgagtttgccttttaggtccacatgttgacaaatgtrtcagagtaatctctgtcctaggatcagagggcctgtaggcacttgcaaaagcagttagctctgactcccagccagtgcacactccacctttctgactcccagccttgtctcaaattaggcttggaagcgaggaactgtctggtgtcccccwgcataggaagctgagccagggggcagtgctcacaaacaatacagactttaacgtgtaggatattggaaaataataatttgtggggaaattgtctcagacttggtccacccttatttttagctgcttctctaatccgtttttctttttttggtgcttgtatctaacctacccattttttggtgcttgcatcattttttcaaatatcaaaaacgaactttatgttttctaacaatgaaagtattgcatgttcattgtggaaaatgctgaagacttggaaaatacaaaaatgctgagatcaaacactattgatacgttagtgtatttcttcctgtcctgttctacttwctttctttgaattctgctcacgtgtttctgactgatgaggtctgacttttgggttccttttccagaggagaagccttctttcagcttgccatttgttaccctggttatgaaggctggtaaccttttttactaggtagagaagctggaccaactggggttcttccagggggagaatgagaaagagaaactgttttgcaagtccgtagctatttctctagggccctgttagctgacattgacatgccttgcattgctctgcagatcccctcrcagccctctgtcccttgttcatttctggccttagagaaagcaaagcagggtctgtaacaggggaggctgcctctaaactcagggtttggttacagctgttttcacttacatcactggccctggttttttttttttttctggcattaaaaaaaaaaattggaagcaggtgatgttcccattgctgatgtggtggaaactctccaagtgaacaatatacgtttttcttggcagctgtttcttgtgccctgcttgctcctggtccaggacaagcaaggaccatctgcctctttcaatagaacacctccagatccctttgatcaaaagttactcattgtctgacttgctatttctgtgagataaatgggagaagatcaataaatgcacttgtttgtccagtcagcgtgtggaaagttgataattttgaccaaagcacaacccttgaaaggaaaagaaaaagggagtgaatgtcttctgagaagctgcctaggttcagacagtgtcacccatttccctgtatgctccacatgacaaacctgagtgggtctcatcatgtccattttgcagatggcaccaaggctcagaaaggttaggcaacttttccagtcacccaatgagttaattgacaaaactgggattcaaacccagaactgttggattccaaagcctgtgttgttgcctgcttcgtgaaaaactccagtagcgactggaatagaaaggagaaccttccaagaaagaaaatacgcactagcagaacctggaaattgggaggaaatgaggacttgaggaataagatgaatgaaagctgacctgagtttcacatctgggtgatgggaagggaggacagggaggcagcatctcagatgtccacccagcaccgaccagctgcctggcattgctaggtgttgaggactcagcagtgaacacgctaacttctctgctttcttggggcacgtatagggtgagagacagaaacaaacaggtcagtgtacaatgccacaggagggatatatgcagtgaagaaaaagcagggtaaggggcatagagcatgagaaggtgctttttttaaaggggktgattaggaaagctctctctaaggtgacagttggacctgaaggagatgatagcatgtctgtggtgagggaaggaaactccgaacaggaagaatggcagatacaaagacattgatgctagagcatgcctaaggaatgtgtttaaggaccagggaaagtgagcaagtggtggggggaggagaggagctcagagcaggaggaggtgagtgccatacaggcctggcaagactttggattcctgctgggtgagatgagaatccagcggagggcttgagggaggggacatgatgtgatctagagtttagactgtttacactctggttgttgggttgagaagagactgggatgggggaaagggaggacaaaggacattgtgctggattgagaaagcagtaagtcagtttcattcattcactcarccgatgatgttcaaataccaccatcatccgtgggctaaaggatgaagagccatccctccctgagagtcaggaagcacttcccagataaagtttggagtgtgagctgaggtgtaggagaaagagtaagagtttacccctgaaacgggtgctgggaagagtcaatagtttggaataactcaataatttatggtgcttctttagaaagatttgctggctttatgtgggaagaaatttktttttttgattggggagtggtgggttggtggtgaggctgcctgtggaaagagaagtgagtgttttgactcactgttatttaaaaatctctagggctgttccaataagcaacaaaaggcaaaatggcctggttctctgtcmcctttctgtctgtatgcctcgtacaggttatgaaaagaaaaagttgggaaaagctgtccacctcacctaattgtrttcttgtggagtgtgctagatgccccctctctggagaaaaaaaatccttgtggcctctgacccacctctggagagcctagttcccttctggaggcagaaggcaaagcttaggwcctagagartgctggaccacgccactcacaggaaccagcaggctgtgaggttgaaagctaggcatatggagctttccaggctgggtgcagggcctcgtggcccttcccctcccctctgtgctctatagctcagtcttcccaggcggtgtgaacacgcagtgacatttccaggaatacagggatttattaatgatttmttgtgaaatgtttggaaatacaaagtactctataaatatttcataatagcattggggctgagaactccacaaagtgccggaatacatttgcaygtaagacagaacgctgcctgggtcattgatgcctgttgagtggcagtcacagacactgcctrgggtttctgactcacgctgttgggactgttctatgcagggcaccctcttgtgtggcataggatttgtgcctcaccacasactgttgtagctttgctgtcttgatgatgagtagagggcagtgtccaggccatggtataagcatctactgccccccagggttaccaaaaccaagccaagttgtgtctcagcgagctccgtgaagcatggagaagttgagtactcagagacatgacgtgacttttcaaaggctgtaagctgacgagggacatagctagggttcagacttgagtttttctttttctttttctttttcttttttttttaagactgagtcttgcttttgtcgcccaggctggattgcagtggtgcttggctcactgcaacctctgcctcccgggttcaagcaattctcctgcctcagcctccccagtagctgggattacaggcacctgccaccatgcctggccaacatttttgtatttttttagtagagatggggtttcaccatgttggccaggctggtcttgaactcctgacctcaggtgatccacccgcctcgacctcccaaagtactgggattacaggtrtgagccactgcaccsggcccagactcgagtttttcatcttaatgctttttcattgcctgacactttactgagaccaagatagggaacttcacatacagtaccttttctcccaaggcggaagagggctgttcaatttctacactagagttcggggagttttagaaatgagycagttrtcgaggatgagagcagttcctgataggctcaaccacaatgagatgtagctgttcagagaaagcattcttttatctataaactggaagataatcccggtgaaacraagcccagccccaggggcttcactaactccaggctgtgcttctcaaactttagtgagcataggaatcacctgggcatcttgtgaagctgtagatttgaattctgcaggtcggcagaggggtctcagaatcygcatttccaacaatgtctccagtaatgctgatgctgctcgtccctggaccacagattgggtagccaggttctggcaagctcatcccaaggctttgagatgacatcagacaaaatatgttctgggacatggcttttgagaggtcaagaaaataagatgtttctttctcttctcatccccaacccttgcactgcccttttctcccttcccctaccctcctttctgtccccatccctgacgccagctgttcagcatgagaagctggagtgacatgcgacaggaggtgatgtttctgaccaatgtgaacagctccagctcctccacccaaatctaccaggctgtgtctcgtattgtctgcgggcatccygagggagggggrctgaagatcaagtctctcaactggtatgaggacaacaactacaaagccctctttggaggcaatggcactgaggaagatgctgaaaccttctatgacaactctacaagtgagtgtccatgcagaccccagccctgtccccaaccccatccctcccttagttctggccttggcctgtgtcatctcctccctctgtagcagcgttagatgtctacatgcccatttgcccaccagactgagctcttcctagaggagagaggcttctcttgaatagctacctgtccccagttctctgaatgcagcctggcacatctcaggtgcacagtagtgtttatcaatggaatgaatgattgacagccaaccttctggttttctgggggatgtggaagggtggcttccagggtgatcaagaatgagataatggcagaaggacaaatcctgcaagatctcacttatatatggaatatatgtaaggtagaaagtgtcagtttcacatgatgaataagttcctgggatcttgatgtacatcgtgatgactatagttagtaacactgtatagtatacttgaaatttgctaagagagtagatccgaagtgttcacactacacaaaaaaggcaactatgaggtgatggatttattaacagcttgattgtggkgatccttttacaaagtatacatatattaaaacatcacattgtataccttaaatatatacaatttttgtcagttgtaactcaaaaaagctagaaaagcatttttaaaaaggatgatgtactggtcttaatattaccattgagataagctttataataacataaaaagaaataacagtaatgataatagcaacaacaacaacaacaaaraactaacatttaagtagaatttcttgtgcactgtgcattctgtttaagttatctcattttaccctcatgataaccctgcagggaagattctttaaccycacatttcataggctcagagaggttaagtgccttggttagagccacatcagagttaatccacaagagccaggattcargcccaaatctgcctggatctgtgctctctaagataactgttagtggtggcgtgtgtgttctcacactcagacatttgatctgcyctttgtttcccattcttagctgcaaggcrgtgttaaagaaccctgtgtctccatatccactccccacacttaagcacttttgtgggcccgtgtgccgtatgcctcgtggcagcagggatccaatgtcacagttttaggcagtggcatccttttccttgaaaacttgatgcaggggaacctttctccatttccaaccacaggtgtgtctttcagacactgagtgaggcaggttttgtactttattgtaacacaagaaccttttctyctctggagtaaagcactccagacattcgcaagttgctttacaagccttaaaaggatggtattgtaggcaactttaattaaatcccatctcctcctctcccccagcttgcaagttgacccaaggaagccttcatttccatgacagacttaattgtgagggcatcctcattaaaaaaaaaaaaattctattatctttccagcatatagaagatacttggtatctaaaaatccctgaaaaacttagaatgaatttttaaaaatcagggatcctgctggataaccaaacccatttgtctgttacaacttttgtatttgggtttttgttaagtgtacatatactagtttgtgttaattaaagagaatttttttttttttttttgagagggagtctcgctycgttgcccaggctggagtgcagtggcgccatctcggctcactgcaagctccgcctcccgggttcacgccattctcctgcctcagcctcctgagtagctggaactgcaggtgcccgccaccatgcccagctaatttttttttttttttgtattttgagtagagacggggtttcactgtgttagccaggatggtctcgatctcctgacctcgtgatccgcctgtctcggcctcccaaagtgctgggattacaggcgtgaaccactgcgccctgttgagaatttttttttttttttttgggagacrgagtttcgctcttgttgcccgggctagagtgcagtgacacaatctcggctcactgcaacctctgcctcctgggttcaagcgattctcctgcctcagcctcatgcgtcaccacgcccagctaattttgtatttttagtagagacagggtttctccatgttggtcaggctggtctcsaactcccaacctcaggtggttcgcccgccttggcctcccaaagtgctgggattgcaggcatgagccactgcgcccagccccaaattttggtttttgcttgaaaactgaggtctgaattcagccttctggttgcccctcaagagtcagtttaartgttggtcatgttagttgtcagtgaaaacaatggtgaggctggcatgagagtgtgaayctggatgggagggcttgtgcttcaygaaaacatttttccagatcagctcagtcgtgagttatccgtcattgacgttataataagctctgattatttatcaagcatcattctttatagatatctcagtttaatctgagataatcttctccacatctctccacatagatgttatgaattttacttttacagaggagccaactgaggctcagataagttacttattatatgactagtagtggtagagctggggtttcarctaagaactctctggctccaaagcccttgtaagtttctatcagtatatgaccatgcatatgagcatttgtctctcctcttcttcatagctccttactgcaatgatttgatgaagaatttggagtctagtcctctttcccgcattatctggaaagctctgaagccgctgctcgttgggaagatcctgtatacacctgacactccagccacaaggcaggtcatggctgaggtaagctgcccccagcccaagactccctccccagaatctccccagaactgggggcaaaaaactcaaggtagcttcagaggtgtgcgctaagtatactcacggctcttctggaattcccagagtgaaaacctcaagtctgwtgcagaccagagctgggccagctccccagtcgtgggtatagaatcatagttacaagcaggcatttcttggggatggggaggactggcrcagggctgctgtgatggggtatcttttcagggaggagccaaagcgctcattgtctgtgcttctcctcctttttctgcggtccctggctcccyacctgactccaggygaacaagaccttccaggaactggctgtgttccatgatctggaaggchtgtgggaggaactcagccccaagatctggaccttcatggagaacagccaagaaatggaccttgtccgggtgagtgtccctcccattattaccatgtgcctgcttgatactggagaggtgagtttctggtcactttcccaggtgtgagtgaggtgagaattctttcagtttatctagctgggggaatgtagtgagcatagctaaagtcacagggcaccacctctccagaagtacaggccatggtgcagagataacgctgtgcatatcagcatccatgccactcacggtcaaatagcagttttctgcaaaactyagtgagggctggtgtttggaagtggagttgagtaattgcagtaccctattttcctttttggctgcagcctctcagccagccacagcatctccctgtgtcttggtaggttttggaaagaagtgtgggagcaaamgcatgatgttacatgtagactggcctgagatactcattctcagggcactgtgtgaatgatgagctgctgttactgtgtggaggggaaatgcacttagtgcttcagagccacttgaaagggataagtgctctagagacaattggrttcaaatgtggagcaggctgagcaagaacagaatgtctcctttgcctgagcctgagtgctgttaatcacatcttcctgccttgggctgagttagagaatcattagactatttcctgtttccatggtgagggaggcctcttccttttgtctctgctccccttaagaagcaggtgaggattttgccaggtttcttgttttgaaccttattgactttaagggcggctgggttttagagactgtacctacctagggggaacacttccgaagtttaggactattccctgatccgctgggaggcaggttactgaggaagtccctttaaaaacaaaggagtttatactgagaaaagcataaacagtgatttgtatggattcacactgactaatatagctcatgccattaaagtggggtctcttctctaaaggagggttatatgatctagccccgtagacctaagtgtggtttcagacctgttcttcctggtcctctccttggaatccatatttctactagttggactttttctgtttgtctggctctcagaggattataggaggccctgtgaagtgactcagtgaattttgatttgtgggcaagtagatggttccctagtctgaaattgactttgccttaggtgcttcaattcttcataagctcccagttcttaaaggacaagatccttgtaaacatggcaatggcattcattaggaatctagctgggaaaatccagtgtgtatgcttggaaatgagggatctggggctggagagaaaggcatgggcatgccttggagggacttgtgtgtcaagctgaggacctttactttaagctctaggggaccaggcaaggggagatgtagatacgttactctgatggggtggatgaattgaagaaggatgaggcaagaatgaaggcagagaccagggaggaggctctccaagtggccaaggcataaagcaagaaatgaggcctggtgactgcttagtggcagagcagtgaaagagagggaggcatcaaagygagtctcgatttctagctgggtgggtggtagcgatgtccagtaggccagtggctactgaggtctgcagtggaggagggtggttgggctggagacagatgatgagggagtcatcagcctgtgggtggaagaaaagggaacctcttccaactgttttctttgcttcttccctctctttctctttttttttttttttggacagagtcttgctctgtcaccyaggctgaaatgcagtggcatgatcttggctcaccacagcctccgcctcctgggttcaagcaattctcctgtctcagcctccagagtagctgggattacaggcacatatcactgtgcccggctaatttttgtattttcagtggagatgggatttcaccatgttggtcgggctggaatgaactcctgacctcaagtgatccacctgcctcagcctcccaaagtgttgggattacaggcatgagccaccgcgcccggcctttcttccctctcttaaagagtgtttatttaattccacaaacatgagcttgtcaccccctgtagcctggcatctcctacacgaggtgatggctgaggcttctgcttctgctggggtagctctgatctttctgctttctctggcactgtctacccatgttgcctcaccccacaggtcccagggcacctctctcgggcaagtcttggaaccctctgacactgatttgctctcttttctgagctgcttttagccacccatcctcrggacctgttttctctctgcctccacccctgcgggcagtcttaggtctcctgcccctcacgagcaccccagagaggccacgtgctcagtgatctcagtgggcgcatctttctagtcttgctattctttttggycatgttgttcagaaaccatactgggcagggccgacttcaccctaaaggctgcgtctcttcactctgcttttgtttgttccaaataaagtggcttcagaattgctaaccctrgcctctgtgaacttgtgaggtacaattttgtgtctgttatgttaacaaaaatacatacataccttcctggtgatggtataaattgctattctctattggaaagcaatttggaatgaaaatttaaagaaccattttaaaatrtgctatcctgcgtacctscattccacccacccccagggatgtagcctactgaaataattttaaagaagtcaccatatgagagaaaatgttattgctatattgttattgtgagaaattggaaatagactaaatgttcagcactataggaataattaatgaaattacatatactctatacaatcattatgctsccattgaaataataaatacaaaggcgcaaggggggaaaagcttataatgttagtgaaactaagactgatttttttataaagcagcagttttcagacccttggagactccaattcggtagaaccagrgcttcatcttctctgtcgaagctgtgacaggagttgcaaatgcctctcctttttgctgagtttgcagctgctgtttttcyggcagcacatctgtgcaggcctctgcctcggcccctctggatctgctgattgagcagcggattgatctgtccttctctttcgtgttgacccatgtgaggaaccractggcaagggaacaagaaatggaaataggcctcctttgcatcatgacctgtacatcctgcaattggaaaagattgtactttagttggtttaaccagcagcattatttttctaaactaagcaktaagaaggaattaggttttatgtgggatcaacagactgggtctcaaaagaggaaggtgatagaacacagtggggagggggaggtgcactagaaacagagggcctatgctttcattctggctttgctacttaatagctgtgtgacccaatcttagagacttaacctctctgaacttccattttctcatgtataaaatgggaaatattaaaggatactcactgggctggtggcttgtgcctgtaatcccagcacttggggaggttgaggtgggaggatcacttgagcccaggtgttcaagaccagcccaggcaacatggcaagactctgtctctatgaaaaaattaaaaattagccaggtgtggtggtgtgcacctgkagtcttagctacttggtaggctgagatgggaggatcacttgggcttgggaggtcaaggctgcggtgagctgtgattccatcactgcactccagcccgggcggcagagcgagacactgaatccaaacgacaacaacaacaaaaggcaaaaaaataaaagtgccctctttatggagttgtgtaaggtgaagcatatacactattcaacatagtaactatataaaggaagtattgttgttgttactgtagttaataccattaagtgagatgtttcgtatagtggaaagcacatggactctgaattcagactggtctgactttgagtctcagctccacatctagtaatactatgaccaagccctggttaaaatcatgtttttttttcttcagcctyagtcttctcacatataaaatagggacactgtcatttacctcagttttctgtgaggataaaacaacgacagtgtatatgcaagtattttgtaaattttgtagtgctcctcaagatttagttggtgtttactacttgtactttctcactggaatggcagatgctgttggacagcagggacaatgaccacttttgggaacagcagttggatggcttagattggacagcccaagacatcgtggcgtttttggccaagcacccagaggatgtccagtccagtaatggttctgtgtacacctggagagaagctttcaacgagactaaccaggcaatccggaccatatctcgcttcatggaggtgaatctgttgctgggatcatttagaaaagacttaacggcttctttctctgagacgttacaataaggttcaggcaggaggcaagtttagaaataatgtatagtctcatttacaaaactatccctcaagcctaacacaggatttgataacaaaaggcacttaataaatgttagttgagtggttgaatgagtaaataaactctagctttagtaaattaactctagcttattctatataggctcaagagaatatttctacccattttcttctaggttttcctatctcagtgactaatggtagcaaagcattcccttaaaaaggcattatttgtgaaacttayctaaaatcgaattcgggtccaattaaatttttgaaattttrtattaaaaattatattagtagggatgggtaagaggtgttttggtctggttggttggttagttgctatgactcagaattgctaagaaaacagaaaagtaagataagatcaytgttttaacctcttttcctccacaaaatcaataaataacatatccctaaattactcttagaatttctcttaaattgcagtgaaaaaccaaaatccttcattcttggttgaaggttggaaaactacgttagagaggattagagagagaggatgagcaatcgtgtagtcagcccttgcctcctagtgtaggatttgtctcagccactgcttgttgtcstggctgccaacgttctcatgaaggctgttcttctatcagtgtgtcaacctgaacaagctrgaacccatagcaacagaagtctggctcatcaacaagtccatggagctgctggatgagaggaagttctgggctggtattgtgttcactggaattactccaggcagyrttgagctgccccatcatgtcaagtacaagatccgaatggacattgacaatgtggagaggacaaataaaatcaaggatgggtaagtggaatcccatcacaccagcctggtcttggggaggtccagagcacctattatattaggacaagaggtactttattttaactaaaaatttggtagaaatttcaacaacaacaaaaaaactcaacttggtgtcatgattttggtgaaattggtacatgacttgctggaaggtttttcataggtcataaaataacagtatcttttgatttagcatttctactcaagggaattaattccaggaattttggtggcaggcacctgtaatcccagctactcgggaggctgaggcaggagaattgcttgaacccaggaggcagaggttgcagtgagctaagatcgcatcattgcactcccgcctgggcaataagagtgaaactccatctcaaaaaaaaaaaaagatrcaaaaatagaaaaaggggcttggtaagggtagtagggttttgggcaatttttttttttttttttttttattgtatggttctaaaggaatggttgattacctgtggtttggttttaggtactgggaccctggtcctcgagctgacccctttgaggacatgcggtacgtctbggggggcttcgcctacttgcrggatgtggtggagcaggcaatcatcagggtgctgacgggcaccgagaagaaaactggtgtctatatgcaacagatgccctatccctgttasgttgatgacatgtaagttacctgcaagccactgtwtttaaccagtttatactgtgccagatgggggtgtatatatgtgtgtgcatgtgcatgcatgtgtgaatgatctggaaataagatgccagatgtaagttgtcaacagttgcagccacatgacagacatagatatatgtgcacacactagtaaacctctttccttctcatccatggktgccacttttatctttttatttttatttttttttttgagatggagtctcgctctgacgcccaggctggagtgcagtggctcgatctcggctcactgcaacctttgcctcccgggttcaagctattctcctgcctcagcctccacagtagctgggactacaggctcatgctgccacgcccggctgactttttgtattttagtagagacgaggtttcaccatgttacccaggctagacttcaactcctgagctcaggcaatccaccctccttggcctcccaaagtgctgggattacaggtgtgagccactgcacccagcccaccactttaattttttacactctacccttttggtcaaaatttgctcaatctgcaagcttaaaatgtgtcatgacaaacacatgcaagcacatactcacacatagatgcagaaacagcgtctaaacttataaaagcacagtttatgtaaatgtgtgcacttcttctccctaggtggtaaaccacatttcaaaacaacccaaataaaactgaacaaagcttcttcctcttagactttttagaaaatctttcagtgctgagtcactaagctgccaagttctcattgtgggaactatgcctttggatgtaatgatttcttctaagacaatgggcggaggtgtagttattgcagacatctgaaatatgtaatgtttcttccagattctggaaattctcttattctctgtggttggtggtggtggtggsatgtgtgtgtgtgtgtgtgtgtgtgtgtgtgtgtgtagggatcaggatgcgggaggagctgggttctgcttktattggttctctgttttgcattgaatagtgtgtttccttgtatggctatctatagcttttcaaggtcaccagaaattatcctgtttttcaccttctaaacaattagctggaatttttcaaaggaagacttttacaaagacccctaagctaaggtttactctagaaaggatgtcttaagacagggcacaggagttcagaggcattaagagctggtgcctgttgtcatgtagtgagtatgtgcctacatggtaaagctttgacgtgaacctcaagttcagggtccaaaatctgtgtgcctttttactttgcacatctgcattttctattctagcttggaatctgaaacattgacaagagctgcctgaaatgtatgtctgtggtgtgattagagttacgataagcaagtcaatagtgagatgaccttggagatgttgaacttttgtgagagaatgagttgtttttttgttttggtttttagtactttaacataatctacctttagtttaagtatcgctcacagttacctagttactgaagcaagcccccaaagaaatttggtttggcaacactttgttagcctcgtttttctctctacattgcattgctcgtgaagcattggatcatacgtacatttcagagtctagagggcctgtccttctgtggcccagatgtggtgctccctctagcatgcaggctcagaggccttggccyatcaccctggctcacgtgtgtctttctttctccccttgtccttccttggggcctccagctttctgcgggtgatgagccggtcaatgcccctcttcatgacgctggcctggatttactcagtggctgtgatcatcaagggcatygtgtatgagaaggaggcrcggctgaaagagaccatgcggatcatgggcctggacaacagcatmctctggtttagctggttcattagtagcctcattcctcttcttgtgagcgctggcctgctagtggtcatcctgaaggtaaggcagcctcactcgctcttccctgccaggaaactccgaaatagctcaacrcgggctaaggraggagaagaagaaaaraaatccaagcctctggtagagaaggggtcatacmtgtcatttcctgcaatttcatccatttatagttggggaaagtgaggcccagagagggrcagtgacttgcccaaggtcaacccagccgggtagcagctaagtaggatgagagtgcagggttcatgctttccagataaccacatgctcaactgtgccatgctgtctcattggtagtggttcatggcagcatctgaaagctatttattttcttagatatattgggtggcgattcttcctaagtttctaagaacaataatcagaaggatatatattgttgcaggttagactgtctggaagcagaggctgaaatagagtttgatgtatgggtatttatgagggctcaatacctatggaagagatatggaagatgcaggattgggcagagggaggagttgaactgtgatatagggccaaccccgtggggcactctagagaatatgcagcttgttggagttgttcttcatcgagctgaaacatccagccctttgtgctcccccaaggcctccctcctgacaccacctacctcagccctctcaatcaatcactgsatgtgggctgccctgggaaggtcgtgccccagggcctacatggctctctgctgctgtgacaaacccagagttgctgatgcctgaggccgtctactgacagctgggcaacaaggcttccctgaatggggactctgggcagtgcagttttgtgtctgaaccatacattaatatatttatatccgaattttctttctctgcaagcatttcatataaagacacatcaggtaaaaataaatgtttttgaagcaaaaggagtacaaagagataagaactaactaatttaatactagttaccatctgttacaaatagttcctactgattgccaaggactgtttaaacacatcacatgggcttcttcttctatcctcactaacccttttaacagacaaggaaatgaggctcaggaaggtcaaggactttattgaggttccacagtaggatacagttcttgctaaaagcaacccctccctcatgctctgttatctaactgcaaggggaaggtcagtggcagaggtagtggtcccatggttggtgcataagagctgctctgagacaactgcatgctggtgggtcctgcagacatgtasccatcagccggagataggctcaaaatatccacaagagtttggatgattgtgggaatgcagaatccatggtgatcaagagggaaagtcaagttgcctggccattttccttggcttttagacagaaaagttacrtgggatattatctcccacasctcttctgtggtgccaccagtcatagtccttatataaggagaaaccagttraaattacctattgaagaaacaaagagcaaactcgcccactgaaatgcgtagaaagccctggactctgttgtattcataactctgccattatttttctgcgtagttttgggtaartcacttatcttctttaggatggtaatgatcagttgcctcatcagaaagawgaacagcattacrcctctgcattgtctctaacatgagtaggaataaaccctgtcttttttctgtagatcatacaagtgagtgcttgggattgttgaggcagcacatttgatgtgtctcttccttcccagttaggaaacctgctgccctacagtgatcccagcgtggtgtttgtcttcctgtccgtgtttgctgtggtgacaatcctgcagtgcttcctgattagcacactcttctccagagccaacctggcagcagcctgtgggggcatcatctacttcacgctgtacctgccctacgtcctgtgtgtggcatggcaggactacrtgggcttcmcactcaagatcttcgctgtgagtacctctggcctttcttcagtggctgtaggcatttgaccttcctttggagtccctgaataaaagcagcaagttgagaacagaagatgatwgtcttttccaatgggacatgaaccttagctctagattctaagctctttaagggtaagggcaagcattgtgttttattaaattgttwmcctttagtcttctcagtgaatcctggttgaattgaattgaatggaatttttccgagagccagactgcatcttgaactgggctggggataaatggcattgaggaatggcttcaggcaacagatgccatctctgccctttatctcccagctctgttggctatgttaagctcatgacaaagccaaggccacaaatagaactgaaaactcttgatgtcagagatgacctctcttgtcttccttgtgtccagtatggtgttttgcttgagtaatrttttctgaactaagcacaactgaggagcaggtgcctcatcccacaaattcctgacttggacacttccttccctcgtacagagcagggggatatcttggagagtgtgtgagcccctacaagtgcaagttgtcagatgtccccaggtcacttatcaggaaagctaagagtgactcataggatgctcctgttgcctcagtctgggctycataggcatcagcagccccaaacaggcacctctgatcctgagccatccttggctgagcagggagcctcagaagactgtgggtatgcgcatgtgtgtgggggaacaggattgctgagccttggggcatctttggaaacataaagttttaaaagttttatgcttcactgtatatgcatttctgaaatgtttgtatataatgagtggttacaaatggaatcattttatatgttrcttggtagcccaycactcccctaaagggactctataggtaaatactacttctgcaccttatgattgatccattttgyaaattcaaatttctccaggtataatttacactagaagagatagaaaaatgagactgaccaggaaatggataggtgactttgcctgtttctcacagagcctgctgtctcctgtggcttttgggtttggctgtgagtactttgccctttttgaggagcagggcattggagtgcagtgggacaacctgtttgagagtcctgtggaggaagatggcttcaatctcaccacttcgntctccatgatgctgtttracaccttcctctatggggtgatgacctggtacattgaggctgtctttccaggtacactgctttgggcatctgtttggaaaatatgacttctagctgatgtcctttctttgtgctagaatctctgcagtgcatgggcttccctgggaagtggtttgggctatagatctatagtaaacagatagtccaaggacaggcagctgatgctgaaagtacaattgtcactacttgtacagcacttgtttcttgaaaactgtgtgccaggcagcatgcaaaatgttttatacacattgcttcatttaattctcacaaggctactctgaagtagttactataataaccagcaattttcaaatgagagaactgtgactcaaagacgttaagtaaccagctttggtcacacaactgttaaatgttggtacgtggaggtgaatccacttcggttacactgggtcaataagcccaggcgaatcctcccaatgctcacccaattctgtatttctgtgtcctcagagggggtacaactaggagaggttctgtttcctgagtacaggttgttaataattaaatatactagctctaaggcctgcctgtgatttaattagcattcaataaaaattcatgttgaatttttctttagtacttctttcttaatataatacatcttcttgaccaagtccaagaggaacctgygttggacagttttcatatgagatcaaattctgagagagcaagatttaaccctttttggttcaccttctgatcctcccctaaggaggtatacatgaaatatttattactcctgcctgaacttctttcattgaatatgcaattttgcagcatgcagattctggatttaaattctgagtcttaacttactggctgagggaccttggataggctccttatccctcagtttcctcatctctaaaatggggatggcacctgccccgtgggttgttggaaggacttacagaggtgcagaatgtacgttgtacatagcaggtttcagcaaatgttagctccctctttccccacatccattcaaatctgttccttctccaaaggatgtgtcaaggaggaaatggacctggctgggaaaccctcagaatactgggatgwtgctgagcttggctcatacctgtgctttgctttcaggccagtacggaattcccaggccctggtattttccttgcaccaagtcctactggtttggcraggaaagtgatgagaagagccaccctggttccaaccagaagagaatrtcagaaagtaagtgctgttgacctcctgctctttctttaacctagtgctgctgcctctgctaactgytgggggcaagcgatgtctcctgcctttctraaagactgtgaaaccactccaggggcagagaaatcacatgcagtgtccctttccaaatcctcccatgccatttatgtccaatgctgttgacctattgggagttcacggtctcgatccctgagggacattttctttgttgtcttggcttctagaagagtatcttttacttgccccctcccaaacacacatttcatggtctcctaacaagctagaagaaagaggtaaagacaagcgtgattgtggaaccatagcctcgctgcctgcctgtgacatggtgacctgtgtatcagcctgtgtgggctgagaccaagtggctaccacagagctcagcctatgcttcataatgtaatcattacccagatccctaatcctctcttggctcttaactgcagacagagatgtccacagctcatcaaakgctctgccttctgggttctttgtgcttagagtggcttcctaaatatttaataggtcccttttctgccagtctcttctgtgcccatcccctgattgcccttggtaaaagtatgatgccccttagtgtagcacgcttgcctgctgttcctaatcatcttctcctacctcctctttacacctagctcctgtttcagtcacctagaaatgctcacagtcgctggaatatgtcatgttcttccacacctccatgcctttgtaggtactgtttgctctcacaggagaactttctctctaacttgcctatcttctcaactcctcctttctctccaagatctagttccggatcccctcccctgagcatccctccttggttctcaggtagtcagtcactctctgccctgaacttccatggcacgtgaaagaaaatctttttattttaaaacaattacagactcacaagaagtaatacaaattacatgagggggttcccttaaacctttcatccagtttccccaatggtagcagcatgtgtaactgtagaatagtatcaaaaccatgaaattgacataggtacaattcacaaaccttcttcagatttcactagctttatgtgcgctcatttgtgtgtgtgtgtgcgtatttagttctatgcaattttatcatgtgtgaattcatgtaattactagctcagtcaagctgcagaaatatctcattgtcacaaagctccttcatgctaccccttaatggccacagccacctcccttcttcctcagttcctgacacctgtcaaccactaatgcgttcctcgtttttacagttttattatttctagaatgttacataaatggaaccatacagtaggtatccttttgatactggctttttttttttttcactcagcagtattcccttagatctatccmagttgtgtgtgtcaacagttcattcctcttcactgctgagtagtgttccctgggaggggtgtatcacagttccatggcatttttagatgtattttttaaacagctttcagcatcctctattttaattgttcatcaagtcctttttcccaatagactctgaatgctcctttatcatcgtattcccatcaccaacatcagtacccaaataggccctaaataaacatttatagcctcctgcctgcctgagaaaccagggtggacatggagagaaggcacttctgaaagttcaagcrcagtgcsctgtgtccttacactscactcctcagtgctttctgtgggttcatttctgtcttctctcctgtcacagtctgcatggaggaggaacccacccacttgaagctgggcgtgtccattcagaacctggtaaaagtctacygagatgggatgaaggtggctgtcgatggcctggcactgaatttttatgagggccagatcayctccttcctgggccacaatggagygggraagacgaccaccatgtaagaagagggtgtggttcccgcagaatcagccacaggagggttctgcagtagagttagaaatttataccttaggaaaccatgctgatccctgggccaagggaaggagcacatgaggagttgccgaatgtgaacatgttatctaatcatgagtgtctttccacgtgctagtttgctagatgttatttcttcagcctaaaacaagctggggcctcagatgacctttcccatgtagttcacagaattctgcagtggtcttggaacctgcagccacgaaaagatagattacatatgttggagggagttggtaattcccaggaactctgtctctaagcagatgtgagaagcacctgtgagacgcaatcaagctgggcagctggcttgattgccttccctgcgacctcaaggaccttacagtgggtagtrtcaggaggggtcaggggctgtaaagcaccagcgttagcctcrgtggcttccagcacgattcctcaaccattctaaccattccaaagggtatatctttggggggtgacattcttttcctgttttctttttaatctttttttaaaacatagaattaatatattatgagcttttcagaagatttttaaaaggcagtcagaaatcctactacctaacacaaaaattgtttttatctttgaataatatgttcttgtttgtccattttccatgcatgcgatgttaggcatacaaaatacattttttaaagaatactttcattgcarattggaaacttcgtttaaaaaatgctcatactaaaattggcatttctaacccataggcccacttgtagttatttacygaagcaaaaggacagctttgctttgtgtgggtctggtagggttcattagaaaggaatgggggcggtgggagggttggtgttctgttctctctgcagactgaatggagcatctagagttaagggtaggtcaaccctgacttctgtacttctaaatttttgtcctcaggtcaatcctgaccgggttgttccccccgacctcgggcacygcctacatcctgggaaaagacattcgctctgagatgagcaccatccggcagaacctgggggtctgtccccagcataacgtgctgtttgacatgtgagtaccagcagcacrttaagaataggccttttctggatgtgtgtgtgtcatgccatcatgggaggagtgggacttaagcattttactttgctgtgtttttgttttttctttttttcttttttatttttttgagatggagtctcgctctgtagccaggctggactgtagtggcgcgatctcggctcactgcaaccttggcctcccaggttcaagcgattctcctgcctcagcctcccgagtagctgggactctaggcacacaccaccatgcccagctaatttttgtgtttttagtagagacggggtttcaccatgttggccaggatggtctcaatgtcttgacctcgtgatccgcccacctcggtctcccaaagtgctgggaacacaggcatgagccactgtgtctggccacattttactttctttgaatatggcaggctcacctccgtgaacaccttgagacctagttgttctttgattttaggagaagtgggaggtgaatggttgagctgtagaggtgacatcagcccagccagtggatgggggcttgggaaacattgcttcccattattgtcatgctggagggccctttagcccatcctctcccccgccaccctccttattgaggcctggagcagacttcccagacctggtagtgcttcagggccctggtatgatggacctatatttgctgcttaagacatttgctcccactcaggttgtcccatcagccataaggcccccagggagcccgtgtgatggagcagagagagacctgagctctgcaatcttgggcaaggcttttcccttatgtttcttcttatctaaagtgaacagctggggctcatgtgctccctcctcatctaaagtgaayacatggggctcatgtgcagggtcctccccgctttcagagcctgaggtcccctgaggctcaggaaggctgctccaggtgagtgccgagctgacttcttggtggacgtgctgtggggacagcccattaaagaccacatcttggggccctgaaattgaaagttgtaactgcctggtgcatggtggccaggcctgctggaaacaggttggaagcgatctgtcacctttcactttgatttcctgagcagctcatgtggttgctcactgttgttctaccttgaatcttgaagattatttttcagaaattgataaagttattttaaaaagcacggggagagaaaaatatgcccattctcatctgttctgggccaggggacwctgtattctggggtatccagtagggcccagagctgacctgcctccctgtccccaggctgactgtcgaagaacacatctggttctatgcccgcttgaaagggctctctragaagcacgtgaaggcggagatggagcagatggccctggatgttggtttgccatcaagcaagctgaaaagcaaaacaagccagctgtcaggtgcrgcccagagctaccttccctatccctctcccctcctcctccggctacacacatgcggaggaaaatcagcactgccccagggtcccaggctgggtgcggttrgtaacagaaacttgyccctggctgtgcccctaggtcctctgccttcactcactgtctggggctggtcctggagtttgtcttgctctgtttttttgtaggtggaatgcagagaaagctatctgtggccttggcctttgtcgggggatctaaggtkrtcattctggatgaacccacagctggtgtggacccttactcccgcaggggaatatgggagctgctgctgaaataccgacaaggtgcctgatgtgtatttattctgagtaaatggactgagagagagcggggggcttttgagaagtgtggctgtatctcatggctaggcttctgtgaagccatgggatactcttctgttakcacagaagagataaagggcattgagactgagattcctgagaggagatgctgtgtctttattcatctttttgtccccarcatggtgcactaaatttatggttagttgaaagggtggatgcttaaatgaatggaagcggagaggggcaggaagacgattgggctctctggttagagatctgatgtggtacagtatgaggagcacaggcaggcttggagccaactctggctggccctgagacattgggaaagtcacaacttgcctcaccttctttgccgataataatagtggtgcttacctcatagaggattaaattaaatgagaatgcacacaaaccacctagcacaatgcctggcatatagcaagttcccaaataaaatgctactgttcttacctctgtgaggatgtggtacctatatatacaaagctttgccattctagggrtcatagccatacagggtgaaaggtggcttccaggtctcttccagtgcttacccctgctaatatctctctagtccctgtcactgtgacaaatcagaactgagaggcctcacctgtcccacatccttgtgtttgtgcctggcaggccgcaccattattctctctacacaccacatggatgaagcggacrtcctggggkacaggattgccatcatctcccatgggaagctgtgctgtgtgggctcctccctgtttctgaagaaccagytgggaacaggctactacctgaccttggtcaagaaagatgtggaatcctccctcagttcctgcagaaacagtagtagcactgtgtcatacctgaaaaaggtgagctgcagtcttggtgctgggctggtgttgggtctgggcagccaggacttgctggctgtgaatgatttctccatctccaccccttttgccatgttgaarccaccatctccctgctctgttgcccctttgaaatcatatcatacttaaggcatggaaagctaaggggccctctgctcccattgtgctagttctgttgaatcccgttttccttttcctatgaggcacagagagtgatggagaaggtccttagaggrcattattatgtcaaagaaaagagacttrtyaakaggtaagagccttggctacaaatgacctggtgttcstgctcattacttwtcaatctcattgaccttaacttttaaactataaaacagccaatatttattaggcwctgatttcatgccagagacactctgkkcatgaaagaaagtaatgataatagttaattttatatagcgttgwtaccatttacaaccttttttttttttttaacctctatcatctcaattaaagbgcagagagaccctgggaagaaggtaactatatttattatcccagatgagggaagtgaggcttgtagggaattggtagctgattcaaggtcacccagcaggtaaataacagtggtgggaccagacccaattaccaggtatgttttcctctgtaccgcagtacatgcctgagatttatttgtgtgttgaagccagtggtacctaatgtatttacatccsaacctgaaactcctatccacttatttaccttttaatgagcctcttaactcaagtgcagtctgaggaccagcagcatcaggatcacttgggaacttgttagaaattcagcaacctgggcccagctcagacctaccgaatcagaatctgtgcattttaacaaggttcttgagtggttgaacacacattaaagcatgagaagcattgaactagacatgtagccaggtaaaggccttgcctgagatggttggcaaaggcctcattgcagcattcattggcaggccacagttcttttggcagctctgcttcctgacctttcaccctcaggaagcraggctgttcacacggcacacacatgccagacagggtcctctgaagccacggctgccagtgcrtgtgtcccagggaaagctttttcctttagttctcacacaacagagcttcttggaagccctcccyggyraaggtgctggtggctctgccttgctccgtccctgacccgttctcacctccttctttgccatcaggaggacagtgtttctcagagcagttctgatgctggcctgggcagcgaccatgasagtgacacgctgaccatcggtaaggactctggggtttcttattcaggtggtgcctgagcttcccccagctgggcagagtggaggcagaggaggagaggtgcagaggctggtggcgctgactcaaggtttgctgctgggctggggctgggtggctgcgggkgtgggagcagcttggtggcgggttggcctaatgcttgctggggtgcctggggctcggtttgggagctagcagggcagtgtcccagagagctgagatgattggggtttggggaatcccttaggggagtggacactgaataccagggatgaggagctgagggccaagccaggagggtgggatttgagcttagtacataagaagagtgagagcccaggagatgaggarcagccttccagatttttmytgggtagcgtgtgtaggaggccagtgtcaccagtagcatatgtggaacagaagtcttgrcccttgctatctctgcctagtcctaatggctgrcttttcccaggaaggcttctgcttccatggactgttagattaaccctttatttaggtaaatgagggaacctactttataagcataggaaagggtgaagaatcttttaagattcctttactcaagttttcttttgaagaatcccagagcttaggcaatagacaccagactttgagcctcagttatccattcacccatccacccacccacccacccatccttccatcctcccatcctcccattcacccatccacccatccagctgtccacccattctacactgagtacctataatgtgcctggctttggtgatacaaaggtgaataagacatagtcctttcctttgcccccaaccctcagaccagagatgaacatgtggaatgacctaaacacctggaacaggtgtggtgtatgagcggcaggcctctgatgagagggtgggggatggccagccctcactccgaagcccctctgagttgattgagccatctttgcattctggtccctgcagatgtctctgctatctccaacctcatcaggaagcatgtgtctgaagcccggctggtggaagacatagggcatgagctgacctatgtgctgccatatgargctgctaaggagggagcctttgtggaactctttcatgagattgatgaccgrctctcagacctgggcatttctagttatggcatctcagagacgaccctggaagaagtaagttaagtggctgactgtcrgaatatatagcaaggccaaatgtcctaaggccagaccagtagcctgcattgggagcaggattatcatggagttagtcattgagtttttaggtcatcgacatctgattaatgttggccccagtgagccatttaagatggtagtgggagatagcaggaaagaagtgttttcctctgtaccacagtacatgcctgagatttgtgtgttgaaaccagtggtacctaacacatttacatcccaaccttaaactcctatgcacttatttaccctttaatgagcctctttacttaagtacagtgkgaggaacagcggcatcaggatcacttgggaacttgttagaaatwcagcaacttgsgcccagctcagacctactgaatcagaatcaggagcaattctctggtgtgactgtgtcacagccaggtatcaactggattctcatacataggaaatgacaaaygtttatggatggatagtctacttgtgccaggtgctgagatttgttttttgttttttgatttttttttaatcactgtgacctcatttaattctcaaaaaaakatgaaaaaatgaacactcaggaatgctgacatgagattcagaatcaggggtttggggcttcaaagtccatcctctctttatccatgtaatgcctccccttagagatacaacatcacagaccttgaaggctgaaggggatataaaagctgtctggccaagtggtctccaagcttgacagtgcagcagaatcacctggggatattattaaaaataaacatactaaggtttggcttcagggcctgtgaatcagaatttctggaggtgaggccttgaagtctgtatttctattgcatactttggacacagtggtctatagactagagtttggaaatgattgcgctcattcagattctcttctgatgtttgaattgctgccatcatatttctagtgctctatttcctcctgctcattctgtcttggataacttatcatagtactagcctactcaaagatttagagccacagtcctgaaagaagccacttgactcattccctgtaggttcagaataaatttcttctgcgcagtgtctgtcatagctttttttaaatttttttttatttttgatgagactggagttttgctcttattgcccaagctggagtgcagtggtgcgattttggctcactgcaacctccacctcccaggttcaagcgattctcctgcctcagcctcccaagtagctgagattacaagcatgtgctaccacgcccagctaattttgtatttttagtagagatgggttttatccatgttggtcaggctggtctcgagctccagacctcaggtgatctgcccgcctyggcctcccaaagtgctgggattataggcctgagccacagcgctcagccataactttaatttgaaaatgattgtctagcttgatagctctcaccactgaggaaatgttctctggcaaaaacggcttctctcccagrtaactctgagaaagtgttattaagaaatgtggcttctactttctctgtcttacrgggctaacatgccactcagtaatataatrrtygtggcagtggtgactactctcgtaatgttggtgcttataatgttctcatctctctcattttccagatattcctcaaggtggccgaagagagtggggtggatgctgagacctcaggtaactgccttgagggagaatggcacacttaagatagtgcctyctgctggcyttctcagtgcacgagtattgttcctttccctttgaattgttctattgcattctcatttgtagagtgtaggtttgttgcagatggggaaggtttgttttgttgtaaataaaataaagtatgggattctttccttgtgccttcagatggtaccttgccagcaagacgaaacaggcgggccttcggggacaagcagagctgtcttcgcccgttcactgaagatgatgctgctgatccaaatgattctgacatagacccaggtctgttagggcaagatcaaacagtgtcctactgtttgaatgtgaaattctctctcatgctctcacctgttttctttggatggcctttagccaaggtgatagatccctacagagtccaaagagaagtgaggaaatggtaaaagccacttgttytttgcagcatcgtgcatgtgatcaaacctgaaagagcctatccatatcacttcctttaaagacataaagatggtgcctcaatcctctgaacccatgtatttattatcttttctgcggggtcctagtttcttgtatacattaggtgtttaattgttgaacaaatattcattcgagtagatgagtgattttgaaagagtcagaaaggggaatttgctgttagagttaattgtaccctaagacttagatatttgaggctgggcatggtggctcatgccagtaatcccagcgctttgagaggctgaggtgggtagatcacctgaggtcaggagtttgagaccagtctgaccaacaaggtgaaaccccgtctctactaaatacaaaaaattagccgagtgtggtggcacatgcctgtcatcccagctacttgggaggctgaggcaggagaatcgcttgaacccaggaggcagaggttgcagtcagccacggttgcgccattgcactccagactgggcaacaagagtgaaaactccatctcaaaaaagaaaaaaaaagaattagatattttggatgagtgtgtctttgtgtgtttaactgagatggagaggagagctaagacatcaaacaaatattgttaagatgtaaaagcacatcagttaggtatcattagtttaggacaaggatttctagaaaatttttaggaacagaaaactttccagttctctcacccctgctcaaagagtgtatggctcttacattatatataactgcctgacttcatacagtatcagtacttagatcatttgaaatgtgtccacgttttaccaaaatataatagggtgagaagctgagatgctaattgccattgtgtattctcaaatatgtcaagctacgtacatggcctgtttcatagagtagtctataagaaattgatgacttgattcatccgaatggctggctgtaacacctggttacgcatgaacacctcttttcagttgtctcaagacacctttcttttctgtacttatcagacaaggactgaaaggcagagactgctactgttagacattttgagtcaagcttttccttggacatagctttgtcatgaaagccctttacttctgagaaacttctagcttcagacacatgccttcaagatagttgttgaagacaccagaagaaggagcatggcaatgccgaaaacacctaagataataggtgaccttcagtgttggcttcttgcagaatccagagagacagacttgctcagtgggatggatggcaaaggrtcctaccaggtgaaaggctggaaacttacacagcaacagtttgtggcccttttgtggaagagactgctaattgccagacggagtcggaaaggattttttgctcaggtgagacgtgctgttttcgccagagactctggcttcatgggtgggctgcaggctctgtgaccagtgaaggcaggatagcatcctggtcaagatatggatgccggagccagatttatctgtatttcaatcccagttctattccttgccagttgtgtatccgctggcaagttacttctctatgcctcaatctcctcatctgtaaaatggggataataatattacctgcaatacagggttgttacgaaaataaaaatgaataggtgcttagaatggggcctgacattagtaagtgcttagttttgtgtgtgtatatgttatttttattttggaggagaacataaaaargacaaagtgtagaaaaactggttgggtgtattcagctgtcataacatgagagttgttatgcccagatgcacttgacatgtgaatttattagaaacatgatttttctctgagttgatgtttaactcaaactgatagaaaagataggtcagaatatagttggccaacagagaagacttgttagactattgtctgcatgtcagtgtttgcatgctaacttgcttagttagaaaggttaaattttttcactctataaaatcaagaaatatagagaaaaggtctgcagagagtctttcatttgatgatgtggatattgttaagagcgggagtttggagcatacagagctcaagttgaatcctgactttgctacttattggctatatgaccttgggcaagctgcttagtctctctgatcctcagttacctttgtttgttgatgatgaccattgataacacaaccataaataatgacaacatagagatagttctcattatagtagttgttatacagaattattcactcaatgttaattttctgcattgaaatcccagaacattagaattgggggcattatttgaatctttaaggttataaggaatacatttctcagcaataaatggaaggagttttgggttaacttataaagtatacccaagtcatttttttttcagagaagatatggtagaaagtcttaggaggttgaagaaggaattggatatttattctttctgagactatcatgggagataatgaytatggttgtccatgattggagccgttgctgtagagttggttttattatagtgtaggatttgaatgggccatgtgttctcagacctcagattaaaatgagaaaactgaggccagtggggagcgtgacttcacatgggtacacttgtgctagagacagaaccaggattcaggacttctggctcctggtcctgggttcatggcccaatgtagtctttctcagtcttcaggaggaggaagggcaggacccagtgttctgagtyaccctgaatgtgagcactatttacttcgtgaacttcttggcttagtgcctctgccaggtggccataacctctggccttgtgttgccagagaaaaggtttagttttcaggctccattgcttcccagctgccaagaatgccttggtgcagcacagtcataggccctgcattcctcattgccgtgctggttggtcggggaggtgggctggactcgtagggatttgccccttggccttgtttctaacacttgccgtttcctgytgtccccctgccccctccactgcctgggtaaagattgtcttgccagctgtgtttgtctgcattgcccttgtgttcagcctgatcgtgccaccctttggcaagtaccccagcctggaayttcagccctggatgtacaacgaacagtacacatttgtcaggtatgtttgtcttctacatcccaggaggggrtaagattcgagcagaccaaagatgtttacgagggccaagggaatggacttcagaattacacggtggaatgaattttactgctgcggctcaggtccctgtataagctaatactgcatgcrtagaacagcagcgaactaaccctgaataataggccagtcttctgttgagcctttcagcctctctcctcttcatcctactgttgtcaggaacagccacatgtgttttaggtgaaataatccacccttgcaaaaatccatgattaagttataaaatatttggatttgtggagctgtgttttaattctgtaactgagtcacagggcacactgtcaaagcatagaacctccagagacttgttttctgcaaagtataattcatgtaattattatctattctgttatatttgggatgttaggtagtgtttgttctttagataaaaatatcccccactctgtaacaatacattaaatcaaagaaaaggacaaaggatttttctgggtcttgttagcaggagctttcttcagtcctgaaagatttgtagacctgtagatgggggaactgtgtcagtgatacaaaagggaagcatttaaaaaaaaaaaagtatatatatatatatatatatatatatgtaatgtgaattggcctctttttctctaagcccacattttcttcttacatagttcaggtttactttattttttcctttccggctgctgaccctgtattgcccgtagttgtggaacatagcatgtgtttgtgacctgtgcctgttatttttgtgctttctagttgtgcatgcaaagagtacaaagttttcttgccctttcttggaaaatcctgcttgtctgtgccaaagggataattgtgaaagcacttttgaaatacttaatgagttgattttcttcaaattaaaaaawatatataaatgtatmtgtgtatgtacatgtgtgtacacatacacacctttatacatacagcccatttaaaacaagctccactttggagtgctctacgtcaccctgatgccgaatacagggccagagtctgagatccttctgggtggtttctgtgttttgttcatttctgttttaagagcctgtcacagagaaatgcttcctaaaatgtttaatttataaaaacatttttatctctcgattactggttttaatgaattactaagctggctgcctctcatgtacccacagcaatgatgctcctgaggacacgggaaccctggaactcttaaacgccctcaccaaagaccctggcttcgggacccgctgtatggaaggaaacccaatcccgtgagtgccactttagccataagcaggcttcttgtgcttgttgcctggtttgatttctaatatgctgcatttatcaactgcatgccacattgtgaccgccagcatttgccctttgaattattattatgttttatttacaaaaagcgaaggtagtaaccgaactaaattatctaggaacaaacgtttggagagtcttctaacaccgtgcaaagcacgtcattacagacatttgtttactgatttagaaccttaatatttaatttaaatagcactttacacttactgatgaaatgcttttcctttcyttctctcccagcccctgtacttaagtgcttcaataggctctcattatatatgatttttaggttttgyttatcagcttcttcgcttttataatctgaaaagatggcatatgaatttttataaaaagggacactttcttcttctcaaattgtatatttttattgtactttccttcaaaacccccttttaaaaagtaagcagtrgataaataaattcagtgaagcatccatatgacycttaagtgagtgtaggggaagggaggtcaccagatcactgtgagtgaagatggtggagaggtgaggatcttatgaggccgtgctcaaggctggtagaggtgggttagtgtttccaggtttaggcagaatctcagctgaggtcatgaaacaacagtgatctctgaaaaattatggcaaggtgggaaggtgctggagaattggagagggggcaaacttgactttcaagtttcaatgggaagataggtgactctgcacaccacagaacagtgagcatgataacctgtttatacaaggttctagagcagatttctaaatggatagctactgtgtgcttgtttgttcttaattagtattggatagttactaaatacttgttagtacttagtacataatgggtggtaaatcctagcagctaatattggttcccaaataaccagatgacaaggatagagaaggacacagacacggcctatctggatttcatggtgcctttsattttccacatgaaggttgtgtagggaagatagaagcatgagatgagatgataatatagttatctggattcatcactggccagctgaaccatatgaactcatggattgatgctagcttaggaaggctctgtaggagccagaactgggctgagagccagcccatagagacaaaagaggcccggccctgacatcagagggttcaaacatgatgtctgagccccacctacagtctgccggaggtggttggaaggaagagcctttatccttacaattcttactgaaattcaaatttttaggttttgcaaaaaaatggtggacctgaaggaaatttgacaggagcatgtctcagctgtatttaaatttgtctcagccaatccccttttgaatgttcagagtgtaagcttcaggagggcagcgcgtcttagtgtgacttttctggtcagttcaggtgctttaaggagacaattagagatcaatctggaaaacttcatttgaatttttaatacataagaaaacaataagaaatagttaaaaatatatatttatawwatatatrtgtgtgtgtgtgtgtgtgtgtgtrtrtatatatatatattttatttatttatttttttttgagatggagtctcgctctgttgcccaggctggagtgcagtggctcaatcttggctcactgccacctctgcctcccaggttcaagtgattctcctacctcagcctcctgagtagctgggattacaagcatgtgccaccacactggctaatttttctaattttagtagagatggagtttcaccatgttggacaggatggtcttgaactcctgacttagtgatccacccgccttcgcctcccaaagttctgggattacaggcatgagccatcgtgcctggcaattatatttaatatttaataataaggaaataattgctgtaactttactttaaattgtggaattctgaaactggaagggaactggaaatgacttgttgaatcaaatcattttaaacttttattttgccagtggaaaaaataagcccccaaaagagcaggggacctgctgatgtcccacagtaattcagagctggagatgaggttgaaggctttgtgtcttatctccagggaaaatttgtagacagcgtagctctttatgtgacgagcattctcaccccagtcatcccccaattctctactcatttgagaacataaattggatcttgccagtctctactcatttttcagcacatcgagcataagatccagactctttcccaggcctctctcatctggctcctctcctcctcctttatcattactcttcttcgtagcttatcctactccarccatgctgtcttcctattattcctaaaaartagaaatgcatttcttcctagggcctttgtacctgcacttgccatcgcttttgctcagaatgttctttttgccaagcttttgcccagcttgttctccatcattgttatgttttggctgaaatgtcttctcttagtaggttcattctccccagtcactgtctttttattttgctttattttgggccatctaaggttatcttattagtgtatttgttgttcgtctcctccatgggcatacacctccatgaaggcaggtattttcaccttaggccctcgaatatactggacagcatctggcacgtagtagatgctcaacgaatgtttgttgtgtgagcaaatggttggttgattggattgaactgagttcagtatgtaaatatttagggcctctttgcattctattttacttatgtataaaatgatacataatgatgatataaatgatgtcacagtgtacaaggctgttgtgggatcaagcaatcaaatgagatcatgcttgtcttttccaaatggtgagggaatagatgcatgtttrtggttgttacggaatgatcctgtgctcctgaggcaacagaaaggccaggccatctctggtaatcctactcttgctgtcttccctttgcagagacacrccctgccaggcaggggaggaagagtggaccactgccccagttccccagaccatcatggacctcttccagaatgggaactggacaatgcagaacccttcacctgcatgccagtgtagcagcgacaaaatcaagaagatgctgcctgtgtgtcccccaggkgcaggggggctgcctcctccacaagtgagtcactttcagggggtgattgggcagaaggggtgcaggatgggctggtagcttccgcttggaagcaggaatgagtgagatatcatgttgggagggtctgtttcagtcttttttgttttttgtttttttttctgaggcggagtcttgctctgtcgcccaggctggagtgctgtggcatgatcttgcctcactgcaacctccacctcccaggttcaagcgattctcctgcctcagcctcctgagtagctgggattacaggcacgcaccaccatgtctggctaatttttgtgtttttagtagagatagggtttygccgtgttggctaggctggtctggaattcctgacctcaggtgatccacccgcctcggcctcccaaagtgctgggattacaggcgtgagccactacgcccagccctgtttcagtctttaactcgcttcttgtcataagaaaaagcatgtgagttttgaggggagaaggtttggaccacactgtgcccatgcctgtcccacagcagtaaagtcacaggacagactgtggcaggcctggcttccaatcttggctctgcaacaaatgagctggtagcctttgacaggcctgggcctgtttcttcacctctgaattagggaggctggaccagaaaactcctgtggatcttgtcaactctggtattcttagagactctgtttgggaaggagtcctgagccattttttttttcttgagaatttcaggaagaggagtgcttatgatagctctctgmtgcttttatcagcaaccaaattgcaggatgaggacaagcaattctaaatgagtacaggaactaaaagaaggcttggttaccactcttgaaaataatagctagtccaggtgcggggtggctcacacctgtaatctcagtattttgggatgccgaggtggactgatcacctaaggtcaggagttcgaaaccagcttggccaatgtggcgaaaccctgtctctactaaaaattcaaaaattagccaggcatggtggcacatgcctgtaatcccagttacytgggaggctgaagcaggagaattgcttgaacctgggaggtggaggtcgcagggagccaaaattgcgccactgtactccagcctgagcaacacagcaaaactccatatcaaaaaataaaatgaataaaataacagctaatctagtcatcagtataactccagtgaacagaagatttattaggcatagtgaatgatggtgcttcctaaaaatctcttgactacaaagaatctcatttcaatgtttattgtttagatgttcagaataaattcttgggaaagaccttggcttggtgtaagtgaattaccagtgccgagggcagggtgaaccaagtctcagtgctggttgactgagggcagtgtctgggacctgtagtcaggtttccggtcacactgtggacatggtcactgttgtccttgatttgttttctgtttcaattcttgtctataaagacccgtatgcttggttttcatgtgatgacagagaaaacaaaacactgcagatatccttcaggacctgacaggaagaaacatttcggattatctggtgaagacgtatgtgcagatcatagccaaaaggtgactttttactaaacttggcccctgccktattattactaattagaggaattaaagacctacaaataacagactgaaacagtgggggaaatgccagattatggcctgattctgtctattggaagtttaggatattatcccaaactagaaaagatgacgagagggactgtgaacattcagttgtcagcttcaaggctgaggcagcctggtctagaatgaaaatagaaatggattcaacgtcaaattttgccacttagtagcaacttgaccaggtaactggttatccttttaaagccttagtttatctaaattgtgatattaatgttgctcttataagtttgtcatgaggactaaattaaatggtgtacatagagtgccttgggtactctctgatgggggactccatgataatttgtggtctcatggagggagctctgggaaggtttaggagcctgccttggctctgcagccttgggagagccttctagcttcccaggacatggcagcctagtgttgaatgcttggctcagcaaatgtttgttctcgtttccttcccatcaacttggtcagttggggtctttcagttaggagtatctcagtgactttaaatggcatgggcatgctggagtgatagtgaccatgagtttctaagaaagaagcataatttctccatatgtcatccacaattgaaatattattgttaattgaaaaagcttctaggccaggcacggtggctcatgcctgtaatcccagcactttaggaggccaaggcgggtggatcacttgaggtcaggagtttgagaccagcctggccaacatggggaaaccctgtctctactaaaaatacaaaataagctrggcgtggtggtgcgtgcctgtaatcccagctacttgggaggctgaggcaggagaaytgcttgaatctgggaggcggaggttgcagtgagctgagttcatgccattgcattccagcctgggcaacaagagcgaaaccatctcccaaaagaaaaaaaaaagaaagaaaaagcttctagtttggttacatcttggtctataaggtggtttgtaaattggtttaacccaaggcctggttctcatataagtaatagggtatttatgatggagagaaggctggaagaggcctgaacacaggcttcttttctctagcacaaccctacaaggccagctgattctagggttatttctgtccgttccttatatcctcaggtggatatttactccttttgcatcattaggaataggctcagtgctttctttgaactgattttttgtttctttgtctctgcagcttaaagaacaagatctgggtgaatgagtttaggtaagttgctgtctttctggcacgtttagctcagggggaggatggtgttgtaggtgtcttggattgaagaaagccttrgggattgtttgtcactcacacacttgtgggtgccatctcactgtgaggaggacagaagccctgtgaacatgtggagcacacaggggcacagacagatttagattaggcctgctttatagagtttctgcctagagcatcatggctcagtgcccagcagcccctccagaggcctctgaaatatttgatatactgatttccttgaggagaatcagaaatctcctgcaggtgtctagggatttcaagtaagtagtgttgtgaggggaatacctacttgtactttccccccaaaccagattcccgaggcttcttaaggactcaaggacaatttctaggcatttagcacgggactaaaaaggtcttagaggaaataagaagcgccaaaaccatctctttgcactgtatttcaacccatttgtccttctgggttttgaaggaacaggtgggactggggacagaagagttcttgaagccagtttgtccatcatggaaaatgagataggtgatgtggctacgtcagggggcccgaaggctccttgttactgatttcygtcttttctctctgccttttccccaagggccaggacccctggatctctgggcagagcagacgcaggcccctataatagccctcatgctagaarggagccrgagcctgtgtataaggccagcgcagcctactctggacagtgcagggttcccactctcccaactccccatctgcttgcctccagacccacattcacachcgagccactgggttggaggagcatctgtgagatgaaacaccattctttcctcaatgtctcagctrtctaactgtgtgtgtaatcaggccaggtcctccctgctgggcagaaaccatgggagttaagagattgccaacatttattagaggaagctgaygtgtaacttctctgaggcaaaatttagccctcctttgaacaggaatttgactcagtgaaccttgtacacactcgcactgagtctgctgctgatgatactgtgcaccccactgtctggsttttaatgtcaggctgttcttttaggtatggcggcttttccctgggtgtcagtaatactcaagcacttcctccgagtcaagaagttaatgatgccaycaaacaaatgaagaaacacctaaagctggccaaggtaaaatatctatcgtaagatgtatcagaaaaatgggcatgtagctgctgggatataggagtagttggcaggttaaacggatcacctggcagctcattgttctgaatatgttggcatacagagccgtctttggcatttagcgatttgagccagacaaaactgaattacttagttgtacgtttaaaagtgtaggtcaaaaacaaatccagaggccaggagctgtggctcatgcctgtaatcctagcactttgggaggcygaagcgggtggatcacttgaggtcaggagttcgagaccagcctggcctacatgacaaaaccccgtatctactaaaaatacaaaaaaattagctgggcttggtggcacacacctgtaatcccagctacttgggaggctgaggcaggagaattgcttgaaccctgtaggaagaggttgtagtgagccaagatcgcaccgttgcactccagcctgggcaacaagagcaaaactccatctcaaaaaacaaattaaatccagagatttaaaagctctcagaggctgggcgcggtggcttacacctgttatcccagcattttgggatgccraggcgggcaaagcacaaggtcaggagtttgagaccagcctggccaacatagtgaaaccctgtctytgctaaaaacatagaaaaattagccgggcatggtggcgtgcgcctgtaatcccagctactcgggaggctgaggtgagagaattrcttgaacccgggaggcggaggttgcagtgagcccagattgcaccactgcactccagcctgggcgacagagcaagactccatctcaaaaaaagctctcagaacaaccaggtttacaaatttggtcagttggtaaataaactgggtttcaaacatactttgctgaaayaatcactgactaaataggaaatgaatctttttttttttttttttaagctggcaagctggtctgtaggacctgataagtactcacttcatttctctgtgtctcaggtttcccatttttaggtgagaattaaggggctctgataaaacagaccctaggattgtggacagcagtgrtagtcctagagtccacaagtctgcttttgagtgatgggcccatgtatctggcacatctgcaggcagagcgtggttctggctcttcagatgatgccggtggagcactttgaggagtcctcaccccaccgtgataaccagacattaaaatcttggggctttgcatcccaggatttctctgtgattccttctagacttgtggcatcatggcagcatcactgctgtagatttctagtcacttggttctcaggagccgtttatttaatggcttcacatttaatttcagtgaacaaggtagtggcattgctcttcacagggccgtcctgttgtccacaggttccagattgactgttgccccttatctatgtgaacagtcacaactgaggcaggtttctgttgtttacaggacagttctgcagatcgatttctcaacagcttgggaagatttatgacaggactggacaccanaaayaatgtcaaggtaaaccgctgtctttgttctagtagctttttgatgaacaataatccttatgtttcctggagtactttcaactcatggtaaagttggcaggggcattcacaacagaaaagagcaaactattaactttaccagtgaggcagtacggtgtagtgtagtgattcagagaatttgctttgccaccagacataccaggtaaccttgactaagttacttaacctatctaaacctcagttycctcatctgtgaaatggagacagtaatcatagctatttccaaactgttgtgagaattcaatgagttaaaggtataaggtcctcaccacagcgcctgcccacatagtcagtgatcactatgtcctgaacactgtaattacttcgccatattctctgatcatagtgttttgccttggtatgtgactagaatttctttctgaggtttatgggcatggttggtgggtatgcacctgcctgcaggagcccggtttgggggcattaccttgtacctggtatgttttctttcaggtgtggttcaataacaagggctggcatgcaatcagctctttcctgaatgtcatcaacratgccattctccgggccaacctgcaaaagggagagaaccctagccattatggaattactgctttcaatcatcccctgaatctcaccaagcagcagctctcagaggtggctcygtaagtgtggctgtgtctgtatagatggagtggggcaagggagagggttatggagaaggggagaaaaatgtgaatctcattgtaggggaacagctgcagagaccgttatattatgataaatctggattgatccaggctctgggcagaagtgataagtttacgaattggctggttgggcttcttgaactgcagaagagaaaatgacactgatatgtaaaaatcgtaacatttagtgaattcatataaagtgagttcaaaaattgttaattaaattataatttaattataagtgtttaatcagtttgatttgtttaaaaaccactgttttaaatttggtggaatatgtttttattagcttgtatctttaattcctaaattaagctgtgtgtgtgtgtgtgtgtgtgtgtgtgtgtgtgtgtgtgtgtgaagtttaaagccaggatgagctagtttaaagtatgcagcctttggagtcatacagatctgggtttgaatctggtctctaaactttatagatgtatgatattaaatgaggcagttcatgtaaattgccaagcccagcactcagcacagagttgatatttcacacacattagatacctttcctgtatgtggagcatggcagttcctgtttctgctttactcctacaggatactaatataggacactaggatctttataccaagaccccatgtaatgggcttatgagaccattcttcttataaaaatctgacagaatttttgtatgtgttagatcaataggctgcatactgttattttcaagttgatttacagccagaaatattaatttatttgagtagttacagagtaatatttctgctctcatttagttttcaagccccactagtcctttgtgtgtgaaaatttacaacttactgctcttacaaggtcatgaacagtggaccaaagtgaatgccattaaccactctgacttccttcattagttttattgtgacagtggactcttttgacctcagtaataccagtttggcatttacattgtcatatttttagacttaaaaatgatcatcttaaccctgaataaaatgtgtctggtgaacagatgtttttccttgggctgtgcctcagatatctctgtgtgtgtgtacgtgtgtgtttgtytgtgtgtccatgtcctcactgattgagccctaactgcatcaaagacccctcagattttcacacgctttttctctccaggatgaccacatcagtggatgtccttgtgtccatctgtgtcatctttgcaatgtccttcgtcccagccagctttgtcgtattcctgatccargagcgggtcagcaaagcaaaacacctgcagttcatcagtggagtgaagcctgtcatctactggctctctaattttgwctgggatatggtaaggacacaggcctgctgtatctttctgatgtctgtcagggccatggattgayatggataagaaagaaagagctctggctatcatcaggaaatgttccagctactctaaagatgtatgaaaaagaaatagccagaggcaggtgatcactttcatgacaccaaacacagcattgggtaccagagttcatgtcacaccagagggaaaattctgtacacaatgatgaaaattaataccactaccrcttaagttcctatgtgacaactttcccaagaatcagagagatacaagtcaaaactccaagtcaatgcctctaacttctctgatgggttttaacctccagagtcagaatgttctttgccttactaggaaagccatctgtcatttgaaaactctgtacattttatcagyagcttatccatccattgcaaatatgtttttgtgccagccacaatatattgcttctatttggaccaatatgggggatttgaaggaattctgaagttctaattatatttcaactctactttacaatatctccctgaaatatatctccctgtaacttctattaattataagctacacagagcaaatctaattcttctcccaccgaacaagtccctggatatttaaaaataactctcatactctcatttaacctgagtattacccagataagatgatatatgagaatacaccttgtaacctccgaagcactgtacaaatgtgagcaatgatggtggagatgatgatgagatctttgctgtttataccaagccccttagactgtgtcactcttctgatccggttgtccttgtatggccatgctgtatattgtgaatgtccgttttcaaaagcaaagccaagaattaaccttgtgttcaggctgtggtctgaatggttatgggtccagagggagttgatctttagctcacacttctattactgcagcacaaagattttgcattttggaaggagcaccgtcttactggcaacttagtggtaaaccaaaacctccatttcacacaaatgattgtgaaattcgggtctccttcattctatacaaattcatttgatttttttgaaactaaactttatatttatccatattaaattacatgggttttatttttgttttatcttgattcagtaattactcctttcagtaaacacagactgagtgctgtgtgtctgacttatgccaggcataggtgattcagagrtgaaaggtcaagtccctgaacccatctcttgtcttcctgggtattatctgtccctccctgctttagagctcctgaaatttgctagaagcatgtcttcatctaagttgttgataaacacatcaagtaggattggactgaggcagagccctgtagtctgaagctgcagttcttctagcggctgacaagccccactatcacttccctgctggtgctttgctctgccagctgtgaattctcataattgtcctatcgtcaagtctttatttctgcattttactgcttgatacactgtcaggacagactttaaaattattctcagtgcgatgaaacaattctgacattcatgttatgagcagttacctcataaatagattacatgtgagattgaacttgggcagactataatatagcattaatgaygaaacagacacagtcatcttcgggaagaagaatagaggcttatttgctgcctgtgaaattaaaattactctgactkggartccatcgttcagtaagtttactgagtgtgacaccttggcttgactgttggaaagacagaaagggcatgtagtttataaaatcagccaargggaaaatgcttgtcaaaatgtattgtcgggtattttgattaatagtttatgtggcttcattaattcagagttactctccaatatgtttatctgccctttcttgtctgataatggtgaaaactygtgtgatgcattgtatatttgatttaggggtgaactggatgtctttgttttcacttttagtgcaattacgttgtccctgccacactggtcattatcatcttcatctgcttccagcagaagtcctatgtgtcctccaccaatctgcctgtgctagcccttctacttttgctgtatgggtaagtcacctctgagtgagggagctgcacagtggataaggcatttggtgcccagtgtcagaaggagggcagggactctcagtagacacttatctttttgtgtctcaacaggtggtcaatcacacctctcatgtacccagcctcctttgtgttcaagatccccagcacagcctatgtggtgctcaccagcgtgaacctcttcattggcattaatggcagcgtggccacctttgtgctggagctgttcacygacaatgtgagtcatgcagagagaacactcctgctgggatgagcatctctgggagccagaggacagtgtttaattgtgatcttattccacytgtcagtggtattgacactgctgactgccttgtcctgtcttcagagtctgtcttccctgagaaggcaaagcacctttctttcttgctgtgccttacattttgctggtcaagcctttcagtttcttttgacagttttttttacttctttcttttttcaatgttgctcttaccaagagtagctcctctgccttccactttacacatgagagctgggcgacgccattcagtcctaaggcttttaccatcacctctcttggtgtttttattgtcatctctaagatcaatgcctttagccttgatcataaccttgaactctaatctcaaattctcacttgcctagtggattgctccatttagatagtatatagataccccaacctggayatgtcctagttttctttccccttggaacttaatgcttttcttgccatccctgtcacactcagtggcactaccatccactcggttgcccaagctggctcttagagttatcctagatgcttgctttgctgttgcagatttcccacattcaactggttatgttgtcagttcttccaggtatggacctctaaaataaggcttcctctccattccggttgtcattgcctttgtccaaacacagcacacaaggccttttacagttgcacaactcttcytgtccatacccaccacacyctttcccagctgtaagcttcagatgagttgcctccaaccaccatgctcctgtaggcctggcttgaaatgcccttcttctgtcacagggtctggtagtatatcccttgcccttcaagatttagctaaaatgtgaagctttccttacctgctgggaggtgttctctcttttctctgtgctctcagagtccttagtccatgcctccagtacaacgtacatccacttacatggtaatttcctgtttacatacttttcctactyggagtggagtctgtttcttaataattttgcctctcccatgccctagcacagtgcatccagcgtatagccccttattcagttggtagatatttggccactgttgccttgtgggatcataagttctgatgtatttgagaagaatttctaaaattctgacaaaatcctgaaactcaaatattgacccagacatgagcaatttgcttttcaaatgctaagggatttttaatggatttgctttaattaaatctagcctgtttctaagctttattcattatttctccatactcagagcatttctccagattttctaaagaatagaattttattgctacatatcatcagctatgcctgctgctatttaattggtatctgaattaaaaggtctggtttgtccctagagaatcaaattttttcttcactcccatatttcagaacttgatacatttttaggataaaccatgaatgacacccgtttcttctccctcaccctcccttccytcccattttttttttttttttttagaagctgaataatatcmatgatatcctgaagtccgtgttcttgatcttcccacatttttgcctgggacgagggctcatcgacatggtgaaaaaccaggcaatggctgatgccctggaaaggtttggtgagtgaagcagtggctgtaggatgctttaatggagatggcactctgcataggccttggtaccctgaactttgttttggaaagaagcaggtgactaagcacaggatgttcccccacccccatgcccagtgacagggctcatgccaacacagctggttgtggcatgggttttgtgacacaaccatttgtctgtgtctctgatagcattgagaaaagtgaaagggcagttttgaaggtaaggaaaatagtgkyatttgcttggatccactggctcatgccactgtctgggttggttagaagcactggaaaagtcaaaccrtaactttgagaattaggtgatcagggaatcagaaggaaagatgcaaactttggctcttttaggcgaatcatgtgcctgcagatgaggtcatttattatcttttacacagtctataaaattataatgtattacatctttttctacctttagaatggttaaaaatatttctccggtagccatatgattattattcatccattagataatatagtcaaatgggccatgttatttactgttcatagaagaggggctttttgcaacttgggctacaaaggagatatgtaaggaatttaaggaatggttacatggaactagatttaattgaatctagtggtttaattgattcactaggatatatgctactgaaaggggaatctgcttaaagtgctttctgatatttattattactaaaacttagaatttattaaaaatactgactgtgaaaattacttgggtcgtttgcctttttaaaaggatttttggcatgtctcattaaaaaaagaaatactagatatcttcagtgaagttacaaatcgaatacacattggctctgaaattctgattgatactgggtcataaaaagttttcccaaatcagacttggaaagtgatcactctcttgttactcttttttccttstcatgggtgatagccatttgtgtttattggaagatcggtgaattttaaggaacataggcccaaatttgaggaagggccatggtttttgatccctccattctgaccggatctctgcattgtgtctactaggggagaatcgctttgtgtcaccattatcttgggacttggtgggayraaacctcttcgccatggccgtggaaggggtggtgttcttcctcattactgttctgatccagtacagattcttcatcaggcccaggtgagctttttcttagaacccgtggagcacctggttgagggtcacagaggaggcgcacagggaaacactcaccaatgggggttrcattgaactgaactcaaaatatgtgataaaactgattttcctgatgtgggcatcccgcagcyccctccctgcccatcctggagactgtggcaagtaggttttataatactacgttagagactgaatctttgtcctgaaaaatagtttgaaaggttcatttttcttgttttttcccccaagacctgtaaatgcaaagctatctcctctgaatgatgaagatgaagatgtgaggcgggaaagacagagaattcttgatggtggaggccagaatgacatcttagaaatcaaggagttgacgaaggtgagagagtacaggttacaatagctcatcttcagtttttttcagctttatgtgctgtaacccagcagtttgctgacttgcttaataaaagggcatgtgttcccaaaatgtacatctataccaaggttctgtcaattttattttaaaaacaccatggagacttcttaaagaattcttactgagaattcttttgtgatatgaattcccattctcgaatacattggttttatatgcttacmtttatgtgttagttattaaaacatactaatattgtatatctagtcaaaactgaggtagagagaataaatggttgattttgagwytgagtttcatagtccaaaaagctgatatattgcctgtgttcaagagggtctatatcagccctctagatgccagcatctccaaattttacttttttggaatctgtacagtatttgcaatatttttattacaaatttctactctgtggaatttaatttttaaaatacctgcaatacatatatatgttgaatagatgaaaaattatgtagatrataatgaatgatrcggttctaaaaagacaggttaaaaagtaagttcacttttattttgagcttcagaatcattcagaagccagtcrccacaaacgcagaccaaggctcttggcacatyaaatatgcctatggcttagggttattgacaagtcttatgttgcagtgtatgtggtttatagtcctgccttccacagttgcttgggagagctgtgagtcactgaggcttatgaatgtttacattttgtttgttgcagatatayagaaggaagcggaagcctgctgttgacaggatttgcgtgggcattcctcctggtgaggtaaagacactttgtctatattgcrtttgtccctattagttcagactatctctacccaatcaagcaacgatgctcgttaagaggtaaaagtggattttaaaggcttctgtatttatgccaggatggagcaattagtcatcgagaagaragggaccctgtatgtcaagagaatgatttcagagaatccaatacaatttaagaaaaagcatggggctgggcgcagtgattcactcctgtaatcccagcactttgggaggccgaggtgggcggatcacgaggtcaggagattgagaccatcctggccaacatggtgaaaccccatctctactataaatacaaaaattagctgggcatagtagtgcattcctgtagtcccagctactcgggaggctgaggcaggagaattgcttgaacctaggagggggaggttgcccagattgcgctgctgcactccagcctggtgacagagtgagactcatgtcaacaacaaaaacagaaaaagcacgcacatctaaaacatgcttttgtgatccatttgggatggtgatgacattcaaatagttttttaaaaatagattttctcctttctggtttcygtttgtgttcttttatgcccttttgccagagtaggtggtgcaatttggctagctggctttcattactgtttttcacacattaactttggcctcaacytgacaactcaaataatatttataaatacagccacacttaaaatggwcccattrtgaaatacatatttaaatatctatacgatgtgttaaaaccaagaaaatatttgattcttctctgatatttaagaattgaaggtttgaggtagttacgtgttaggggcatttatattcatgtttttagagtttgcttatacaacttaatctttccttttcagtgctttgggctcctgggagttaatggggctggaaaatcatcaactttcaagatgttaacaggagataccactgttaccagaggagatgctttccttaacaaaaataggtgagaaaagaagtggcytgtattttgctgcaaagactttgtttttaatttatttaaagaaataggttgttatttttgattacagtggtatttttagagttcataaaaatgttgaaatatagtaaagggtaaagaagcacataaaatcatccatgatttcaatatctagagataatcacaatttacatttcctttcagtctcattctcttcttttaacagctttattcaggtataatttacatacaatataatttgcttgtttyttaagagtataattyagtgatttttggtaaattgagagttttgcaaccatcaccacaatccagttttagaacttttccatcaccccacatctgtcttatatacacatataaatgtgccatacaattgagatcatactgtatgtagaatttaaaattagtttttattgttaatgagtgtattatgaatatttcccagtgggttacatttcctaagatgtggaattttacattgctacataaaatycccctatgtacatgtacctataatttatttaataaattccttataaatgttggacacattagtttccatttttcrctatgtaaatatgtccctgtatacatcttttattatttcctcaggaacaattcctacaaagtaaattgccctctctaaagagcatacaaattgactgagccaccgttaggccattttctgagactgcacaggtcacaaagcaatctgatctttgggaatacagctacattttataggcttcttagataatgttactctaagtactttaaatatgtggggcttctctgggcttttttttttttgagacggagtttcactcttactgcccaggctggagagcaatggcgcgaccttggctcactgcaacctccgcctcccaggttcaagcgattctcctgcctcagcctcctgagtagctgagattacaggtgcccgccacaatgcctgcctaatttttttgtattttcagtagagatggggtttcaccatgttggccagactggtctcgagctcctgacctcaggtgatccacctgcctcagcctcccaaagttctgggattacaggcatgagccactgcgcccggcttctctggacttattatgtggagagatagtacaaggcagtggctttcagagttttttgaccatgaccgttgtgggaaatacattttatatctcaacctagtatgtacacacagacatgtagacacatgtataacctaaagtttcataaagcagtacctactgttactaattgtagtgcactctgctatttcttattctaccttatactgcgtcattaaaaaagtgctggtcatgacccactaaatttatttcccaaaccactaatgaacaatgactcacaatttgaacacactggacagggggatagccaataaaattgaaaagagcaaggaaattaatgtattcatgatctcctctcctgtctcttwcatttttgcagtagcaatgtaaaggaatcctaagagaacagacattctgggaatagcaggcctagcgctgcacaactgctttcctaggcttgctcctagtaccaagctcctgacgcatatagcagtggcagtaataaccagcccatagtaaggtttgtcacagggactggttgtaagaactgatttgrttggtatarctgtgagggcctggcacggtgtccacgtgtgcctcaatcctaattctgaaaaaggctgaccctgggggtgctaattagatacacagagaggaatgaatgctgccagaaggccaagttcatggcaatgccgctgtggctgaggtgcagtcatcagtctggaacgtgaacactgaacttctctcacatgtgattcttcacttgactggcttcatagaaccccaaagccaccccaccaccacataaattgtgtctctaggttctgtgttgctcacactcaaaatktctgggccttctcatttggtgcatgtgaatggtgcatatgagtgaagtctaggatggggccttagcrttaaagccctggggtagtgtgactgagattgttggtaaagaatgtgcagtggttggcatgacctcagaaattctgaaatgggactgcacctgcagactgaagtgttcagagagccagggaggtgcaaggactgggragggtagaggcaggaaccctgcctgccaggaagagctagcatcctgggggcagaaaggctgtgctttcaagtagcagcagatgtattggtatctttgtaatggagaagcatactttacaggaacattaggccagattgtctaaccagagtatctctacctgcttaaaatctaagtagttttcttgtcctttgcagtatcttatcaaacatccatgaagtacatcagaacatgggctactgccctcagtttgatgccatcacagagctgttgactgggagagaacacgtggagtyctttgcccttttgagaggagtcccagagaaagaagttggcaaggtactgtgggcacctgaaagccagcctgtctcctttggcatcctgacaatatataccttatggctttyccacacgcattgacttcaggctgtttttcctcatgaatgcagcagcacaaaatgctggttctttgtatctgctttcagggtggaaacctgtaacggtggtggggcagggctgggtgggcagagagggagtgctgctcccaccacacgagtcccttctccctgctttggctcctcaccagttgtcaggttatgattatagaatctagtcctactcagtgaaagaactttcatacaygtatgtgtaggacagcatgataaaattcccaagccagaccaaagycaaggtgctttttatcactgtaggttggtgagtgggcgattcggaaactgggcctcgtgaagtatggagaaaaatatgctggtaactatagtggaggcaacaaacgcaagctctctacagccatggctttgatcggygggcctcctgtggtgtttctggtgagtataactgtggatggaaaactgttgttctggcctgagtggaaaacatgactgttcaaaagtcctatatgtccagggctgttgtatgattggcttgtcttcccccagggacagcagagcaaccttggaaaagcagagggaagcttctcccttggcacacactggggtggctgtaccatgcctgcagatgctcccaaatagaggcactccaagcactttgtttcttagcgtgattgaggctggatatgtgatttgatctttctctggaacattctttctaatcatctttgtgttcattccctgaaaatgaagagtgtggacacagctttaaaatccccaaggtagcaactaggtcatagttccttacacacggatagatgaaaaacagatcagactgggaagtggcccttgaccttttttcttctgtagataagagcattgatgttattacgggaagaagcctttgaggcttttatgtattccacctcggtctggaatttgtttctgtaaggctaacagttgcaatatactagggtaatctgagtgagctggaattaaaaaaaaaaaggaatttcaccccaatcttatactgacttcaatagagstttcagacaaaaagttgttttgtatatacttatcagtcatgaaaagataattacaactaaatggcctttttccttccctatttatytggagaaatttaattacataaaaaagtactcagaatatttgagtttcctgcatcaataagacatttataataatgaccttgtttacaaatgaatttgaaagttactctaattctttgattcatcaagaaataactagaatggcaagttaaaatttaagctgtttcaaagatgcttctgcatttaaaaacaaatttatctttkattttttttccccycagcaaataagacttattttattctaattacaggatgaacccaccacaggcatggatcccaaagcccggcggttcttgtggaattgtgccctaagtgttgtcaaggaggggagatcagtagtgcttacatctcataggtccgtagtaaagtcttgggttcctcactgtgggatgttttaactttccaagtagaatatgcgatcattttgtaaaaattagaaaatacagaaaagcaaagagtaaaacaattattacctgaaattatatatgcatattcttacaaaaatgcaagcccagtataaatactgctctttttcacttaatatattgtaaacattattccaagtcagtgcatttaggtgtcatttcttatagctggatagtattccattaggatatactcttatttaactattcccccttttgtagacatttggattatttccaacttgttcacaattgtaaacaccacyacactgaacagcatcatccctatatccacatgtacttgtaacagaatacaattccctaggaagctggaatgctggaagtcatggtgatgttctcatggttacagagaatctctctaaaactaaaacctctttctgttttaccgcagtatggaagaatgtgaagctctttgcactaggatggcaatcatggtcaatggaaggttcaggtgccttggcagtgtccagcatctaaaaaataggtaataaagatartttctttgggatagtgcctagtgagaaggcttgatatttattcttttgtgagtatataaatggtgcctctaamataaagggaaataaaactgagcaaaacagtrtagtggaaagaatgagggctttgaagtccgaactgcattcaaattctgtctttaccatttactggttctgtgactcttgggcaagtkacttaactactgtaagagttagtttccctggaagatctacctcctagctttgtgctatagatgaaatgaaaaaaatttacatgtgccagtactggtgagagcgcaagctttggagtcaaacacaaatgggtttgcatcctggccctaccaattatgagctctgagccatgggcaagtgactaactccctgggcctcagtttctctgtaacatctgtcagacttcatgggtccaggtgaggattaaaggagatcatgtatttacagcacatggcatggtgcttcacataaaataagtatttagtaaatgataactggttccttctctcagaaacttatttctgggcctgccaggggccgccctttttcatggcacaagttgggttcccagggttcagtattcttttaaatagttttctggagatcctccatttgggtattttttcctgctttcaggtttggagatggttatacaatagttgtacgaatagcagggtccaaccyrgacctgaagcctgtccaggatttctttggacttgcatttcctggaagtgttctaaaagagaaacaccggaacatgctacaataccagcttccatcttcattatcttctctggccaggatattcagcatcctctcccagagcaaaaagcgactccacatagaagactactctgtttctcagacaacacttgaccaagtaagctttgagtgtcaaaacagatttacttctcagggtgtggattcctgccccsacactcccgcccataggtccaagagcagtttgtatcttgaattggtgcttgaattcctgatctactattcctagctatgctttttactaaacctctctgaacctgaaaagggagatgatgcctatgtactctataggattattgtgagaatttactgtaataataaccataaaaactaccatttagtgagcacctaccatgggccaggcattttacttggtgcctaatcctatttaaattagataaaaaagtaccaaataggtcctgacacttaagaagtactcagtaaatattttcttccctcttccctttaatcaagaccgtatgtgccaaagtaaatggatgactgagcagttggtgatgtaggggtggggggcgatatagaaagtcartttttggccgggygyggtggctcatgcctgtaatcccagcactttgggaggctgaggagcaggcagatcatgaggtcaggagatccagataatcctggccaacagggtgaaaccccgtctctactaaaaatacaaaaattagctgggcatggtggtgcgcacttgtagtcccagctacttgcgaggctgaggcaggagaattgctygaacccaggaggtggaggttacagtgagccaaggtctcgccactgcactccagcctggggacagagcaagaccccatttcaaggggggaaaaaaagtctatttttaagttgttattgcttttytcaagtattcttccctccttcacacacagttttctagttaatccatttatgtaattctgtatgctcctacttgacctaatttcaacatctggaaaaatagaactagaataaagaatgagcaagttgagtggtatttataaaggtccatcttaatcttttaacaggtatttgtgaactttgccaaggaccaaagtgatgatgaccacttaaaagacctctcattacacaaaaaccagacagtagtggamgttgcagttctcacatcttttctacaggatgagaaagtgaaagaaagctatgtatgaagaatcctgttcatacggggtggctgaaagtaaagaggaactagactttcctttgcaccatgtgaagtgttgtggagaaaagagccagaagttgatgtgggaagaagtaaactggatactgtactgatactattcaatgcaatgcaattcaatgcaatgaaaacaaaattccattacaggggcagtgcctttgtagcctatgtcttgtatggctctcaagtgaaagacttgaatttagttttttacctatacctatgtgaaactctattatggaacccaatggacatatgggtttgaactcacacttttttttttttttttgttcctgtgtattctcattggggttgcaacaataattcatcaagtartcatggccagcgattattgatcaaaatcaaaaggtaatgcacatcctcattcactaagccatgccatgcccaggagactggtttcccggtgacacatccattgctggcaatgagtgtgccagagttattagtgccaagtttttcagaaagtttgaagcaccatggtgtgtcatgctcacttttgtgaaagctgctctgctcagagtctatcaacattgaatatcagttgacagaatggtgccatgcgtggctaacatcctgctttgattccctctgataagctgttctggtggcagtaacatgcaacaaaaatgtgggtgtctcyaggcacgggaaacttggttccattgttatattgtcctatgcttcgagccatgggtctacagggtcatccttatgagactcttaaatatacttagatcctggtaagaggcaaagaatcaacagccaaactgctggggctgcaagctgctgaagccagggcatgggattaaagagattgtgcgttcaaacctagggaagcctgtgcccatttgtcctgactgtctgctaacatggtacactgcatctcaagatgtttatctgacacaagtgtattatttctggctttttgaattaatctagaaaatgaaaagatggagttgtattttgacaaaaatgtttgtactttttaatgttatttggaattttaagttctatcagtgacttctgaatccttagaatggcctctttgtagaaccctgtggtatagaggagtatggccactgccccactatttttattttcttatgtaagtttgcatatcagtcatgactagtgcctagaaagcaatgtgatggtcaggatctcatgacattatatttgagtttctttcagatcatttaggatactcttaatctcacttcatcaatcaaatattttttgagtgtatgctgtagctgaaagagtatgtacgtacgtataagactagagagatattaagtctcagtacacttcctgtgccatgttattcagctcactggtttacaaatataggttgtcttgtggttgtaggagcccactgtaacaataytgggcagcctttttttttttttttttaattgcaacaatgcaaaagccaagaaagtataagggtcacaagtctaaacaatgaattcttcaacagggaaaacagctagcttgaaaacttgctgaaaaacacaacttgtgtttatggcatttagtaccttcaaataattggctttgcagatattggataccccattaaatctgacagtctcaaatttttcatctcttcaatcactagtcaagaaaaatataaaaacaacaaatacttccatatggagcatttttcagagttttctaacccagtcttatttttctagtcagtaaacatttgtaaaaatactgtttcactaatacttactgttaactgtcttgagagaaaagaaaaatatgagagaactattgtttggggaagttcaagtgatctttcaatatcattactaacttcttccactttttccaraatttgaatattaaygctaaaggtgtaagacttcagatttcaaattaatctttctatattttttaaatttacagaatattatataacccactgctgaaaaagaaaaaaatgattgttttagaagttaaagtcaatattgattttaaatataagtaatgaaggcatatttccaataactagtgatatggcatcgttgcattttacagtatcttcaaaaatacagaatttatagaataatttctcctcatttaatatttttcaaaatcaaagttatggtttcctcattttactaaaatcgtattctaattcttcattatagtaaatctatgagcaactccttacttcggttcctctgatttcaaggccatattttaaaaaatcaaaaggcactgtgaactattttgaagaaaacacracattttaatacagattgaaaggacctcttctgaagctagaaacaatctatagttatacatcttcattaatactgtgttaccttttaaaatagtaattttttacattttcctgtgtaaacctaattgtggtagaaatttttaccaactctatactcaatcaagcaaaatttctgtatattccctgtggaatgtacctatgtgagtttcagaaattctcaaaatacgtgttcaaaaatttctgcttttgcatctttgggacacctcagaaaacttattaacaactgtgaatatgagaaatacagaagaaaataataagccctctatacataaatgcccagcacaattcattgttaaaaaacaaccaaacctcacactactgtatttcattatctgtactgaaagcaaatgctttgtgactattaaatgttgcacatcattcattcactgtatagtaatcattgactaaagccatttgtctgtgttttcttcttgtggttgtatatatcaggtaaaatattttccaaagagccatgtgtcatgtaatactgaaccactttgatattgagacattaatttgtacccttgttattatctactagtaataatgtaatactgtagaaatattgctctaattcttttcaaaattgttgcatcccccttagaatgtttctatttccataaggatttaggtatgctattatcccttcttataccctaagatgaagctgtttttgtgctctttgttcatcattggccctcattccaagcactttacgctgtctgtaatgggatctatttttgcactggaatatctgagaattgcaaaactagacaaaagtttcacaacagatttytaagttaaatcattttcattaaaaggaaaaaagaaaaaaaattttgtatgtcartaactttatatgaagtattaaaatgcatatttctatgttgtaatataatgagtcacaaaataaagctgtgacagttctgttggtctacagaaatttacttttgtgcatttgtggcaccacctactgttgaagggttataaagccattagaaaagtagaggggaagtgatttggatcaaaaggaaaaactttagaaaagattcaratgttcccttaatcataaaagagaactgaggggactacttgaaaataaaaggttgttttgtattttcatgttggttaagatactgagtaactggtattaagtgttagaggtttttagataaatattctgcttaatgattatgaagctgcactgagatttctgaaaatgctctgtagctgagcttatttaataaatgttcacttggtataggggaagctacaaaggcagccttcagtgtccttttgtttattcaaccaaaaatataaggacacaatgtagcagttatactgggaaggtgctgggggtggtggcaatggtgagcaggaaggcgaagtagatatggaaacagaaatgatactaatatcggtgattccttccttttttcctgtaataagtgctgtgcagacaacatatgagcagtgctgataaatgtaaatgtatttttcatagctcattaagaatcagtttcagaaagagatgtctgcttattttgctacttgaagaatccctgtcaaacagtccttttgaggaagtacaagaggctgtctctatttgtgacctcaggaatggctgtgacagtgtcgtgagcagtccttttcctgtggcacagatctgaactttgtgtgcagaaaaatcttggcttcaagtgagccaagatgccccctgagcatcagcatcacaacttcatcctcctatcttgaagttcatgttatagtgactttaatgaaatcatagaacactgtttcttcgtgaacaatgacgagggagaggaaaaaactttattgaaaaataaaaaggcaggtaatttagatgaaaatatgttacccatgaggttttgtttttgctttttgtttttgtttttgagaaacagaatctcgctctgtcgtccaggctggagtgcagcggcatgatcttggctcactgcaacctccgcctcccgggttcaagcgattctcctcagcttcccaagtagctggtactacaggcatgcgccaccacaaccagctaatttttgtatttttagtagagatggggtttcactatacgttggccaggctggtctcaaactcctgacctaaggtgatccttctgccttgggctccmaaagtgctgggattacaggcatgagccaccttgcctggccctacccatgagccttgactaaaacattcttctatctgtagaaaagcccaaaagaacttttccagattcaaaaaacttggcactttgtaatggtaatgtttacattaagtaaaaaaaaaaaaaaamcccacttagcttcagttttcaagtgtttactgtgttgtcatgcacttcatttaattctcaacacctgccctatgaggtaaaaagtaccattttacatatgagtaaattacagctcagtggataagaaactcgtccaaaggtacaggttcagtcaagtggcagagggttctttttgttgaagttaggtatcagttaaaattgaccttgtaaaatcacatcagcatcaatatacattaatttaacaaatatttattgaactttactgtatgccagatacttctctaggtactagggggtacaatgtagaagaaaatagaattcctgctctaatgaatttatatttcagtggtgaaagatgatgtgtggacaaacacatctaatgtattttgacagcaatgggtgctaagaagaaaataagacatggtaattggataacaatggagagaagtcagagatggccttttctgaggagtgacatgctcagaatcgaataaaaagagcaggagcagcctttcaaggtgggtgcgaaggatattcccggaagaaagaataagtgttgcaaaagccccagtgggaaaaagcttggcaagctgaggtggtaaaagagctatctgtactaatgtctcttgtactgagttagcaaggacaagagtggcagggrgtggaactggagagatagcagggaccacatctcacaggatctcgccagcctttttaaggtatttggattttattgttagtgcaacaaggagccactggagagttttaaacagtagtggtgtgacctactgtttcagaaagaacactggctactatgggaagaaaggacagtaggaagactaatagataatggtggattgaactaagatggtagcaacagatagggagctatggtaatgttcagtatccactttggagayagatccagcaggacttgctgacagactgcatgtaagggctgagggaaagagagctagcaaggtgacttctagtttgtgacctgaactaggtagatggttgtgttaaaaatgcagtgggtatttcagtctgaagctcaggggcaatgatggaaaataagataaatgtgtgcaagytggctgggcgtggtggtgcacgcctataatcacagcactttgggaggccgagacgggtggatcmcttgaggtcaggcgtttgcgaccagcctaacatggtgaaaccccatctctaataaatacaaaaaaattagctgggcatggtggtgcatgcctgtaatccaagctacttgggaggctgagacaagagaatcgcttgcacctgggaggcggaggtttcagtgagctgagatcgcaccattgcactccagcctgggcaacaagagcgaaactccatctaaaaaaaaaagtgtgcaagttattggtacgtatatatttaagcctygggactgaatgagattacctagagagaatgaagatagggaacattcttgagcctgagatcctataacatttagaagagaagctagccagggaaattgagagggactggccagtgagagagagtaaaatctgaagagtataatgccatatgttgaagctcagagaattattgtttcaggaaggcagaagttgtcaattatrtccaacattgctgagaagatgagtaaggaatgtaaatgagtaaaggcaggaatggctattgaatttgttaagacagaggtccttggtgaccttcmtaagagtcatttcagcatgacaaggatgcagacctaactggaatagattttcagggaagactgagaggcaaggaaggggagactgcaaatatatgcaaatctatatttttgctttgaagggaaacagaaaacaggacaacagctggtttacagaacttttatttggattctttccttgtctgttaataatataggctgcacctgggcatcatcgtgcccttcctttttgattctgctgttttgcttttaatcctacaggcatttcttctggcaggagccttgtacacactctgggtggttcatgaccaccacggacttgccctttcaaggcagaagcctgtgattcaaaaacttccattccttccaatcgactattataaaactcattttgtctagtgcccatactcctttaccttaggatcctgggccaactgtcactaaagaaaacaaaccatttcctcctcctgggggaatgtgcttctttcaagaaggtgcttagagaatagacattctaggtgacagcagttatgaaagaggtgtctctaatgaacctaacacttcttccaacatactccaggttcaccctcctttgaagacagaaagtactacaacttcagttgccaccctagtcaggttcataggatttactcagtaggttaagagatggtgctgagaatgaagtccagagtttgagtctacaagtggcatttgcttctcctttgggacttctgtggcagggtgtggaaccaaatcagattggttgcatatctgtttctcttcctgaaaatacaattcaaataccttcatagtctgtgacagcaacttataaccaacagrcaatggtattatttttatttattgatggcactcccccatagccagaacttctactgagtcattcatcgtgtattccaggaatactttccaaatggagtagtgaggcacttccaataacagttatgtaatctgttaacagtggctcaaaatgacatgtgaaggaatgatgtacttcttttttcagactcacagatctcatatgttaattcagtcaacaagtacttagggcttatcacatgccaggcacaggtaatatgacaataatgaaaacaaaaacccttgctgtcatagaattcggtttctagtgggaagagacatacattaacaaatcatatataagtaaaacattaattatggtgataacagaaaaagaaagcaggggagagggatagtgtcttagttcaggttgctgtaacaagagtaccatagacagggtggcttaaacaacaaacatttctttctcacagatctagtggctgggaagtctaagaccagggtgccagcatgaagaagttctggtgaaggcttacattctggtttcctcacagtgagggctcttcacgcccttataaatgcactaattctattacccacatgacctcatctaaaactaactcacaaaggccaaacctcctatgttgagattaaggcttcaacataggaattttgggggggacaaaaacattcagtctctagcagataggggccactgtgggaggggattacaatcttaaatagggttgtcagggaaggcttcatgagggcaaagacctgaggaggcatggaaatgatccacgcagatgcatgtctggggaagagcattccaggcagaggcagtgggaatggaccctcaggtaagagcatgtttagcaagttcagagaaaagcctcttaggtcaggtctggagcgagagtggaaaatgtaacaggacagatcatgtaaagayttgtagaccacagttagaggcttggacaataactctgaggatgacatgaaggtattgggagggggtgttgagcagaggagtgatatgatctggtttatattttagattattctgactgctatgttgaaaatagggttgagagcagaggggaagggcagcacaccagttaagaccacttcccaaaaatccagatgatgatgggcttgaaccaggagagttgctatagggatgtgaagcaatcaaattctagatatttgggacctgctgacaggtacataatggtgtatgagagaaaaggcagtgtgagaatgactctgaagtctgtggcctgagcaaaacagaaacctggagttgccaatagctgagataaagtttctggttaaagatcaagagctcagttttggacaagaggggtgtgagatttctaatagacattcaggtggaggtgtggggaacacacctggatgtgatgagcctggaattcaaattcacatgtgtgaatttgaaaaaagattcagaaaagaggtgtggactggaggagctatccacacacagatagcatttgaagccacaagactgggggtgatgacgcagggagtaagtataaatagaaaagagaagtggtccaaggactcagtccttacatcagaggtcaaagagacaagatggagactaggagatatgaaggcttrtgcagtgagtgtttcggagaaacgaagaaacttyccagaagaaaggagaggtcaactgctaacaagtcaagtgaaatgagaactgggaaatgagttgacaagagcaatttggctggcgtgatcagagaatgtttaagagataatgtgagggaagaaaatggaggcaggaagtatgaactactcttttgagtcatattgtaaaggaaaaaaatggggtgattttactcttttttttttttaaagataggaaaaaaaagtatatttatatgctgaggagaagaatccagttgaaggggaatactgtggcttcaggagacaggaaaactgcctaagccacatccttcagcaagtgagtgttcaagtggagggtttgtctttgcttggggcacgggcggttcatccacagtgaaaggagagaaggca

SEQ ID NO: 13231 - DNA, 52192 bp, Homo sapiens
gtggggacggagacgggcaaaaccaggaggaagagagctcccccgacccggcagtgttcccggctcaggcgcttggaagggctcctgagcatggagggctgcgggaggccagggagataagggctcgagggagggcgcttgggtggggtaagagctgtagcagctctgcccactggttcctagagccagctcaggggagcaggcagctcggccctgggtcccacaacatgtgcagcccagggaagagaaggctctgctttccaggtgtggagccgaacagagatcatcgctccaccctaaagcagtgtggctggaggagtgaaatactctagaggcttgagctccaggtcacagtgcctttgggtgaccttccgctggtcatgtgtttcctcaaggatccgtttcctcacctgtgtggcaggatagtttattgagtcatgaatatctgttcttatccaccctataaccctcccctcttgccactttccaagcggctctccacgttgcaagcaaaaagccgccgaaagtcatctttgagatgagagtgagtatcttagactggaagcatctcctgccagcccggagatgacagaatgtcctgcaggccactcccttggaagcacctctggaggtggtccagccccgagcttcccagcctcagattccagcacagtcttggggtgcacacgagcacacaggctccaacaagggagtcagggagtcagggcccctactatctccaggctccatctaagatgcctggattttggtggggggtggaagtggaggaagacagacccagtaactgggatggaattcactgccacctacccgtgtgacattggcttaaattaaattaaacagatctaaggcagacaccaagatgctctttctggtggggccgagtttatagacaggactcctaacccttctgcttgttaaccggcataataatatccccattggaaaatggaagtgtgctttgcaaacggtcaagtgtcaaacaaacaagaggcgtgctctggactcctccatcccgggtcccatgggaagggggtgcacagaggagggccggctcacgatgttcccctctagatggcaacagacagcccgtgaggcactgtaggaacagcacagggcagaacagcccgtccgggacacccacctccccacccccggctcacactggccaaagatccagactgacaaatgactcagacacacaaacgcccggggctaagaggaaacacggcatggcccggaggttgcagggggcagcactcacagggatggggctttctgctatgcctacccctccacccagccatgatcagtggcctgaaatggtgtcatggaccccctcccatgtttgagcacttgctgtataccaaattcttacagatatgtttgtactcttaaatggttatgaagatcctgtcttcataggacgaaaccagggattctaggggtcaattactgttgatgtcaccatccttcattattattagataatctggccaaactcatacactaatcaacatcagtccccatcacaaccacaacaacgactgctgacccttccgaacccactcccagcctggggggttgcagaagcaccgagttccagaatttcagcctccctcccacaacgtccaacgcaccccctcgaagcacagcctgtccttcttttgagctggctctgtgtgatgaagggacacccagcaaatggcccagacccatgggcattcgatctattttcggttgcagtccctttacctctgacacctgtgcctgcgccagaccccttcctttcctggccggccatccgaggggtccctggtggcctctgggaagagaggaactgcagaagtccctttcattttccagctgaggtgctggctctgggccgatgctgccrggcaccccacaggaggtagccgccctctctggctcagtcaccagcacgagggcagggccactcctttggggctgcttgtcacgggtgccctttgccagcctccaaggacatccttccttctctgtccctctcccctgtcctcaagccccgtcccattttgaacctctgcatagcaggattcagattcccttccaagcgcatcagaactaaggctagctctggctgggcatggtggttcacgcctgtaatcccagcacttagggaagtcgaggcgggaggatcacctgaggtcaggagttcaagatcagcctggccaaaacggagaaaccccgtctctactaaaaatacaaaaattagccaggcgtggtggcgcgtgcctgtaatcccagctactcaggaggctgaggcaggagaattgcttgaacccgggaggcggaggttgcagtgagccaagatcgtgccactgcactccagcctgggtgacagagaaagactccctctcaaaaaagaaaacaaaccaccaaaaaagaactaaggctagctcatctcaccagtcctttatgatctaaaccagtgctgtccccggtggcagctgctggccacatgtggctaatggagcacttgaaatgtgacaagtccagattgagacgtaccctcgatgcaaaatacacaccagttttaagacctggtacaaaaaagaatgcaagatatctcaataacttttattttgattggatgttgaaaggattatactttagatatgttgtgttaaatatattactaagaatagttttacttatgttttcttttatttcatatggctactagtaaatttaagatcataggaggggctggatgcggtagctcacacctgtaatcccagcattttgggaggccgaggcgggcggatcacctgagctcaggagtttgagaccagcctggccaacatggtgaaatccggtctttactaaaaatacaaaaattagctggcagtggtggcggatgcctgtaatcccagctactcgggggctgaggcaggagaattgcttgaacctgggaggcagaaattttagtgagcggagatcacgccactgcactccagcctgggtgacagaacgagactccgtctcaaaaaaaaaatctgaactttgtctggatagcgacggagggtgtctgagcaaagcacgatgttctcagagccatccagagactgggaactctgtcctaccaaaatgggtgcacccagaggagctggaagatagagatgccctgtgggtgactcatctggttgccccttggtggcactgagccaggcaacaagcgggaaaggcttgtcaatgataacggcaagaccaacgatcaccaggcrgccaggtgcacccggtagccctctgtgggcaattctgcatgtatgaccttatttagtcatacagctaggcaaggaggtgacactaagcatttgagtactgatggggtcttgaatgaacaagtaaatgaatgaatgaatggatggtggccgatgactgtcatctctagttcttacattatgtatcttatgyatcagactacacggcatggatattcagtgcaatggatttgattgtgaattgaggcccccttttgcaatcttgttgcatgttatgttcgtggagctcctgcaatgagcagaggctgctaagcagaagcagcgcacaggctgggggcaggacacagggcccccggcctcaggggagaggtctgttccagccacctcaagtctattcctgtgagtgcccctccacacccctcctggatccccccactgcaaactctctccccctggctccggactctctccccgtcctggaattaataaagactctgtgcagactgcggtttgcaagtctgaaagctggttcctgcccgygtcactgcctcgagaagagagggstccagctccccacagtagcccctgccttcctccttcccaggcaggcggaggcacgcagatataccattgacttcccctcccctgcagcaggcacatcctgggcatygagcttcagaccctgcccctgagcagcccctaaccccaccaacaaagggtggcttgggggggctttcaccccagcataatctccatcagctaccctcaaagcacccccaaataaacacacaccgtaagtaagagctgtacactggctgtgtgcgtacatcttcaagacaattctcccagcatgcccctaccttccaaaattccagagctgctccctccaaagacccagggaaaaggaagggtttgtccagggtcctggggtggccccgtatagaccaaagcctgatarctgtcctagaagcagagtacttgcagagcgagtgamggcaactgtggtattgacaccagtcctagcaccagctgaacacagagcatttttgatctagcagaaatacaagaccacgttgtatttgtctttgcaataatctcttagctaggaatactgatcacctgtagacagataaggaaactgatgctctgtggagaggttttcctaccagaaaggctagagccagaaatttacttctaggtccaccaatacctgcctttgaccaatgcctgcatttgacctttccacgctgagccacccctgctggcactccagactgccacagtgctcctgcctccacaaggggtctttaactcatccctcggagccatcgtggtgcagggaaaagcccacagggcgtgtggcttccatgctgttccctgactggctgtgacctaggacaaggaacaagtttccctctcctattctctaggtctcacatttcttctcctctagcagtagtgggaagtgaggggtgggggacacgaccctcccctgttccatcccacactccaacccccaaaatcccccagggtccccgtccagctcagtcctgggggcagaaatgcagagttctccaggaacgtggtcccagctgtttcagtgcaggccgccccctcctggccaccagcggaatgtcagccttcccagaggggccgggagaacagcagtcgagaagctcccagactggtgtgggcgctagctgtgctcagcgtggggatgggaggtgacccagtgataatgggaagctgggctgcctgtcagtctgcggggggctcccacctccctgttcccccacagggcacctggggatccagcctgatttttaccagaccctgcggcctgcatggggctgggtatagggctgtgaccttgacccatgcagaatagaaccctgtgtgtcgggatcctccatgtgctccagatgcccctggggacagcaccaacatggccttaactcccaagccattcccctgcctctaaccccctggcatctgcaggcatccaccccagacccacccaacacctcctccccagcttcaggcgctaggcagagaccttggcccctgcagaatgcagccctgtccagggtcccctaccttccccccagatccctcccagagcaataccaacccgggcctaccttccaggccattcaacctgcagccccccggcctctgtagacatcgcaccccccaaacccccagacctgcccaatgcctcccctccccagctttgggcagaacctgtctctagccagacctgggggtgttggggagtctggagggccggggtgggggctgaggcgcgggacagctggcccgtatcctcacactgggcccggggcccagccggaggggcgggggcctggccactcgggccttggctggggctgggatttttggcctggccgccaggccctcccttctgcttcctctcccgagggctgtcctggcagaggcccccctcgctctttctggcgggaacagggccagcagcgaaagaacagtcgcagagggaaagcgggaaagagatgggggaaagtgtgtgtgtgtgagtgtgtgcttgtgtgcatgtgtgtgcgtgtgtgtgtcaaggaaaaaagctcgcagtccagcagcccgggcctgggaggcttgtgagccgggcctttcgtaattgtcccctccccgcggccccctcccccaggcctcccccctctcccgccctcccgcccgccctctctccctccctctttccctcacagccgacgaggcaacaattaggctttggggataaaacgaggtgcggagagcgggctggggcatttctccccgagarggcgggtctgacggcggcggccccgcggcccggagtcctcctgctcctgctgtccatcctccacccctctcggcctggaggtaaggacccctcgcccctgtccccagcgctgcccacagctgcgggccctttgggccaggtgactagacgctcaagggggagaccttcgtccctgggaactgcaaggggtcccaggtgggagcccctcagccactgggtcctcggaactgcccctcccaggagccagccccgtgcccaggaggaacctgtcaaagagacaccctcgactcagaatagtcccagcccagcatccaggctttgctgccctgcgagggctgagggggcccctgctcaggtgcccgggtgcccgccctgtagggggatcagagcatcctgggggagggcccagcgggaacccctgggtctggagacaccacagtctgcacacytgtggacacagctggggtgcacaccagccctggggacagggaacctgggcttgataccagctcaaccgcagtgagctgtgtgacctcagcaggttccttgacccctgggaagccgggatccccccgtcaggaaggtcagggctccgctgaggatgggtttgcaggttgggaagctgctgctgtgttctccctgctgaggcaggcagggactcctggtatgcatttgtgtgtgtgtgtgtgtgtgcatgcacacaggaatgagcgtgctgtgtgctcrtgtgtgtatgtgtgcatgcacaggtgtgcatgtgtkcagatgcccggctgtgtcactgaacagggaaagggatttctggaggggtacatatgtctgctcacaggttcatccttaggcaggtgtatgcgtatgtttggaggaggtatatgaagctgctccttagtgtgtgcaaaagtctgccacctgacagacatgtagacatgtacacatgtagacatgggcgatctggcatccaggtgtgacactggtgtggactgtcactgtgtgtgttatggagtgtgtacatctgtgtgtgtgaatgtgtgtgcgatgtggcacgcaagcatggaaaggcgggctggagaaggtgtctgtctcctggcagaggcagtgtggctgagacagaggctggagtggatcctggggcactgctgggccatctgctatgtgccccaacccaggcacagttggttatggggtttgagggtgtgccctgtggggctgctatgccgcggccaacgggggaggacagaagaggctcccgggcatgggaaaaaggagggcatttggtaggggggtctgggtggagtctggtttcctcgggagtcctccttgccatgagaaccaaacgctgagtggggggcgggagggccacggggtggagtcaagggcctgggcaggagctgcagctgtttccgtgagattgaacagcttcctgtgcagggtccgctgctggacctggatgaggccaagggacatgggtacccacaggcgggccccagcaggggcaacgagccagggcctgaaagcagcagccccgggtccgtctcagcctcctccccaggtgtagcccccaaacacccagccacccttcttcccagatggggccaccacctatagggtggcagttcatcatcaaggaaccttgagaattagaaattattatcatcacttgacaaacaaggaagctgaggctccggcaggctaaggcagtccccgggggttagtatcagccagctctctgccccaggtcaaggggcaagggggttaggagtgagctagcaggcaacatttggggaggggaaggcttggggctgagtccttaaagcaggcatgccctaggcagaatcagctctctccttgtgtcctcagtgacaccgctaaacgcccagctggcctcacactttgcagagatcaatctcagctctgtcccaggtggctggacttgctaggtccaaataaggggtgtgtgaactgatgagctcgtgtggggttttgcacagaagtgctactgaagtctgcagaggtcggggagccaacacagggagtggagcgctcagtcacatgctcactgccactcacctggctgtcctgggggagcctggcttctccctcaaggaggagggtgtcacttatgcaagttcagcggctccaaggaaggaaccctgttgcgggggtgggggagcaggaggaggggacaagccgcacagctcccaggctgtttcaaaagtgagcatgagaaattaacccagggataattcttccccatcccccagaaatagtatcagggattttttttttttttttttcctgatttcagaactgaagatggtttggaacagaggtttccttttcttttattttccttttttatttttatttttttaccttttttattttttttaaattgagacagggtctcgctgtgttgtccaggctggtctgaattcctgggctcaagtgatcctcccacctccgcctcccaaagtgcttggattacaggcatgagccactgcctctttttaaatatttttttaattattgttttccgtccttaagtaggaacaggggttttcaacctggctatctattagacttcccacccaagaayccctgcttgctttggttggagagggacctggacacagacttttcaggcttcccaggtgacggtggggtcgccagggccaagaagcactggtttagaggtcgatcccgctctgtgtgtctgccgaggccccggcatgagggcaaatgtgccctgtgtgggaggggacacagtcacccagtggaggacagcttgtttttgaaaacccttggcagccttctgcatgcaaacaacaaacagcttcgtgtggtcttatctgctccccaagccagccccctggactttggtttggcaaagccccctgccaagatcggctggccccaggctcgctcccaaacaggctgcttccagctctttgaacctggagcccagggcccaggcaaatggccctacatgtgacttggggtcagctgggggtcccagaccaggctcttcagctcactggttctccatttccctggctgcaaaatggggagaaacagccctgcctgaagtacctcctagggccagtgagagcttctagcaatgtaatatctggggggaaaaaaagcatcaaataaaaggaccgtgggaatgggcatttttaaaataatctattctcttattcagagtctgctaatttgggctcatggatccttgtaattagtgcacattgctaaggtttaatactccctctcrctacttacaccatgttttgtctagtggaggggcagctaatgtgtaaatagatgtgcaatgatgaaagaagcagacaggactcggttgggggtggccagaakgagccttgagaaatccaggaaggcttcccagcagaagtgacatttgagttaracctaaagagaaaagtaaatggggccaggtgcagtgactcatgcctgtaatcctagcactttgggaggcccacatgggcagattgcttgagcccaggagtttgagamcagcctgggcaacataggaaggcccccgtctctatttaaaaaataaatgaatatttaaaaagaaagaaaaagaaagaaagagagagagagagagagaaaggagagagagagagacagaaagaaagaaaggaaggaaggaaagaaggaaggaaggaaggaaggaaggaaggaaggaaggaaggaaggaaggaaggaaggaaggaaaatgttggaggacctgtctgtggatgaggggtaagtccccagactacaggccctggcaggcagaactgaagagacagaagagcagattctcgattggaggaagccctgtctgcagttagtgctgacagcatttggaggtggtgattttcccatcatgggaggtatgcaagcagaacacgaaggatgtttgtggaaggaggtccagcccaggccagaagactattatgatccctgagagtctaggatcgtgattctaagatgcaagagacaagttccaccctgggctagtcggtgaaacatgccaaaaccacataaaacaagacaagtgttctccaggccaactgcttagggccagctgagcagcacagtcagggagagccgtgggctcgggaaaggcaggcgggagagtctgagctcagccctggtgcgggggtaggacttggacagaggcaaggacattcctggcaggagaaacggcttgtgccaaggagtggagggagaagtgaggatgccccacggggcctggggaagcagctgttaccttttcaaagtcctttccaatttccagctgctgtcattttattctcacctctctcacttgcagagaggcaggaatccttcgtagcccctaaaccttctccatttcctcattgcaaagtggggattaaaacctcgggctccccaggccgtcaggttcaggcatgaagtttggcaaatgccaccatcatcagggtctgaacggtgggggtggagagtggggacagaggagatctgggggaggggaagctaagtcttccccccagaaagtgcctggggtgcaggagggcagaaccccaggagaaaggaagtcagggttcagccaggcccaggggctcaacaagcccaaggcagggggactcccagggcagatggggatgaaacaggttagagctggattcacagacaaccaccctgccacccctctacttaattcacccatcatgtattgagtaactactgcatacctggccctgggccacggactgtgcagtgaaatgggaaaaaatgaaacgtaagtgccactgtctttttatttttgagcaattactgtctgccaggtccagaagaggacatagcctattacttgaacccttttacaacttgcagcaaccttgcaaccttgcagcaaccttgcaaccttgcaacaaccaagtgattatctgccccatgtcacaaaaaaggaaaccgatgttcagagaggttgagtgactttcccaaggtcrcacagatggtaagaagcagcgaaggcagaattagaagccagaggggtctgttctgagcactttgctcttccccccacctccaccacactgttccctgcagtctgctctggagccagagagtagagaggaagggagagaggcacgtgaagaaygagggagagggggagaaagaggaggaaggagagaggccgaggcagagaaagacgcataagagactgttgagagctggaggccggagccagggaaggcatcagaggcccgaggcgggccatgtgtgtgcttggcagcggatgacagggcccaagtgctccttctcagcaggcccagcccccctggggccaccactccgagccttgaggttctgaccagattacttgcacacttcaggcctggactgcagtgcctgaggagccacaagccctgggagggggtggcgccggggtcttggctccggtggctgtgacagctccacagccctgaccctgctgggctgcagctgaggctgacagggccctggggccagcaagcccagctgtgcagcgtcgccaggcctcagaggccagacgtctggccgcgaggcctccctggacacattgcagagacacccgttcccccagccccgcccatgccccacggggctcccggcccctttcagcaaaagcagtaagggagggctgggctggggcgttggcaaggtggcttgtcaagctcagaggggggccttctgaggtggaggcagggcccccggtttgggaccctgtctgttgccatggcgatggctcaggcagggtctggatccagcatcacagygttccccagtgagagcttcactggtccatggggactgaactcgtgatcctgtctggccggtgaattcgcttttccttaggaaactattcactgtgctcattcatggcgtccccctgcggccccggcgcctcctaagacagcccgtgtcagacggccagagccccacccaagctcggctgcccagtggctgaggacgctgacctcacgccgtcctatcagtgtgggaatggctgcatttgtgctggcagctgcacctccttaatgctcgctgtagcagcccagcctgcccttcccaaagctctggcctctacccggcagctcagctcgggaagggagtgggctgcctggtgagaggtgctcagacccagtgtcttccaccccaggccctctccctgactccagggagaaccaggtaacacagcaagaacaatcatactctaaggactggcagcagggcgcaggggcctgtcatcctagcactttaggaggccaaggcaggaggatcgcttccaggagttccagaccagcctggggaacatactgacaccccatctttacaaaaaaatcaattagccagatgtggaggtgcacgcctgtagtcccagctacttgggagactgaggcaggagaatcgcttgaacctaggaggcagaagttgcagtgagctgagatcttgctactgcactccagcctgggtgacagagcaagactctgtctcaaaaataaagcactggcctgagcttcaatccaggccccgtctctttccagctgtgtggccccaggcatgtcccttaacctctctgagcctgatttcatgtcttaagatgatagtctctgggagcggtggctcacacctgtaatcccagcactttgggaggccgaggcaggcagatcacttgaggtcaggggttcaagaccagcctgcccaacatagtgaaaccctgtctccactaaaaatacagaaattagccgtgcttggtggcatgcacctgtaatcccagctactcaggaggctgaggcagcagaatcgcttgacccaggcagacggaggttgcagtgagctgagatcccaccactgcactccagcctgggtgaaaggccaagactccgtctcagtctcaaacaaaacaaaatgatgatagtaagccctgcccttccaacttcacaggccgatttcaaagagcaagaatgagaacacactttgtaaacagaaactgctctggagacaagcaatgtcattattgccatcagcattattcttgtttccatgtaattgtgggttttgccattgaaagtaatggcaaaaatcgcagttacttttgcaccagcctaatagttctggctcctggaggactgactctacctgtttcctttcaggggtccctggggccattcctggtggagttcctggaggagtcttttatccaggtaacgtacatgaaacttccacacacccaggtcatgcggatgatgctgatgtccataatagatgcacattttgacactacagaaggtaggaacattgacacrcctaccagaagtcacacccacttaaaaatgcaattaacaagacattgatttacagctattaagagcatacaggctggacatggtggcttatgcctgtaatctcaacactctgggaggcagagaaacaaggattgcttgaggccaggagtttcagaccagcctggacaacatagtgagatccccctctctacacacacacacacacacaaatttaaaattagccatgttctgcattgagaaaaatgaaaatgaagtatagaaattaaaaaaaaattagctgggcatagtggtgcacgcctgtagtcctagctactggggaggctgaggcaggaggatcacttgagcttagsagttcaaggctgcagtgagctataatagcaccactgcactgaagtctgggtgacagagtaaaaccctgtctctaaaaagaaaaggggaaaaaaagaaaagaaaaatcaaaagtaatactttcaatacttaaaaagtatttgaggccaggcacggtggctcaagcctgtaatcccagcactttgggaggctgaggcaggcggatcacaaggtcaggagatcaagaccatcctggctaacacggtgaaaccctgtctctactaaaaatacaaaaaattaaccaggtgtggtggcgagagcctctagtcccagctactcgggaggctaaggcaggagaatgatgtgattgaacccaggaggcggagcttacagtgagccgagatcgcgccactgcactccagcctgggcgacagagggagactccgtataaaaaaaaattaaaaaattaaaaaaagcatttgagtgtacagaagtgacctggaagtggggagagacgccagcactcccccagatacatactgacactggactactggccaagcagaagagaaaaccgaggcttgcagagagcaggtcttgcccaaggtcacgtagttaggcagaggtggattcagccatagctgggggtggcagcgggcttgcctggcagaagtaccgatgatctctctttctctttctctccccccacaggggctggtctcggagcccttggaggaggaggtgagctcagaaaccacacttgttcatcactgaaagggcctgggtttcacccgagccacatgcatcctcagacctgagaaccctgggagacccgagcatcaaggactccctcatttcacagacagcatccaggcggtgggaggaggcttctttgagaaccagaacccattggccttcccagtccctcccctagactttatgtctggtgccctctgccttcctatttcttcttttttttggtgggggaggacggggggacagagtctcgttctgtcgcccaggctggagtgcagtggcgtgatctcagctcactgcagcatctgcctcccaggttcaagtgatgctcctccctcagcctcccaattagcgaggactacaggcgcgtgccaccacgcccagcttatttttgtattttttctagagacagggtttcatcatgttggccaggctggtctcgaactcccaacttcaagtgatctgcctgactcggcctctcaaagtgctgggattacaggcgtgagccaccttgcccggccccttgcccggccccttcctatttctttttatcctcaaaaacctccctgccaagccggctgagcaggcaccatcttcttttttttttttttgagacaaagtcttgctcttgtcacccaggctggagtgcagtggcgcgatctcagctcactgtaacctccacctcccaggttcaggtgattctcctgcctcagcctcctgagtagctgggattacaggcacatgccaccacgcctggctaatttttgtatttttagtagagacagggtttcaccatgtttgccaggctggtctcaaactcctgacctcagatgatccgcctgcctcagcttcccaaagtgctaggattacaggcgtgagccaccacccccagcccatcatccccttttgaggctgagactctgggactcagagagtataaaccacgagttagaagtagagctaggttcccaggggctccaagtctgagcgggaggacctggggtgtgtgattccacactgcccacactttgcccgggttgggggttggataagtagtagatggataagctgggccaccccattcactatcttctcttccctctgcagcgctggggcctggaggcaaacctcttaagccaggtaagacccaaggcctcggagcattgagagacagcgagggagctggggagggaggagcctacccagctggraatgggacaaggaaactasgaacaggacaaggaagccaacgggcaggaggaaggagggaggtgtggacaccgattagcctcccaaggatgagtaggccggggccaggtcccagggcttccagraacaagaggctggaagcagctccatgtcctccctgtgtgagggcgtctagcatctaccctacatgtgcatgtgtgttcacccagctgtccagagactcctctctgcaaaggagaggctgttagaggcaacatcagggattgctccggttccagtggcctccaagccttacatgaccctcgggagctcagacacagatcctcagccccagacttcccctgagtggtcccctagcccttgaccccagaccaataccccagatcaccctgaccttgatgccattctgagcccttctcctgactccagatggagcactggtctcaagccaaagcttaaccccagcccaagccctgagcctaatcccaggctgaaccctgaccctgctgaccctggtcccacaggacccccaatcctggccttaggccaagccctgaccccaagcccaagctgagcaccgaccatggccccggataagctcccctcctaatctcaggccctttccagctgtgtccagaccacggagttttccagtaagaaggtgtggccggatctatcctggcctcgcccaaggggctgggatctgccacgagggtccactctcagctctggggaatgcacccccaggaaggaaggtggggcaggtccctccrggaaatactggcggataaggagcaggtggaggaaacagcgtctctgtccagattgatggtccctcggcatgagacgctccacatgtgactttggccgccccacaccctgagctgtgttgccctggctcagaagcccaagtctccaggacacagtttagatgtccaagagctcttatgaaatcctgatagttgataatccaagtgcaaatgaatcttcaagacccagattcccctgcgctaaaagtccatctgggttgtgaaacaccagggctggagccaggagaggcgggagaacggggtgcctggggtctacagggctctgcaaggccaggagaccctgggagcttgccacttatccccgccagcacctataccctgtcttcctggagcaggtgagggttcttagcagggtctttgacggtgaagagaggacaggggagatgatagtggtgcagaggtgtggaggtaggtctgtgcttggcctagaagacccaaattgaggaggttgtgcctgcaaagctggagggtacattcattgatcccactaggagcaagagacacatagcaggttgtggttaaacaccagaggaaagacagacaactccctacgaagttccaggatgtgtagttgcaaaagtgaagcttttgttaatgaaagatttaggttagacttctgaaagaacttccagctcagggtgaaggagtcaatccaaaggaaagtcagagcatctccttctgataaaaagggcagtgtttccaggcaaggggctggattccatgacctccccgaagactcagggctacagaagggtcggcagagcccccatggcacccccagggaggcccccacatccgggctgccaggacgtctgggcctgcccaggcaggatggaatggagcacaggcagcgcgtgtcatgcttgggaacaattaatcccttggtgacagagggtgggtggcctggcagctgcttttccacgtgggcgccaccacaggtccaagctggccctgccctgcctcagctctcagcgggggaccaggcagctggaagcctgcacacccaacaccctgagcactagccagaggccagccgcccactgagaggggcacgggcatggacaagaaggaactgggagcacccactgtgtgccctgggtaggttgcacaactaggtgctttctgcacacatgctcactggtcccagcaaggcaggtgatataatggccattttgtagatggcaaaaactaagcctcatcggagaggcaaattgacctgcttgtgctcatrgaggctgggtagcagcagcagggtctgaatctagaactctctgactctagaaagaaggaggatggagctggccaggtccctggactcccagctgtggtcagcccctccccgctttctcctcctttccagatgctagaatccttggggcatttggggcaggtgagtgcaaaggaaggagggcaggcagagacagaagtggtcaggccacakgacaggatgctcaggctgggatcatgggaaaaaggaagatggccccagagaagctgcctgccccycactgcagccccagcctcttctcacttcctgtgcagtcctcagcttcccctcccagcccctctgtggacaggaaaggtctgagcatgtcccttgccctctcagagctcaggaaacatgcctggcttgagagaagcgactgccagcgcaggtgggkctggcccgggtgctgggaagtgactcctgcctgatcgccaggcactcccgcccggaggcaaagatgcttcttacatgaggctggctgagtttcagaggggtccagctcccactagtaggaaatgagggacgaggagtggttagtaacggagaccacacccarggaaagccaggggggacctctccagggtacagcaggctccatgtttgggatccatccctggagaggactcacccctgaggctcaggactagcacttgtaggagagatcgtcacataattagaaacaaacctggcatggttgtgaactctgacctgatggcccattggtcctggccaaggcagtggaatgtctcccgcagtgggagacgaagcgattgggcccagatgtggggaggagagagccagagggacccatttggcgtctcataaacatcttagtaggaggctcctgggctgcagggcaggctggatggaaggacagatgggtagtggggacacaggagttccccgatgcaggtgaaggggaggggactgagtcaagagatatctgcaaggaagcagaagagagacctcactggcctggggtgaggtctcgctcacggactctgctctgtcccagcccttgctgaaagccctgctgaatcytgttagccagcagggcttctaggagaagcacaggcctggcccaggcttgttagggatcggtgcaatgacacctgcactgcacatagtagtcgctcactaaactactgrtggatgctattttatcaggatcgaccctgagcatcacaggcttagggaccagcctagggacctgagtggctgatcacagcactgccctaactccaggagacatttcccactctgggcctaggaacactgcctacactcctgtctctgtttcttatccacagttcccggagggcttgcgggtgctggccttggggcaggtgagtgctgacacccaagaaagatatcccctgtggggaccagcccctgagctcaacccagggctggtatgcagcacggtcatggaacaagggtgcaggccaggttccgtcctgggcactgacggggactgatgctgataccaactgccccaagcagctgcccaggacatgaggaaatcacagctgagtacctgggttcctttataacatagtagtgaaggctgcatggaggaagccccatggaccaaggaagcccaagggagtcgcttaactcagcaggggttcaggaaggcattctagaggaggtgggtggggaaatttgaccccaaaagatccatgcagttttcaggaaggctgaagtgagaggatcccttgagcccaggaggctgaggcttcagagagctatgatcatgtcactgcactccagcctgggcgacagagaaagacctcatctcttttgttgttcttgttgttgttgagacagagtcccactctgtcacccaggctggagtgcagtggctcagtctcagctccccgcacctggtgcagttgatctcagctcaccacaacctccacctmcccggttcaagtgattcttgtgtctcagcctcccaaatagctggaattaccagtgtgcaccaccacgctcggctaatttttgtattcttagtagagacggggtttcaccatgttggccaggctggtctcgaactcctggcctcaagtgatccactcacctcggcctcccaaagtgctgggatgacaggctcaagccaccgtgcccagccacaagaccccatctctaaagggaaaaaaaaaaaaagagccatgcagttttgtcagagctgtctaacacattaacctcggcacacaatctagttctggtacttaggcgcggtggctcacgcctgtaatcctagcactttgggaggctgagacgggcagatggcttgagcccaggagttcgagaccagcctgggcaacatggtaaaatcttgtcactacaaaaaatacaaaaaaaaaaaaatttgccgggcacagtggcatgcacctgtagttccacctasttggaaggctgaggcgggaggattgcttgagcctgggtggttgaggctgcagtgagccaagatcgcaccactgcactccagcctgggtgacagagtgagaccttgtgtcaaaaaaaaaaaaatccattaccggtgagcagtgctcacatggatgtcctgcaggcattgatgtctggcagagagcggaagagcctccaatgtrcttcctgagtggggcacagccaggcagggccagagcgtaggagtcttcataggtgtggtagctcaggacctcaccccatcctcccctccgcagggctcggcgccttccccgcagttacctttccgggggctctggtgcctggtggagtggctgacgctgctgcagcctataaagctgctaaggctggtgagtggtgctctttgggacatgccacaagccctctggcttccgtggggccctccgctttgcaaagaaccttccctcaactcaggcttgggagccgggtgggtgggattgtcagttgcaatctactggggctcagggaggcagctagctgtgcccagtctgaaggtgagttagtaacggggccagacctcaatgctgggccctcagcatgcagccccrggcccttctgcctccccactgttccttacgcaatgcctcacctgtcctggctctgcaggcgctgggcttggtggtgtcccaggagttggtggcttaggrgtgtctgcaggtacgatggctatccccgaactccctgggtcaaagttgcaggcctgggtggagccaactctgatgcagccccttctgtgccaggtgcggtggttcctcagcctggagccggagtgaagcctgggaaagtgccgggtcagtgcggaatccctggggctggaggacagagggcagggaggggcagagggcagggaggaacagagccctctccatgccactgcacttgsggaggaagggcagggcctggcttcagtcgggcagagaaactagccaggctggtgcctgcgtctgtgaaatggggaggaggggcctggcccacttcccgggcccttctcccgggatcttggggtagaaagagacgggctctgtggcaggctgtcgggcgacagatggggaaactgaggctcaaagaggcgagtcagtgtggaagggcctgcagcgagtcccggcagagctgggggagccccgtgtcctctgactccccatctggtactcgttctgccccaccaagccctttaggaagtgacttcaggttaaacaaaagactgcctgagtctacgcagcagggagggacatctggaagctgttagccagaggtgggctggcccagccatgtaaacaggctccaggagacggagataaatccacacaccgaagagtttgcagatgacttccgaaactcgtgggaggagggttgtggccaccccacgtctgtccctggctgcccctgtcgggcacagaggctgtgggtttgagggccttggagctgcctgggtgggaagggctggggaggggtccctggaggctgagctgctgctagtaactttgctttcttttggccacaggtgtggggctgccaggtgtatavccaggtggcgtgctcccaggtgagagcaaggagggaaacagggactctataggaagaaagcagccaggacgcagtggctcatgcctataatcccattgctttgggagactgaggcaggaggatggcttgaggccaggagtttgagaccagcctgggcatcatagtaaggccctcgtctctacaaaaaaatttagccaggcatggtggtgtgcacctgtagtcccagctactcgggaggctgaggtgggaggattgcttgagcccagaaggtccaggctgcagtgagctacgatggtgccactgcacagcagcctgggtgacagagcaagaccctgtctcaaaacaaagaaaaagaaaaaggaaaagaaaagcagccccctcagcctccctagtacccccctcgcctccccgaaaagcagaggccaccagaagccctgggtcctgacctgagccatttccccaaactccaaagctcaggctaacagacataaggtccctggcagtccgtccatcccctgaaggtcaaccagccttcctgcaccccacccaagccctgatcccaggcacagaccatcatcacagcccgaggcgggcccccgaggacagatcccagtgtgaccagctatttcccaaaagctgtgagtcaccaaggggccacccaatgagtctgccctgcaggagaccctaaagagctgcccctcaccctcctttcccctgccagggcctgaccaccccacccaacatgtgacctcctgaattcccccaaaagcccagatttaggctgttatgtgggatttgctgatggagtggcccttcctccctctctcccccactacgctgaaagccaaggctgcccagccccaggggagacaggagaggtggaagacgctggcatggtcccagctgtagctggatggctgctttgggggtctgggttgtgagcgagagccccagagagcatgggcctccctggtctacgggcgagtggcaccgcgcagcagctgtccctctctttaccttttctgcggagggtggtcgagacggcttttgtgattaactccagcatagagatgaggctgactgaggcaccagctcacatggctgggaaataggattaaaactcagatcttctgaccttgagccagacagggaaggaaagtcagcactaaacaggtcctttctccacccaccccgtgagccgtgcctgtcactgacagtcagtcccaagggaggtcagctgggggacccgaggaggggaggggttcccagcagggcctgcaaggcctgccttcctayactcactgctttgtcccccggcaggagctcggttccccggtgtggggktgctccctggagttcccactggagcaggagttwagcccaaggctccaggtatgcagctgtctggacagagggctgatggcagggactctccaaccaccttctggccccgggtgtgaaatggggtgggatcctggactggctcagggccctctgggtgacactttttatgttccagccctgggcagcctggtgctgaaaaacctcagagtgtggctgggcacactggctcacacctgtaatcccagtattttgggagggtgagctgggaggatcgcttgagcccaggagttaaagaccagcctgggcaacatagcaagaccttatctctacaaaaacatgattaaaaaattagccggacatggtcacacacacctatgatcccaactattcaggaggctaagacaggaggatctcttgagcccaggagatcaaggttgtcgtgagctatgatcacaccactgcactccagcctgggcaacagagaccccgttcccccgcaaaataagaaagaaagaaaagagggccagatgcagtggctcatgcctgtaatcccagcactttgggaggccgaggtgggcggatcacctgaggtcagcctgaccaacacggtgaagccctgtctctactaataatacaaaaattagctgggcgtggtggcctgcacctgtaatcccagctacttgggaggctgaggcgggagaatcgccagaacctgggaggcagaggttgcggtgagttgagatcaccccattccaccccagcctgggcgacaagagcgaaactccatctccgaaaaaagaaaccccagagttcatgtgagcgcagcatgcgatgactggtctgggaagaactggccattccttgggcctcctggccccttggtgctgtctggcccagtgtccacagttccagggctgtagtgacagctttttatcattacaggtgtaggtggagcttttgctggaatcccaggtgaggcaaggctggtgggagaagmagggtggccagccaggcagaggctctggcgttgggaggggttgggcacccaagatcccatccaagcctgcccaatttctcccacgcctgcagagccaggtcttgcagtggctgtagcacaaagtggcacccatcccaggcctgctccccccactggcatagcagcccaaaattcaaaggagtccagaaaaccctccagcctgtgccaagggctgcaggcccaaactggggcccaggccccaggagggagagaatcccgtagcttcctggaggaagtggcctgtcmctgggaatttctcaactgacccatgatggagattcagggagtccctcgaagcaggatggtttctggatgctgtagcaagctccttctgtctgagcagaaagtggagtgggtggcggagggtttggaagggggtgctgggacctgaacttgctctctttattcccacaggagttggaccytttgggggaccgcaacctggagtcccactggggtatcccatcaaggcccccaagctgcctggtaagtcagagggacggttcaagatgcaccactcggccgggtgtggtggttcacacctgtaatcccagcactttgggaggctaaggcgggcagatcacttgaggtcaggagttcaagactagcctggccaacatggcaaaaccccgtccctactaaagatacaaaaattagccaggtgtggtggcataggcctataatcccagctactggggaggctgaggcaggagaatctcttgaacccagaaggcagaggttgcagtgaactgagatcgcgctactgcactccagcctgggtaacagagtgagactctcctccaaaaaaagaaaaagaagaaaaaaaaaatgtaccactcactgcacctccctgcacagaagtcagcctgggtacaggtgtctctggtggcagggaaggggtgttgaagcccctgtatggtcaccagccaaggagagcatgggaaagtcatctgcaggtattgaactcacacacacacgctcatgcacagagacccatagtcccgatctgaagctattaggctggtggaaaggaacacggttcattggaaagatccctctaacatccacccactcgtgctcccgcccctacctctgcaatcagcttagacaataagatgctttccactgaggagggggtgtaaggaaaatactcagactccagggccatgatggggcttgaatttgtagggggatgggtgttccatgggcctcgggggcagaggtgtcctctccctccttcacccagcgcctttgctctcctgggagcagctcaggaccctgatgtgggaggtctcaagctttagcacctgtgggggtagatctgtccacccaggttggtgggagcccagcaaggcatggggcagcccctgagtttgctctgtcctctctccaggtggctatggactgccctacaccacagggaaactgccctatggtgagtgagacccttctagactgtgggcttccagctctttccctctccagggtcctagcaagggtgctgtgcttccagccctgggccaggagagcacctcgctggggcagggttggggtcttggagtgggaatctcagaaggaaagggcatggaatttggactcagcatgggtctccatccctgccctcccacctatcaataatgagaccttaagtgagctgtgttgcttctttgagcctctgtgttctcatctgtaaaatggacataacractccatacatgtgtttgtatttgttttcactctggctgggggtgacaggtgcagactcaggacagcttgggccccgagggcagagcagggggrgggggagggcagcagtggtgatgtctgcacagatgaccatcaagcctctctgttttgcaggctatgggcccggaggagtggctggtgcagcgggcaaggctggttacccaacagggacaggtaaggaaagcctcacgtcacttccagccaagggagcactgatcttccaggctccagagccctggggtgggtgaggttccctcctgaaagcagcagcccaccctgcatccagaccctggtccaaacctggagcaggatcctgggggaggagtggggcagctccatcagcctctgcctactctgaagctcccatgtatacccacatgtcagtggattggctctcttggggctgggaacaagtgggctctggagatacaggagcactgtttcaaggtctctcccctctgcttccttcccccaggggttggcccccaggcagcagcagcagcggcagctaaagcagcagcaaagttcggtgagtgcccctggagtccccacctggtggcctccaggcccctagcctctccattcccattactattgacagcctgcctccaaagtggcccctacatacccccatttactcaaaattttcaacatcacccatctatctatccctccctccaaccattcttccatgcatccatgtatccattcatccttccatcaatctattactttctccatccctccctccatccattcccattcctccatgcatccatctatccatccatccattcatgtactcatctgcccatccatgcatccatccactcatccgtccattcattcatccatccatctctccctccatccattcatccatccatccatccattcctccatgcatccatgcacccatccatccattcacccatgcattcattcattcattcattcattcattcattcattctttcctccatgcattcatccatgcctccttccttccctccctcactgcctcctcccacccatccatatcagagatcagggacaaacaagagttctcttagagaatatagccactgttgtgggagtcaagaaacgggaggcatttttttctacctgaggaaagttagaaaggcttcccagagaaagtgacatgtgatttaggccttaaaaataaagatggagcttaccatgtggttaaaacaggaaagaggaggccaagcagagggaatgggtaccacggtggttagaaagataattttaggtggtgcatatataagcatttaaaatatttaatagttatgtatcaatttaatgtgtactataaaaatgttaactcactgctcaggtcagtgagttcttggctagcatggctgcagatggaacgtggtattcctgtgcccgtgcagtgggtggagtgggcatctgtcccctgccccaggtagtgcccacctcagggtcagaccactagggctgaagtcctccttcatcctcagccccagggaagccctttccttatctccccaccagcccgagagagcgagaatgtggggagaagcctgaagctgggcctcccagtggaggccccgcaggcccccctcccagcacccgaggctccttggccccagcggctggtggggacggctgcaatgtgggagcgggagagcagggctgtgaggggctgccagagccaagcagccaggcgcttggattacaaacttggctgcatcttcggaacacagggagaggaagtcttgaacattcctgcaggggaccctctggcccagggagcggccacttgtggtttctcagtatgtggcagtgattagaatgggatttgtctgaaaacatacaagtcccttaatgagtgtgttgaaatggacactttgggggagagtcaaggaacagtggagtggggtgggggcctccccagacaggcccatctggagacacccgggccccattcctggataagatcacactggtgaaaacgccggcgtctaagtggccatcctgcctgtcctcaggagggtccttgggaaactacattgcactgtccccatctcaacaggtgctggagcagccggagtcctccctggtgttggaggggctggtgttcctggcgtgcctggggcaattcctggaattggaggcatcgcaggtaacatctgtcccagcagggggcgggtgtgtccttgagatggccacagggcaaggacctcaccctctgtggctgtgttttcaggcrttgggactccagctgcagctgcagctgcrgcagcagccgctaaggcagccaagtatggtgagtgcctcccggggtggcaagtccacggctcgggcccctgcatagacctcggagaccctagccgcaaagccagatggacttggcctttgttccttcccaaatatgcattgttcatgcctccttacctttgccccttctgatcactctacctgagatgccatctctattgttttgccctgattaactcagcagagggaggggaccctgcagaggggacatggctcctcccactccatcccctccagggccagcccacaggtgtctgctgcatcaactaaatgggtgcccagtggtgagaattctgactgtgctttaggaatagatcacattctagctatgcacagtggctcacgcctgtaatcccaacaatttgggaggctaaaaccaggagtttgagaccagcctgagcaacatactgagaccccatctttccaaaaagtatttaaaaattatctaggcatggtggcacatgcctgtggtcccagccacctgcraggctgaggtgagaggattgcttgagcctagtagttcaaggctgcagtgagctatgatcatgccactgcactccagcctgggtaagtgagaatttggttcaaaaaaaaaggaaagagagacagaaagagagagacaggaaggaaggaaggaaggaaggaaagaaggaaggaaggaaggaaagacggaaggaaggaaggaaggaaggaagggagggagggagggaaggaaggaaatgaaggaagggagggagggagagagagaggcaggaaggaaagaaaggaagaaacaaaagagagaaagagaaagaaagaaagggaaaggaaggaaggaaggaaaaagaaaagagggagggagggagagagagagagggagggagagagaaagaaagaaagagagagagagagagagaaagaaagaaagaaagagaaaggaaggaaagaaaagaaaagaaaaagaaagagatcacattcctccagctcactgattcaaatcctagagctctttagggaccctcttagtctctccacatctctctgatgagtaggatccatgcagaggaaatgtcaacccacctgcaatcctgcattcaggaccaactgtcacttccatactctactaaccacccttctagcccctctgaggttcccataggttaggggaacaatgctttttcttccacaggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggtgagctgggctgtgtgtgtgtgtgtgtgtgtgtgtgtgtgtgtgtgttattagagagaaatattgagactattgccaaaatttttgcattctccctaacaccataaccatctgcccatacccttgaccacgtctcatcccctcatcttctcttccttgggctataccaatctccttattagcttctaatcagtatcatattttccaattgaccttctggctatcagtgttctctggggggcaggaaccgtgtctttttcaactccatgttcctagcccttagctgagtaggtgttcagtttatggtggataaaacggtaagtgggtggatagatggataagtggatgaatgggtgggtggatgaatgaatggatggatagatgggtgggtggatggatggatgggtggatgggtgggtggatggatggatgggtggatgggtgggtggatggatggatggatggatgaataagtggatggatgaatgggtggatagatgggtaggtgagtggatgtgtgggtggatgggtgtgggatggataggtgagtggatggatgggggcatggatggatgggaggatggatggaagaatggatgaatgggtagatggatgagggatggatggatgggaggctgaatgaaagaacgggtggatgaatgggtagatgggtggatgaatgagcacatggttggaggggcagatgaatagacgggtgggtggaatggtgggcaagcaaatgcaaaatggatggttggctagatggttagatgaatggatagataggcagatgggataagttggcagatagatgagtggacagagagttaggtggttgggtgggtggattgatatccaaggatagacaaatggacagccgggagcagtggctcacgcctataatctcagcactttgggaggccaaggtgggcggatcacctgaggtgaggagttcgagaccagcctggccaatatggtgaaatcccatctccactaaaaatagaaaaaaattagccaggcatggtggtgggtgcctgtaatcctagctacttgggaggctgaggcaggagaagtgcttgaaccggggaggcggagattgcagtgagctgagatcgcgctattgcactccagcctgggtgacaagattgagactccatctcaaaaaaaaaaaaaaagacaaatggacaggtatagaggtgggtcattaggtagatggatgatgggggtggctgggtatacagatgggcaggtgggtggacatcagtgcataaatggatgtgtagccaactctatgttggcatgaaaggagatggcccaacacacagatgggtagacagagggatacatactacacagctctcctccaatctctcctgagcatttgtgtcccttttggtctctccaggggttgtgtcaccagaagcagctgctaaggcagctgcaaaggcagccaaatacggtgagtgctatgctgacagctctgccccaccctgtcctggcctttacttgccagaactaaaggaccctcytctacttgcccagagaagggaagtgacttgcccaaggtcaccgagcaagtcaccagcaggcctcaggacaatgtctcccccatttgtctcccaccacagggccatggggctgagtggcgggaaagtcccaggatggcattcccagtggggacagtgaccctgagcttccctgctctggccaaggccctctcagaggagcccaaaactgcctggggatgtggattctgccaatagtctctctgcatccaacaaagggggtcttcccgaagtgctcagagaggagaggggccagaggaggactgaagagtgtcagtaaagggctgggtgcagtggcttacacctgtaatcccagcaatttgggagaccaaggtaggaggattgcttgaggccaggaattagagaccagcatgggcaaaatagcaagaccctgtctctacataaaatgcaaaaattagctgggcatagtggcatgtgcttgtttgttccagctacttgggaggtcaaggcaggaggattgcttgaggccaggagtttgagaccagcctgggcaacatagcaagaccccataaataaaataaaaataaaaataaaaaataaaataaataaaaaataaatgaaaaattttaatttttttttctttttctttttctttttttctgagatagagtctcactctgtcgcccaggctggagtgcagtggcatgattttggctcactgcaatctctgcatcccaggttcaagcaattctcatgcatcagcctcccaagaagctgggattacagacatgcaccaccatgcctggctaatttttgtattttcagtagagacagggttttgccttgttggccaggctggtctcgaactcctggactcaaatgatccacctgcctcgtggatcccaaagtgctgggattatgggcatgagccactgcacccggccaaaaaaaagaaattttttttttttgagacggagtcttgctctgtcacccaggctggagtgcagtggcgtgatctccgctcactgcaagctccaccttctgggttcaagtgattctcctacctcagcctcccatataactgggattacaggtgcccgccaccacgcccggctaatttttgtatttttagtagagatggggtttcaccatattggccaggctggtctcgaactcctgacctcaggtgatccacctgcctcagcctcccaaagtgctaggattacaggcatgagccactgcacccggccccacattttttttaaaggcttcatggtggaggtgctggggacccaggcatcccagttttctgtcttttatggacaaggcctgggggaaatttacatcctctttcccaatccatcagcatccctcagagcccgcccagcctctctcactgagcttcttttctacttggctcccttccctctgcaggggccaggcccggagtcggagttggaggcattcctacttacggggttggagctgggggctttcccggctttggtgtcggagtcggaggtatccctggagtcgcaggtgtccctrgtgtyggaggtgttcccggagtcggaggtgtcccgggagttggcatttcccgtgagccttagtcacayctggggacatgggttgagaagggatgggggcttcttgtctgctcrgctctgcagggrcagtggggactgtagatcgggcttgaatgtgctcagggaggagttgggggagaagaagggaggtcgtatccatgccttacagggcagaagagctttaaacacggctcggaggagacccaggcacggcttctgagggtctctttctttctcgtttccttgtagccgaagctcaggcagcagctgccgccaaggctgccaagtacggtaagtgcccctgccctgcctgtccccaagtcctgctctcccgcggggctcagggtccaacctcagggcaaactggctcccaggcctccaggactgaaatggcctggaccaaggtcacgaggcccctgccccatcttccaaagccacactccactcttactgtccttttcagatgccccctgttaggactgttggtcactggctcatcaccccaccccccacccccagaattgaaggtgtctggcagggttgggtggctgatgcctgtaatcccagcactttgggaggccaaggcaggtggatcccttgaggccaggagttcgagaccagcctggccaatatggtgaaatgctgtctgtactaaaaatacaaaaattagctgggcatggtggcgggcacctatagtcccagctacttgggaggctgaggcaggagaatggcttgaacccgggaggtagaggctgcagtgagcagagattataccattgcactccagcctgggtgacagagcaagactccaactctaaaaataaaaaaaaaagaaaaagaaaaagaattgaaggtgccaggaagccattctcttcttcctccgattctcccacccacccttgctcccccaaaaagtgagtactgggaggggcaaggctgaaagttctccactccccgaggtgctgcaggagcaggagtgctgggtgggctagtgccaggtgccccaggcscagtcccaggtgtgccgggcacgggaggagtgccaggtgagctgtgtctccagcccagagatgggtttggtttgtctcatggaagggtccctggagttgaccaaggtcgactgcaccattttacaaatgggaagactgagcctagagatgggaagcagggaggggtgtgagagattactctctcaccccttctcttcacacctccaggagtggggaccccagcagctgcagctgctaragcagccgccaaagccgcccagtttggtaagtccccctcacccccgccactggctcacggagaactgctttctcctgtgccctgctctggggtctgaccgcccagcttcctgttcctttccaccccacttaagctgtcacattctggggtgggccctccttagaccttttggcccactgatgaatgacctctaggagtgtgggtgrtgtttctgattaggggagcagggtgagcagtgtgagcctccctgttcctaaagcccctggtgcctcccaggctattggggacctgacctcatgctgagctccagctccccttgagggactccagttctcccccttctccttctctttctccttctccttcttcttcttgtgctcctcttccttcttcttcttcttctttcttctcctcctcctccttctccttctccctcctcctccttctcattcttcttcttctccttcctcttcttctcctcctgcttcttttccttctcctccctcttcctcctcctcctgcttctcctttcttctccttcttcttctttcttcttcttcttcctctttttctccttctttcttcttctttctccttcttcttcttcttcctctgctccttcttctttctcctccttcttctcttctcttccgtctttcttctcctccttttcctccttcttctttcttctccttctccttttttcttgagatagggtctagctctgtcacccaggatggggtacagtgccacaatcatagctcactacagcctcaacctcccagtctcaagcagtctgcctgcttccgccccccaagagctgagaccacaggtgcccaccaccatgcctggctaattttttaatttttttgtagcgacagcggtctcactatgttgctcaggctggtctcaaactcctaggctaaagcgatcctcctgcctctgcctcccaaagtcctgggattacaggcgtgagccaccacacccggcctgcagtacttcttgttccccatctcttgctacatttgagggccaccctggcagccccaggtgcccacacttttctgaacatggcaaatcgtggcagcaccaattgtagagctcaactgtatgtcaggccctgggcatggggtctgtaggccttggccctagggacctgtgggctgaaaggttcagatcagaatctctaggactgaataggccagagagcatttcgactgcaggtctgctgagccccatattctcacacacagcaatctttattatttatttatttgagacggggtctcacattgtcgcccaggttggagtgcagtgatgccgtcagctcgccgcaggcctcaaactcctagcttaagccattattcccccttagtatccctagtagctggggctacagtcacatgccaccatgcccagtttaaaaaaaaaaaaaattgtatgcgatcctcccacattggcctctcaaagtgctgggatgacaggcatgagccaacgtgyctggcctacaaaaatcttacagagttgattttatttttcccattttacagatgtggaaactgaggttcccagagcttaagtaacttgcctacagttgcacagctaaatggtggctgagctgagatttgaacccaaagcctttctgtcttacaaagtcccttatataatgtaaatctgcctccatcagcctcaaatctccaaggggtccttgtcactgaaaaggttaagaactcctggccaaatgcagcagctcacaactataatcccagaactttgggaggccaagtcgggtggatcacccaaggtcaggagtttaagaccagcctggccaacatggtgraaccctgtctctactaaaaatacaaaaaaattagccgggcatggtggtgcgcacctgtagtcccagctactcaggaggctgaggcaggagactcacttgaactcgggaggtggtggttgcagtgagtcgagatcacgccattgcactccagcctgggcgatagagtgagactctgtctccaaaaaaacaaagttatgaactcctgagcctgcacacacttcatattagggaggaggaagctgaggcccagcaagggaaagtaactgatccagggtcacacagcaaatctatgccagggccgaggctccagccctctttccataagcttctgtcctctttgatcaggtcttggttaatgatcagctcttctcaatcttgcagggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggwggagttgcaggtgagtttcatgagtcaatgagcctgaggggcccccgaagcctccatgggccccgyctccatctctaatccccctctctctccctccctcagctgcagcaaaatccgctgccaaggtggctgccaaagcccagctcygtgagtgcctcgcccacctttctctcctctccccaacgatctcagagctggttaggggcaacagccagggaggaggccgctgcttggatctgggccccttcctctgggactaggctcagctccctgggcaggacacctccttaggggcatgctccctgcctgctgtcgccaccactgccctctgtctgcaggagctgcagctgggcttggtgctggcatccctggacttggagttggtgtcggcgtccctggacttggagttggtgctggtgttcctggacttggagttggtgctggtgttcctggcttcbrggcaggtgcagatgagggagttaggcggagcctgtcccctgagctcagggaaggagatccctcctcctctcagcacctccccagcaccccctcatcacccaggggtgcatagtaaaatccttgttaggttctcctaagcatctgggggtaacagatagcgggaggagggcagaccaggccaagggaccccaggctgcccaattgcagagtatctgcctcctcagtagaggggtggcagggctccagactgagaaaaagcctgccctccaaccagggaaggagcaggtagatcagcctggctccccttcagcagtgctctgtggccaggggaccactaggaactccagttcttcaccagctggtgactgagccccactctgtgcccagcctcaggcagtccatgctaggcctggggagagaaggaaggggcagacggaaggtggaggcactgttcagccctaaagctctgtgcctgtacagcttcagggctttgaggaagcaatagaggccaaggaagtcagggagggctctctagaggaggcggcagaactcccaggcacagagctcggctcctgaccactccccaacttttctttctccccagtacctggagccctggctgccgctaaagcagccaaatatggtgagtgcaccccacaaccacttgtggctcccttgccaccacaccatccctgacagcacaggactggggtggtcacaatagaaaaaggcagtttcggccgggcgtggtggctcacacctgtaatcccagcactttgggaggccgaggcaggcagatcacctgaggtcaggagttccagaccagcctgaacaatatggttaaaccccatctctactaaaaattcaaaaattagccaggcgtggtggcgggcacctgtaatcccagcactttgggaggccgaggtgggcagatcaactgaggtcgggrgttccagaccagcctgaccaatatggtgaaaccccatctctactaaaaacacaaaaattagccaggtgtggtggcgggcacctgtaatcccagctactcgggaggctgaggcaggagaatcgcttgaacccaggagatggaggttgcagtgagccgagatcacgccactgcactccggcctggacgacagagcgagactgtatctcaaaaaaagaaaagaaaagaaaaagaaaaaggcagtttctaggacacgtttatgacagtttaaaaacctggcccctgcccactaaatgcttatggtgccttcaacccctgtgaccaccaaaaacacccttgaaatcccagttgccccccaggaggcaattccaccatccctaagcttgccctgaccctgacagttacatggtccctgtgtccaggaagggactgggcctgctgtgggtatgaggagtctgggcagyctctgcctccacyccagctctctggcccgagcaaaggagctggtattcctcatctgggcaccccgggcccccgcccgccttcctgtcctgccagcaggaccgctcccaccacgagccagcccagaggacgtggcagtcccacagcctctgcacttggcgctctggcagccctgcctggccagacccacgctgtctgtagcccctgaattcctggcctcctgtgagcagcgttggtgggaggtggaagactcccccagggatccaccaaccagccgggcaggtccacttggggccagtttctacctcggaaaatcctggcttcctcagcgccgacccccagcagccctggcctcctcccctgctcactgctgactgcttggcaggcctgagtcaacagacattgccagggaaacagagtgacgtcatgtggtggagccgcgaagggcgcaggctccccagccacttcccgtccctgaagccctgagcacactgcttaacctctgctctgcctcagcgttctcatctgcaaaatgggaatgacaatagtgcctacctttcctgctgcaatgcataaaaaatgggctgctaagtgtgaagcactcaaaatgttaagtgcctgctgtagatactattaccgttgtttgtttgtttgtttgtttgttttgacagagtcttgctctgtcgcccaggctggaatgcagtggtacgatcttggctccctgcagcctccatctcccgggttcaagtgattctcctgcctcagccttccaagtagctgggattacaggcgcccgccaccacgcctggctaatttttgtatttttcgtagaaacagggtttcaccgtgttggccaggctggtctcaaactcctgacctcaggtgatccactagcctcagcctcccaaagtgctgggattacaggtgtgagccaccgcacccggcttacaaaagaacttttaaggccaggcacagtggttcacaccttcgggaggctaaggcaggaggatcgcatgagcccaggagttggaggctgcagtgaactatgattgtaccactgcactccagccggggtgacagagcaaaaccccatctcaaaatgaaacaaaatatggactggacttcctgtccactgctcctccacagtgtcacatggcccctgccacctgtctgcttgccttgtgtccctggggcagggagacccatcgttcagaaatggaacactcattttccctcctctccccgcaggagcagcagtgcctggggtccttggagggctcggggctctcggtggagtaggcatcccaggcggtgtggtgggtgagttgaaaccccaggaggggcagggtggggagggaatctaaccagtacagagtgcctccctgaactcggtctgtgttcccaggagccggacccgccgccgccgctgccgcagccaaagctgctgccaaagccgcccagtttggtgagcactgggtggaggtgggagctgccgccaggcccccaggcccccagggtgtgggaggagcttctgaccaggcactgtagactcagagtccctgccccagacacctcctggctccactgtgccatcgaaggccaggggagacctcaggctccacctgtgtccccagaggacacctccgccctccacaggccgaggcttcagtcccacctttctgaccagcggagtctaatgctcagctgtctccacaggcctagtgggagccgmtgggctcggaggactcrgagtcggagggcttggagttccaggtgttgggggccttggaggtgagagttgttctgaaatcagtgagtgtgtgtggtgtgtgtatgcgagacagagatggagacagagacagagacagagactttcgttcccacccctggcacgtctttgctcaagatgtcctcttggccaggtgcggtggctcacgcctgcaatcccagcactctagtaggccaaggtgggcggatcactagaggtgaggagtttgagaccagcctgggtgacatggcgaaacctcatctctaccaaaaatacaaaaataagccgggcgtggtggtgggcacctgtatttccagctacttgagaggctgaggccagaggatcgcttgagcccaggaggcagaggctgcagtgagctgagatggtaccactgcattccagcttgggcagcagagtgagaccctgtcatctaaaaaaaaaaaagaaagaaagaaaagaaaagaggccaggcatggtggctcacgcctgtgatcccagcactttgggaggctgaggtgggcagatcacgaggtcagatcaagaccatcctggctaacacagtgaaaccccgyctctactaaaaatacaaaaaattagctgggcgtggtggcagacgcctgtagtcccagctactcaggaggctgaggcagaagaatggcgtgaacctgggaggcggagcttgcagtgagccgagatcgcgccactgcactccagcctgggcgacagagcgagactccgtctcaaaaaaaawawatatatatatatatatatatgtatgtatgtatgtatataaattagctgggcatggtgacacacgcctgtaatcccagctactcgggagcctgagacaggagaatcacttgaacccaggaggcagaagttgcagtgagccaagatcacgccgctgcactccagcctgagcaacagagcaagacctcatcccaaaacaaaataaaaacaagaaatgtggcaaacgggagctggggctatcccttgccgccagggtcccagtcctccccctctcctctctctttcaacccacctgaccactgcggtgggagtaaattaggagaatgatggttatgccagttctccaagaaagaaatcaaagcttggagagaaattgctttccctaagtctccaccatggtggccgaccttgtgtggccatttccccctttcttgggctgtcattgtgtctccccctgtaaactagcctgcacagctcttcctgtgagtgccacaagaccagacacacagtaggagcttaacaattaagacttttggggccgggcatggtggctcatgcctgtaatcccaacactttgggaggcttaggtaggtggattgcttgaggccaggagttcaagaccagcctggacaatgtagcaagacccccccccaccaccacctctacgaaatatttaaaaattagctgggcgtggtgtgtgcctgtagtttcagctacttgggaggctgaggcaggaagatcacttgaacccgggagttcagggctgcagtgagctgtgatcaagccactgcattccagcctgggcaacagagcaagaagctggatagatgaaggagagatggggggatagactgggaggatgagtccatgggcagacggtaaagggtgagtaggtcagaagacagggcctagccaggtgcagtggctcacacctgtaatgtcagcactttgggaggccgaggcaggtggatcacctgaggtcaggagttcgcgaccagcctggccaacatggtgaaacctgtctctactaaaaatacaaaaattagccaggcgtggtggtgggtgcctgtaatcccagctgctcaggaggctgaggcaggagaaccgcttgaacccaggagatggaggttgcagtgagccgggatcgcgccactgcactccagcccaggcgaaggagtgagactctgcctcaagaaaaaaaaaaaaaaaaaagacagggcctgacaggtggcattggcattcctgagccgtcatgtgcctcatctccccaggtatacctccagctgcagccgctaaagcagctaaatacggtgagttcccctctgatgccttcctgccagtggcctgcaccccctgccatgcccatcgccaccctcccccagcccagctcaggcctccctctggctccccctacccctgaagatcttgtctgggacattccttaacccagaacccagcagggatatcagggcctcttcccgatgggggtgtcttatcctgaccccacctgcctcttctcaggtgctgctggccttggaggtgtcctagggggtgccgggcagttcccacttggaggtaggggtggccagctctgctacgtagtcctcagctctgtcccgatctagagggggcctgtccatctagcagtggggactcccagagcccatgtccacacaaggacaggagactggggctggtgagggcactttaggattgcagatgtactgggcaaacgggcaagctataaggttggggacagtgccaggctgagctcagggttgaggccatgaggtgccacacctggttgctaggtggcrgcatgttgtgttgagaaagccactctggctgtagtgagggggattggctgggcgtggtggctcacgcctgtaatcccagcactttgggaggcctaggtgggtggatcacttgaggtcaggagttcgagaccagtctggtcaacatggtgaaaccctgtctctactaaaaaaaatgcaaaaattagccaaacgtggtggacgcctgtaatcccagctactcgggaggctgaggcggragaatcactggagcctgggaagcggaggttgcagtgagccaagatcgcaccactgcactccagcctgggtgacagagcaagaccccatctcaaaaaaataataataaaataaaatataaaaaattatatagtgggggggatggagaggaggtgatcccagacagaggtcttgggtgagccagtgcaggcagaaagtgatgaggctggagtcagtttccacccytaccaacccaccaacctgaaatctctcctgcaggagtggcagcaagacctggcttcggattgtctcccattttcccaggtatgccaggctccctgcccctgggccctgccctggagctgcagccacctcctccctcctctcctgtgccatctcctgctcagaagggctgagccagcacccaggggtggaccccacagcctcaggtcacacgaggctggaccccgagctgaatgtagagcctcccctccttcttgctgacctcttataaacacagggaacatttgctttttaaaaacacagttcatggccaggtgtgatggctcacacctgtaatcccagcactttgggaggctgaggagggcagatcacctgaggtcaggagttcaagaccagcctggccaacatggcgaaaccctgtctctattaaaaatactaaaattagccgggtgtggtggctcacgcctgtaatcccagccctttgggaggccaaggcaggtggatcacgaggtcaggagatggaaaccatcctggctgaaacggtgaaaccccgtctctactaaaaatactatagtcttctttttttttttgagatggagtcttgctctgttgcccaggctggagtgcagtggcacgatcttggctcactgcaacctctgcctcctaggttcaagcgattcttctgcctcagcctcccaagtagctgggactacaggcatacaccactacgcccagctaatttttgtatttttagtagagacggggtttcaccatattggccaggctggtctcgaactcctgacctcgtgatccgcccgcctcggcctcccaaagtgctgggattacaggagtgagccaccacgtccggccgtctctactaaaaatacaaaaaattagccgggcatggtggcgggcacctgtagtctcagctactcgggaggctcacgcaggagaatggtgtgaacccgggaggcggagcatggtgtgaacccgggaggcggagcttgcagtgagccgagattgcgccactgcactccagcctgggcggcacagcaagactccgtytcaaaaaaaaaaaaaaaattagccaggtgtggtggtgcacgcctgtaatcccagctactytggaggctgagacaggagaattgcttgaacccaggaggcggaggttgcagtgagctgagactacaccactgccctctagcctgggtgatgacagggcaagacgattgcgtctcaaaaaaaaaaaaaaaaaaaaaaaaaaaccttcagaggcagatgtctgttcctgccccactctctgctcactgccaccaggtggcggtaaggagccatatctggctcaagcagggttaggaactgctccgggccgcgctactagacaatggtgccttacctaatacagactgatgccttgaaacagggttcacccatcagactattcccaggagggggtaggaatcctgggtttgagtcccagctcagacactatgtggataagaccctctctccctctactgggccttgatttacttatctgatgccctctcagatgtatgggtccaccccactccctgagagggccgtctcctgcagacactgactctcccttcatcccatgttccttgatggagctgctcttagcctttccccgaaaggcttcttggagcagtggrgccaggagccagtgccaggccccgtccttccccagccaggccccatgacctgcccccttttctgcgagcgttggtttcatccaagtaatatcttgggggcttctcccgccccatctgtccagtggaagttgatggcatggatcaggtctgagtttggcctggggccatgacttggcttctcttggcttcttggagcctccattcgagtgggtcagagcaggcggggattagagccgaaamtgagaggggccggactcacagtgatgtgcacctcctcccgtccaggtggggcctgcctggggaaagcttgtggccggaagagaaaatgagcttcmtaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacmtaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcsgtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaarcctttaaaggaaactgtgtcttagcttccttcgtatgatttaatctgccttcaactcgctggcctggatggggataagggctctgcttcagggaacctccaccacccacagtgtatttgagaggttgcccaaccaaaagcccctgctgctggcttctggggcatcgatctttctccaagtttggcttgtactttaacaatgaggccaggagtttgagacccacctggacaacatagctgtccagtggagaatcactttgtaccatatagctacaaaaaaaaaaaaaattacccaagattggtggtggtgcatgcctgtggtcccagctactcaggaggctgaggtgggaggatcgcttgagcccaggatttcgaggctgcagtgagctatgattgcgccactgcactccagcctgggtgagacagcaagatcctgtctcgagagagagagagagagaaacagaaagagacagagaggaaagatggctgacctaagaaaatgcagaagacagtcaaaggtaaccattttcctccgaaacagtcccctctgaggaagacccactctcatgcgtggccatgtaaggccatttggcttgagaagtttaagaagtgatacccagcagcaggttcagctccacccttactcagatgcacccattcccattctggcccttcctcctccccttgaggccagaaatccgtggggcccgggaatgtgttcacctgcagcccacatccctacctctagaccacgctctggataccagatactggaattcccttccccaaccaccaagcccacttccagggctcactcagcctcaggcctgtgccaccctcctgagagcgggccccgtgctgagtgtgcacacctctaagccagaaatgtggcaacagagctgttcgtggggagtgtgggtggggctcaccatgcagactggagcatatgtgggtttgcatacgaggatccttgcgatcccagaaggagctgggagggaaagagaaagctggtggagggtatgctcagasagagcttcccagaggacagtaaagggcaaaaaacattttaccaggcaaagaatagaacagagaggagggtcaggcctttcaggcagaggacaggacaactagatgtctggtaggagagggcagtgctgaggacttatggaggatgatcaggagggggtgagcggcgtggttcaaggagatgcacaagagggttgctgtaataatccagggaggggtgacacagcctgccctagagtggtgacaaagtagatccatccatccatccatccacccatccacccacccatctgtccacctacccacccatcaacccacccatccacccacccacccaaccattcttccatccatccatgtctccttccacccatccacccacccacccatctatccacccacccatccatccatccatctatccacccatccatccacccaccagtccatccatccattcattacttcactcgacaaaaatatccattgctggtttttcctcaggtctccggcctctaaaagtcagtaagccccagcattcaggcctgtggactccctgtcttrgtttctcatagcttgcggttttatttatttatcagagacagggcctcagtctttcgcccaggctggagtgcagtggtgctatcacagctcactgcagccttaaactcccaggctggagcaatcctcccaactacaggcacataccaccatacccagctaatttttaaatttttttatagagatagaatcttgcyatgttgcagccaggcgtggtggctcatacctgtaatcccagcactttgggaggccgaggcaggcggatcatgaggtcaggagttcaagaccagcctggccaacatggtgaaacctcatctctactaaaaatataaaaattagccgggtgtggtggtgcatgcctgtaatcccatctacttgggaggccaaggcaggagaatcacttgaacccaggaggcggaggttgcagtgagccgagaccgtaccattgcactccagcctggcgacagagcgagactctgtctcaaaaaaaaaacaaagaatcttgctatgttgcccaggctgctctcaaactcctggcctcggcctcccaaagtgttggggttacaggtgtgagccacctcagctggttgctcgtggctttaaatatttaatacgacctattcattggtgactctccaattgacatctccagcatgaccgctcccctgagcccaggacttgcacatccaaggccaattctaacatctctacctagaaatctcatagacatggcctaggtagcgtggttttccctccctgcctttcccatctcagtaaagggcagccctactcttccagaggttccggcctgcaactctgtaaccatctctgactctgctcttccctcactccccacagcagattcaccagcaaataatacggcaccaccttcagaatatatccagagttggccaggcacactgactcacacctgtaatcccagcactttgggaggccgaagtgggcagattacctgaggtcgggagttcgagaccagcctgaccaacatggagaaaccccgtctctactaaaaatacaaaaaaattagccaggcatggtggtgcatgcctgtaatcctagctgctcaggaggctgaggcaggagaatcacttggacacgggaggcagaggttgcggtgagccgaggtcacaccattgcgctatagcctgggcaacaagagcgaaactctgtctaaaaaaaaaagaatatatccagagtcctaccacgtctcagggctaagccacaatccccagtatctcttgcctgaattactgaaatagctccctgaaccccttagttctcccctggctccccttcggccttctctccactcagcaaccaaagcaatctttttttttttttttttttttttttgagatggagtttcactctgttgcccaggctggagtacattggcgtgatctcagctcactcaacctctgcctcccgggttcaagagattctcctgcctcagcctcctgcgtagctgggactactggcatgtgccaccatgcctggctaatttttgtgtttttagtagagacaaggtttcaccatgttggccgggctggttttgaactcctggcctcaagcgatcctcctgcctctgcctcccaaagtgctgggattacaggtatgagccaccacatctggcccaaagcaattctttcaaagcataagtcaactcgggtcatgcatctactccaagtcctgcagtggttcctgtctcactcagagacaaagccagaggcctttctatggccaagaagcccctacttgcatggcagcagctctcctgacctcacattctgctattcgagccatgcggtcgccctggccatcttacttttccttgagtgcaacaggtcacccactgccagccttggcatctgctatctcttctgcccaaaacgccctttcatcagctatctgtgtttctggctcactcagctgcttcaggtcttgactcaggtgtcaccttctcagagtgtcctacactgacacctttctaaaattgcaaattgggctggatgcggtggcctgtgcctataatcccagcactttgggaggctgaggtgggaggatcacttgaggccaggagttcaagaccagcctgggcaacatagcgagactccatctctatttaaaacataaataaaattgcaagctgcaccctcctcctctgctcattactccctcacctggctctacctccgttttgtgttttgttttgttttttgagatggagtctcactctgtcgcccaggctggagtgcaatggcaaaatctcacctcactgcaacctctacttcccgggttcaagcaattctcccacctcagcctcctgagtagctcggattacaggcacccgccatcatgcctggcaaatattttttgtatttttatacagacagggtttgaccatgttggccaggctggtcttgaactcctgacctcaggtgatccaccctccttggcctcccaaagtgctgggattacaggcatgaaccaccgcgcccagcctgtctctgccttctttgactccagagcacctgtcaccataaacaaaatatattttacttctttgttttctgtctctctacaccagactgtaaactctaagatgggcactgctttaagaataacacagcctggacacagtggctcatgcttgtaatcccagcactttgggaggccgaggcaggcagatcacttgaggtcaggagttcaagaccagcctggctaacatggcaaaaccccaacaacaacaamaaaaattagctgggtgtggtggtgcatgcttgtaatcccagctactctggggactgaggcaggtgaatcgcttgaacccaggaggcagaggttgcagtgagccaagattgcgccactgcactccagcctgggcaacagagcaagactgtctcaaaaaacagaaaaaaaatttttttaaagaccctatctccaaatacagtcatattctgcagtattggagtaaatgcttcaagatataaattttgaggagacacagttccacccctaagagttacctcatggaaaaagggtctttgtagttgtgattaagtcaaggatcttgagagatagggagattrtcctgctgggccctaaatgctacataggtattcttatgagaagctggggctgggcacaatggctcacacctatcatcccaacactttgggaggccaaagcaggaggatcacttaagccaggaggtcaaggctgcagtgagctatgattgtgccactgcactccaatctgggtgacagagtaagaccctatctgaggaaaaaaaaaattggaaaatctagataaaatggataagttcctagaaagccacagcctgccaagactgaatcatgaagaaatagaaaatcagcatagaccaatagtgagtaaggagattaaatcagtaataaaaagtctcccaacagagaaaaacccaggaccagatggcttcactggagrattctaacaaacatttaaaaaattaacaccaatcctcctgaaactcttccagaaaactgaagtagagggaacacttccaatctccttctaagaggccagcattattctaataccaaagacacaagaaaagcaaactataggccaatatcctttatgaacattgatgcaaaaatcttcaacaaaatacaagcgaaccaaattcaatagcagattaaaaggattatacaccataaccaagtggaatttttcctgaaatgttaggatgtttcaacatatgaaaatcaatcagtgaaatataacatataaacagaatgaaagacaattacatgatcatctcaattgcarcagaaaaagcagcaagatcmaataaactttcatgataaaaacattcaacagactaggaatagaagcaaaccacttcaacctaataaaggctayagatgaaagcccacagctaacatcatacttaatggtgaaagactgggcttgagtggtggctcacacctgtaatcccagcactttgggaggctgaggcaggcagatctcttgagcccagaagttcgagaccagcctgggcaacatagcgaagccctgtctctacaagaaaatataaaaataagccgggcatagtggcacatgcctgtagtcccagctgttcaggaggctgaggcaggagaattgcttgagactgggaggttgaggctgcagtgagccatgatcatgccactgcactctagcctggaaaacagagtgacaccctgtctcgaaaaaaataaaaaggacttaaagcttttcctctaagattaggaataagacaaggatgcctactcctatcacttctattcagcatagtattggaagtcctagtcagaacaactaggcaaaaaaaaaaaaaaaaaaaaagaaattaaagatatccaaattgagaagaaagaagtaa

SEQ ID NO: 13232 - DNA, 20082 bp, Homo sapiens
ttaaaagtttactggaaaccacatacctttcttcctttacgacaacctgtcattcatcacagctaaaacatccacccattaaatgatatttttacaagattaaagaatggttttaaaaagaaagaaatctccttagttaaaaatgaaccaaacaaaggtacctaatcactgatcagcatcaaagttttgttccacacatgaaaataattcatcaggccaggtgtggcggctcacacctagaatcccagcactttgggaggccaaggtgggtggatcacctgaggtcaggagttcgagacctgcctggccaacatggtgaaaccccatctctactaaaaatacaaaaaattagccgggcatggtgacagatgcctgtaatcccagctactcaggaggctgaggcaggagaattgcctgaacccgggaggcggaagttgcagtgagccaagatcacaccattgcactccagccggggtgacaagagcaagactctatctcaaaaaaaaaaaaaaaaaaaaaaaatcatcaatgtaaaaatgaattctgcctaaggaggggaatttaaaaagtcagagaaaagcaaggaattaaaattcagaaacaagctgttttataattaagcatctgcaatttaactatactatgtcactctgattttcatctttcctttctcataagagtcatagatgttctccgctcatataaaggtggtaggaagggagggagggcgccatgctaatagaacccacatcatgtttactaagaactaggcagatgtggacaaaaactccaaagatttaaaagtttcttgactagagcaagacatcttcaagaactcatccaacatggtgcctagccttcttcagagcaagacaagccactaagtcatccctgggtgtgtgttcagcagcagcccactaggaagtattaggtgagctacgatgggagagtaatgggcaggaaaatcataggaaagcaggtctggatttgggctggctgcttagctgcatggcaccttgcacaagttataatcaggtctcttgcctccatttcctcttccacaaaaaatggaacagtaatatccatatccaccctacagactgtgcaaagattaaagaatactggcgaggtgcctggcacctagtcattgttcagtgaatgccagtcatgatcacgaacacagtccttgctaagagggtgatatgatttggctgtgtccccgcccaaatctcaacttgaattgtgtctcccagaattttcatgtgttatgggaargacccaggtgaggtaattgaatcatgagggctggtctttccygtgctattctcatgatagtgaataagtctgacgagatctgatgggtttatcagggtttccacttttgcttcttccacattttctcttgctgccaccatgtaagmagtaccttttgcctcctgccatgattctgaggcctccccagccatgtggaattgtaagtccaattaaaacctctttttcttcacagtcttgggtacgtctttatcagcagcatgaaaacagactaatacagagggtaatcaccacaggaatccagacggggagtggggtcagttcactggtacaaggatcttsatcaaaggaactcatttcccacctgatccctattcactccagggtccacatctaggagtcccaaagaccggcatgcatgggttgggtcaacaggctgcctggaggtttacctcattccaggagttggagaagcactgtgggaggaactggggttcaaatctgcaaacctccaaaacataggagggatcttctaaaagtttctgagagttctaaccacagattaggggaaaaaaaagatgccctttcatcaacatgggatgaaatgctaggatttagacatggtttttttgtgtgtttttgtttttgtttttttccaattcagaaaacactaaatcatgtaaaaatcttggaagaggagatacagattctgacctaataagatgctactgctctgattccaccatcagaatacctttaggttggcaccacttgcaatgtattagtgcagcaaactgcacgaatcccctcattagatccagggcccctgagagtagaaaggggagtggggcagtaaatggccagggaacaggagacagtgggctggagggtgtcccaggttctaaccccagctgggccttcagagccctggtrtggtctgggctaacctctcaatccttttccaagtcttaagtttccttccaactcactgtgattcttccagagaattacacagggcaggtgaaattatttcctagaaaatgcccatggagtacagaggttctcactgaacttctctattccagggccgatgcctttgttttaatggcagcgcatcatcgactaaccaaatccacaggtactgcacaggtctgaaggatcyggctctgagggataccgaggcatccggggctccctctgtcttctttctgtgtacacaaggtaccttcagtgactgcaaggaaaatcctcttgctttctacatcagagcacgttccataagggcaaagtgctccagtcatcacctcctgttttctctagccagacctgctctgagctggagacccactgcagtcaagcaaacttttagacacaagaaaaaatgacaacgtgtctattacagaggtctcagcttaatcagaaaatggcactgtgggccagagaaaagctgacggtgatggctcctaccccagtgcaataggcagatccatgagagctctcactggggctgctggagaactggctgctctctcccactttagtmacccctgcttcataamtgtctgtgccagaaagccacagtgagcccccagtggcccctgtattacccacccagagagacaasctctcccctccatgaaactcatttctgggacccacacctaaactttaacacaaatcagaaaagttgagactccttaaaaatgcgttttgcaagctcacaggttcttggttcataagtgatactatggaacaatctggttgggaagggtggcacacaatagaaaaagttaatgattatctggtgtagtttgctttagtctgtgagttcaaaagtctcctcatttacaataaccttaaaggataacaaaataaagtcctagaagaaatgtaaatttaattatttccattttctcaaaatattaattgctgatacaattaaatggattggcctaaactgctccaaagcttttcctatctgctaattaaatttgccctcgctgccataatacaaattctgggaaaccttctggcttctgggcacactatgtaggatgagagaatcaaatccattcagtcctaatctactgccccacttaataaacaaaaaatgttaagaacatgcatttwaaaaaaaatctaaatgccttcataatatagatacagcaagtcttcccataatgctaatgaaggcttctcacaagagtttaatgagctagtatccagtatcttccaggcccggggatgttagcttctcctcccttagtacagaggttgctcagacagcaatcagcatcatgatccatactaaatgcaacggccctactctttatctttatagtctgtaatccaagtcactctattaacaggcagaaaaatcccagctagcttcaaaactccctcatctttccattatttcaaatgacaaccttttcccactactttatctttgcattaagtaccaggagctgaaagatgcaatcaatttaatattkccctctgcccatttacatgacttatttgtttcggcrgatcttctttgccacaaatccttcatytgcccattcrtgtctgcatacttaacatagatttaatatttctccaggccaaagatcatatgcagagtttttctttgactggaggacagaagagacaaggagagaagragaacgtctggaattcctttgttcttggagacaactccagagaacaattctcaataagaaaagttataaaaagcttcaatcagcaccctcacgtttctgatttaaagttggggtgggggrgcgtggaataaaragagagggaactaaacatgtacgaaactcattctagcgtgagacgttgtcagrtactttgctgacattttatcataaaactctctctcggtggccacgggttacagcagggaacctaaaacctagacttgggaccccaagtcctcgcttcacaaaaatcatgacatgggtgttgaaccagtttctgttcagccacacagaaactcattcaagtccttcaagaggaagaatcccaccttcaactccacacctcctccagcaccaggcggagatgctcctgattccactgagaatcctcctgcccacacaggcaggaaactcggggcactcagtgcctgctctctcacccactgcatgcccacagacctctgcaaaggcagctcctttattcccccaatcctgaacatctgttaagtgctaaggcctcagagggggctttttaaacaggcacaaagtagaaactaccagctttccaccactcctacctcatccatcagaaaacagagccaccagccttccagggtagggttcatcaagccttttcctccccatggaactaagctgtacacagtagtcagagataaataatgtctaagccaaaccggcttgagggcacatatggaggtggggggcagagggacactggcctgggacctaaaccaccattcagacctcatctttacaaaatagtatactccacattccaaatgcctggcaaagttttgcattacaactcattcacgagtcgagggccttgtatacagtgttcggcaaacagtactgagcaagtgtggacatttctcatgaaaggcctcgatttcaaccagacccaaatattcttttaatccaaagttccaaatgtggaacttaccctcctctgagctcctagcacttgttgcctctatttctcttctggcaaaagtcgtagagtgtctcgtcacaccgcataagttgtctctctcttttaaatgtcaagtgtttttatcttatctcacaacagaatcctagtttgtgtcatctcatastgcctagcatgagacttgcacaaaacgggggcaccttaattgtgcagctgagggacacgatggaaactctggccaaggaactagcaaggaaacctgcaaagacacatccagacctaacctaggtgcgacttataactcaaacctcttccccagtctccctctctatgggagtgatatgtacacaatgtgttcgcttccacttccttaatgatggtggactgacatgaataagaatgatggggaggaccataggaccccaaataattcacaagtcagcaaagtgaagaactcacctaggccatacatgtgcacacattctctagcacacacacttactctcacactctactgttatttagtttgtttattcattccagctagaaccagggaccaatttggtcatccaaaaatgttttgtaaatctctttataaaattcctgcacctctcagggccagcaccagagcaaggcaagattggtgtccaggatacaaaatgtaaacaggtgctccctctcatggtgcactaccctgagagaagacctcttttgtctctggtccaagatttctcactctggtccaagatgccaccactgctgccactgccatcgccacctcctcctccttcccttcctcctcccccaagagaactatgaggaccaaaccactcagacactaagtggggtcaagcccacatgggagatggatttttacagagtatctcctccacgggcttcccattagctgtgaggttggagaatcaaacattataaacaaagcatgagtcctaacccacaagtggtttctcaactgtttggggagagagatgaatgaggagtaaacaaggtcctctgaacctactgataaaaagtacagagaaaccatcatcactgaccaaataacccagcaatggatgagcacaaaagcaacctggaagcaagagtcctcagtaaggaagatttggggggcttcatggaagatcaagtgggtgatggttaaggagaaaccacgaagagcgtagcctcagtaggtaacgtctgctccagctagagctcaccatgcatgcacaccaaacccagatgccgaaaaccaaaaaatacagcagaacgcacccaactcccaaaccactgagaaagtattttaattttgctttgatcactccagctgcgcttcagagtccccagcatttcagcagcatcatagaagaagacatcaatcactggccatggcacaaggaaactcctgcttggctatcgggctgctcagattctggatgagggaaagcttactttagtggaaaagaatgacttaaatgaatttaaattcattccacataatcgagttacatcagcatttctcatatgcacttatgaataattcactttggtaacagcaaaagccagaccagagaaagtcacttcaaagatctaagacttaacatcaatcctacctgaatttcctgctctcaactccttccctaaccactttatttccttctgccctatcactgaggtgctttgccagcctcctgtcctacatccgttatccctcagtaagctctctggaacttyccaattgcagccacctcctaatgtccacagcctcctcttctagatctagtttcgtaggcagtccctaagggtagggcccatcctaaaaagttcgactgcttcataccattccaagtctagaacatgtcctcagtctctagtagtgtttactgaaagccacggccaacagatctatccgaggtccccaacaaccttgtcttcaaaactgaatctcagagctggaaggaaagtcagtagaagaggccagatcgtgctttctgcaatagacaatggtgcttaagtgtacacaattttcatgcaaattcccccgatcatgaagctgggctgctccctatacttcttgtcatttgattctccaggccacctgcctctccagcccagctttataatggtaaggcactgatgagtttgcatttatttagatacactggagggattttgcgactggagttacaggaggctgaggagctggcatctgaaagtccatgcttcacgcttttcaaatgcactatgtataaccaagctcrtttccaaaaacagaatctgaactagctcataataaaccattcaccttttattttttgctgaaggggtcagagcatcatcccaattaccatttctctctaatgaccacttactcccttcttacacattttcatcagctctttattctacactgagtatttccaagaattaggataacactacygcccaataagatagagttggggttacccaaataagcaacagaagctttccagtgggaccgagtcaagtcaagggtctcaagtccccccaccctaaagcactgaacacgaagttcagggagcctgtgtctgaggcctaagcacttgccctgcatcacaatgagcagaagacacaggaggcacgacagccgtcatcactgcacagccaccagtacacctcgaagccaattaatcctgcaaaacaaattcctctcaaaatggcagtctgttaggtcaagtttggctgttttrttaatygcctatcaacagaaacagctttgctaggcacacccagaagttcatctctcctmatcacccacctttggcacccagtgacttttccaaggaggatctttttcccccctcagcaaacaagaaatatttggtgagctaaagaagcattcttctgagaaaattatacattctcagaattccattcataaasgactactggtcacaaaagaatggccagggrtaaggcaggggtgggargaggaagggcaggagayccaacggatggtgctgcctggacagtccctgaagtgataaagagttagaaccagayacacacttctgcattcagctgctgtctttccttgtgagtggaaaaacacactcagtacattctctgcaaycctgcttaaaacctcttctaaagcttctttgacacagttattcaaaagcttctaaaagtagtatcgacgtattacaaaataatccaatcatttcaagttcactgaggaagagaacaaaaatatatccttacatcctatctgaagaatagtctaagcacctaataatatcatctacttagcaaagcagaaggggccattcagaggtcaagaaataggaacggaaacgttgtactaggttaccaccccaggaacaaagctggtcttttctaggacccaaggatctgactagtttccatttgtctctgcattacaactaatacctctgggaggtgggggtgggggtgatcctaattcaaacagtaaggctgcccaggaagtayttctaataatatcaaccttcgtctttccttttttgtactgtaggctctttgtctcctgatcttcttttattttgttccccctttttactactaagcccaactcctggtctcagcagctgctaaaacacgtccaagcactttgcatctatccggaaatccagaatggcagcctgggttcacagatctgctgccaagggcagatgtatscgcactgcagctgggccctcctccccaggggccccatgggcacaagcagctcagggtgggccagcgagcctcagtcacactggctgccctcagccccaccttctgcatgaagggtggctaagctccatgggccactctgcattaaccccaggaacggcaacctcactaacttcatccaggtcccttcattaggacttgcaaaaacaaatcagatgcagctacacgttggggcagtgggtgcagcttctctaaacaaggccatgggtatcaagcaaccgacagtccctaaatacgctgcctctgttcccatcccacatggattctgggaaaaatggcaggaagaaagaagagaggactgggcgcttgtttgtgaccaaggcaaagaaacaaaaagcgacttctgttcaataatgagatgaaacagaagcccggcttcgggcagaggcctggcattcctgcacaacattttcccacccacctgatccccttgaacggaaggaagacctaagggaggacagagagccagtgtttgtttcctgcaatgggggtgagaggaggaaaatgaaactaaacaaaacaggagaagaggctgggtgggagaataaagtggtacgcacatacacaaacacacacgcacacgtgcacgtgtgcacacatatacctagcgttaccaaagaagaggataaacaggcacatgcttcatcctggagcagatggttggctacctatgtgagacctaaagttgtcataaaaatgcacatctttgtaatctttaccaataactgtgcccactctaaccactttaatgttatccatgcaaacagacagaggcatttaaaaaatatggtatttaatgatttaatgtcagtatcatacaagaatctatggatatttcttaaatgctcccaaayaccaaacttgcaaacaaaataaattcagtttcggaaccaaataaatagagtttacatatgactagggtgactccactggcaccccgatatagacatatgtacctcgctgaatgttctgtaaagatacagtttatctggacagacacaagaatttgaacagtacgaatcaaattagcaagaaccacacctacagtatggcccgctatttacaataattgaaattctacaatttagaaaagcaatacagaaggaccatttagttatggtagtgaacatatatagtcaacacagcttaagactcagaattttagatggtctyagaatgcaactcttagatagtttaatttaaaaaaaaaatagcagcagctgccaccatttaccaaaaacctatgtgcttggaaacatgttagatgcttttcaaatactgtcctattcctgtctcactgaaggaaggtgaggtctggcagctttgtcctagcaccacatacctgaggcaaacagatggcactatctcaaggcatcaacggtccttaaacctttgcatatgataccacttgtccacacaggaacgtagtttaaaagaaatacatcctgttctgtacaaaatgatgtattcttgcagatctcgctgttaatatgccatggggaaaacaagcaggggaaagctgtacatccgcatgtggagccacctaaacatcctgaagaccagtcacactgagagtgagggcaggcacaggatggtagcttctgcccccacggactccacaatattgtaaggaacagatgctcagggatatcaggggtgaggcctggccagccccatgacatcctgaaaacctaacagcggccaagctgaccccgcagaagaagtgatctaacctggatggtcacccttccctgcctaagactcaccctttccaccsgccccagaagcccttattcctccttgacttgaaaagacaactgtcccccataagccctcacacctcctaccaagctccaaggactgttctgttcttctgcctactcccgcaatgcagttcaaacgtttaccagggctctrcagtgagctacttttccaaagacagaaaagcaaggctatgtgcaatcagacgaaactccagctctcattgtaacatccagcttaaagccatatgttagccagtggcaggtacagattagaacccagaatggtctagattttgggtttctacttggggttccttcttccatataaatgatctctaaatttcttaaaccctgattcccaaattatacatgatgatcagtgtgccatttgatgagttatgaacattttaaatgctgcataccttgcctgtatgtactaggatcaaagaggagagagagagagacagagagagagaccaagcaacacgaacacacaggcagatcaggaagcaagaaatcttctcagagcagaccacggaaaccctcartaacttactcaattttagagtttgaggaaacggcacaggtagtccgatgcaagccccccgagttcaaagaaaggaaatggaagtacagggcagacaggtgacgtggcaaccgtccctaggaaaggcactgctggacccagctgtccctgtccctcaccagcctcacatgccsaagtcccatgtacccctggggctgccatgctggctgctgagccatgggcgctggtttggagrtgaacttcttcgaggaaagcagcttcttatcccccagaagttctgcagatcatctgtgcactttggtttttacttaaaatgtgatttaaacagcctgctctacttaatactgcctgtgccacagacagaaaaatcccatctcccacccaccagcctccctggaacaaacaccttggctgtctctcgctacctccragtcaggggaacattccaacyaggatggtgctcagagaccccaccttttatagccagagtccctgattcacaccatatgcccaaaggaggcgtgtttctaagtgatgcttccaacttcaccaccagccaaacttaacttttgaaccaccctatacacgcaagttgagcaaggcaattcaggacaagattaaccacgggcccacacgctccacgtcatccccactctgccgagaatgtcacactggcatacacatgaggaaagcaagacagaggtattaacgcaacaaagaaagaggcttttcaagcacaggaagaaaccagaacaawtgtacaaataggtttaactggtgagagctgaaggggctccagatattttccaaatacttggcatgcaaaaatcaccacaagtcagtggttctgaaagctttttggtctcttagacgagatccctattaaaaacttctgaaggaggcccaggatggtgacaccatcactaatgacaattagccaaaagcaaagtctttgaggcacaaggcacacgccccaagaaatgaggtgggctaagccaggtcccagggaacctgcacacaaactgcttcaccatctcggcaacaagcgtcggcaatcaggcagaagagaatgtgagctccacgcctgactataaaaggcatagcaatgaggcctgggggcatgtgacccccttctaaataaagatcacccccacactgggagcagctgaccagagcagaggccttccagggcaaccgagacaagttcctaccaacaacacaaagccagatgcccctctcctggctgccttctcctccagggtccacaagcccctcccaagagtccacctgaaaatgcaagcctgtgtcatgatcgtcttagcagtctggggaacagtggcctgcagaagaccagcagcagaccacacagtgcttaacagaaacatctcagctcttcacaagtagcttaagtttaaaaaaaaaatgttaagatgaaatactgcacatcacatgagtgaagtctcactacaaagacaatgtgcccctcttccccccatccagcaggtgatttacacattctttttttattattattttcctttctcaaagctagccataaaacttagttacaaaatctttttttttttttctcagacaggatttcattatgtcgcccaggctgaagtgcagtggcacaaccacggctcactgtaacctccatctccccaggctcaggcggatcctcccatctcagcctcccaaagtgctgggactataggcacgtgcctccacaaccagctaattatttaaatttttttatatgaacaaggtctcaccatgttgcccaggccagtcttgagctcctggactcaagcgatcctcctgcctcagcctccccaaatgctaggattacaggtgttagccactgcgcccagccttcaatttacacattcttaaacaggtcctccactttgatctagcaggtcagccacaccaacctatagaggaaaacgagggaaggagagcgcctctactccgcaagacaacactgcccttgtgagcagtggctgacaaacaaggatataagaacgtggcggtggaaaaatgtagacttttttttttttactacaacctgccttcattttaagtcagtgagatgccatcagtgagatggcagtaaaatgttttccttttgtcaataaaaacagccatttactgccttctcgaaggctccaatctgctattttcctggtttctcattttgagggcaataggaaatgcaacaaactccaggactgctgctcccagtcaatgcccttttaattgaaataaggctgccccaccagctaagccagcttccaacacagcccggccctgccttcctggatttcctggcaaagcccaggccttctcacacgcactcagggtgatctgagcagaccacaggctgttcatcccawtrggttaaaaagtacttggaracttagttgcagtaaggtcttaggttttgttggggttttttttgtgggaaagtgaaggcatctgcacctgaaatgaaataccagaaagcctccacagcaagcaaacaacaggcacttaggtaaattcagcaggaagtaagaaaaccacaggtactcaggaggattcacctccgtccctcccagggcagaactggccttcagcaaaactgccttacaaagtcatgaatggcttcacgtgccaagcttcaacctttcagatgatttccatacttctccatcatctttggcctggaatcatccccacaatggcaggaaagaaaagagctacccgccatagtggtcctctctgccaactaagagttgcagatgattctggtcagtactcctcagtagcaatgacagcaacaatgacacagtaaacatctgcatttcataatcctggtacaactggctcaccgaagactgccaggatacgcyactctctgctcaaggggaaaatgtatcttccgaacaataaatccttcactaagcagatgcagtgcttgcccttggggtgacagcatacagtggaggatacacccagaatttacagtggggcaaaaagtgtcccatcaggtgctgggagacaggcctcccgaaatctgcagagcctttacatccttgagaggaaaaggcaaggctagagttcggccaggtgagccgtgccggctggtcagcacgggagagcaccactggggccaaggacacagcaggcaggcrggagggagtggcacatggagtgtggcatgttgtcacggggtagctgttgaccactcaggagcttcacactgtaccacatgcctatcctatagggacttgctacaggatttcaggtaggggagctcatcagtccaaagtgcacactagatggccgggcgcagtggctcatgcctgtaatcccagcacattgggaggccaagaccggtggatcgcctgaggtcgggagttcgagaccagcctggttaacatggtgaaaccccgtctctactaaaaatacaaaaattagctgggtgtggtggtgcgggcctgtaatcccagctactcaggmggctgaggcagtagaatcacttgaacctgggagcccggaggttgcaatgagccaagatcgcaccactgcactccagcctgggtgacagagtaagactctttctccaaaaaaaaaaaagtgcatactgaaaagctccccagtgctcggtggagccacaggacacaatagcaggagagaggctatgtcactgctgtaagggggaggagcagaggaacacagctgaagcagcatttccattccattcgggagggaaagggcctggtatccaactggagaaggaagtgtccaaaggacacccacattcctgacataagaaccaggggaacaaaagtgtggcccacttaagagggaatagaaaagaaaaaaaataggcaaaagtgaggaaacagggaagaccatcagaggctgtagtgaaatgctcgtggtggtctgatatgaatgacaagtcctgggttcaaaagggttctgggatggatatgaatgacaggtcctggactcaaaagggttctgggctggagatacttggaagtttaggtggagacaggaggcaatgcagttaccagtggatgagatgagaacaaggaaagtgaaaagagagcccaggacagaactccagccatgctatgatctgaatgtttatgtcccctcaaaattcttatgttgaaacctaatccccagtatgatggctctgggaggtgattaggccatgagggtggagccctcacaaatgggattagtgcccttataaaaaagacgccagaaaaaaaatccctcgccccttccaacatgtgaagacagtgaaaaggtgcttctgtgaaccagagtgtgggccctccccagacagttaatctggtaagcaccttgaacttggacttccagcctccagaactgtgagcagtatttctgttgtgtgtaagccactcagggtatgggattttgttacagcagcctgaatggactatgtcaggagaccaccgttaaaagccagactgagggaagggagacagagaagcggcacctgtgggggtaggaagagactcataagagggtggcgttggaagacaaggaagaagaatcaaccacaccacatgtcagggggtgccacacaactatgttcttactgaaaggaaaccactgtacacagttctttaagggtcaatcgctctttaggaatgactcaaaaatgtataaaatccactcctaaatccaaaaagaaccgagaaatacagaagtgtgcagagaacccacagagggatcacgtccatagagggagtagagtctactacgctgccagacactgcagagtcacggcacagaaggagtttaaaggacagtgccaagtgaaaaccrcgcaacagcacgacaaaatcgagtaggctcaacgatttcacacacacccttgacrtgtttctccagatgttctccgtagttctacagccagccaacagaagattacctgaatgggattcttctgtgcttaatgttttcgaatggccatcttaatgcttatgttgaactcaaggtagccattctgcctggactcaatgcccttcatggagctccccaaatgattcctaagggttctggctggagaggtacatgcggggctatgagcgctgcagtgacgactcagccaaaaagatgatgaggggaagaactcctggtgttaaaagaaatgctctaaagcagcttaccaacacagaatgcaagccacatctgtaattttaaattttcaagtagccacattaagaattaaaaagagtcrrgcatggtggctcacacctgtaatcctaacactttgggaggctgaggcgggcggatcatctgaggtcaggagtttgagaccagcctggccaacatggtggtgaaaccccgtctccagttaaaatacaaaaattagacgggcatggtggcacatgcttgtaattccagctacttgggaggctgaggcaagagaatcgcttgaacccaggagacggaggttgcagtgagcygagatcgcgccgctgcactccagcctgggtgatgagagmgaaactccgcctcaaaaaaaaaaaaaaaagaataaaaaggaaacaggcaggtgaaatttaagaacacattttacttaatctaatatatccaaaatgttatatttcaacatgttatcaacatagtaattattaatgaaatggtgtacagagtttttgctatactatgtcttggaaatctagtgtatattttacacctaaagcagtcccaattcggacaagccacagttcaagtactcaataagccacgtggcttactcaataagcggctaccacactggacaatgcaggtctaaatggaatctacrcaaaccaagaggaagttctgattcaactagaaaatctccaagaaatatgcccatgcctgagttttcaggacaaggggaagggaagtcaatttcccggaaagcagttaccaattttatataagtactccattgtgaaatcacaaggaacatcagcagggctgggatggtcaaggagaaggctgcagggcgtggccttggggaagcaggtgaccaaccaacaggtgatatcaaggctctgtctgtcaccagcagagcccaccttctaaccatcgttaacattttcacggtgcttttccttcctccttttcatcttccaacagccctatgaggaaggcaggctttaccccattccacatatgaagaaaccaaggcccaggcaatttaaataacttgctcatttctagtcgccactcttagacttggacccagaatgcaggcctcacccctaccccaggggtcttcaawcagtagctcatcagaaacagccaaaaacctatggcaagaccaaagtaactacctacctagttcgtgaacaactctccacttaatgacgtttcatatggcacctcccttctctaaagagcttatgagttttcaaaacatcctcatgcccatatatgatcaccactaagggatgtactggactgccctagaaatatcctaaaaaagcccaactacagcccagaagggctggcccatccaaggtcattcctggccctcatcaccacattcaacatctcttttctactccatgctgcctcccttgataacaccttttacttttcagataaaatttttaaatgtcaaggttatttaaaaaatatattttgttgttttctcaaaccagtgggtaacttaatgatagggcagttttaatcaaccacacaagtgactttagcataagatctccctccaactccagccaaccttaaagtggcctgactgcattctcagagctctacaaggtactggctgcagccagtgggacccctgccctcactaatcaatgttcacatacgcactgatccaattctgcagaatagaaaagtgcgtggcagatcagggtacacagatccttttcctgcctcaggactggttgaacgggaactgaagggctacctgggaggtctgtcctttatttactttacacacttcacccctgtggggtctcgccttttatttattttaggcaagtctaacaatttggggtttcttggttcttcataactagagaacatgggttccttacatctttaactgggccaacacttaaataatagctatttatagctaacacactgacttcaaaccagtgaggaaaagcttcctagccaatatacataactattgctgaatgcaataaggtgaaggctcagagtcacattttaataccaaacagcctggttcttaaggaactgatcacatgaaggcaagagctcagttattctcaagggaaaataagcatattgcagataaatatacaagaagcttcaaaataccaccatctgacccccagaacagtaaatactttccaaagttccttcactcgtgaaatcttaagattttcacaactgttcagtaaacaggtataaaagaacgaaaacagaatcccagaggtttaaaaatgcaccctgctacacagctacctgcaagtacagcctgaacctgggacttgcagaaatgggtccagaggtctcccacctgggccaggtgctctgtcataaccaggacacctgagtatcataacatcatcactaggacctaaggaccactttcacaggatatgagttagtgctttaccttccctttatttaaccatattccaagtccattcaaactaaggaagtcctgcagaacaaaaaatatcacttcgcacaaaggatgaaagagctgacacataagcagcccccagctgccaaggctcagggacttccaagcacaccaggtcacctttctcatcaggaattcaaagctgaaggtcagcaagtgtctagcccaggagtgtgctggattatttctaacatgtgatttgaacagtcttgacagcagccatgatggcctccagccacgccacagtcccgcaatccaagagtcccagatgcaaaggaaagccaaccaagacccccactgggaaccacttccgcacagcaggcatgccacgtcctaaatgcaacacgactgcaccctgcccagcggaactcgtgcactcagaagagaagggaggtcaaggaggaggagaggagagagagaggcagagagaaagcarcagtcagcatcattcttacttttctggcagcggtttgtggtccagcagcggtagttgtactcattgttgatggtggtcttctcacacatcggcttctcctccatggtccctggacacaggtccccacattcctttgggggcttattccccacaatgtagttattggacaccgcatccaggatcagggaccagtccacagtggagaggtaacagaggtcagcatttttctcaatcctgatggccccccgagtaatgttyctcaggttgtaaagcccaatatccttgagattggtcatctcgaagatgaccagggcgtagttgtagaagagtttccagccgcggatgaccgtgaggttggggaagaggtctccgaggctctcgaggccagccactcggaacagcagcaagtactcggtaatgacmgtgagcttggggaagcggtagctgcggtagtcctcggccttggagatgagcaggatgtggaggtagccctcgatcaccgtgcagttctccaggcgcttcagctgctgatagtcgttgcggatgtcgatgcctggcccgcagactgaagggagacaagagggtaaacgtctcagttagaargaaataatttttaaactattttccaaacaataatacagttggttttcaggaatcctgtattattattaaagaaatgaggttcaattgttcactgcagagctgtgggttgcagactgacagtttaggtggctaaccagttagctggcatttatacagtgccaacactggaccagacgctgtgcaacacactccaaccgaccatgggagaggccatccccgttaaccgtgcaaactaaagcttacagcccagaggcacacagaggcagaggcgaaagttaaatctgcaacccaggccagccggactccaccaccgcacactcctggtccgttctgcagagcgtcagttgccaaggcctgaacgacagctcag

SEQ ID NO: 13233 - DNA, 199130 bp, Homo sapiens
  misc_feature (1)...(199130): n = A,T,C or G, or insertion/deletion polymorphism (see Tables 1-2)
tttttaataacttagcaccaaggtaactcaatgaaggaaacaacaaatgatgttagaactactatatatttgtgtttcaaaaaaaactactctcaacctctaccttaaaccatacacaaaatataattcaagaattcattcaggatacatcacagacgcccatttagcagaacaaaatatggatgtctgagtacctgggtactccatggcctctcaagtagttaaataatttatttttctaatgtaacaacaaaacattacagttttaacgtaatttgaccaagccccttagatcaacaggtggctccactggggctgcagtgagctatgattgtgccactgtgctgtagcctgaatgacagatctagtccctaaaaaagggagtaggggggaaggtagattaaatgcgagatatttggtcagtcattggtcaaacactgctaagcactatgacagacaaaagtcagccaatagcttcgtttatgagcccacaaaatcaatgatcacagttattatgtgatcatcactgtgataacaattgaaactcatcttaacctcaaaatttctcacaacaatttcctaggtgcaaatacctgatcaaactctataagagcagtctgctcttataaaagtctataagagcagtctgctcttataaaagtctataagagcagtctgctctgcaggaaaatacataattatcacattgcacattccaccttcccagagtcatctaaaatttagcggcgtgctggtgaaatgcttaacagtcggctttaggcaagggctgatttgtagtgtagccaatttccattgcgtattcattcatcgtgagcatgacattactgaattgtgaaactactgaacccagagatgggaagagacgcacagtagagcaccatagtatagtatctcctccacaaagatacaatagatgtataaataacctcaaaagtaaagtaacaataaaacatggtaaataataaaagtgatgagtttttagtattttcactgcctttgtttttaacataatttacgtaattttacgtttatatgattgagttttcaatgatggctctgtttagcaatgggatcccgtgagtcagtactaaattaaatacaacctaaacattcaaaatagggtaagacgcataacttaaagacgtgctccactgcgaattacacggaatctttgactatgccgactaaacagaaggctattcctaagtaccatcccatatgtgctagtttttcaaaaccaacaataaagcagttggggaggtgccttgtacacagaatgacgccacgaggcatttgagatgaacgtccaaagggacaaagaagccagaccgcttccgagaacggggacagaatgtcttcgggcttctgcgccgggggcggcgccggaaggctgggtgagctccactggagacgacaccccagggtggttaggccccagacacgcgcgtgaccttggccggaccctgggagcggctgagccaggggcgatccccgagcgccctccccgtccccgcgccgcttggactccccggggagctcggtcgcgactggcgggcgcggagcccttccccttccggagcccaggaaggcggctccccgcggcgccggccgcgcgcgcgcccgcccttaccttgactggacgcggccatttcggtgagcttgtctcgcgaggacacacgtagaggatctgcgcggtaggccgcggagtggcgcgcagttgtcgccaccacttggcttccggcacgtggggcagatgtttccattcccacggcggcagcggaagagggagggccgggcgcgccgcggctgcttgcagtctccgcaagcggctacatcacagagctcagcgtgcggtgtcacaggccccgcggtcccgcccaacagatgcaccgagatgcgcgtgcgcagaaagcgtcccgggggtgaggctccctccctcgctctccctctactcccgccccactctcccccactttcccccctccacccaccgcggccgtcggggctcgctcgctcagtacctggaggcgagttcctgacgcgactgcgactcaatcctcgcctggtgaagaatattttacctatgactcactgaaaataaagacggctgagtgaccgtgtttgttcatgtaaacattgaacaaatatttatcggcttctgcgatgtgtcctactcttttagtggaggaagacacattttatttatgtatttaatttttcttttgaattttacatgcgagttatacttaataaaactcacttcaaaatataccttcaacagaaaatccagcaacagtttctattatgttagttaaaacagccagtcttttcctttacttttaaaaattattcataaatgtaattagtgaatgataataaacattgacatctgatccactgctttaggagtgacacaaatgaagttaactcaggctattttctttataatcattgtgctattgttttctttttcttttcaattatactgcttaatataggattttgtggcaccataggagttgagtaaaaataaaaggaataaaaatataccttatctggccgggcgcggtggctcacgcctgtaatttcagcagtttcggaggccgaggcgggcggatcacgcggtcaggagatcgaggccatsctggctaacatggtgaaaccccgtctctactaaaaatacaaaaaattagccgggcatggtggcggccgcctgtagtcccagctactcgggaggctgaggcaggagaatggcgtgaacccgggaggcggagcttgcagtgagccgagatcgcgacactgcactccagcctgggcgacagagtgagactgcgtctccaaaaaaaaaagaaaaaatacgttatctatgaagatttccaatttgatttctatttatcacaaatggccacagtactcctttgtactttaccacataccatattgtattcagtaattatttgtgaatatgtaattgataatattgtaggttttagagaatccttgaaaacatgaaaatttggtaatggggtctattttgattatttatttatttatttatttattttatttttgagacagagtctcgctcttgttgcccaggctggagtgcagtggcgcgatctcggctcactgcaagctccacctcccgggttcaagcgattctcctgcctcagcctcccaagtagctgggactacaggcacgtgccaccatgcccggctaattttttgtatttttagtagaggaggagtttcatcttgttagctaggatggtctagatctcctgacctcgtgatctgcccgcctcagcctcccaaagtgctgggattacaggtgtgagccaccgtgcccggccatattttgatttaaaatttagcaataatagataaaattttcaatcaactaagcccttgggccagggaatgctattccttaaaaagtgcttctatcaatatagcctctgactcattactttgttaatttttaaattgtatttcattcctgattaacattcccacccagattattaattatacaatctgttaactgtagaacctcaaacatgttggattgtactgtatttgtctggaagacacatttttaaaacattgtaatcgctataagagaagcactgggaaagaaaggagcttctatgcctgcagtgcctgaggagccctttaacagtgtgccccgcccctaagctactcatgcagtcatccccatcccagttagtcaactttattccaaaaaacttggtgttccaaatttttccttctcaaagcccacagatccaaaattcatcagcagttcccacaaacgttaccctcacaatgaatccagccatttttcaccctctccagtggtaccatcatagcccaagccgccaccatttctcacccccggttaacaggccaccctccttctacccttatcctgctagagtttgttttatctacagtgatcagaaagatcagcctaaaagataattctgatcaccaccctcctctactcacaacccggccgtgtctccccattgccctcagtgtagaagtcaatgtccctttgctgaaatgcaaccttagtgaaactttccatgactaacctcctttaaaattgcaacctggtccacccttactcccccttaccccacttctcttttttgcacagcacttattttaccttctaacatactgtataatgtactcatgtattgtaattattgcttatcatccctctttcagttgcttatatttttcatcaatgtgtacccagtgcctaggacaatatctgtctaggacaaatgggtagttatgtggctgtaggcaagccatttaacctctctgtacctcagttactttatctgtatccactttgcggtgttgtcatgaggattaaatcagatagcctatgtgtagcacctggcagtgaatttatcaccctgtactgtaactgtctacttttctgtctcctccattggactgtcattcccagggggttgggaactgggatttcttcatttctgaggcatagaagtatagcatagtggttaggagcatgacttctggagccagagtacatgggtttgaatgctaccactcacaagctgtgtggmcatggagaagttgcctaacctctccgtgcttcagtttcatcacccataaaatgaaggtaagaatagtacctgtatttaaaagcacctagaacagttcctggcatatagtgtcagctgtcatctctgcatccttgtacctgtcagagaggagtgtttatcaaaggggcttcttgctgcctgtttccaaaccagtcgacaatataccaattgctccctaacacattcttgtttgtgcagaactgagctcaatgataacatttttatagcaaccctgatcaagtttcttctcataatctcttacactttgaggcccctgcaggggccctcactctccctaataaacattaacctgagtagggtgtttgagctcaccatggctacattctgatgtaaagagatatatcctatacctgggccaaatgtaaacagcctggcaaaagtgttaggttaaaaacaaaacaaaataaataaatgaataaatgccaggtggttatgagtgctattgagaaaaatgaagccaagagggatatcagtgatgcaggtgggggtaaagagcttacaacataaatgtggtgttccatatttaaacctcattcaacagggaagattggagctgaaatgtgaaggagttgtgggagtggaactacgtggaaatctgggggaaaggtgttttgggtaaaagaaatagcaagtgttgaggtccaggggcatgagtgtgcttgatattttagggaagagtaaggagaccagtataaccagagtgagatgagactacagaggtcaggagaaagggcatgcagaccatgtgggatgctctaggacctaggccatggtaaagatgtagggttttaccctgatggaggtcagaagccattgraggattctgagaagaggagtgacaggactcgctttatagttttaaattataactataaattatagtttttaaaacaatagttgcctaacctcatgttatatgtaaaactacagttttaaaaactataaattcctcatactggcagcagtgtgaggggcaagggcaaaagcagagagactaacaggttgctggttactcttgctagtgcaagtgaattctagaatcttcgacaacatccagaacttctcttgctgctgccactcaggaagagggttggagtaggctaggaataggagcacaaattaaagctcctgttcactttgacttctccatccctctcctcctttccttaaaggttctgattaaagcagacttatgcccctactgctctcagaagtgaatgggttaagtttagcagcctcccttttgctacttcagttcttcctgtggctgcttcccactgataaaaaggaagcaatcctatcggttactgcttagtgctgagcacatccagtgggtaaagttccttaaaatgctctgcaaagaaattgggacttttcattaaatcagaaattttacttttttcccctcctgggagctaaagatattttagagaagaattaaccttttgcttctccagttgaacatttgtagcaataagtcatrcaaatagagctctccacctgcttctttctgtgccttttgygattctgctttagkgccaccasaagatrctrccbgggtgcagtggwactgtcakrggaytatatgcaaagtgatctcggtgagctgcctgtggacgcaaggtaaaggcatgtcctgtagggtctgatcggggccaggattgtggggatgtaagtctgcttggaggaaggtgcagacatcgggttaggatggttgtgatgctacctgggccccaaagaaacatttctgggtaaggtgtgcacacatctgtgttattagcagaaatgctaactgccaattcttttcataggtctgacctatttgttgatattttgttctgttttgtccattgcttctcttcgtcatatgctgctcctccagaatctagagactggagtagagggagggtgaagggacaaagacaaaacttccctctgcctgcccaagcttccatagagagaatcaaggcaatgaaatccaatcaatatcacacacaagtttcatgtctggttctcttgtgtgtacatgcaatgtgtgtttttataatatcttttcctactttgggtgtaaggataatatgagccttgagttcagaagcttttcgtgttttgggggttctggtgcatttaggcagagtattaaataactttatcaatattgtctatggtcatcagttgattcagatttttctacctcttcttcagtaaatattggtatattttggtctatactttcatagaaagcaatctactgtccctagatttgataatgtattggtatcaagttatgtaagagtctcctgtgattttgttaaactgttctgtgtctgtagttatattttctttttcattccttatgttgtatatgttctcttcctctcttttaaaaataatatttccaggagttttcttgattttattggtcttgtcaagaattttcttttggtttgatttatcaatctcttttttctttctgttgcatcagtttctgcttctactttcattgatttattccttccttctaatttcctttggttcattttgttgttagatttttgcttcttgagttgaatgctgaaatcatttattttatttttttgtcttctttaaatgtgtattataaagatttaaatataatacatagattgtggctgtgtaaacattaaatgtggtcatgttgtacatactttatattctttttggttctttctgtttggctccccaccctctttccacatcagtccccttctcccccacctcagctaggtaaccccagtatgataatatatattcacatacacatacacacacacaaaggttttcttggacattatttgttttataaaattgggacattatacacacatttctcactcattaacacgtactagaactctaagtcaattggtatagctttaattcattatttttattggctatataagattctatggtatggctgtatcacaatttagtcaatatgttcactttattccagtttttggctactatatcctatatcattacatactggtgcttttacttctgttgaacaaacttgcaagaggaatattaatggaacgaagggaatgtttccttctaagttttaatttccaaagaggtcagaacttttcaaacatttctaccatcgaagtatgaaaatggccttctctctgcattcacatagcgataagttttatcctgtttttaaaatttgccaattttacaggtgtagagtgatattgcatcattactttcattgtgttatttttatttmtaataagttgagcatctttttaaatgcttgttggctattggatttatttgggggatttaattagtcatatgatttgcccattattctttggactctttcatttaaaaaaattatgagaacccttttattattacaaatattaactctttgtcatgtatattgcagttttccccaagatctattgtttgtctgttgwctttcttataacttttaccaaaacartttttaatttttataatcagagatatcttttctttcatatcttcagagtcggcaaggttggttaaaaatgtttcccacacctcaagattgtacgtgtaatctcccagattttcttgcaagatgtttactgtttcgctttttatatgcattgcttcaattatctgctaattacttttgtcatatggcatgagagagggatttgtctagttttatttccatccagatcaatagcctattgtgatggcaccttttgccactgatttgaatcaacacattcatcatataaagttctcatatatattagcatatatttctggattcattaggctgtttcactaatctactattatcttgctatgccagtaccatagtgatttgattacagtgagcctatgatatcttctgatatctggtgggtgaaagcaatcctcactattctttttgtacctttcttagctattcttagacactttattcttccacataaaactgttaagatatttttcaaattaaaaagatccaagcyctgttgtgattctaactgcaatttcattaaactcagaccttaattttattaatgtaataaatttaaatatttttcttattacatttatctctgtgtattttataagtgtgatgctattgttaataagatagttttctcctatttccatttatgagtgcttagtaccaaatagagataagctatkggtttgtgtattttcagctttttcttttgagcctgggtctcattttgtcacccaggctggagtgcagkggggtgatctcaccttactgcagcctcaacctcctggattcaagcaattctcctgtatatcagccccccaagtagctgggactacaggagcaggccaccatgcccggaaaatttttgtatattttttagagatgggtttttgccatgttacccaggctggttttcaactcctgagctcaagcattccccccacctcagcctcccaaagagctaggattacaggtttgagccaccgcacccagccattgtatattcatcttaaatctagctaccttaccaaatttgcctattaattctagtaattttaccctaaagtctctgtgagtattgaatcatatcataagttaaatgagacagattttagctcatttccaatatttatagccagttatttcattttcttatcttattgaatttattagaaaacaagagcaaatgttaaataataacaatgaaagtgaacattccttctactctatgattttacttgaaataatttttgtattttgctatttagagtaacatttgctgttttggtttttgtaaatggtgtttattctattctcatttgccacaaaatgtttatcataaataagttttcagcagctggtatcatctgaattgtcttctttgatatgytgatgaacaaattatgttcatagatgtcctgacactaaatacccttacattcttggagtaaaatctactattcatggaatttgatcattagtgggttctatgtactatttctttagactattcttagtagattttcactactcaacctactaataataataaacaaagttttgttggctttatcaaatgaattgatgagtactccatctttttctattgcttagaatagcttaagtaacatttgaattatccattgtctaaaagttaggtgagactcacttatgaatccatttggtcctagtggcatttgcaatatctttaatcacccctccaggctcttctatgataatcagtcaattcaagtttcaacttccaataattatatacctttctaggaagtaactttatttattttttcaattttgttgccacagtgttgcatgtagcactcactcatgattcttttactccacattatctgtagttatgtgccctttcttattcctaaattcctctatctttgctatttatctttttttccttgaataagcttgccaatgacttgtctattttgttgctggtggtgctcttttcaaagaatgggcttttggattttttttttttctagttggtataaagcatttttattttcactgagcagaaaaagaagctattgattcattaactgtgctgctttattggcatgtagctatgcactgttcacacattaatatataaaactcgtcagtctgttttattttgtctgatgggaaaacatgaacagtgagatttcttatgcaaaaagtgaacagttcaactatgctagctccatatacctttattaacattccagagacttatcctctcaacatgatctgatttctgtaggataacttttcaggaaaagtattttctgatcagtgaagcttggagatataaataagcaatcggccaggtatggtggttcatgcctgtaatcccagcactttgggaggccgaggcaggcagatcacctgaggtcaggagtttgacaccagcctagccaacatggcaaaactccgtgtctaccaaaaaaaaaaaaaaaattagctgggcatggtggtgctcacctgtaatcccagctactgaggaggctgaggcaggagaattgcttgaacctaggaggcggaggtggcagtgagctaagattgtgctcagcctaggtgacagagtgagactccatttcaaaaaataaaaaaataaaaaaaagcagtatctctcatattcattaactggaccctgactttcttaaagctcaccccaaagctgaagtccatgaaggcactagttctcaaacttcagtgtgcataagaatcactcgggaagcttattaaaatttacattcctaggccccatcctcagcaaactatttagtccccaggtaattctatcccaccccaccccagctttattgtggtataattgacaaataaaagttgtatatatttaaggtgtacaagataatgttttgatgtaagtatacattgtaaaatggtatagcatgaagggttttcttttcatttttttcagaatagtttgtaatatcttctttgatttcatctttgataatctagacgtatgattttaattgctttttaaatttgtttatcaagttagtttgtagtatttgggtcaacattgaatatcctgttaatttcctattgctgtgtaacaaactacatcaaatgtatcagcttatgacagacccatttactgtctcacagtttctgtgagttagaagtccaggtggactcagctggatactctgtgcagggtcatacaaggccaacaccaaggttttaatagggctgcactccttagtgaaagctcttggggagaatctgcttacaggctcatttggaatgttagcaaattcagttccttctctcactttccatgtagtgccctctaccagcaatggtgcatcaacactctctcatgcttggaattgctctgacttcaattttccgtgcatatctctggccttttttgcctctctcttttacttttaaggactcatgtgattacattgggccgacctgggtaattcagaatactctccccatctcaaggtcagctaatcagccccttaattccatctgcaaagtttaatttgccacataatatatttttggacatgacaccaaggagcaaaggtgatgtgggccaaatttttacctgccacaggtatagtttacatacaatgaagctcatcaattttaaatatgcagtttgatgagttttgacaaatgcatacacttgcataaccaccaccctaatcaacatgcatttacatcaaccctcctgcaactttttaatgagtctctcccactgacctggcctcagccaataaactgctatctggaagttacagatttgttttcacatgttctagaattttacatcagtggaatcatacggtatgtattcttctatggctttttttcttcagcatcatgatttggaaattcatgcaggttgttgtataaagtatttctatcctttttattgctgattactgctccattatgggattatatcataattttggattatttccagttaggagcaaatacaaataaacctgctatgaacagtgctccacatgttttgtgtgaacatctattttcatttatcttagttaaatatctaggagtggaattgctggatcatatggtaagtgcatgtttaagagaaactgccagacagatttcttgaacgtaccattctatactcccaccagcaatgcatgagagttccagttgcaatatatcctggacaacatttgatgttgccagtacttaatgactgcacagtggtatctcactatacttttttttttttttgagatggaatctcatcccatcacacaggctggagtgcagtggcgcaatctcagctcaacatctgcctcctaggctcaagcaattctcatgcctcagcctcctgagtagctaggactatggtcacacgccaccgtgcccagctaatttttgtatttttggtagagacggggttttgccatgttggccaggctggtctcaaactcctggcctcaagtgatccacccgcctcggcctcccaaaatgttgggattacggcttgagccactgcacctggttatacttttaatttgcgtgtctctgatgactaaagatgttgagcatctttgcatgtgctaattagccattcctatatcttcttggaagtgtctattcaaatcattggtcctttgtttttaaacgtagtttcaacttttattttagactgaggaggtacatgtgcaggtttgttacatgagtatgttgcatggtgctgaagtttgggttacgaatgaatgatcctgtcactgaagtagtgaacatagtacccaataggtggtttttcactccttgctacccttcctcctccctctttcctctagtcrtctccagtgtctattattctatgtccatgtgttctcatcatttagctcccacttctaagtgagaacatatggtatttggttttcagttcctgtgttaattcacttaggataatggtttgccagtttttaattgggttgtttgtcttgttattgttgagttttgataattttttatatattctgggtacaagactattcagaggtacctgttttgaatgtttttttccaatctatggcttgcattttcattttccaaatggtgtctttcaaatagtggaaatttatagttgtagttaagtccaatttagcttttcttcttctatgattcatgcttttttttcccctgtcctaggaaatctttgcccacctcaagttcacaaagcctttcttctgttttcttctagaacttttatcattttagcattagtatttaggtttataatacattttgagttaaattttctgtatggtgtgacttttctttctctattgaattcccttggtgcctttgtagaaaattaaatgactgtatataggcaaatctgtttatggattctctagttccatagatgtgtatatctgtgcttatgccagtaccagattgttttgattgttgtaactttatagtaagtcttaatatcaggcagtctaaaacctccaacttacttttttattgaaattgcttttgatatatttaggcttttatatttctgtattaattttatagtcaactagccaactccaccaaatagccaactgggattttgactggaattgaattgaatctgtagatcaatttggggagaattgacatttaaacaatactgaatctttcaatacaacaacatggtatggctttgtttctttaaattttctttaatttccctctaggatattttgtagcctacagagtagttcttgcaagaattatattaattgtatccccaagtattttgagggattcgatgctattgttaattgtatcatttttatttgttttcgttttccaatcatttgttactaaaatatagaaattcaattgatttttgtatattgaccttgttcactctaatcttgttaatttgcattttagctctagtagcgttttgcacttcttttagaatttctacatatacaataatgttgtctgcaaataaagacagtttgcttcttcctttccaaactggatgctttttattttttttttcatgccttactgtactggcaagggcctccagtacaatgttagatagaactgatgatagcagaatccttgtcttcttcctgatttcagagggaaaatattcattattttaccattaagtacaattacttgtaaattttttcatagatgccctttgtcaaattgaggaagtttccttctattcttggtgtgagagtttttatcaagatttgatattagattttgtcaaatgctttttstgcatctattcaaatggtcatatggtttatcttgtttattctgttatggtgaattaccttgattgattttttaatgaggaactagctatgtattcccagggaaaaaatccacctggttgtgacatattacattggtaatattttcgctatggactgaattgtctccacctccccccaccccaaattcatatgttgaagtcctaactctcaagatgattatatttggagatagggcttttaggaggtaaacaaggttaaatgaggccataaggatggagtcctaatctgataggactggtggcctcataagaagagagaaggttctctctctacactcatgcactgaggaaaagccatgtgaacatacagcgagaaggcagccatctaccagctgggaagagggctccactagaaactgaccgtgctggcaccctgatattggatttccagcctccggaactgtgagaaaataagtttctgttgtttaagtcacccaatctctagtattttgttatggcagccctggccaactaaaactgttttgttaagggttttggtggtgatggtggttttttagtttttgcgtctgtgttcatgatggatatttggctgtgattttcttataatgtcattgtctggttttgatataagagtggtattagtccgttctaatgctgctatgaggacatacccgagactgggtaatttataaaggaaagagatttaatggactcacagttccacatggctggggaggcctcacaatcatggtggaaggcaarggaggagcaaagacacatcttatatggcatggtggcagacaagagagcattgtacaggagaactgccctttataaaaccatcagccctcatgagacttattcactataatgtgaacagcatgggaaaaccccactgccatgattcaattacctcccacctggtccctctcacagcacatggggattgtgggagctacaattcaagatgagatttaggtggggacacagccaaaccatatcaaagagtaagactattcttttttttttttttttttttttttgagacggagtctcgctctgtcacccaggctggagtgcagtggtgcgatctcggctcactgcaagctccgcctcccgggttcacgccattctcctgcctcagcctcccgagtagctgggackacaggcgcccgccaccacgcctggctaattttttatactgatagtagagacggggtttcaccgtgttagccaggatagtctcgatctcctgacctcatgatccgcccacctcggcctcccaaagtgctgggattacaagcgtgagccaccgcgcccggctgactattcttataaaatgagttgagacgtgttcactcttctatttaatgaaagagtttgtgtagaattggtatcatttcttttttaaatgtttattcaccagggaaatcatcttatcccagtgttttttgttttggtttggttttttttttaagggtcttwattgtgaattctatttttaataggtaaagggctatttgaattttctatttcttataggataaattttaataatttcttttaagaaattccatttgagactgggcatgrtggctcacacctgtaaccccaacactttgggaggaggcagcaggattgctctaggccaggagtttgagatcagcctgggcaacataacaagacttgacttctacagaattttttttcattagccaagtgtggtaacatatgcctgtagtcccagctacttggaaggctgaggcaggaggatcacttgagcccaagagttcaaggctgcaattaactatggatcatgctactgcactccagcctgagcaacaaagcaaggctctgtctcaaaaaaagaaaagaaattccatctgagctgttgaatttaatagtataaagttcagaatatttccttaccattttttcactccttggaggtatgatttacatactgtaaaaatcacttattttcagtgtggagattcttttcctttcctaaatctccacatttttattgacatatactttacatatcataaaattcaccatttgaaagtgtacaattcagtggtttttagtgaatccgtaaagtgtacaactatcatctttatttaattccagaatattttcatcacctcaaaaagaaaccctgtaatcattaaacagtcacttctaattttcttcctttccccagcccctggcaaccattaacctactttccgtcactgtggttttgcctattctggatatttcatgtaaatgaagggataaaatatgtggccttttgtgtctagcatcttttgcttagcatgttttcaagattcttccatttttgcagaatgatagaggagttaaaataagaaaataaagatatagtaagaatgaaactattttcattttttaatttaaaaaaatcttccatgttgtagtatgtatcagaatttaactcctttttatggctgaataatactccattgtatggatagaccacattttgtttatccattcatctgttgatggacttttggattgtttccccttttggctattatgaataatgctgctatagaacattcatgtacaagtctttgtgtacatatgcttttatttctcttcggaatatacttaggaatataattgctaggtcacatggtaattctatgtttaacttttagaggaactgccagactttttcaaagcagctgcaccattttacattttcactaccaaagtatgagtgttccaatttttccatattcttatcaacacttgttactgtctgtctttttaattatactcatcctagtgtggataaagtgatatctcattgtagtttggatttgcatttccctgatgacttacgttgttgagagtcttttcatgtgtttattgaccatttgtgtatctcctttggagaaatgtctatttaaatgctttgcgtgtttttaattggattatttgttttttagtactgagttgtataagttctttatttattcttaatattatacccttatcagagctatgacatgaaaatattttttcccattctgtgggtagtattttcactttcctaatagtatcctgtgatgcacaaagtttttcattttgatgaaatccaatatttatttattttacccctttggttgyttgtatttttgttgtcatatctaagaaatcaatgtcaaatcaaagatcactaagatttaaacctatattttcttttgagacttttatagttttagttcttacattgaggtcattgatccacttggagttaattttggtatatggtgtgaggaggggatccaagttcgttctacagcctatatagcctgcagatgagcaatgttagtgaccttgaaagtagaggcccagrttrtcagtagcctggcatctaactaaacaaccatttatccattaaagttagccctgttaacaattaatattgagataattttacttaatacactgtgtatattagtgtccatctagcatgcagcctgaggcacagagaataatagtttgagtataaamttgaattgaatggaatacatcattaatttattatctagctttctgttattgtataggcagtcacatgtatttaccagaaaaaagttgatagaatttttattttaatgaaacccttttatactttagattattttgatgctgattaacaggataagctgactctggacacatcctgacagcctctgccaaggtttgaaataaacagctgggaaaattcagttttatattatctgttcccrcagctgctcagtttcttctaaccacaggtcagggaatataataggttttccgattagttttagataaaatgtgaaagaacagttcatgtcaaggacaatggttgccaaatatatttggcaggatttctatattgaatcccaaaggaaatacacaaacaaaaccccacaaaagttaggaaggagtaaaacccaggaaccctggaacattttgtcatttactatgcagatttgcctgaaagtgagacaggcaaataaatcacatgtttctgccagcgtggaaaatattcactcaaatggcaaaggtctcaggctggggagctggataytgtcctgtaataggttcatctcagaactgaatcacacacttggagggtgttaatgctcttaggaacatctagttattccctttgaatagagtcctgtcctgaatcacatatacttgacctagggcctaggcctttttgtttttctgtctcacaatcttgtttctccatcaattatgtgttttcactcttccctcagagagggaaaaagtgtttctgtgtgctcttgatcctgttccctctctgatcttccaatctattgctctataacatattttatatgtgtcttatatcttcattttagtcagaaacatttatttatttatttatttatttattttttgagacagagtctaactctatcccccaggctggagtgcagtggcatgatctcggctcactgcaacctctgcctcccgtgttcaagcgattctcctgcctcagcctcctgagtagctggcattacaggcatgccccaccacgcccagctaatttttgtatttttagtagacagggtttcttcatgttggccyggctggtgtcgaactcctgacctcaggtgatcctcccgcctcggcctcccaaagtgctgggattacagatgtgagccattgggtctggcctttaatcagaaacatttaaagtgaaagcactgtggtaacttatgttgaaatmccttagaaatcaatggaaactgcacagagagggggtaggatagacgtagtggaaccaaggatatgatatggaaaaaggagaaaggtagcaaactagggatgagttggtgaatgtggaagggcataataatgttaaatgactgaaaactacataggcttatgttaagactagtgccatggaaatttttagaggtagatgacattagagtatgtttaaatataaattaatgttcttgcagtgagccgagattgcgccactgcagtccgcagtccggcctgggcgacagagcgagactccgtctcaaaaaaaaaaaaaaaaaaattaatgttactggttgtgttccctagatgtagactctgagatgaagattaacatgcaggaattttatttggagtgttcttgggatcaacacctgaggaatcagggataggcagagggagaagcgcgctgccgggtakgctccaggacagccttgctggatcttacagggagctctggagctggaatgaaccttccaggttggaccaacatgtccaggcctctgtgtccctgcactgagcactcatgaagtgctgtccatcctgggacagggcagagtcggcgctgggaagaggcgtggtctgcccagagagggggtggggcctgtcctggaaatgggcggggcatgccctggtagaggggcgtggtctgtcttgggaaggaaggtgcgtggcccccacaggcaacattcctctggggcaatcccggcgcacacctcagcggaggtgaaggctgacttcccacacccaatggctgggactggggagttctttcctagactgccatccgggcgcccctcaccctcttgctgctcagctccaggtcgtcgtgggttcagggctcagctgcacgctcctgcccgcgccctgggygtgatggcacccccagcccctgccattcttccccctcaccccctctccctgccactgctctgcattgccctgggttagcctggcggggccaggtggcacccgccgtatactcttgcctttctgctgcaggggcctttctgctgcgggtcccagagctgcagggaggggcggcagagactccccacgtggctcattggcgggggtgctaatcagagttcttttgctgccactctttgattcccaaaccccatgtaatcttcttagtggggacacagaatcatctttgaattcatacatatacagcaccttggaggctggccctccatcctcacagagacctgcctccaagctggagttctacctgtgcctggttgtggacccactccctcatctcttttgctgtacaatgattccccaggtctacacggtgctatatggaattccacatcagtgaatcaaatcctctgtaagatttcagatagtggtgctggctaaggccctgaagggaggaaaggctaagttacgccaagattaggtatcacaatgaagtcctgtcctttctaggatggaaggagttcagtgtgtctggccaccgagaagctggtttgtctctgtgatggacaataccatattgcagcaatccccaacctttttggcaccagggactggtttcgtggaagataatttttccagagactttggggttgttgggaatggttacggcatgaaactgtccgcctcagatcatgcggcattagttaggttctcataaggagcacaaaacctagatcccttgcatatgcagttcacagtagcattcgcactcctatgagaatctaatgcagcagctgatctcacaggaggcagagcccaggcggtaatgcaagtgatggggagccgctgtaaatacagatgaagctttgctccctgcctgctgctcacttcctgctatgtgaccccattcctaacaggccacagaccagtactggtcaggggcccaggggttgggcccaatatggcatattgggagctcagcattgatttttgttgctggcaggttggactttggtggcaacagtagctagatcagccttagtcagtgggaagccacgcttttgggtccatgcattaattctctccctgctgctgtagccacttagctcatgtcttgccagtactgcgatggcctatgcagaggctagctgatgtgaattgccagagtcatttttatatgtgttgttggtttgtgcttccttcaagatggatgctttctgttggcattaacgtattacttggagatttttctagtttgtgtccactcactaatatgcctttgtcccaacttttttctggaagagcttccttatcagtacgctgggccctggccctcagccagtacagaaagtcatttgtcaaggccttcagttggcagacgtgctccctggactacgtgctttctcgggtgtcccagaaaccctggaatggagtgaaatgcagggctacgtgggagagcagggaggcaagaattaagtcggccccacctttgcccaactcagtgggtctccttgagagaggtctgcagtttcaaggagacttttcagccaatctgctgcgagatcctgtgaaggggtgtgaaggtcttcctctgtgactatagattggccagtctctccttgtgtgtccaacagttttcattatactttatgtgaattaatgcaaaactgctaggtttaaactgctcaccattttagggatcccttctggattttaccttccttaaggggaaattttcctcctttcctcagttcatcctttctgccttggctttgacgtggtctggaggccacagagcctcctcctgagaacctctctctggtgtgtctgtttgtgtccgtccctctcctttcgatcattccctgtggttcctgttgggcgcggctcccataaacgcacagagcagggtctgctttgtctgcaacctgatgcattgttatttctcaccaaaacttgcagtccaaacatcacatttccgggccacactctttgtcagagctccaggggcacaaccccggggacctgctggaaggtgccaccgtgacgtgtgcctagatgcgttttccctcagttaccacagcgttcctctggttctggtggctggagggtgaccgcgtgcttcatgaagggggtccttactgcttcgcatccacccttttcacggaaagcactttgtcacatgttttcagtgtttctaagcgattttctgccaatcttgtgtgctaagattgtgtggcagcgtttccacagatttatagctggcaatgaattctcccaaaggaaatcagacaaaataaaatgtttccaacattgttcacatactgacaacttatgtgcttccttgggtgattttacaactttttaagcacatgaataaaaattattgtctgcttttttctccttttttctctcttttttttcttgcatgcagaaagtttataggagggggatcctctggatcaacacccatgggggagtgaaggaagcaggattgggtaaaagaagttgaggtgatacagtctgaataaaggtcagtcccacagggagctcaagctaggatggctctgcagagatgttctctattgaggcaagttgtctggacctatatagtcccacctttaccaggaataaggcatgagtttggatgtggtgactgacttcagccaaaattggttctcagagaggaattcagattagagttgtcagctgtcagcacacccagcagcttaggaaataagtgctttagtcctgaagcggtgaatctggacaccagcctccactgtggtccaccctttctgctgctcagattcatttgcttcataagttctggaatggttccttcaggattctgatgggctccctttcctggggaaacaaaagagaaaggtttggaacacagcacaactcctgctgctttagcttttcttgagtctgcaactggtactcatcatcttccccttctactacccattctagatccctccccccaccaccctctcaattcatacttctgctgctccaagtgggttaccagataaggtatctggtcatcatgccctttgtaagccatgactgtacttgtccatttatcatcaacattgaacaagggaatactaagagatacccaggcagatgacctggctgccaaatatattctcctctgtctccattgtgtaatgtcagcccttcctcctgatgatcaggatcggttacgcttgccaggatagtgactcttttccttacctcttggtctcttaatagtgatctgaagtaatatgatggcaaccatagtttcaagtttaatgagactcttggtgtgtccactggcggacatattccccttttaagaaccagtacttctaaactctcagagcccagagttgggataagaggcatagtttccctaattgggtcactgggagtaatggtagtgtgaggctgctcctacttacactccttgttttccaaaaccatatattttacttcgggacacaccccactaaacgatggccattgatctagagtatatactgcatcctgcaggatggtgcctcgtccttaggtattatgtctaagctagtgcctcagctgtgccttcaacaagctgtcctaccactctatcaagtgggtagcttctgggtagtggattccatggtcatgtatcttcttgctttaaagtaggtctcttggtctgatgcagtgttatgtaagatcaaatattctgtgaggccttgaatggtggtgtttactgaggctcaccaagcaactgaatgattttcttgagaaatggtgacatatcagagccttagctttggtctctgttactggcaagttgaacattaacaacatcagtagctagatctgtattgatgagtccatgatgttgggcccatgcatagcctctgccatggctcctcctttcatacatccattttgtaagaattggggcaccaacagcagagactggtaagcatcaaagtggctaagtcattcagtctacttggttgtttagtgctgtttctgtggctgatgttcttttcatttattcattctgtaatgcgtatcctttgtagattcaatttccttctctctgaacaacttctttggatatttattgaaaggcaggtctactgtcaataaattccttaatttttattgtctgagaaagtttttatttctccttcatttttgaaggatactttcacagagttcagaattttaggttgactgttttttctttctctcaacactttaaatatgtcagtgcactctcttcttgtttgcatggtttctgaggcgaagttggatgtaatttttatctttgctcctctatggataaagtgtttttccccatctggtttcttacaacattttttgtctttgattttctggagtttgaatataatatgcctaggtgtagggtttttttatttgtttgytcgtttgcatctatcttttttttttttttttttttttttgagacagaatctcgccctgtcacccaggctggagtgcagtggcgcgaactcggctcactgcaagctccacctcttgggttcacgccattctcctgcctcagcctcctgaatagctgggactacaggcacccgccaccacagctggctaattttttttgtattttttagtaaagatggggtttcaccatgttagccaggatggtctcgatctcctgacctcgtgatctgcccgcctcggcctcccaaagtgctgggattacaggcgtgagccaccgcgcccagctgcatccatcttctttggtattctctgagcttcctgaatctgtggtatggtgtctggtgtctgacattaatttgggggaaattctcagtcattattgctttaaaaatttgctcctattcatttctgcattcttcttctggcatttccattatgtgtatgttacaacttttgtagttgttgttccacagtttttggacattctgggcccatgcatagcctctgccgttgttgttggtgtttttttttttttcagtctttttttctctttgcttttcagttttgattggaagtttctattgtcatgtcctcaagctcagagattctttcctcagccatgtctcatcaaccaatgagcccatcaaagacattcttcatctctgttacagtgttttgatctctagcatttcttttttattctgtcttagaatttccatatttttccttatgatatacatctgtcattgcatgttgtctactttttacattaaagccattagcatattaatcatagtttaaaaaattcctggtctgataattatgacattcctgccatatttgactctgattctgatgcttgcttgttcagtctcttcaaattttgtgggttttgccctttagtgtgccttgtaatttcttgttaaaaggtggacatgatgtactggctatgaggaactacagtaaataggcccatagtgatgtggtgagatggaaagaaagaaaagatgctcaacatcactaatcattagagaaatataaatcaaaactacaaagagatactgcctcacacccattaggatggctactatcaaaactaaaacagaaaataatgaatgttggtgaggatgtggagaaattggaacccttgtgcactattgcaaatgtacaatagggcagtttctctaaaaattaaacagaattaccatatgatccagcaactcgacttctggctatatatgcaaaagaactgaaatggggtcttaaagagatatttatacatcaattgtattagggttctccaatgaaacagatccgtgtgtgtgtgtgtgtgtgtgtgtgtgtgtgtaaatatatgccaatggtaaaagtacagggtctgagtcagaaggcagaaccaagaatgcttatgtccaagggcaggagaagacagatgtcccagttcaaacagggagagtgaatttgcccttcctctgtctttttgttctattcaggccctcagtggaatggataatgcccacccacattggtgagagtgatcttctttaccaattcacatgctattctcttctggaaacatcatcacagacatacctagaaatactgttttgccatgtatctgggcatctcttagcccagtcaagttgacatataaaattaaccatcatatccatgtttataagcagcattattcacaatagctaaaatgtggaagtactgcaagtgtctattgacagatgaatggataatctaaatgtggtatatacacacaaagcattacgaaagaaggaaattctgacacatgctacgacatagatgaaccttgagtatattacgctaagtgaaataagccagtcatgaaaagacaaatgctgtatgattccacttatattgggtacttagagtagtcaaaatgatacagaaagtagaatggtggatgccagagactggaggaggtgagagttattgtttaatgtttatacagtttcagtttacaacataaaattaattctggaggtagatgggagcatattacacgttttctttttggagatgggatctcactctgttgcccaggctggagtgcagttttgtgatcatagctcactgcagccttaactgtctgggctcaagtgatcctcccaccccaggcaccaaagcagctaagaccacaggtgcacaccaccacgcctggctaattattattatttgtagaggccaggtactgctgtgttgcccaggctggtgttgaacccctgggctcaagtgatcatcctgccctggcctcccaaagtactgggattacaggtgtgtgccaccacacctggccagamtatttaatgctactgaactgtatatttaaacatgcttgggctgggcatggtgcctcatgcctataatcccagcactttgggaagccaagragggtggattgcttgagcccaggagtgtgacaccagcctgggcaacatggtgaaaccctgtctctacaaaaacattaaccgggcatggtggcacacgcctgtagtcccacctactctggcggctgaggcgggaggatcactcgaacccgggaggtggatctcgccactgcactccagcctgagcaacagagtgagaccctgtcaaaaaaaaaaaaaaaaaaaaaagatttacgatagtaaattttatgtgtattttaccacaattattaaaattgaagaaaatccccatgggtcactggtttaccaatttagccattttcaccatttttagattgcattttccttctctatctcagcattctgactaaaggaaaagcaaaatttcttacaagaatgaatgattctccagtgtggctgctcctgaaaggaacaatgagacttttgttatttcaccacaagactgagaaagaaataaacaagtgataaatgcccagaccccttcttattcattccacatcctggtaatctgaggcatggtgtggcttttactccaagcatatgaatacttacaatcagaagctgcctctcctttccctcactttatcattattgccatcatttatgacaatggagggagtgtctcactggatgatatttggggttctttcttcagtggtccgccataccaagcatttatttgtgctgttctccatctttcacatctaccacttttcaaaagtccctgagagtcaataagacatgcgactcgaacaactgcttcacatctaagtgtatgtctttaaaaatctctccttttccatgtttatgtctgatgtgttttgttatggcaaagtggcatgtagtatacrgttcataagtgaatcgatgtatatctgtggagggcaaatgctcaattttagatctacacatgaaagcttttttccagggcaggagccttgctttctccaactaagccttaattacccaaatgcccatgtgttgtgcctttggcttgttgaaatgataccaactggtaaaatctgatgggagataaaagttagatgtccagaagcataaaagtcaggaagagaggctctttatggcatagagaaagctgcagaactgctccatggtgtgcaaaactcatcagcacatgaaactagtgagtggagatagtcaccttcaaccactttgtaatttctaccaattcacttggggccagtgtcccttattcaccaagattcacattggtccttttgattatttggcgtgaggaggcccccagacatgctaaactgtcatgcagggagagaggaaaagttgggaaccagcctttgcttaaaagggctttgacaatggaggcaaataataacattttgggaacatttatataagtaattatataatttctgattcagtagctggttcatgaataaatgagtaattgggagtatctgagtggagacaagaatgaacattaatgtaggactgattctgaattacagcttctggcactagtaggtttcaatatacatagtctgctgaaaggtaattttctctgtgatattcctggtatccctaaggagggaagtataattttaggtacatactgacaaaatttgaacacaaggtacttagatgaaagttatagtctgttttagagatgaaattgaaggatgcagtagctattgctttggcaaaggatttttggctgatgcagtgtatggttattgattttatgattcttatcatatggcacctaatgtatcagttgagttgtgaaaacagtgtttcggtttaatggatgttagggatttatatacaacttcaaatttgcctccttgctaatagtagaaaagagtagtatggaagcattacttccagctgctttttgaagtgtccaccaaaatgaacgactttttcctttcttcacgcagatttcctcctagagtgccaaaatcttttccattcaacacctcagtcgtgtamaaarasactcygtttgtaraattcacgkwtcaccttttcaacatcgctaagccaaggccaccctggatgggtaatgaaaacaatgttgaatgctatttatgaaattgggtatcttattttctatcacagattccccaatcttgaggttgcagttaaaaagtgcagctgccaaagagaatgtttccctaactgctacctatagggaaatacactgactgcattttctgtctttttgctgggccgtcttcctctgcttggtctatgccaactgcttacctccacttagatgtcaaataaagtatgtaacaacatgttatgacaggacattttctgtcttagaattgttgctgagaattataggtgggaagtatccccttattctaaagagagatatcagcctatcgatttagaacttgttcaggtagtagtccaaaattggttctgcaacccttaggccctgactcacctccaaccttgtataaaaaaaggctaggaacttatggaagactttagatttgaatatttattatttggagagcctcttcggtgttttatgtgttgcttaccccatggggagtgggaggcctgtccctcatgtcaaggtataatgaaggaggcttcaggagaaccacttagaagactggacaaggtacctatggaacttgggagacactgaccactgcctggtttttatctggataaattttcaaggtcagaggccaaaaggacttctcctgatggaatagcagggggagtgggcaatagtgggagctaactgcactaccattgttaggtgtaaggccaggaaggtcactgaatgggacttgtcttacaaagactctgcctgagaggtcttcctgccaggattagataaccccaatagaaaaagcctgtatgggttgtactgccagaagcagaatctgagaggagagatacaagtgaccagctggagaaggtatatcccatgccaagatcaggagcagtggggtgtctccttgttggcagggagaggtctccaaataactcataagttccctaagaaagaaaggcagaattttggtatgtgtcacaactagggagtactaatgccacattatcactgctccttccaagaaagactttgtcattgtgcctatttgtttttaccctcccccctcctttccacttgctcctaccttggcaggtccagagacacaaaggtgagttggggaggaagattaggagaggaaggtgggaaagcagcgaagctgccaaaacaaattacctttacatattgcagatttctggggctgtcagaatgtagctggagaaggaagggaacttgcaattgcagaagacatcaaaaatttggtattagactggactggacttgttagaacctaagagtgatactgttggttaatacctgaaggttactggaaaagatttgggatcaaccaaagtgcaagaaaagggagatctcacataaagtaattaaaagcagtggtctaagaaaaataaggctattttatgtttttatcccactcaatccagttcattcaacagactgtttataggcattttatacttagtgtattcataaaacagagctcttaattttcctcctgattttctgtcatggcctgactaacaacccagttgcacaagccaaaatcataggagttttctttgactcctctctttttttctatctccacatcatatttatgagcaagtcctgttgactgttcctccaaaacaagttccaagtcttcttattttacttcttgtaaaatccaaattcatccaaattcctgtggcctgcaaggtcctacatgttatgtttcctttttgaccatattttctgttactcctctgctgattcactgtgcttcagccacactttacttgactataccaaacttatttctgcctctggacgtttgcatttgttttatctgttttcaatgctcttccactagatctttgaaaatcttgcttctttttcattagtcagatctctactcaaatgtcacctcctcagagaggcccttcctgactactacactgaaagtatcctctacctcctgcctcatcactttctagcagaccactatcttttatatttataacaacttgaaattttcttatttatttctttatgtgcttaatgtcttgagaatatgatctccattatctgtcttgtttgctactgcacctccagtgcataagacagttcctagaatatagtaggaactctagttgaatgaatgaatgaattgaatgattgccagaaatcttgcctcagagcaaccataaggttaggctgatgttggcagcaagcaaatactactttttgtcagtaattacaggggcatgcttctccactgtgaccttgactctaacttttggaataacaggttttctggagtactatccccaagtaacctttggcggacatctcattcttacagrtctgctagbtcctaccatccaggctgaggtttatgatacagtggwcattacacttamgaacrtggyttccyrtcctgtcagtcttcatgctgttggtgtatcctactggaaagcttctgwgsgtgagtaaaataccctcctattgtcctgtcattctatgaatagaacagtgagatgtgtgtgctttgtaatggtggcgttacaactcttttaaggtcctaactgaacattatgtgtatttcttaacatttactagattataaatatctcaagatagggaaatccatcttatttattgctgtgtccttagcatataacatattgcctaccctatagtagatactcaatacaagaatgagggtgtagtggacaccagtcattttttcttcctaaaattaaacatttctcacctgtataccccctaggaattgcttttctgaatatacttcaaacagaacctgccattttcttaaagcccatgcctccctagccatagcagttgatctaggagtgagcagttgacacgggtatcccacctccttggccacagttgattggtccagagatgggcaccttacccaagctaggccaatgagagtacttgcactagcattttgaaatttatgagaaaaaggacctattattaccaggtaatcctatacttaggggatggagcccaaatataataaaatcaagattctactacttcatgtatatcatgtgggccatggatcttataggagtcttaagggggtgttggtcttgtccttttcttagttgcctagctctttgcaggcatggtgcaaaggcaggacaatctacctttatctgctccttctataccactgatcctaccctaaacatgtagctgtataatcagagacaggaagccatggcaaatctggagggtctcggcttggctatatcttaaagagttacatgtawtcgtagttcaacattggggaaattttccaaaaattggtggagaaacgagtggccaatgcaattttatctttttttttctgctgacatcagggagagataagagctttaaaatcacaattatggggagataatattttaaaatccagctcaagttaaacccatcagaaaaggtaacaccttttgggacccccaaatggccacatcttatccaatgaggggacaccaaccatagagtctatactgcacagttcaaatggtagccatgagctatcaggcacttgaaatgtggtgagtcctacttgagacatactgtaaaatatacaccagatttcaaaggttaagtacaaaaaagactaaaaatatctcattcattgtttataagtacaagttgaaatgcttatatttggatatactaggttaaacgaaatacattattaaaataatttcacctgtttctttttacttttcttaatgtgactaccagaaaatttaaaattacatatgtggtttgcattatatttctattgaacagtgaaatgtttagcatatgttgaagttgctgctcctgatgcagtggctcatctcagatttggccaagttcttctgtccaaggaaaactaggttcaacccattcctggagaggaacagactcaaatctttctgggctgggtcacttaccttggttaaatctgttctccacctattctaccaacaaccaaagggatggacatagctgaaataaaaatcacgcaatcacactgaatggtatctcacctcaggtgggccttcagcattgcctagccattctactgctacatttcccctaatccatttactctccctctccccaagacagctataatgtttcacacattgttagcctctcattgaacctccaacatgtgctcccgcccctgcccccaccacaacgtgagccttgggaaaaagggtatttttttcctaatgaaatatttcaaacaaagataaatacagaaaataatataacaaacaaacatgtgcccatcacctcactttgccaaatcttaacattttgtcatctttgcttaatttattttacaaaattaagcattttacatacagtctgtactcctctatggggctggcaggaaaaggctctcattgtcaaagttcaaagtaattgatcattgaaaaaataatgatcacattaaaaacaacacttatataatagagatacatattrtaatactcataaatgaaatgatatcctgtctaggattggcttcaaacacatccaagctgatgttacaatcattaggtgaattcctgatgtggaatttgacatttgtatggcgccaaaataatatcccagtgatttttttctgattgtaagtggaaatgttaactttagaatggaggtatcaggctaatccacaggtcagttttagtgtcactaaggatgggatggccagatattatctgcccctgatatggcacaatatgagggactcagcatcatctttgatatattttagccaaaaaacttatttaatttgaatctaatcagaacttaggcatattcaatagcatgggatattctacaggactacaagccaaatttctttcaccaaatgagtgtcagaaaaaaagggactactccatactaaaagagactatgggcctaaacaaccagatgcaatctgcagtcttaggttggattctgatttggaccaactagctacaaaggatgcctttgaggcaattaagaaaatttgaatattgcattgatattaggtgatattaactggatcaggtgtgctagtgtcattttgtttatgtgggcaatttttttttaaagatgacttctaaagtatataggagtggactatcatgaaatttgtaatgtacattaaaatgcatcatcataaaaagtgtgttgaaagaaaaaagtgaaagtagcagtgcaattctaagaataattttctaacatccactcacaaaaatattaaattctttatattaaacacatgaaaaagaacacaaatatatctgtctttcaagattcatctcaaattccacctccttcatcaagcattactgaagagtaggaagcttgtttactttttttatccactgtgttgctcgctccaagggcatagagacttctatcttgatctttatattttcagcttgtagctgagtctggtaaagaataagaactcaataaatatttgtgaataaataggtgaatatttccacatggtattataattatatctttatatgtctatgtcccccaccaaacatagtgttgtaccactaggaaagaacaaagtttaagaaattttcttaaatctctctttcttactgttccgtgaccctcactagtgcctaccaaagagtctgtgacaaagtgtatttgttgttgaattgaattaggcaaaaagatgcaataatggaagcaatttattatttaacagaatgtggagatatcaaccagaacctagtttttactgctcatgctagggttagtgatctcaagatcctctggagtatatgaagcttctccccatttgtggctgctgcttgttagtttttcaaattaagatgcagaaagtaggccgggtgtggtggttcgcgcctgtaatcccagcactttgggaggctgaggcgggtggatcacaaggtcaggagtttaagaccatcctgaccaacatgatgaaaccccatctctactaaaaatacaaaattagccgggcatggtggcacgtgcctgtaatcccagctgctggggagtctgaggcaggaaaatcacttgaacctgggaggcggacgttgctgtgagccgagatccagcctgggcaacagagtgagactccgtctcaaaacaacaacaacaacaacaacaaagatgcagaaagtccgtttcttatgtagaacctattggtgacaataaacttgacatgtttctttgagtgtacagtggatatagaaaggacaattttatttcttcctgctataggagctgamtrtgatkrtyagaycagtcaaagggagaaagaagatsataaagwcttccctggtggaagccatacayatgtctggyaggycctgaaagagaawgdtyyaatggcctctgacccactgtgscttacctamycatatcttyctcatrwggacctggtaamakrcttgaattcaggcctcattggagccctactagtatgtagagaaggtaagtgtatgaaagcgtaggattgagatgaaataagcagagaagtacaaacaactgaatctatcyataacagttagcatttgtgttccttcacctgaaagaggcttttttactctagcatcatgctcatggaaaggagaataatccagtttctgagagaagcagatatgcattctatataaccacaataaactctaagctgggatcaggaggagctgagttccagaattaaatctctctcctcaaagcattgctattttcctcttcaaatctgtgggctttatcagtagtgatttctactgtcctctgccttttgcaaactttgagctaggttccttgaaaacttcatggaggtaaacacatccaagtgtgtgatcaatggcatatagactggttcaggtggttagtttgtcatctgtaaaccaaaagtatataaaaatctaagaaaagtcagcatttatttatatgttactgaaaattaattaatttggattgaattaatatattctaaaataattctaatcamacctgtttttawtttataccttagcataaattagggaagtaaattttgcataatttgtttttatcctattttttatggtgaaatcagcttcactgtaccttttccttgttccatttatcttttactgcataactccacaatttagtggcttaaaacaacaacagtctcttattatctctcatggtttctgtgagtctcatggaatttgtcagtgttttgacttggtggcctatctaagtgtgtctcatgaggctgtagtcaaacagtggctagagctgaaatcatcccaaaggtgactttattcacatgtctttgaccttggcttgatggtactctccacatgatctctctcacatgggttttacagggtagccagacttcttatatggtcctgagatagcccattagaagctgtttcacgatttctaatgtaaccttggaaatcactcacataacctacattctattagttagaatgcatcactaagaccagtctataaagggagactccaccttttgatggggaataggcaaagaatttattaacaggaatcaccatactctttctgaatggtgatgatgaatgtgattcaaaaaaaggatgggagcggggagtggagaagatgagaaaggtttgtagtttataatagtttcagatgaaagtatgatttctcatatactgagttcagtttcatagtcataattaatgagaaagtgccaaaaccacagtgtattatttatgggatgtaaaggctaatggaacaatgagatcatcaaaacattagtgtttacatatgacatataaagaaataagttaaaaacccaaatgattctttgacacagagttgaactaaagagtctacagaggttctagttccaggtgaaatggataaacacactccaccctttatttcccattgaacttaactataaaaccttgacaaaatgcaaagcccagatatttaaaaatttctaaaaagcaaatagaacaagtatatagagaaaagacactagaattgaaagtattaccaaacttgtgggggagtatacctttttccccactctagtattccttaacctgaattaaaacataactggagacttcgaagtgagtactatgttgcaaagagagctccaggacaaaccctctggggtttcaaggagtgagaaaggtaactctaaatgctcagagagcgtgggaggggaaatcccctagggtttttgtcctcttttccaccattctctcaagcttcagtcccaggttgcctgtggcaatgacagtggctggcaacagaaacctgccggagtaaaaacttagggaggggaacattattcttcattcagtacagctacagatctaagacatygggggaaaagcacattactttctctctgtctttccccttccattgcttgaccttagctatgatgtagttgtggaaattggaagcttctggttagaaaaccaaaaaagggagctcacagaactggaaagtttatagatgacagagagaaaagatcccaggaaagtaaacccataaagttgtgcattaactcctggattcacccccaacctacacatccaggtatgtagtttcagtgtcagatctgttttaaaccccttgcagtgccattgagtccaacgcagtggccagtctggtgcttgaggggaaatctcagtttcacagtcttcaacatgttccattagcctttacgtcccataaataacacactgtggttttggcactttctcattaattatgactatgaaactgaactcagtatatgagaaatcatactttcatctgaaactaacgcccacagaattccttaaaacatgtctgatggctgaaagcaaagatagaacattgtgagataggttttttaatgtatggtagatacaatacataaaagaatcatagcataacaagaggagggtaaggaaaactttatggtccattcaacttcattccaattcaaatggtaaaatgttgactctaagtagatgatagtgaaaggttaagtatgtattttgtaatccctagagcaaccaataaaaaattataccaagagacacagtaaaaagtcacaataaactaattacaatggtatatcaaaaatattcaaataactcaaaagaaggcaagtaaggagagatgaaaatcagagagaagaagcagtaaaatcataataaaatgataggcttaaatctaaacatatcaatacttacattaagtgcaaatggctaaaacacaccaattaaaaacagagattagcatactggatataaaagcttgaaccaattatatgttgtttacaagaaactcatttcaaaaaaatgatataggtaggttaccagcataaagatggaaaaggatatatgatgcaaacatgaatatgaagaaagttgaagtagtacaaatctgtaatcacaacattgatttttgccaggagtgccaaaaccattcaataggggaaagaatagtgtcttcaataaacagtgctgaaacaggtgaatatctgcatgcaaaatactgattgagtatcccttacctgaaatgcttggaaccaagaacgtttcagatttcagatactggaatatttgcacatatataatgagatagcttggggatggaacttaagtctgaatatgaaattcattttggatataaatcccttgccagttatgtgattggcaaatattttctcccactctatagtttgttttttcattcttttaatggtgtcttttataaagcaagagttatatggacaaacatatgaaaagatgttcaacatcattaaccattagggaaatgcaaattcaatcaacagtgatgtatctattagaatagctaaaataataatataaaattgccaagaatcctgtcaagaattcagagcaacagaaagtttcacaatgcacaatggtatagccattctggaaaacagaatggcagttttgctgcttggtagagaaacagtctctggcagtttcttgtgaaattagatgtacactatagagggatagcaggagggagttctttttggatattgaaatggatctgtatcttgacgatgatggggtttcatgagcttatatctttgttaaaagttatagacctatacaccaaaagaaaaagtcaatttcactataattgaaaatttatataaaagtaattagaatgttttaagacagctttatacgtattttaaatgtgtctctaaagtttttaatccagtacttctggtaaagatggcacagggtcttcctacttagccatttttccatcctccacctcaaccccaacctcgctgaaaaccaacaacaaagataggtaaaccataaatagagaaaatcgaataggcatggtcagctgaaaaagaagataaatatttgtggaccagaagcagaacaggaactgtgagtagtaaaaggggtggaaattacaggccaactgagatctgggtcaggaagccagctgcggtagccaaggagtcaggatgacaaggataaatagtgctccccaccagagggactgagagcccatatcatagagttgggctcttcttcacttgaaagagagctgagcacagctgctgctcactctttgtttagggccatggctttgtggaaactcagagtcctagaagaggggaaagcaaacccagtcctagaataggaactgaactaagttttcttggttcagtgggggaatctgcaatatccccaaggtttccattggccagtatctccaaaattccattctagggtatgatttgctagatagagaatagtgaacacatcctttgcttaatcaaccaatgatcacaagggacagcaaagatcactatagttcaacaaagtcagatttattggctcatggcaacaagagactgtggacacctccctaaacaaagggaaatactgtatagagttagtaaagaattttggggaagggtggaggttaggtgatatttaaatgaagcaaagtagagttgtgtgtaaagaaataaccatgaggtctagactgtgaagtgttctaaaaagttaacatagacatgaaaggttaagtcaaggcaccccttacctgaagcttgagctttaaattgagctgcttctttgtgtcaaagtaatttagatgacctaggaaagaatgagatgtttcattcttgttgctattagttcaaacatttctggcaggctgtgaattcagagaacaaacaactcaattgagtaagaaagcaagagataatcaaagcaaatagttggcattcagtgagtttatacagtggcaatgtgtccttgggagaaatggtgttgttaactctgcagttagctttatctatgtctcttatcccagcctgatgagtagcagcacacgtactgttgctttcttagtccaagctaatttttatttctaagcattaagggtgcgagagagagaaagaacggcaaaatgtcataaacaaaaatctttctactcaaaataagcctgtaaacaaaagtttccagtcaaatttaaaaaatatataattctaagaaagatagccaacaagctcaacagttaaagcatgaaacaagctagtttgttccattaaaaacttcagctatcgatatacacggtatttatttaaaatgtgagtataattagaagcactgtgggctattgaaaaaaaatcatgagtatagatgtttaatatggacaattgctattttactcaaaacttttaatttacaattgcagaagtataaaaagttacaagagtaacagaaattatctataatttcactattatcacacagtgtgtgagggcttgtattttgtaagtgtttttaatttttttctttagtaattcatttttatcatattttacacaagtagtggtcttcatcaaagttgaaataaaaaaattctttgctccagatagttttagaaacactgctataggagacctgacatcaaagccaagttatcaagagacagaagactacatttgttcttactgtcaagtaactgatgaagaactgtctcctcctagtgacaatttcctacaatgagattttttaaatagaagataaatgttctcacttctttttcagggagtctggccaaggaaaagacacagmccttgcacaaatttatactacwttttrmtgkatttgwtrawggttagtgagtcttaatctgaattttggattsctgaaagaaatcctctgctactattaagaggaggtgattatagaaagatcataaattacatkactgttcaggaatgaaggagatggggttaaaaatgaattccaagaaaacaaaacgtaacctcagttccactggcagctatgaggtaagaagatagaggagctggataacggactggcctcatccccctcattaagactgtcaacaaatactttgggctctactttctaaatactttctcttatcttcatctattattaagtgcacaacctttggcaagttatttaacctctctgtgtctcggtttcctaaatggaaataatagtacatttttcataagattgttgtgagtgctgagtgatttcacttaagtaacctagagcactgtgtggcatagagtaggccctcaatagtgttagtacctccgcctcttcctcctcctcctaatgtaatcactatgtaatcatagtaacataatattcttcttgcccccttatcaatttacattgccatcttcttaattgaggccctcatgatctgtctcataactctcaaaggaagcttactgaagtgagtatctgatcttgtcactctagcctctacaatacttcagtttgccagtttcggtggctcatgcctgtaatcccagcactttaggaggctgaggtgggcagattgcttgagcccaggagtttgagaccagcctgggcaacagggcgaaaccacatctctacaaaagaattaaaaaatcagccggtcatggtggcgggtacctgtactccagctacttgggaggctgaggtgggaggatcacttgagcccaggaggtgaaggttgcagtgagctgtgattgcgccactgcactccagcctgggtgataaagccagaccctatctcaaacaacaaaacaaataaaataattcaatttcaaggtaaagtgcaaaatgcattatctattctctggtgacatttccagccttgttgtgttccatttcctgccttatcttccatgtcacccaaatatgtaatgctttttcttgcatgagacctctgcatatgcagtttcctctgcctggaaaaatctgtctccctctttacactaagtaagcttctcctttttctttaagtctgacttacttcagttatccccttccttaattccttctcccaggatgacctctagtctggattagatgcctgcttatatttccacagcatcttgagcttattccttatcatactatatcagtattttctactttatttaatatttatcttctttgatctcatatctttttcccttcaagcaaagtgaaatttcttctcctctctgctccctgtaacaccctactctcatctttattatatcactctttactctttattataattatcagcttctctgacgattccagctagagtgtaagcatcttgaaagcagaggctgtatcttcctctctatcatcagtgtctacaattagtagtgctcaataaatatgtgtttgaatgaatgaacaaatgaatggctgcctcataaagttttagcactagctaccagtccttcacacaaaggggtaactccagggagtcactgttcaatagtatttccagtgcttcagcccttatcaatttcagagacagtgttagggagctttcaggttcctggggtttcataaatataagctgggatgaagcaattataacggagacagggactgacagacagcctttttcctaggacaattttcttttttcttttcttttttttttgagatcgagtctcactctgttgcccaggttggagtgcagtggcacaatcttggctcactgcaacgtccacctcccaggttcaagtgattctcctgcctcagcctcctgagtagctgagattacaggcacatgccaccatgcccgcctaatttgtgtatttttagtggggatagggtttcaccatgttggccaggctactctcaaacgcctgacctgaagtgatccacctgcctcagcctcccagagtgctacgattacaggtgtgagccaccgcgcccggcccctaggatgattttcataagctttcttttaaataattcagctaataaaaagaattgaatcctgatgcctcaagctaaccaatattctgtcttctattattatccattcccacttattgtcatggacaaatggagggagagaaaatcagtttgagcaagagatgtctgcctttacataattatcttctccctccctcacactgactttgagaggataagtgctgtgtgcctactttgctgacaaaaatgcttaaggtgtgagcacactgggagcagggaaggagaaaggggaggcggtcattcatgagacacatgcttagctgactctatctttgccttctctctcatcagggaaaagttggcrctcagaaacaaagaactccttgatgcaggatagggatgctgcatctgctcgggcctggcctaaaatgcacacagtcaatggttatgtaaacaggtctctgccaggtatgtacacacctgctcaacaatcctcagggtcttccaaattcagcaccagagttctgtacttcagttcacaaacagctcggcatctcagaggatatagcccactgaatacttgaagatctctggcctctggggatcttaatgtatagtaggcaattcctcttttggtcacctgaaaatgaaggcttacccatgtacatacagcccacagtcagatttttctttccttttcttaaatgtgagtgggcaaccaaggatgaacagacatttaaaaagaacctaaaatatggaagggatatgcaaagatgaacaaagaaaataataatcccagaataaaaaaagctatggctcagaacagaactcatcggaagctcttacttctattttcataaagattcaagaagatactgcatcaataaagtaacaataagatgccttccagttttaaaataggggcatagaggcaggctggctttactccctctcacagaaaaccaaaaccaaacatacagcaccaatatctacaccaacaacaacccagagctcacatgtgaggatgagacagttcccggagccacagagaagtgaaaaaactttgagaatcagacttccacatccatgactctccttcctcctattctgcccagcaccaagtgtatggaaaatctcccctcaactcatggtttctacactggaaaaagtgacattgaggtgttcaaccagcttctccaccttcttgggttccctggggggagatttgtccttgccttaacccacagaaaacatcatgactgtctgaaggcagaaatatcccagagtacaggcagagacaaatgagggaggaaggactaccatccccagccctggaaattctgctctataatttggccaaagacatgcaaattcagaatggccgtgcagcagcaccatgctgtagcaggtttatcctacaggtcaccttggcatgaatcactagctggccttccaacactgctatgataatccctttgggacctcacccacttgggacaggcagggctctgaccacttactggaacacctgtaatcccagcacttgagctcagcacaataacaataggagatggctactaccgttaattttatgcagttacgatttaatactggatctttacgtttgtttacatttgtcccaactggcaccttcatcacctccaccctccccaccccagactatggtaaccacgattctactctctattttcacaagatccactcttttagctcccacatgtgagtgagaacatgtggtattgccctgcagtgtcacctatgttgatgcaaatgaaaatattcttttttatggccaaatagtattccattatgtatatataccactgaactgtacacttaaaaatggtaatgatggcaaattacatatgtatattttacatcaataaaaagaaacttaaaaataaggtaacaataggattctatgaaaaacaatcataacaaaacgtgctcataaaaattataaacacaatggtcaaaatagaaactcaatagaaagtactaagaatagataaaatctttcataaggtcaaacaaaatgtggttgagaatatagttgacccttgaacaatgtgggggttggggtactaaccccctgcacagtcaaaaatccatgtataacttttgactccctccaaattcaagtactaatgacctattgttgatcagaagccttatcaataacataaacaacaaatattttgtgtatgtattatatgctgtatattttcaataaagtaagctagagaaaggaaaatgttatttatacttttctctgcttcttgggagtacttccagcatcactagtggcactttatacgggtcccaagtatccttcaaagtttatggagagatgaaatgcttatgcagagatgattagcatcatgcagagttttcagtggatgcctgcagcactcgagctcagcacaataacaataggagatggctactaccgttaattttatgcagttgcgatttaatactggatctttacgtttgtttacatttgtcccaactgggaatggtgccrtgtatggttgtaagtatgtaagtttttataaatttcaactttttataatagatttttgtatattttatggtaataaatgataaaatagtctagtatcaacatgtatatgtatatataagtgtgtatacatatatatatatatwtattttttttttttttgagacggagtcttgctgtcgcccaggctggagtgcagtggcgcaatctcagctcactgcaggctctgccccccggggttcacgccattctccygcctcagcctcccgagtagctgggactacaggcgcccgccacctcgactggctaattttttgtatttttagtagagacggggtttcattgtgttagccaggatggtctcgatctcctgacctcgtgatccacccgccttggcctcccaaagtatatatatatattttttgagacggagtcttgttctgtcacccaggctggagtgcagtggcacaatctgagctcactgcaacttccccctcttgggttcaagcgattctcctgccccagcctcccaagtagctgggattacaggcatgtgccaccacgcccacctaatttttgtagttttagtagagatggggtttcaccatgtttgccaggccggtcttgaactcctgacctcgtgatctgcccgccttggcctcccaaagtgctgggattataagtgtgagccactgcatccggccatctccatatattttttgcattcataacatacctttttcttaatttttttgatatttttaccctatgtggtccatctgacagttttttcaaattgtcataaatttccaaaaaaatctcactatatttattgaaaaaaaactgcatataagtggactcatgcagttcaaacctgtattgttcaagagtcaactgtgtgttttaaagcagattttaacatcaagaaatgatagaaaaatgataagaattaaaagagataaatattcatattagaattgcccatcaggagcttctgagtagctgaacgcatggaggttcctggagagtggctggccccatgccccttcccacatacccttccttatatatgcatctcttccatctggcgtttataagaaaaggtgctgactgctgaattataaggacactgtggtctactagataaaggttgaggagaggggtttgggcttctattgtcttctttccgggccttcatctcctgcttgtgattaagtagtgcatgctgagtggagcaaagtggtggaataggactcttcagcaataatcycctcacagaaacatcaaggtaacaactcgatgcgtgaaattaccttcagaagagttaagaaaacctgaacccatgagcaagactgtgaagcccttttggactgcaaagacgagtaaaaccatagttgcacataaaggggattggttctttatgactgagaccccacccgcaagccactgcagtaccacaggcggaaagtcaccatggacccacggtttttacaccggaaaactctcccgtatggcctgagtgccctctgtggatctccactaattagtagcagagccagcatgagacttgcgtctaacctgggctcagggcgccctctcgtgctaaaaggaaatacaacagccagtcctttcactttctttttgatatggtctctgttgcctaggttggagtgcagtggtgcgatcatagattactgcagtcttgaactcctggctgggctcacrcggtcttcccacctcagcctccagagtgggactacaggtgtgtgccactatgcctggctaaattttcgggttttgtgtgtggggtggggaagattggggtattgctatgttgctcaggctgggtctcgaactcctgacctaaagcaatcctccagcctcagcctcctaaastgctaggttacaagtatgagccaccacactcagccccactcaatttctaaacgagctcactgaaatagagcagtcacaaacaaacccagactgtgaacatgagaataaatacctaattcttcaatgtgtagacagggatgcacatctgcaaagaataagaatagcctaagaaagacagcctcaacaaatgaacaaaaaatcgtgccagtgactaatcctaaagacatgcaggtgaatgatctggtagacaaagaattcaaaatagctattttaagaaaactcaacaaacttttataaaacacagagaaacaattcagaagtttatcaaagaaatttaacagagaaattgaaggaataaaaaaagtcagaaatcctggaactgaaaagtataataaaaaatgacacatgcaatacaagacatcagcaacagaattgatcaggcagaagaaaggatcagcaagctcaaagacaggttatccaaaaatacaatcaggaggggcttcaggatggttgactagatgcatctagtgttcatcccttccatggagaggaaccaaagtagcaagtagataattatactttgaataggtcatctaagagagaacactggaattcaacagagcagtgacaggaagcattgaaagcaagggaggagagagaaataaggcctgtttgcctgggattggctgggagtctggaacagcttcctaatgtggggaaaaggtaagagacccttagtgttcctcattttcaccaaggactcttgcaatcctagccacaggagagcgccttattccttgacagcacagagactagcatagggagttgcctaaagaccgtgtgaaggcattgcaacagagagctcacgctggattctgcaattctcccaagcagctgcagcacagcaccattttgagaacacagcccacacatcctgccctgctatgatggccgtgacttaggcaggagccctgagcagtgatcctgccccacccagcagaggagtgcccatgcattttcacatattccaagaacaaattccactacctacaaccactgctgctgcaggctgctgtggggccaaaacactagtgaaccttgtgctcccaagctacctgcctacagctactccctgagaaagcaaccccaccttcaccaagagcagggctatagcacagctactgctgcaccccaacctgagcattttgctagtgacctcggtatcaccccacccctgcatagcacaaccagcacctcacacaccaccaaggagcctgagggcaggttcacgtagcccagctctacctgcccccagtacccaagcatatcatccaggggcctagggatcacttagccctgtccaccactggtggcacctgagcacctcctggggtctgaggtcaggcccactcaacctgccactactgccacagttagcactcactgcatgcaccacttgagggtctggagactggccatgcgatccatagcagccacaaccaacgccagcacagaccacttgagattcaggttgtttcattgctatgattgccatcaaccatgccactttgctgcccaggaacttgagaacccacccacccatgtgatccatcaataccacttctggcacccaagtaaaccacttggaggcccacaaatcaacctgcctggacctaaaaccagtgcaatcatatgccaccatggtacaccaaagacaagcacactcagcccactgctgccaccattggggcctgaagacaggcctacctggcatcccacttctcagaaaaacttcaccacagcctccactaataaccacaccctaagccactgagaaaatcacaaatatcactgatgctgtttagaatcttatacagaggctactacattcaccgagaatcaaaaccgaagtgctctacccaagcaacaccacagatacatcttcaggaaaaagttctttcctacaaaagcaaattttaaaaattggaaaaagtgattattacaccagatgtgcagatatcaatgtaaggacacaggaaacatgaaaaatcaaggaactatgacactccaaaggagcacaataattctgtagcaagagatccaaataaaaaaaatttaagatgggtacaaaaaaatagaaagaatgaataagacctgctatttgatagcacaacatggtgactatagttaataataacttaattgtacattctaaaataaagagtgtaattggattgttaataactcaaaggataagtgcttgagggtatacatacctcattctccatgatgtgtttgtttcacatcacatgcctgtatcaaaacatctcatgtgttccataaatatatacacctactatgtatccacaaaataaaaaaatcatagtttacaagcaaaacagtatatgtgaccattggtttttaagtaaactggccaacatctctttaaaaatttatgaaatcctggaaaaataattccaaattttgatactaaataaactcagtgagatacaagagaattctgaaaaaaatacaaagaacacagaaaaacaattgaggctatgaaagagaaatttacccaagagatagatatcaaaaaagaaccaaacaaaaattctggaaccaaagaattcattgaatgaaatacaaaatagatttgaaaggttcaacaatagaccggaccaagcagaagagtatcagaactgaaatacagatcttttgaaataacccaatcagacaaaaataaagaaaaaagaattttaaaaaatgagcaaagatttcatgacatattaggcactataaagtgaccaaatatttgaatcttcagtgtcccagaaggcaaagagaaaatgaagaggttagaaagcctatttaatgaaatattagatgaaaaatttccaagtctaccaagagatttagacatctagataaagaaggctcaaaaatacccaaataaatacaatgcaaaaaggtcttctccagggcacattatagtcaaactatcaaaagtcaaagaaaaaaatttaaaaatagcaagagaaaagcatatagtcacctgtaaaggagccgctatcagactaactgtgaatttctcagcagaaactttacaagccaggagagaatgagagagagagaaaaaaaaaaaaaaacacctgccagccaaggatactgtacacagcaaaattatccttcataaatgaaagagagagaaaaatattttcagacaaaaaaaaactgaggaaattcattgcaacctgatctgctttacaggaaatgctaaagggagtttttcaaactgaaagaaaaaggtcctaatgtgtaacatgaaaacatctgaaggtataaaacccacaggtaaaagtaagtatcccgacaaattcagaattctctaacatggtaattgtagaacataaatcacttayatccttagtaggaagattaaaaaacaaaacagataaaaataattaccataacctgttaaagaataagcaatataaaaagatgtaaatgatgacatcaaaaacacaaaatttgggagtcgattttttaaaaaattttcttgcaatcaaaattaagttgttatcagttcaaactaacttgttataactataaggtattctgtgtaagcctcatggtaattacaaagcaaaaatttttataatagatacactaaaaataaaaagcaagggattaaaacatactgatagaagaatcacttaaccacaagggaagagattaagagaggaagaaaggaacaaaggatctacacaacaactagaaaacaagtaaaaatatggcactaccaagttcttacctatcaaaaattaccttgaatacaaatgggttaaattctccaactaaaagacatagagtgtttggttttttgttcttgcgatagtttactgagaatgatgatttccaatttcctccatgtccctacaaaggacatgaactcatcattttttatggctgcatagtattccatggtgtatatgtgccacattttcttaatccagtctatcattgttggacatttggaccgcatattctcactcataggtgggaattgaacaatgagatcacatggacacaggaaggggaatatcacactctgggaactgttgtggggtggggggaagggggagggatagcattaggagatatacctaatgctagatgacgagttagtgggtgcagtgcaccagcatggcacatgtatacatatgtaactaacctgcacaatgtgcacatgtaccctaaaacttaaagtataataaaaataaaaataaaaaaatttaaaaaaagacatagggtggctgaatgaatttttttttaaaaaaagatctaactacatactgcctaagagaaagactttacctgtaaggacacacatagactgaaagcgaagggatagaaacagatattccatgcacatgtaaacaaaaagaaagcaggaatagctatacttatatctgataaaatagacttcaagtcaaaaactataaaaagagacaaacagccagacgtggtggctcatgcctgtaatttcagcactttgggaggctgaggcgggtggatcacctgaagtcagaagttcgagaccagcctggccaaatggcgaaactccatctctactaaaaatacaaaaattaaccaagcatggtggcaggcgcctgtagtcccagctactcgggaggctgaggcaggagaatggcatgaacccgggaggcggagcttgcagtgagccgacattgcaccgctgcactccagcctgggcacacagcgagaatctgtcaaaaaaaaattgacaaacaaggccattatataatagtaaagaagttaatacaacaggagaatgtaacaagcataaatatatatacacccaacattggagcacctaaatatattaatgtttgatctttgtattttctagtctcattaaaagtaagggcaaaaactacaattacttttgcaccaacctaatataaagcaaacattaatagaccaagggggaaatgaagacagcaatgaaataatagtagaaaactttaacaccccactttcaccaatggacagatcatccagacaaaatatcaacaaagaaacactggacttgaactgcactgtagaccaaatagagcaaacagacatttacggaacattccatccaacagctacacagttcacattcttctcaactgcacatggaacattctccaggagattatacattaggccacaaagcaagtcttaactaacttttttaaaatgaagtatttttttcctgccaataatggaataaaactataaatcaacaacaggaggaacaactgtacaaatacatggaaattaaagaacatgcccctmaacaaacaatgggtcaatgaagaaattaaaggagaagttaaaaaatttcttgaaacaaatgaaaatggaaacataacatgccaaaacttatgggatacagcaaaagtagtccttaaagaaaagtttatagcaataaatgcctacatcaaaaaaaaatctcaaataaacaacctaatgatgcatctcatggaactagaaaaacaagaacaaacaaaaccccaaattattagaagaaatgaatgaatacagatgagagcacaaataatcaaaatagaaactaaaaaatacaaaagatcagtataatgagttagttagttctttgaaaagataaaaaaaagtcaataaacttttagccagactaagtgataataaagaagaaaaacagaaataaatcagacatgaaaaaggagacattacaactgataacacagaaatacaaagaattataagaaactactatgaacaactataagccaacaaattgaaaagcctagaagaaatggataaattcctggacacatacaacctaccaaggttgaatcaagaaaaaatggaaattttgaacaaatcaacaatgagcaacaagattgaagcaaaaatacaaagtctcccatcaaagaaaagttcagtacccaatggcttcactgctgaattctaccaaacatctaaagaactaataccaattcttcacaaactattcaaaaaattgaaaaggaagaaactcttccaaaattattttaggaggataatgatcattatcctgatcccaaaaccagacaaaagcacaataacaacaaacaactacaggccaatatcctcaacaaaatactagaaatagaattcaacagcacattaaaagatcatttaccatgatcaggtgggatttatcccagtgatgtaaggatggtttaacatatgcaaattaagaatgaaggacaaaaattatattatcattttaatagacacagtaaaggcatttgacaaaattcaatatcccttcatgataaaaactctcaacaaagtatagaaggagcatacctatatgataaacctacaaacaagatgaaactgagtggggaaaagttgaaagcttttcctttaagaactggaataagacaagcatatccaccctcaccacttctattcaacacagtactggaagtcctagccagagcaattaggcaagacatccaaattggaaagaaggaagtcaaattgtccctgtttggccaggctcaatggcttatgcctgtaatcccagaactttgggaggccaaggcgggcagatcacttgatgtccagagttcgagaccagcctggcaatatggtgaaaccccatctctactaaaaatacacacacacacacacacacacacacatgctagccagacatggtggtgcgctcctgtagtcccagctactcgagaggctgaagcaggagaatcactagaaccccagaggcggagcttgtggtgagccaagatcgcaccactgcactgcagcctgggcaacagagtgaaacactgtctcgaaacaaaaacaaaaacaaacaaaacaaattgtccctgtttgcagaagacatgatcttatatatagaaaactgccaaaactacaccaaaaaactgttagagctagtaaatgaatgtagtaaacttgtagtctacaaaatcaacatacaataattgatagcatgtctatatgccaacagtgaacaatctgaaaaagcaatcaagaaagcaatcacgtttacaatagctacaaaaaatgtccagaaataaattaaccaaggaagtgaaagatctctataatgaaaactataaaatattgatgaaagaaattgaataagacacaaataaatggaaagatatttcatgttcatggattgaagaattaatattattaaagccaaagcaatctacagattcaatgcaattcctatcaaaattccaatgtcattcttcacagaaatagaaaaacaatcctaagatttgtgtggaaccacaaaaaatcccaaagagccaaagaagtcttgagcaaaaagaataaacctggaggcatcacactacctgatttcaaattatactacaaagttatagtaaccaaaacagcattgtgttgacataaaaacagacatatagaccaatagaacaaaatagagagcccagaaatacacccaaacatttaaagccaactgattttctacgaagttggcaagaatacatgatgggtaaagaacagtcttttcaataaatggtgctgggaaaactggatatccatatgcaaaagaatgaacctagaccccctatctctcaccacgtatgaaagtcaaataggccaggcacagtggctcatgcctgtaatcccagcactttgggaggccaaggcaggcagatcacttggggtcaggagtttgagaccggcctggccaacatggtgaaaccccgtctttactaaaaatacaaaattagccaggtgtggtggcacacctgtagtcccagcaacttgggaggctgaggcaggagaatcacttgaaccccagaggtggaggctgcagtgagcctagatcgtgctattgcactccagcctgggcaacagagtgagactctgtctcaaaaaaaaaaaaaaaaaaaaaaaaagaaagacgaaagaaaagaaaagaacaatagattaaggaattaaatttaagacctgaaactctgaaattattagaagaaaacatagtgtaagcatttcatgacatcaatttgggcaagaatttgttagacaagacctcaaaatcatgagtaacaaaagcaaaaataaagaaattggattacatcaaactagaaagcttctgcacagcaaaggaaacaatcaacagagtgaagagacaacctatagaatgggagaaaatatttgcagattatacatctgacaagggattgatatctagaatatataaggaactcaaacaactcaatagcaaaagtccaaataatcctattaaaaatgaacaaaagacctgaatagacatttctccaaaagagacctacaaatggccaacaggtatatgaaaaatgctcaacatcactaaccatcaggaaaattaaaatcaaaactacaatgagatatcacttacccctgttagaatgactattataaaaaagacaaaataacaagtgctagcaaggatgtggagacaaagaaacccttatacactgttggtgggaatataaattagttaagccattagagataatggtatagagatgcctcaaaaattaaaaatagatctatcatattttctagcaatcccactactgggtatataccaaaaagaaatgaaatcagcatgttgaagaaacatctgcatccccatgtttatgacagcattattcacaatagtcaagatataaaatcaacttaaatgcccatcaatggatgaatggataaagaaactgtgatatagatacacaatggaatactattcatccatttaaaaaagatgaaatcctgtcattttcaacaacgtkgatgagcctggaggacattatgttaagtgaaataagccaggcagagaaagacaaatactccatgatctcagtcctatgtacaatctttaaaatttgatctcatagtagttgagattagtgattctaggaagataagggggaagtgggagatggggagagattggtcaatgggtacaatgttacaggtagatagaaggaataagttctggtactctattgcacagtagggtgacaatagccaacaataatatattgtatatttcaaatagaagagaggattttgaatggtctcacaacaaagaaatgacaaacatttaaggtgatggatatgataattaccctgatttgaataattacacaatgtatacatgtattgaaacatcacattgtacccataaatttgtagaattatttatgtgtcaataaaaagtaatacagttaaaaaaataaaattgcccattaggataaataaaaagacccacacacaaaattatcattgtggcatttcagagcacagagagaagatacttaaagcttcttctgagaggaacaggacgcatacaaaagaatgggaattagactggcgatataattaagcaatattgtaaaagatctaagggaaaaattatttggaacctagaatttttagtcaaactatgaatcaattttgggggaagaaaaaagacattttcatatatagagggccttaatagtcactgaatgtgtactatagtaaaaccagaaactacataaaagaggaatttgggagattcagcaacccaagagaataatgaagtatgagggggatgttttctccttagttcttttccgtatttttcaataatttgataataaacatgcataattttataattaaaaaggaaattaattttgacaacatgcaagttcctgttctcacataccttatagtggagggacagattgtagtcaaataagcataataatacatgcaaaattacaaactgagcattactctgaaggaaaattacataattctatgtaagcctataatacaggaatctgacctaractggggaatcagagaaggcttccctaagcaagtaccccttgaacttagctttgaaactgggaaaatgaggcaatgtgagatgaagctgttagaggtattaggaatcaaacctattggggccttctagtccttagtagagagtctggactttattctatgtggaatgacagcctccagtgggttttaggctggcggatactacaatcagayctggaatgcagaaatagtacaccagtttctttgtgggtaaaagtcttagaggggagaatatgaccaactgtagggagacctgtaaaaaaagtttatcagtagctcagacgagataatggtaacttggattaagatagtggtagtagtaacagtgaaaaactagatacatttgaaagcttttagagccaaaataggaggcagctgtgcccttgttgttaccagtgtgggatctgaacacatgactacttgggttcaaatactgagcaaattaattaacctctctgggcatccgtttcctctcctgcaagacatggatgataatggtttctacattcatagggttgttatgaggaatgaatgaattaaaacttgtaaaatactttggacagtgcttgacataaaacaagtgctcaatacatattagctattattgattatattgccctggtcagtgtcaaactgcatatgggagatgagaatggtaacaaggataactctcacttgcatattcaaatgcaggatgctgccattcactgttataaaaaactctggaagagaatgaagtgatgaaaattgtaaatttggttttgaacatgtgggttttttgagatatctaggtggagatgttgagaaagtgattggctgtatgagcctggagttccagaagaggtcagsaggggagacagaagaaggagcagtctgagaagtaggagaaaaaaacccacagagatgttggcacagaggccaagggaagagagagttttaaaaacgaatgaatggtcaacaggtgcaaataaagactgaaaaatgtccattggatttagcagcatgatggtgattggtgaccttggcaagagctgttggtttgatagtagcccaatgttcttgataaatttgtttacaagtcaaggtagcaataaagtgtctaaagtcaatttgtccattctgtcctagcaagtgttttccatttcagattctctacttcatagccataggtgtcttattcctactttacaggtctgattggatgccacaggaaatcagtctattggcatgtgattrgaatgggcaccactcctdaagkgcmctcaatattcctcdraggtcacayayttcttgygaggawccatydccagsmgtccttggaaakctygccaataacttyccttrytgytcaaacactcttgatggaccttggacagtttctactgttttgtcatakctcttcccaccaacatggtaatatcttggatctttaaaatgaatattataaatatccagtcctacttttaataaaatttactggacaatgtacaggaatatagtgtgttgctgaaggggacattatagagttactgtattagacctcagccaagatcccctagtttccagcttccagtgtaaagtttttaccttgactataaaagggcttgagtattagtaggactcatggatttttagttaaatgtctgtgatggagaaaagatggcttatggatgattgaggtgggaaaatgaggagaatagtatgcccttggtttctcagccttatcccattaattacgctccaatattatggagagaggaactgcaagttgtagctgaagagattttttttttttttggagaaatctagggaaatgggaaaaaaaggcattgtccagattgcaactgtaagggctccactatatcattagtaatgcccagagcagtaaatagcaaatatgacaggctattgtagagcttgacttcagacaccagacagccagaggcactctgtagatacctggcagtagatgagagacacctgtgaaactgagggcaggtcaggagctagtgaattttagaagtaacatgggattgaaaggactatttggtgggaactttggaaagggtcaaaggttctgtgtaagcaaattaggacgatggtaactacagttttaaattattgttaatgtaactttatttgtaactgctagttgtgcaaattcagattgcatcatcatttcaccccaattttccttacttttgtatttattctgctaactcttaatcttggatcaacctaataaccctctttctctacccctctcgtggccattgaaggctcttagtcagtttgtgctgcaataacagtataccacagaatgggtaatttataatggacagaaatttattggctcacatttctgggggctgggaggtccmatatcaagttgcctttttctgcgtcttaacatggtggaaggcattatatgacmaaagggcaaagaaagggtgagagagagcaagaggagggtgagctcactcctgtgataacaaatccactcccatgaacactttccccagataactgcattagtccattcatgagggtggaacgcttatgacctaaacaccttttatatgttcacctctcaataccatcacgatgataattaaatttcaatatgagtttyggaggggacagacattcaaaccatagcaagagttattggagaaaaatgtcggagaggcctaatcttttatatttaatagcatttctttcttcctattactctcatattaaccttctcctcaggttccttggttgacttagaaaagagaattgatcttgccatgcatccaccattttcctccttatgttctattagtgaccttgtttattgtcttctgtagtgattaagaatagaaatctctcttccccatgtgtcacataatatttatggaattttgacaagaccttagtggacaaaatgtgtcatactgaatgagtaacaggaagttgatgcacaaacaacattcttgcaggcacagaggaataggtcatttacttgtatatgatcattgtcaatcaatcattgtccagttggaccccgattcagtttattttttgttttgtttttctccttttcacagattctatccactaattttaatctttatttttcagaaaaaaatgctttatcttattgaacctcagaccaaacactttgtttttcgatgcagactgagttatgtttaaggctacatgaaccccagactagttgtttgctgctcctaaaaccttccctgttcctcataatcaagtaaacaggtctcccttcttagaagtatttgatcttcaaaattgccctgtggtataaatagggcaggaattattattatccattttacaaagcatgaagatgagactgagaatgttgaatacatttgccatagggtttacaactagtcacaggcagacatgctcttaaaatatatatctccttgattttaagttgtatcttgtcatggttttatgaacttggaacatgtcttaaagtttatatctacactaacatttttcccaataagctgttattaaatcaatgatttgtggcaagaagggatagtgatgtggaaagggggggtacttaggggagagcctggaaggcctaataagagagaaagaagtcataaaagttaaggcaagtgatatggtttggatatttatcttcactgaaatctcatgttgaattgtaatttccaatgctggaggtggggtctggtggcagatgtttggatcatgggggtgaatccctcatggcttgatgctgtcttcatgatatttggtcattcagaagtgtgtggcaacttgcactctctgtcttgctcctgctttcaccatgtgacatgtctcctcccccttcacctacccccatgattgtaagcttcctgagacctccctgaagccaagcagatgccagcaccatgcttcccatatagcctgcagaaacatgagccaattcaatctcttttctttataaattacctagtctctggtatagaacagcctaatatagcaagacactctracattgtttggtttgtctgactccagatggcaygraagcttawgtcaaagtagacagctgtccagaggaaccccaactaygaatgaaaaataatgaagaagcrgaagactrtgatgatgatcttactgattctgaaatggatgtggtcaggtttgatgatgacaactctccttcctttatccaaattyvcyhagttgccaagaagcatcctaaaactkgggtasattacwktgctgctgaagrggaggactgggactatgctcccttagtcctcgcccccgatgacaggtaagcactttttgactattggtactctctcttccccatactcaaaaagttcttaccagttattcaaaccaacaaatcctgaagccatgtttaaggttaggtacaggtatggaatcaaatggcaagggtattaacatttggaaactaacatagctgagcatcagagaagcttgtatttttctcactccttgccttgattgaatcatataagctgttttagagttggatttgagcctacctagaatttttcttcccaacctctmatctttttttctcttatacagaagttatawaagtcaatattygaacaatggccctcagcsgwttrdtaggaagtrcaaaaragtcygatttatggcawacacagatkaaayctktaagactcgtgaagctattcagcatgaatsagraatcttgggacctttactttatggggaagttgkaracacactgttggtaagttgaagaaaagatttaaggtcaggtaagaagaaaaagtctggagagttttgagtttctaaaatacctcataaktcagccttgtctccaatggacatgatcttttaaaagctataaatgttacacaaataatagctgattgtatgtatttaaagtttgagtatatagaataaaaatttaatgtcacccactaaactcgacactcctttgaaatactgcttagactttgatacatatccttccagatctttctccattaattatgtcatataggagtcagcagactatggcctgtgaaccaaatttggcttgtggcctgcttttgaacagtccatgagcttagatgagattttacatttttaaaatattgcaaagaaaagaaaggaggatgggaggaaggggaggagaaggcggaggagcaagagaatatgtgacagaggctagatagggctcacaaattttagagtacttactatccagccttttccaaaaaatgcttgcttgctcctgatctaggatattaagaatgagtatggtgtaagtaacagaatactcaatggacagtggtttaaataaataagggtttattttcttcacaagaaatttgaagattggtcgttggttccataaattcagccgctgaagaatgtcatgaagaacactggtttttagatatggagttttgttagatactgccaaactgactttcagcaattttgtaccaatttatatcccctaccataagtatatgactgcccttttccccacaccattgccaacaacatatattataaaccttcagaaaattttccaatttgatgagcaaaatgtttatatgtkgtcttcatttgcatttccctggttagtggtcaaattgtatattgtttcatgtttgttggctatttgtataactccctctgtgaattgcctgcttgtaaattttgtccagttttctatttggtcagtcatcttttgcttatgtatttgtaaaaggtctttatagattatggatattgacacattgttatttrtctttcaaatgttttcctcacattgtcacttgtactttaactcctttatgatattttttgtccttcaaagatttttcatctttatatagtcaaaacctcctatcttttatcaatcttttcatttatatgtctctggatctttttcacttatgttttctgcctgagaatgtcttkgccacccccaagacactacaaaaatagtctatattttattctcttacttgtatagctttatttttacagtgagcaatctaattgccctggaagttacttttgaatgtagtgcataattcaaatagaaattttcccaaatggcagctgacacaaccaatccttttttcattaatttgaaaatgtcttctttatcatatactaaattgctaaaatctgggatttttaattctccttaactaatctgttaccaccctgttttaatgacttcaactttgtgatatgtttgatatctgtatgacatcttctttcattgtacttcttcaaaatttttattagctattattgtacaatttttcttcataaattttgtgtacgtattttttctatttttcattttttgaagattgtataattttattttttattcattaatttttaaaatgcataatgacacaataattttacatatttatagggtactttttgtgtattttgagttacttttactggctaatttaaaaatagataaacaagagcatgcaataaaatgtaaattttcctccctcttggacttccaaccccatagtctgacagacagtcattgctgtgggtttgtatactcccctccagaagtagtgcatacatgtacaaatgtgtgtgtgtatgtgtgtgtgtgtgtgcatttcacacaaaaacaagagcagtgtaaattggtctgtaccttgatttttaaaargtaacaatatattttgaattagccaggcatggtggcacatgcctgtagtcccagctactctggaggctgaggcaggagaatcgctcgaatctgggaggcggaggttgcagtgagctgagatcgcaccactgcactccaccctgggcaacagagtgagactctgtctcaaaaaaaaaaaaagtaacaatatattttggatatcatttcatgtcaacatatatagatctaccccattctttgatttattcaggttatactctggataccatgctgaatcctacacttaaacattacctcaaaatggatcaaagataaaatgtaagagctaaaactacaaaattataagaaaacaacaggataaatctttgtgatcttgaattagacaatagtttattggataggacaccaaaaccaacaagcaacaaaagaaaaaccatttgacccagccatcccattactaggtatatacccaaaggaatataaatcatgctgctataaagacacatgcacacgtatgtttattgcggcactactcacaatagcaaagacttggaaccaacccaaatatccaacaatgatagactgattaagaaaatgtggcacatatacaccatggaatactatgcagccataaaaaatgtcccygtttgcagatgacatgattgtatatctagaaaacaccattgtctcagcccaaaatctccttaagctgataagcaacttcagcaaagtctcaggatacaaaatcaatgtgcaaaaatcacaaacattcttatacaccaataacagacagagagccaaatcatgagtgaactcccattcacaattgcttcaaagagaataaaatacctaggaatccaacttacaagggatatgaaggacctcttcaaggagacctacaaaccactgctcaacgaaataaaagaggacacaaacaaatggaagaacattccatgctcatggataggaagaatgactgggttttaagacaagagcagaagtggaagttgcatttttatcctcatatcacacacctcagatctggaggtgggattgatattttcagggttcttcgctgcagcttccatgttattgctcttccattctctctctctctctctctctctctctcgtctctgtctctctctctctctcttgagatagggtctcattctgtcacccaggctggagtgctgtggtgtgatcacagctcactactgcagcctcaacttcctgggctgaagtgatcctcccacctcagcctcccaartagctggtactataggcatgcaccaccacgcctagctaatttttttattttttgtagagatgaggtctcactgtgttacccaggctggtcttgaagtcctgggctcaaacgatcctcctgcctcagcctcccaaagtgctggcatgagccactgcacctaggcctttgttttcttttaaagctggtgcaatcaggcaataccacctgctacccttgcttaatactgtaatcaactgtcctcttggtcatgcctgctcatgcactgaagattttatctcctgaaacactgtctctttctctattatcagtgaatttaatgcccaaatagtaataaaggctgagaggaagcagtgtcctcaccaggcatctaaatttcaattagtgtgagaaggtgcagagaatacttcctgaagcaattgaaacaatttttaaagaagtggaaaggggcctttagagagaaacctaagtactgtcagccctcyacattgtcaactgaagaatcctaagtttgtaaatttggagtggaaagggttgcaggctgggaagtgtagcctctggcagcaaatggaagcaagcactttgaagaaggaaggatgagataagaatttatgctgaatgagttggctaagtatacatatttaacaggttccaggaggagctgtgaatatttatgatggggcacctgcaaccacacatgttacatacattccatgttcactttggggtggagacttaacatttagatgcatgaaaattaggctgtatatgtcaaaagatgaaacagaggacacagaggcagcctctgtaaactggccagagccagtccatggtcagtggtctctcatcaggaagcaatgcttctcggttgttatgataaaactgcacaaagggaggggaatccaccacgtctttagaaaggactggtttatgtttaacccttaagaaagaaagtctaacggcagattagggagggagggaatgtaacaaggcatgcccgatctcccatcccatcatggtcagaaactcagtttttaagccatctctggggtctccttggccgagaaaggggtctcttcagtcgtttggggatgcttaagattttatttttatttttcagtatcactggatttctagtctcatattcaaacaaccattgattgaaagtattcaaaaaacaaccccaaaacaataaaagataataatacaacaataaacaataatacaaagaaacaatacggtaaaacaactatttacatagcatttatgttatattatgtactgtaagaaatctagagacgagttaaagtacatgagaggatgtgcatatgttatatgcaaatactacatcattttgagtaagagacttgagcatcacagattgtggtatctgcaggggtcctggaaccaatcctccatgcatgccaaggaacaatttcatgaaaagaccaaatattttgagttttatctagcctcaaattactataatgtagatagaggccacttttatttatctggagttagaccacagttttcttgttgatcctagtcgttttaggatttgatctyagatctcgcttatactttcagattatatktamgaatcaagbaagcagaccatataacatctascctcacrgaatcactgatgtccgtcctttgtattcaaggagattaccaaaargtaaatattccctcgatttatagctcttttttacctgtagatacagatgagataaatatcatcaataacaactaaaattatgttggtcctttctccagctgttggccggacctcaagctccagtctaaagttataaaaatcaattataggaatcctcaggtgatgtttcatgtaaattcgtgaagagtcgcctgacatgtttttcctattacctagcggtgatgttcaaatattccacagccaattagattccactgcaattggttccactgcaactactgtaaatgccctaaaatcttgaagctggttcttctggcacttaagataatttttttttctgagtacggttttcagctacattccacacttttggtatctagtgtggtattccacactttgggtaactagtttgatattttcaggattctttgctgcagcttccatgttattgctcttccttgctctctctctctctctctctcaacagggtttcactctcacttttggtatctagtttgatattttcagggttcttcgcatattcatttctaaatagttcacaactccagtttttatttactatattgtttgctgtttaaagatttattttttcttttagtagattggatgttatgtatattctttctattatttaattttggatgaatatttatcaaaataatagatgtgtatgcttaaaactacaaaagggctgcctccctagaggcatccatttttaagaatttctgtttttgatttttggtggttatctctacatctctaaaaagttacttatactgctaactctttgtttttcaactttagacattatatacttactttgttttgtgcttttttccattcaagttgtttcagttttatcagtgttttcagttggattggctatcattagaactttaaaaatatactaaacatcaacttttagtaagatattttccaatcatggattgaaaatatcttttgactccatacttcataaattaaggatattaaaaactgtacccctcacttttcctttccccaaacctttcttttctctactgctgctagccattcctttacttttacaaaactaaacttgataacatttacattttgtgctgtaatttgaaataactcttccttgctttgtctatatattttctctaaagcttaaaaaattaaaaaacagcatttgtattattttagtattttagcaagtttcttttcataaatgttaactgcagaactgggtaatatgctatgattgctctcttttctacagctcaagtgattttactattaagataaaataatatgtggaaggaaaaaagttgatctcatagaagtagagataaaatagtggttactagaggctaaagaggggaaggggagggggaaatagggagacgttggttaatggatgcaaaattccagctagataggaggcataagtcctaatgttctatagcactgtagggtgactgtagtcaacaatgacatctattttcaaatagctagatgagaggatttggaatgttcccaacacaaaggtgtatcctgaagtaagactttgttttcttttattcggaaaagaaatgtaggcttcttcaaccctatttcttaggcctttcagcttcttaatcattctatgtattgcttgctatccaaatcttttattttttttttgagacagcgtctcgctctgtcacccaggctggagtacagtggcacgatcttggctcactgcaacctctgcctcccaggctcaggctatcctcccacttcagcctcctgagtagttgggaccacagacgcacactaccatgcccagctaattttttttattatttttattttttgtagaaatggggtgttaacttgttgcccagactggtgtcgaactcctgagctcaagcgatctgcctgcctcagcctcccaaagtgctggaaccaaatctttttcttcttaaagacattcttgtagtgaatagcattaactwcttttcccttgtacatttctattttttgatttcttctttkgtttttctggaagtatattctcaagtaacttctaaatatgtggtacatagagggtgaactttctgaatccttcaktatcacatgatgggcagacagactggttataaaaattttcccgctgggtgcggtggctcacgcctgtaatcccagcactttgggaggccgaggygggcagatcacttgaggtcaggagttcrasaccagcttggccaacatggtgaaaacccatytctacwaaaaatacaaaaaaaatagccgggcattgtggcgtgtgcctgtaatcccagctactcaggaggctgaggcaggagaattgcttgaaactgggaggtgaaggttgcagtgagccaagatcaccccactgcactccagcctgggcaacagagcaagactgcatctcaaaaaaaattccttcccctgttttctaatattcattattgccrataagaattctttatttgcatttctttatggaagaatggcatagtgacagagttctggggagattttgaatgtgtgtcccgaaatttggaggcatacgtggatagttactggtaacctgcttttccatggagaattttgaaggctgtaatgcccataatagtgggcaagaagagagggcaagagtggagcagtttaccttcctgctgtttgacatgagtttattctgtaacaagtgaatactgttgaaagtagctgggctttatcccttttgaagatattctacccaagaaggcagttaggcaggctgaggggatagcagaaccaatagagtcttggatatatcactggaagtaagaagagctgatggggagaggagagttgcagaaggatagctgaaagaaacatctctcatgtcatggaactatgtaatgctgaggtccccatggtaactctaaagaaaccatacatgtgtcctatgaaaagaccagcatttgggcacctcccacacagagaacattgatgaccaaatagtgttgtcaaagatagagcagcaggayctgttaaacaagagtctgtttgccctttcttctattacctaccctccctcacccccagctcctggaaaagggaagagaaggctcagaaatattgaaagaacatactacaccattccctttctttctttctttcttttttttttttttttggagacagagtctcgctctatcccccaggctggagtgcattggcatgatatcggctcaacctctgcctcccaggttcaagcaattctcatgcctcagcctcccaagtagctgggattacaagtgcctgccaccacacctggctaatttttgtatttttagtagagatggcgtttcaccatgttgaccaggctggtctcgaactcctcacctcaacaccattccctttctatggatcctctaaccataggtcaggcataacttactgaggtgaggaagagcttagaatgaatataaaattaaaattttgatttagattgtatcttcaggtatgaaacatacccagaatgagacttaattactaaaatcagttcttgtcctgaggacccattaccctgagggcagatctcagttcttgctccctttcctcacagaagtcagagactacaccttaaaactccaatgccaagctctttggcatatattcaggcctgacactttcacagtcaaccggataatcaattacagctttttactttttaaaaaaattgtttgaatcttaaaattataataggtgcgactttagcttccacttgctcagaaacttcrtatgtacatacagatttgtagaacccttgcaacaacaacatgattatcaatatgtggcttgttgtactctaattgagctatttatggttttgcttgtgggtaggtgtaaaacatttgaaggattttccaattctgccaggagaaatattcraatataaakggacagtgactgtagaagatgggccawctaaatcaratcctyggtgcctgaccbrctattacyctdgtttcgwtaatatggagasabvtctagcttcaggactcattggccctctcctcatctgctacaaagaatytgyasmtcaaagaggaarcmrkgtgagttcttgcctttccaagtgctgggtttcattctcagtgtatgtccccttataacctgaagaaaatataatggtttgcaatataggtcagtaaaagaaatgagcttagcttttactaaatttgagtttcacgtagtaaacgtgcctgctggatggataggccatagaatgtaggccctagatttttcctatagtactcattcccagtctgggatttagctctctctagctgatcctccccatttttatatgtccaattaccacctattttcagatgacccacaratttatatctacagcctagatttcttccatggacatctcattatgggtgactcaaaagtacctcaaaattaacatgtctgcagcatgtagcactgttgcaggaagtcagggaccccgaacagagggactggctgaagccacggcagaagaacataaattgtgaagatttcgtggacatttattagttccccaaattaatacttttataatttcttacgcctgtctttactgcgatctctgaacataaattgtgaagatttcatggacatttatcacttccccaaccaatactcttataatttcctatgcctgtctttactttaatctcttaatcctgtcatcttcataagctgaggatgtatgttgcctcaagaccctgtgatgattgcgttatctgcacaaattgtttgtaaagcttgtgtgtttgaacaatatgaaatctgggcaccttgaaaagaacaggataacagcgatttccagggaacaagggagataaccataaagtctgactgcctgcagggccaggcagaacagagtcatatttctcttcttgcaaaagcgaataggagaaatatcactgaattctttttctcagcaaggaacagccctgggaaaagaatgcattcccagggggaggcctctaaaatggccgctctgggagtgtttatcttatgcagttgaagataagggataaaatatgccctggtctcctgcagtgcccccaggcttgctaggattaggaaattccagcctggtgaattctagtcagaccagttctctgctcttgaaccctgtttcctgttaagatgtttatcaatgacaatgcatgcacagcaggacatggaacctcattagtaattctaatttcgccctaccttgtgatcttgctctgtccctatttgccttgtgatattttattgcctttgaatcatgtgatctttgtgacccacaccctattcgtacactccctcccctttgaaaatcactaataaaaacttgctggttttgcggcttgggggcatcacagaacctgccgacatgtgatgtcacccctggagacccagctgtaaaatttctctcttttgtactctttctctttatttcccagaccggccgacacttaggtaaaatagaaaagaacctatgttgaaatattgggggctagttcccacaatatagcacagtgcatctcacttagtaagagcttaataggctacgtgcggtggctcacgcctgtaatctcagcactttgggaggccgagacaggaggattgcttgagctcaggatttcaagmccatcctgggcaaaatagtaagaccttgtctacaaaaaaaaaaaaaaaaaaaaaaaattagctgggcatggtggtgtgtgcctgtagtcccacctactcaggaggctgaggtgggaagatagcttgagcccaggaggtcgaggctgcagtgagcctggatgacaaagcgacaccctgtctcaaaaaaaaaaaaaaaaaaaaaaaaraaagcttaataaatacttttgggcaaaacatagggaaagatataaaatatttcaaaatatggctagaatttrgaccatttctactgctttaaaaaataaagctaaattctctgaacaagaaaagcttagttcttcacaaaaactcattgctcggccccagaataactcagtgccatattgctgaggcttgactacatgtccatttgattatatttatgatacataagatccctactagtctgaaaacatttcatatgtttagagagtaaagtatatgaactttggtgccaataaaacacatggcacataaactcagagaagtataaattttgccaagtacttgtcctgaccgatttttcctaactatagttttttcgtcacttttgggaagagaactgaaatattattctatattctccaatctcctctcttcagtattttggtttatatagctataggttataaaaaatgaggtttatacatattagtgargtttacatatgaaatcttagcagatccaattagcaagcgactaattcataaatctggttcatatacaaaatgctcttctgaaaaaaatttgaatgttttaaacagaaaatttaaggtattagtgttgtttgacatttttgtggttcaccttatctttcttatttgatttctgtttttctatttttaattttttatagccttgtggaaggtcagttgctagatggaagtttaggaaagtcagtatctcatttgacttaactaacttaagaaaggcactgaataaccacttggttctttaaggagttaaatcttctaatctgaacatgaagagaataaggctacagactgtaccaaataaatcagctagcatatggccttgggtgcagaaaaaactaagttcagtgggatcagtcaccctcttgtcctggggacacatttgttgtaagcatatactcactgctcatagcacccaccctcaactcccaagccctggtacatgcctaagaggaaatggaattaaaccaatggattagatatatcacatgcatgccatcgctttcatcatagactgctagctcctacctgacaacatcagtagcatttctttacccstttcaatatatgtaattaacagabartgtmagrcaagaggaatgtcatcctgttttctgtatttgatkagrasbgaakstgsymcctcacagagawtatayaaygctttctccccaatccagctggagtgyagctygaggatccagagttccaagcctccaacatcatgcacagtgagtaaagcagcacttaagtccagtgggtggtgaataaagaaaaattgatgtaatcaaagtgatgtccagataatgaatgaattgtatgtgcacataaatttaacaattatgttacctataaatgtataatttttactcaaacacacgtgatcatataacccatattttaaaaatccagtcaccattttttcctttcaatatttacttgatttccctctcccttttaattccctatctccttctatattacatcttttcaccaaccattccatgcccaggtaacatattttaagacatattttctctataattatataatcatatataaacacatacatacattgtattagtcttctagtgctgccataacaaagtactgcagactgggtggcttaaccagcagatatctattgtcttacaactctggaggcttgagatcaggatgtgggcaacgttggtttcttctgaggcttctctccttgtcttgtagatggctttctcccttgtcttcacatggtttctcctttatatatctttgtcctaatctcctcttctaataaagataccagtattgttgggctagggcccaccgtaatgaccttattttaactaactacctatttaaaaacactatctccaggtatagtcacatgctgaggtactggggtttaggactgcaaggtataaatttgggatgggggaacacaattcagcccattgcatacatacacatgtgtatatatttatatataccacaaatctgaatggtcaaaaatatggtaaaaaattccaattgcactatcctacagggaaatgcgaaatagaataacaataggatagcactttatacccatcaaactgccaaaattataattactagtgggcttgtggataaaagagtgttctcatgctatattagtggataagtagtatagtcttttcaaaaccaatatatgccttttgaaattctgattattaagatgtttaagatggagtgagccacatttccctgtgtgtcccactggatgcaactaaaaatcctgaacaggccgggcacagtggctcacgcctgtaatcccagcactttgggaggccgaggcaggcggatcacgaggtcaggagatcgagaccatcctggctaacatagtgaaaccccgtctctactaaaaatacaaaaaattagccgggcatggtggcggccgcctgtagtcccagctactcaggaggctgaggcaggagaatggcgtgaacccggaaggcggagactgcagtgagccaagatcgtgccactgcactccaggccggcgacagagtgagactccgtttcaaaaaaaaaaaaaaaaaatcctgaacgaaatgcatgggaaccttgaaaagttataatgtgagttatactcacctaccagaatgtggcatatgttacaattctatgcccctcctctcaaagctttagccctttaactttgggttgagcctcatatttagcttgaatttctagtaatagtgatatattattctccagagttaaagtcctttactatccattattctaaaaattttaaggttgtttagtcctttgagttgcatttttattttttacatagttcagggtattgctttccttctgaaggattcagatttcacatttgtgcaagagtctaatgcttagtatttaattctagtggcmcagagctttttcttttctccctcttctctccagcctcatggctttggtttagaattccttcagcctgatagaatattgtattttataatttccttattgtgctatttactagatatttgttcttctatttttttctattcataatttctccctttcccaccacatctttttccaagtaggatgtgcacttgccacagtatctggacagttaaactgtctcattttcttggagacggtgatgaaaactagagagatatagtgacataagcagagccagaaaacaatttcactgaagatgatatatattttttttcctctgggatttctaatatagcttttggtggagataagagtctggaattgagaaagaagagattggaattgagaaaaagagtctgagaaagcacagggagagacacaaaggcagagaccaagagacacaggggaaggatcttcagaggaagagtccagggagaaagatgctaagacagagggataagaaaagaagaaaaaaaaggaccaggaggagagagacccaaaccataaatcactcctatttccattagcagtaaaattgataatctattttcatacaatgaaataccatgtgacaatgaagattcacaaaaataaagctatacacaacaatatgaataagtatcacaaagacaatttttagtaaaatggtaartgtcaaaagaatatatacagtattatattatttacataaagttcaaaaatgggcaaaattaacttatatagtttagggatacagaggaagaaaagtataaaggttagtaaggacatgattataataaaagacaagatagtggctacctcttagaaagagttcatttgagaataaacacatgtgttttgtggggatagcagcaatattgtatttcatgacctagatgtttgttttataattttgtgttttaaaaaattgtaggatttatgatttatttcgtagatggatcctacaaatgatagggaaattgcagtaggaatgaagaggaaggaacatgtacaggatttgtttagaagatagaaggcacatgattttgtaaataattagctatgtttggtaaaggactaagaggattcaaagatgattaccaaatttctgatatgggtaactagaagaagagtgagacaaaatggaagaaagtgtatttaaagaaatgatagcaaaaactttccaaatctggagaaagatgtaaatatccacgtacaagaagctcaaagatctctagtcagattagattcaaacaagactatatgaagacacgttacaatcaaactgtcaaatatcaaagacaaagagagaatcctgaaagcaacaacaaaaaagaagcaaaccacatacaaggaaattccaataaggcagaaactttacaggtcagaagagggtgggatgatatattccgagtactgggaaaactttacctagaaaatgtttccttcagaaatgcagagagataaagactttgccacacaattccagttagacaagagaaataaattaaagacatctattgtacactatggtgactacagttaataaattacccattccaatatatacatatataaacattgtgatgtacatcataatatattctatttttccctgtcaattaaaaaataaatttaaaaagattggatagagaagaatcagccattctagtaattaagcctgaggaagcttacattccagtgatttcagataaccattatgcaagttaaggaataaactggataggatgatattaaaaaaacaaaaccaccaatgagatacaccagaatggctaaaattaaaaaggctgtccataccaagtattggtaaagatgtagagtaatgagaactctcataaatttctggtcaggaaatccaaacatcgaaagccaaacatcggcataccctattgactcaggaaatccactcctagtatacacctgttatgtcctgaatcatgtcccctagaattaatatgctgaagccctaacactagtatttcagaatgtgactgtatttggagatagggtctttaaggggtttattaagttaaaatgaggttgttacaatgggccctaatccartatgactastgtccttataagaasaggaaatgtgggccaggcacagtggctcacgcctgtaatcccagcattttgggaggccaaggcgggcggatcacgaggtcaagagatcgagaccatcctggccaacatggtgaaaccccatctctactgaaaatacaaaaattagctggacatggtggcgagctcctgtagtcccagctactcgggagactgaggcagaagattgcttgaacccaggaggtggaggttgcagtgagcrgagatcacgccactgcactccagactggcagacagaccgagactccatytgaaaaaaaaaaagaagaggaaatgtgtacacacagagacaccagggatgcatattcacagaggaaagaccaagccaaggagaggygtcagtaaaaaccaaacctgccaataccttgatcttggaattttagtgttcaaaactgtgagaaaacacattcctgttatttacacctcccagtctgtggtatattgttatggcaaccctagccactagtacagcacccaaaagtagtgtgtacatatttcacaaaagacatgtaactatttaatccatgtggagtgtcaaaaggcaaaaatacaacaaatgtattttaaagattgtaattggcttttatacatgattctagaatcagatagccctcagaaccaaatacagaacagcagccagcaacatagtatggatagaaattggaagtgaggtttagagacagcttaattgattacagttgggcatttttgccttatttgaagctgttagtcgcctgcaattgatggaagttcagctgctataatcggctgagactgagctgtttgttataaaagcatattcctaaattaggctttcagttagttcatcaactaagccaggctgcaactttgttgtgcaaggactcaagtgcaaaggtacccttaggcaaaattcagattaatttaaaaggactttacttttgttagttatgtgaaatgaagtggaatctattttttccaagtggatagtcatattttctattatcatttaccaactagctgatttttttcctgtactgrttggagatgctgcctttattatatattaagtttcaacttattatatattaagtttccgcttacatcttgtcagtttctggactccatattttgtttgatatatttatctattctgcattaagactgcatttttaattataatagctttataatatctcaatgttgtataggaaaaaaacttcaattattaattagttataytaagccaatgtctaagtattgcttagtggtttgtgggcaaccatcttacacagtacctagtaacagagtagacaagtgtttattgaatggatggatgaatggatgtgtggaagaggctttcagaaacaattcccttcatagactaaggccaatgttacttttgcttagctctttagtttgaaataatttaaaatgtacagaaaagttacaagaataatacatggaacttgcacacaccctttacccagattcacaaatgtttaacattttgcaattttgtttttcattttcttttctttatatacacacttctgttacttattttctatttgaaaattagttgcagayatcacatccctttacctctcaatactttagtacacatttcctgtgaataaagatatcttttacataacagacacttcaaattgataaagcacatttccrtaatttacaactggtattccagttgtatcaaccaatgctgtcatttatagcattttcttctttgaagtacagggatctagtacaagtaactacttgtcctgcttctttcatttccttgaatctggaccttcatcagatggtaactttaagcacccaaaggtttttttctggtttctcctctgtgtagtttaagaccatgcaaacatcttgctactcatcaaaatgccccccatataacatccaaattaatctttatcatgatggtttatgactgtctcctcacattgggattggggcccaactgattattaacaatctacttttttggaagatataatatctcttcctgggaataagataatgggcataacatataataattcctaattgtatcatgacaatcacaatccaaaatactaaatctgtgatgtgtctaaatctcttttccccattgtttttgcaggcatcaatggctatgtttttgatagtttgcagttgtcagtttgtttscatgagryggcatastggtacattcyaagcattggagyacmgactgacttcctttctgtcttcttctctggatataccytcaaacacaaaatsktcwrtgaagacasactcaccckattcccattctcaggagaaactgtcttcatgtcgatggaaaacccaggttagttattatatttttcttgtaccaacagctgtgaatgcttcactagccattcgtatgctcttttgcccactagctcacatgctgtcatttatagcattttcttccttgaggtacagggatctagtttctcctctgagtagttattattttcacccttgcaactaataaacagtttgaaggatcacrtagtagttctatttttagttttttgaggaacctccttactcttttccacagtatttgtacttatttacactcccaccaacagtgtacaagcattccccttttgccacatcctcaccagcattttttaattattttgtctttttgataaaagccatttaactggagtgaaatatctcattgtgcttttggtttgcatttctctggtaattagtgatgttgagcagtttttcatatacttgttggccatttgtatgtcttctttttttttttttttttttttttttcaracggagtctcgctctgtagcccaggctggagtgcggtggcacgatctcggctcactgcaagctccgccacccgggttcacgccattctcctgcctcagcctcccgagtagctgggactacaggtgcccgccaccacacccagctaattttttgtatttttagtagagacagggtttcaccgtgttagccaggatggtctcgatttcctgacctcgtgatccacccgmctcggcctcccaaagtgctgggattacaggcgtgagccaccrtgcccrgcctgaatgtcttcttttgagaaatgtctattcagatctttgtccatttttaatagggttctttgttttttttgctattgactagagtttcttatatattctggttattaatgccctctcagttgtatagtttgcaaatatttcatcccatcctataaattgtctcttcactttgttaattgtttcctttgctgtccagaagctttatggcttgatataatcccatttgtctacttttgctttagtcccctgtgcttttgaggtcttacctgcaaaatctttcccagaccaatgtcctggcgcattcccccaatgttttcttccagtagtttcatactttcaggttgtatattttagtctctaatccattttgatttgatttttgtatatagtgagagataggggtatagtttcattcttctgcatgtggatatccagttttcccacaccatttattgaagagactattctttcaccagtgcgtgttcttggcactttgtcaaaggtgagttggctataaatgtgtggatttatttctgggttttctgtcgtgttccactggcatatatttctggttttatgccagtaccrtgctgtttttgttactacagctttgtagtatagtttcaagtcaagtagtgtcatgcctccagctttgttcattttgctccagattatttagctgtttggagtcttttgtggttccacacaaattttaagattcttttttctatttctgtgaaaaacttcactggyatttggataggtattacattaaatctggtagcaytgatattttaacaatattagtttttccagcccattaaaatgggatagataccttttcagttttttgtgtgttcttcaattccctttatcagtattttagttttcattatagagatatctcagctctttggtttaatttattccaatatatttatttttattatagctattgtaaatgatttttwaaaaatttctttttaggttgttagctcttggtatatagaaatgctactgatttttgcatgttggttttgtatcctgcaactttactgaatttgtttatcagttctaatagttttttgatggagtctttagttttttgtgaaatataagattatgtcatctataaacaaggagaatttgacttcttcctttccaatttgggtaccctttatttctttctcttgcttacttgttctggcttggacttccaggactacattttatagaattggtgaaagtgggcatccttatcttgtttcagatcttaaaggaaaggcttttggttttccacatttggtatgakattagccgtagtttgtcatatatggcatttattgttttgaggtaagctttctatacccrgtttgttgagagttttctcatgaagggatgttgaatttaatctttttggcatcaattgaaatgatcatttgtttttgtccttcattctgttgatatgatgtatcacattgattcatttccatatgttgaaccatccttgcatccctgggatgaatcccccttgatcatgatgaatgatcttttactgtgttgttgaatttggtttgctagtagttcgttgaggatttttgcatcaatgttcatcagagatattggcctgtagtttctttttgtgtatgtgtgtgtctttgtctggtttggtttcagggtaatactggmcttgtggaatcagtttggaagtatttttcccccttgatttttgggatagtttgtgaagagctggtattagttctttttttttattattatacattaagttttagggtacatgtgcacaatgtgcaggttagttacatatgtatacatgtgccatgctggtgtgctgtacccattaactcgtcatttagcattaggtatatcgcctaatgctatccctctccccttcccccaccccacaacagtccccagagtgtgatgttccccttcctgtgtccatgtgttctcattgttcaattcccacctatgagtgagaatatgcagtgtttggttttttgttcttgcgatcgtttactgagaatgatgatttccaatttcatccatgtccctacaaaggacatgaactcatcatttttatggcggcatagtattccatggtgtatatgtgccacattttcttactccagtctatcattgttggacatttgggttggttccaagtctttgctattgtgaatactgccgctataaacatacgtgtgcatgtgtctytatagcagcatgatttatagtcctttgggtatatacccagtaatgggatggctgggtcaaatggtatttctagttctagatccctgaggaatcgccacactgacttccacaatggttgaactagtttacagtcccaccaacattgtaaaagtgttcctatttctccacatcctctccagcacctgttgtttcctgactttttaatgatcgccattctaactggtgtgagatggtatctcactgtggttttgatttgcatttctctgatggccagtgatggtgagcattttttcatgtgttttttggctgcataaatgtcttcttttgtgaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcytttgctgtgcagaagctctttagtttaattagttcccatttgtcaattttggcttttgttgccattgcttttggtgttttagacatgaagtccttgcacatgcctatgtcctgaatggtattgcctaggttttcttctagggtttttatggttttaggtctaacgtttaagtctttaatccatcttgaattaattttagtataaggtgtaaggmagggwtccagtttcagctttctacatatggctagccagttttcccagcaccatttattaaatagggaatcctttccccactgcttatttttctcaggcttgtcaaagatcaggtagttgtagatgcgtggcgttatttctgagggctctgttctgttccattggtctatatctctgttttggtaccagtaccatgctgttttggttactgtagccttgtagcatagtttgaagtcagggagcgtgatgcctccagctttgttcattaggcttaggattgacttggcgatgcgggctcttttttggtttcatatgaactttaaagtagttttttccaattctgtgaagaaagtcattggtagcttgatggggatggcattgaatctataaattacattgggcagtatggccattttcatgatattgattcttcctacccatgagcatgsaatagtcttccatttgtttgtatcctcttttatttccttgagcagtggtttgtagttctccttgaagaggtccttcacatccgttgtaagttgtattcctaggtattttattctctttgaagcaattgtgaatgggagttcgcttatgatttggctctctgtttgcctgttattggtgtataagaatgcttgtgatttttgtacattgattttgtatcctgaggctttgctgaagttgcttatcagcttaaggagattttgggctgagacaatggggttttctagatatacaatcctgacatctgyaaacagggacaatttgacttcctcttttcctaattgaatacactttatttccttctcctgcctaattgccctggccagaacttccaacactatgttgaataggaaaggtgagagarggcatccctgtcttgtgccagttttcaaagggaatgcttccagtttttgcccattcagtatgatattggctgtgggtttgccatagatagctcttattattttgagatacgtcccatcaataccaaatttattgagagtttttagcatgaagggttgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttttgtctctgcccggctttggtatcaggatgatgctggcctcataaaatgagttcaggaggattccctctttttctattgattggaatagtttcagaaggaatggtaccaattcctccttctacctctggtagaatttggctgtgaatccatctggtcctggactcttttcggttggtaagctattgattattgccacaatttcagagcctgttattggtctattcagagattcaacttcttcctggtttagtcttgggagggtgtatgtgtcgaggaatttatccatttcttctagattttctagtttatttgcgtagaggtgtttgtagtattctctgatggtagtttgtatttctgtgggattggtggtgatatcccctttatcattttttattgcatctatttgattcttctctcttttcttctttattagtcttgctagcggtctatcaattctgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccatctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatttctgttgttttacatttgctgaggagagctttacttccaactatgtggtcaattttggaataggtgtggtgtggtgctgaaaaaaatgtatattctgttgatttggggtggagagttctgtggatgtctattaggtccgcttggtgcagagctgagttcaattcctgagtatccttgttaactttctgtctcgttgatctgtctaatgttgacagtggggtgttaaagtctcccattattattgtgtgggagtctaagtctctttgtaggtcactcaggacttgctttatgaaactgggtgctcctgtattgggtgcatatatatttaggatagttagctcttcttgttgaattgatccctttaccattatgtaatggccttctttgtctcttttgatctttgttggtttaaagtctgttctatcagagactaggattgcaacccctgcctttttttgttttccacttgcttggtagatcttcctccatccttttattttgaggctatgtgtgtttctgcacgtgagatgggtttcctgaatacagcacactgatgggtcttgactctttatccaatttgccagtctgtgtcttttaattggagcatttagtccatttacatttaaagttaatattgttatgtgtgaatttgatcttgtcattttgatgttagctggttattttgctcgttagttgattcagtttcttcctagcattgatggtctttacaatttggcatgattttgcagtggctggtactggttgctcctttccatgtttagtgcttccttcagaagctctcttaggkcaggyctggtggtgacaaaatctctcagcatttgcttgtctgtaaaggattttatttctccttcacttatgaagcttagtttggctggatatgaaattctgggttgaaaattcttttctttaagaatgttgaatgttggcccccactctcttctggcttgtagagtttctgccgaaagatcagctgttagtytgatgggcttccctttgtgggtaacccgacctttctgtctggctgtccttaacattttttccttcatttcaactttggtgaatctgacaattatatgtcttggagttgctcttctcaaggagtatctttgtggcattctctgtatttcctgaatttgaatgttggcctgccttgctagatttggcaagttctcttggataataccctgcagagtgttttccaacttggttccattctccccatcactttcaggtacaccaatcagttgtagatttggtcttttcacatagtcccgtatttcttggaggcttcgtttgtttctttttattcttttttctctaaacttatcttcacacttcattttattcatttcatcttccattgctgataccctttcttccagttgatcgcattggttactgaggcttgtgcattcatcacatagttctcgtgccgtggttttcagctccatcaggtcctttaaccacttctctgcattggttattctagttgtccattcgtctaattttttttcaaagtttataacttctttgccattggttcgaacttcttcctttagctcggagtagtttgatcttctgaagccttcctctctcaactcatcaaagtcattctccatccagctttgttccattgctggtgaggagctgcattcctttggaggaggggaggtgctctgattcttagagtttttggtttttctgctctgttttttccccatctttgtggttttatctacctttggtctttgatgatggtgacgtacagatgggttttcggtgtggatgtcctttctgtttgttagttttccttctaacagtcaggaccctcagctgcaggtctgttggagtttgctggaggtccactccagaccctgtttgcctgggtatcagcagcagaggctgcagaacagcagatattggtgaactgcaaatgctgctgcctgatcattcctctggaagttttgtctcagaggagtagctggccatgtgaggtgtcagtctgcccctactggggggtgcctcccagttaggctactcaggattcagggacccacttgaggaggcagtctgcccgttctcagatctcaagctgcgtgctgggagaaccactactctcttcaaagctgtcagacagggacatttaagtctgcagaggttattgctgtcttttgtttgtctgtgccctgcccgcagaggtggagcctacagaggcaggcaggcctccttgagctgtggggggctccacccagttcgagcttcccggccgctttgtttacctactcaagcctgagcaatggcgggcacccatcccccagccttgctgccaccttgcagtttgatctcagactgctgtgctagcaatgagcaaggctccatgggcgtaggaccctctgagccaggtgcaggatataatctcctggtgtgccgtttgttaagcccgttggaagagcgcagtattagggtgggagtgacccgattttccaggtgccatctgtcacccctttctttgactaggaaagggaattccctgaccccttgtgcttcctgggtgaggcgatgcctcgccctgcttcggctcacgcacagtgcactgcacccactgtcctgcacccactgtccggcactccccagtaagatgaacccggtacctcagttggaaatgcagaaatcacccgtcttctgcatcacttatgctgggagctgtagactggagctgttcctattcggccatcttggctcccaatgcaaagaccttcaaacaaygtgacttcattttctcactcctaccttttgtgctcttgtcatttatttgaattctacatatattttaaaccccataagacattattattgttttatataatcaatatcatttatatatatatatatatatttacacctttcatttctttcattcttttctgcatttcttgcttccatctatgatcattttctttttgtctgaagaaacttctttggaacttccttcagtgtgtgttggctagtaaaaagttctctgtcagtttttggtcagaatgggtctttattttgcctagataccaagtccttggttggatttacatattgtgaatgttttctccmagtctgtggtttgtcttttcactcctttaagggtgcattatggttaatagaagttcttacatttaattaattcttatttttcagttttttatggttaatgccttttgtattctgtttcagaaatttttgcctatcctaagaacatgatgccatccttctatattttctttctacatattttaaatattttcttctagaagtctgattgctgtgttgttcacaattaagtttatgattcatttttaattaattttgatggagtgatgcagataaaagttcatttttccatatggatatttaattgctctagcaccaattgttggaaaaaaataatttcctcactgaattgcactgttgtctttgccatgaatctgatgactgtatcactgtagctttgtttctgtactctatttcaggggtaggttatgatccacaagccaaatttgcagcttgtttttatatggcattgagctaagaatttttttacatttttaaagaattgtcacacaaaacaaaaaaaaagcaaaaaaacaaataaggatatgtatcatggaccatatgtgtctacaaacctaaaatatttactatgttgctttttacagaaaaagtttgccaacccctgatctcttatattccattgacttattggtctatctttgtaccagtaacatactatcttatagtaagttttaatatttgttagtataattcctccaactttgctctctttgatttttatataaattttagaatcatcttgtcaattttatcaataaaaatatcttctgaggttttgatagggattacattgattctgcagatcaatttgggggagcatacctcttgacaatattgagtattcctgtccatgagcatggtttagttatttatttacatcttttaaattttctcttggcaatgtttttgtaaaattttagtgtacaggtcttgcacatttttgtaaagtgtattctttggtatttaatgctattataatattttttatggtatcagtttttgtcaattgtgtttttctagaaatatgtccctttcatctaagttgtttaatttacttgaagtaagttatttgtaatgttcttttatcatccttataatgtctgtactgatgtctccgttttcatacctgatattgttatttatattttatctattttaagtttatcgcctgcacccactaactcgtcatctagcattaggtatatctcccaatgatatccctcgcccctccccctagtgcacatgtaccctaaaacttaaagtataataaaaaaaaaaagtttgtcgcctttgttataggttcatcaaatttactaatcctaccataggatcaaatttttgctttgttcatcaggtcatggaattaaaaaaatttttttgttttgtttattttctatgttgaatttttatttttattttgctttgcatttcatttatttctggtcttttgttattattccaatactttctctggattcagttttctttttcttcttgacttcttgagattaaaacttggttcattgattttcaacatttcttactttttaaaagttcatacaaagcataaatttccctttatatactgctttaaccccatatcacaaattttgatgagtcatatttttattatcattgagtttaaaatattttataaattttacgttatttcttgttttattcatagttattttacagtgttttacttaatttcccaatatatggcgattttctggctctctctctgttgctgatttatttgttttactgtgatcacataacatactctatattatttcaatcatttgaaatttgttgagacttgctatatgcccagtgaataatttaatttgattaatggcccactgcatttgaaacaaatatgtctttgctgttattgggtagagtgtcatatatttgcctattatgtcaagttgctttatcatgtttttaaaatccttataaacttcctgatattttatctgtttcttacagacatggaggaaactgtgacatctctgtgattgttgagtttgttattttgatttttgtatttgttagtaagaatgtttcaaaataaatgaggcaatataaaatcaggtgcttacaactttaaggttgtattcttattaaatcaattctttcatctttgtgaaatgtcctttttgtctgaagtagtacttgttgccttaaacgtctgcattgtctaaaatttatacacctgcactatcatatttattttgcttaatgtttgtgtggtatatatttcccattcttttcttttcaacctatctctatccttatatttacagtgtgtcttttttaacattttctgtagtgcaagtctgttggttaattaattttgtcagtttttgcttctctgaaaagtctttatttctgtttttgaattatatcttcactgtgtatagaattctgggtttgtggttgttgtttttgttttattacattttgttttattggtttttccctcagcactttaaaaatgccgctccattgtttctacttgcatagtttttcacaataagtttgttgtaattcccatttgcattcaactgtacataatgtatctttttaaaaaaatctggatggcttcaagctctttactttgatttttgtgtgtgtgtgtgtgtgtgtgtgtgtgtgtgtgtgtgtgttactttggcattctctaggcttattcaatctgtaatttggtatcattaattttgaaaaatatttatcatctgtgtcttcaaatattgcttctaattctttctcttcttctggtattgcatttacatatattatactgttcaattttgtcacacagctcttgaatatgctgttctagtttgttttctaactatttttccttctagttgttcagttttgttgacatttattgacctatttttacttcagtaattgtttcctgggttgttgagttaattgatgaactcatagatgacatacaatttatctttttattcttgtgtcacttgtgcttttgatgtcacatctaggaaggctttgtctagcccaaggscacatttacttccatattttcttctaagagtttgatagttgtagctgttacatatatgtctatgatctagtttgaataaatttttgtgtatggtgtgaagaagaggtctaacctcttttttattttttgcatgtaaacatccagttgtccyggcaccatttgttgaaaatatgattcttttcccattaagtcatcttgacacccttgttgaaaatcaattgaccataaatgtgagagtttatttctgaactctccattctgttccattgacccatacgtcttctataaattcttatagctaattctacattagactttggtttttcagatgtggtcatctcattagattatggtgatatgtttggttacaagttttatcttctccttggcaacattttttttattactgctcttcttttattcgtttttgttgttcctttctctttttgtgagacagggtctcactctgttgcccagggtggagtaagtggtgtgatcatggctcactgcagcctcaacctcctgggctcaagcaatcctcccacctcagcctcccaagtagtgggactacaggcatgcaccatcatgccaggctaacttttttattttttgtagagacagggtcttgctttgttgcccaggctggtcttgaactccaagctcaagcaatcctccaacctcagcttcccaaagtgctgggattaccagtatgagccactgcacctggccttgttgttcctttcttccttttatcttgtagtatcttgatcctttttgcttattatttatcattgaggtgagtttgttctaaataaacttttcgcagaaagtttatgtagatatattaatatcaatgaggcattaggagtgagttttagattagcaggaattctcttatgaaaggtattgattgtatgtgtgagttttcagcctttacttctctccagcccatcaagatcaaagctgcagagttgtttacatttcagaatttctttcctcccctccccaccttgcaaaacagacttacagtgcaaaaatgacttgtcaatgtgattctttcttctggtcccatctttcctaccttttgagacttgtgttgaaaggagtccagtaaaaccaccgatgctagcttgtataccctgatcccattgttataatgaatgactgactgtttttcatatcaaagtataatacttgcaccttgatagaagaaagaaacaaggccaggcacagtggttcatgcctgtaatcccagcactttgggaggctgaagtaggaggaataattagactttgatattaaaaatggggaagatatggmggtataagatatgaggaagtatgtcttcttggacttttctgaaatctgccagccatgagcatccactctttttatcttttgatacctgttttatattaactatacttctattttgtggtttcatggcttcagatatcttccagcttaattgtactctgtctttaattatttgcagcaatttctgaaaggagcaagaagaaaggccagccctttcttcactaccttaaaaactggtcatcttttgaaaccccatgaaaggcacagtgggtgaccatctacatcaggagtgggcaaactatggcccttgggtagtctggtctctgtccgtttttgtaaggttttattggaacccatacacacacaaactgatcatctcttgttatgtgttaagttttcttataattattcttttctatttcatccagctgaattaccatttcaccttgtgtatgccctttccagtcttaaattatagaagctatgtctttgtggttttaaattatggaagctgtgccttcttgtgttttagtatggcaagatatttgttcttacttttcctctagaatctgcagtggattactttcagaagtaggtattgcctctaagtttcctgacttctgtttccttctccctgttctgtagtatatttatagattgcatgttttctcgtccttaaacaaggtacaaatatgttctgatcaaggtttgctagccgagaggataagtggcttgctcttagcctaactctctgtctacttaatggatgtcgaattcccttctcaactcaacagctagtaactagttccaagatcggataatagcttacagaattaattagttcagtgaaagccctggtttgatcacagaggcaggagactgatctatatatttgtagtgctgactagaccccaacttggccagatagcttatacctatgtcagaagttggaggaggagattgacagctgaggtgtctccaagggaattacaattattttcattttctttgtgtctgtaattatgtctcttttcttacttcaaattttgtatatgtgaaatttcttaatttttatttggttatttattttattgactttttcatcaaacaaccaactctaagttcttggattgaaatttatgaattaattataatgttttaaatttaccattagtcacacatacaatacaaaaagatattttcattacaaaattttaacccaagccattaaaactaaactccagcttggtcaccattcctaataccaggcccctctcagaggggagggtaaataaaagtccattttggtaactagtttgacgagaatctctaattgtttccctgtttttcttataatgtctgcctttgaattatcctctttttttcaagagttccatcatataatgtattcctttttgcttacagattgacctcctagaggcatgcatccccctgctccagtctgagctggttctctctaggcctgaggctcagttatcaacttgggacttttatttaccctccctcaggataggtacctggttcttggataccaggtcttactcttrtttgagatactcctttattttggtggcaaacattccataatcacttcctgataatggtgacatttgaggtagattttctgagtctttatatgttagaatatgtttttattctcctttgccacttgattgataatttggctgcacatagaatgtaagcattcacagggcttttgggagcagcttcccttgagaagaaggtggatgcagttaagatcttccctgaaaagactgtgtgaaatgacaaggctattgaggtacccaacgggtagcttggtaaaggtgtatcttgtctcttatgtttatgcatctactttaccaccatgtaattagcctattataacttgttgcattccttcactcagctaatcttgttcatggtagaaattaatattgctagtaccatggtagaattttatattagctggatcctagacctaaatgmtccttccttgtgcttacatattctgcaagtgggtgacagtggatgctaggtattgtgttatgtgatttcaatgtattatatgatggggtagatactattagcctcatttgaaaattagaaacctattgttcagaaagtttaagtgactttctcaaagtcacacagctggtaaatggtagaactgggatttgaatccaggcaatctgatggatttaagaggaacctgtgccactatgtgatatagcaataacatctagccaatataaatactttcctgaattaaatcactgtcatattcagagagttctgtgtcactattaagaccctccattattgtgtatattaattacatttccctattttaatcccaatatctattcatttttatcacagtcctttcttatggtcacaaacaggcatagtacaacagcagcaatgcaaaaaccacttttatattacatgttccagggatttaacccaatgacctgtgatataatgatactgactagtattttttcatttatctgggaatgggagagaacctctaacagaacgttttagaatctgtgttatgagtaaccagagtcttattcttcctcatctccaggtctatggattctggggtgccacaactcagactttcggaacagagrcmtsaccrccttacwgaagktttctagttgtgacaagaacactggtgattattasraggacagttrtgaagatatttcagcatamtwgctgagtaaaaacaatgccattgaaccaagaagcttctcccagaattcaagacaccctagcactaggcaaaagyaatttaatgccaccacaattccagaaaatgacatagagaagactgacccttggtttgcacacrgaacacctatgcctaaaatacaaaatgtctcctctagtgatttgttgatgctcttgygayagagtcctactccacatgggctatccttatctgatctccaagaagccaaatakgagactttttctgatgatccatcacctggagcaatagamagtaataacagcctgtctgaaatgacacacttcaggccacagctccatcacagtggggacatggtatttacccctgagtsaggcctccaattaagattaaatkagaaactggggacaactgcagcaacagagttgaagaaacttgatttcaaagtttctagtacatcaaataatctgatttcaacaattccatcagacaatttggcagcaggtactgataatacaagttccttakgacccccaagtatgccagttcattatgatagtcaattagataccactctatttggcaaaaagtcatctcsccttactgagtctggtggacctctgagcttgagtgaagaaaataatgattcawagttgttagaatcaggtttaatgaatagccaagaaagttcatrgggaaaaaatrtatcgtcaacagagagtggtaggttatttaaagggaaaagagctcatggacctgctttgttgactaaagataatgccttattcaaasttagcatctctttgttaaagacaaacaaaacttccaataattcagcaactaatagaaagactcacattgatggcccatcattattaattgagaatagtccatcagtctrgcaaaatatattagaaagtgacactragtttaaaaaagtgacacctttgattcatgacagaatgcttatggacaaaaatgctacagctttgaggctaaatcatatgtcaaataaaactacttcatcaaaaaacatggaaatggtccaayagaaaaaagagggccccattccaccagatgcacaaaatccagatatgtcgttctttaagatgctattcttgccagaatcagcaaggtgratacaaaggactcatggaaagaactctctgaactctgggyaaggccccagtccaaagcaattagtatccttaggaccagaaaaatctgtggaaggtcagaatttcttgtctkagaaaaacaaagtggtagtaggaaagggtgaatttacaaaggacgtaggactcaaagagatggtttttccaagcagcagaaacctatttcttactaacttggataatttacatkaaaataatacacayaatcaagaaaaaaaaattcaggaagaaatagaaaagaaggaaacattaatccaagagaatgtagttttgcctcagatacatacagtgactggcactaagaatttcatgaagaaccttttcttactgagcactaggcaaaatgtakaaggttcatatgasggggcatatgctccagtacttcaagattttaggtcattaaatgattsaacaaatagaacaaagaaacacacagctcatttctcmaaaaaaggggaggaagaaaacttggaaggcttgggaaatcaaaccaagcaaattgtmkagaaatatgcatgcaccacaaggatatctcctaatacaagccagcagaattttgtcacgcaacgtagtaagagagctttgaaamaattcagactcccactagaagaaacagaacttgaaaaaaggataattgtggatgacacctcaaccyagtggtccaaaaacatgaaacatttgaccccgagcaccctcacacagatagactacaatgagaaggagaaaggggccattactcagtctcccttatcagattgccttacgaggagtcatagcatccctcaagcaaatagatctccattacccattgcaaaggtatcatcatttccatctattagacctatatatctgaccagggtcctattccaagacaactcttctcatcttccagcagcatcttatagaaagaaagattctggggtccaagaaagcagtcatttcttacaaggagccaaaaaaaawaacctttctttagccattctaaccttggagatgactggtgatyaaagagaggttggctcccyggggacaagtgccacaaattcagtcacatacaagaaagttgagaacactgttctcccraaaccagacttgcccaaaacmtctggcaaagttgaattgcttccaaaagttcacatttatcagaaggacctattccctacggaaactagcaatgggtctcctggccatctggatctcgtggaagggagccttcttcagggaacagagggagcgattaagtggaatgaagcaaacagacctggaaaagttccctttctgagagtagcaacagaaagctctgcaaagactccctccaagctattggatcctcttgcttrrgataaccactatggtactcagataccaaaagaagaktrgaaatcccaagagaagtcaccagaaaaaacakcttttaagaaaaaggataccattttgtccctgaacgcttgtgaaagcaatcatgcaatagcagcaataaatkagggacaaaataagccckaaatagaagtcacctgrgcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacayttdtgatgaggatgaaaatyagagccccyrcagmtttcaaaagaaawcabgacactattttattgctgcagtgragaggctctrggattatgggatgagtagctccccacatgttctaagaaacaggtatgaatgcattggttattcctttgctctgctcttgtgacatttgactttaccagatgatgacaccaacaatgagagttagaggatgaaaaatcaaggtgtcttgaaactcttactctggtgagatagagagaagagaggtttacaagagggtagaggaatcagggacaagaaggagcaatggggagcaggaagaaagtcaacctcacctatcaaccttatgagctgcaggggaaatcttagtctcatcagagaactttaagcaaggcagaaggaagaagcaagttcgtgttaaagaggttaaggacttggggaggattggttttcatgatactggggatccagagggcaaagtaggatgattttatttttaggtgagtagagggaggttgagcagtcaagtagtacagagaaatgtggaatataaacataaggagagtcagtcagtcacaaatatttatggaacacctactacatgccagacacttttgtacacattggagtgcagcacagcaggagcttatattctattggaaagagcaagagacaagttagtacaaaactaaataaggcaatctcaattgtgttgttcagaagatagaatagaataatatggtagagagaataatatgatagagtaatacggtagagtgttacattagctgtggtggtcatagaaatcatctttgaggagttgagacctaaatgatgataacaggccagctgatggagctctgagagaagatgtttccagacagagggaagagaaaatgcaaaggccctgagaatggaaaaagtttaccatgtttgaggaacaagaagggacaagcatgacttgtcactttcccaccttgctttctagctcaagtaagcccttattgctgcattgcaaccatagactatttccctagtccactgactttctcattctcctggacctctatcttagattttctgtgttttccttaaatctcgagcaccttttttccattctccaatgcccattttcactcttagctgatgctgtgcaatgaacctccacagactcccaacatcacatttactggcatttgtacccatatactctgcctgcacacttattacaataaatagagtgtctgtgctcctaaggccaacctctccagttttgtacttgattcccatctcttctcccttcataaaaaatgttgctccagcaatttctccttttctcccttacatcatcaatttatctctccactagattaatctcatcaacatcaatcatgctattatttcctcccctatctttacagaaaccgtcttaaaataattgtccctgcttgcagcctttgcatcttttcctgccattctctcctctttaacccactccaaagaagcttttatctctattatttcataagaactacattttcaaggtcattattgatctttacattactgattactagccctcatcttatttgaattctcagtagtatttgagaggtgattactccatcgttgatacaggttctcacttggtttctctaacaccacttttcttcacttttctactaaacttactgccaatctttgtcaactttgcgagtccttcttcatccccctaatctttaaaggttagagtgctccagggattagttctccaacttcttctttattctatttatactcactctgtgacgacattgtttagcctcatgattttaagtactatctatctgcagataattccagttgaatatctggagatattctcagatctctctcctgaagtcaaaatttacatatcaactccctaccttaacatgcacacaattagactcttaattcctgccccttcccaaaacctgctgattgctcagccttctccatggcaatcaaaaaccattcctggccgggcatggtggctcactcctgtaaccccagcacttggggaagctgaggcaggtggattggttgagccccagagttcaagatcagcctgggcaacatggcaaaacctcatctctattaaaaatacaaaaattagccaggcgtggtggtgcacacctgcagtcccagctactcaggaggctgaggcacgagaatcgcttgaactggggagacggaggttgcagtgagctgagatggcctcactgcactccagcctgggcaacagagtcagacttgatctcaaaaaaataaataagtaaaaccattccctatttcagttattcagtcacagatcttgaagttttccaactctttttttcttacattaacatctaatctgtaaaggatcctgtattagtccattttcacactgctaataaagacatacctgagactgggcaatttacaaaagaaagaagtttaatggactcacagttccacatggctggggaggcctcacaatcatggcagaaggcagggaggagcaagttatatctcacatggatggcacaggcaaagagagagagcttgtgcagggaaactcctctttttaaaaccatcagatcttgtgagacttattcactatcatgagaacagcaagggaaggacctactgccatgattcagttacctcctatcaggtccctcccacagaacatgggaattcaagatgagatttgggtagggacacagccaaaccatatcattccaccccatcccctcccaaatctcgtgtcctcacatttcaaaaccaatcatgccttcccaacagtcccccaaagtcataacacatttcagcattaactcaaaagtccacagtccaatgtctcatctaagacaaggcaagtcccttccacctatgagcatgtaaagtcaaaagcaagttagttacttcctagatacaatggggtataggcattgggtaaatacagccattccaaatgggagaaattggccaaaacaaagggcctacaggccccatgcaagtctgaaattctacggggcagtcaaatcttaaatctctaaagtgatctcctttgactccatgtcttgcatctgagtcatgctgatgcaagaggtgggtgcccatggtcttgggcagctccacccctgtggctttgcagggtacagcctcccttgtgtctgccttcatgggctggcattttctgtagcttttccagatgctggtgcaagtttctgatggatctaccattccggggtctggaggacggtggccctcttctcacagctccactaggtggtaccccagtagggactctgtgtgggtgccctgagcccacatttcccttctgcactgccctagcagagtttctacatgaaggcccacccccgcagcaaacttctgcctgggcatycaggcacttccattaatttctaaacaacaaagcattcaagaggcgacttgggtgctattaagggcattcagtttcataagggaagcagagcataaaagtttggaaaatttgcagcctgataatgttagagaaaagcaaatcccattttctgaggagaaattcaagcaggctgcagaaatttgcataagtaatgaggakccgaatgttaatccccaagacaatggggaaaatgtctccagggcatgtcagaggtcttcacaccagcccctcccatcaccggcccagaggcctaagaggaaaaagttgtttcatgggctgggcccaggatccccatgctgtgtgcagcytagggagtcggtgccttgtgtcccagccgctacagccatggctgaaaggggtcaatgtagagctcaggctgtggcttcatagggtacaagtcccaagccttggcagcttccacatgatgttgagcctgcgagtgcacagaagtcaagaactggggtttgggaacttccgcctagatttcagaagatgtatgaaaacacctggatgcctaggcagaagtttgctgcgggggtgggccctcatggagaacctctgctagggcagtgcagaagggaaatgtgggctcagagcacacacacagagtccctgctggggtaccacctagtggagctgtgagaagaggaccaccgtcctccaggccccagaatggtagataccctaaatcatctctttcaaattcgaagttccacaaatctctaggacaggagcaaaatgccaccagtatctttgctaaaacataacaagagttacctttgctccagttcccaacaagttcctcatctctatctgagaccacctcagcctggatttcattgtccatatcattatcagccttttggtcaaagccattcaacaagtctctagagagttccaaactttccacattttcctgtcgtcttctgagccctccaaactgttccaacctctgcctgttacccagttccaaagtcgcttccacatttttgggtatcttttcagcagcaccccactctactggtaccaacttactgtattagtctgttctcacactgctgataaagatatacctgagactgggaaatttacaaaggaaagaggttttatggacttactgttccacatggctggggaggcctcaaaatcatggcagaaggcaaggaggagcaagtcttgtcttacatggatggcagcaggcaaagaaagaaagcttgtgcaggaaaactcttttktttcttttcttctttttagacagagtcttgctctgtcaygcaggctggagtcagtggcgtgatcttggctcactgcaacctccacctcccgggttcaagtgattctcctgcctcagccttccaagtagctggtactacaggcatgtgccaccacatgagatgagattttggtagggacacagccaaaccatatcattccccctgtcccctcccaaatctcatgtcctcacatttcaaaaccaatcatgccttcccaacagtcccccaaagtcataactcatttcagcattaactcaaaagtccacagtatttttagtagagatggggtttcaccatattggccagactggtctctaactcctgaccttatgatccgcccgccttggcctcccaaagcactgggattacaggtgtgagccaccatgcccagccaaaaactcttctttttaaaaccatcagttctcatgagacttattcactatcacaagaacagcataggaaagatctgcccccatgattcaattacctcccaccaggtccctcccacaacacatgggaattcacgatgagatttgggtggggatcctcttggctatcatttcaaaaaatagtcagggttgattatggacttagtattgaataagatgaaaatgtactgaaatggaacgatgaagataattgaccagggaaagcaggttacaagccaagagaggatacagtgtcacttcagatgctataaaagtgatgtttttattttttgaatgttatttggctatattttcaaattatctgcactgcatatgcactgcttctgtaataataaaagggtattaaaataataaaatcaagtctataaatcacacacacacaccccagcctcttctctacacctcagtgactaccaaccacatctaaattatcatcatttctcatctgaattattgcaagaagccattgcaataattcagatgagagttgatacaaagccttcctgtttccaaccttaccctcatatagtcttttcccaacattgcatctaaagtaatttttcaaattgcaattctgatcactgttctctgcttcagatcctccagtggattttcatctcactcagtaaattccaaagccttcaccatggccttcaagaccctacgaaatttgaccctctgcaacctctctgccttcatctgttaccattgtctcctgttaatcctgcctcagccacactgacctccttgttcttctcaaatggactagatgtgtgcctatctctagaccattacagtttctgttctctctacttaaaattatgtccctgatactctaatgcaagttctcttacttccttcaggacgctgctcaaatttcattttatcagtgaggctttccctgaacactgtatgtaaatattgctcccaccattttttttcaatgcacttaacagtgcctgaaatattatatatttatttctttattgtctatcttctctgactataagttaagctcattaagaacacaaactttggaggtattgttcaatgttgtgtccccagaactttgaacagtgcctggcacgtggcagatgttcaaataaatgtatgttgaatgaattagaaaatgataaatgtagggagacaaaagcaggtctcccatttatatccaaactctaggactctaggaaagactgattatatggaatcgtgtcacacagcatccatgggcaagagtggaggcagagataccagttaagatgctattgcagtcatacagataaaagaagacagttatttagaccagtgtggtggtgacagaaatggaaagaaatggaaggatgttgggtataattaaagataagcatataagactggctgttaattgagtatgggaagaatgaggagagaggatgtaaagaacatttctttttgtttgtttgttttgttttgtttttgtttctttttattatactttaagttctagggtacgtgtgcacaacctgcaggtttgttacatatgtatacatgtgccatgttggtgtgctgcgcccattaactcatcatttacattaggtatatctcctaatgctatccctccctcttccccccaccccccaacaggccccggtgtgtgatgttcccctacctgtgtccaagtgttctcattgttcaattcccacctatgagtgagaacatacagtgtttggttttttgtccttgcgatagtttgctgagaatgatggtttccagcttcatccatgtccctacaaaggacatgaactcatccttttttagggctgcatagtattccatggtgtatatgtgccacattttcttaatccagtctatcattgatggacatttgggttggttccaagtctttgctattgtgaatagtgccgcaataaatatacgtgtgcatgtgtctttatagcagcatgatttatagtcctttgggtatatacccagtaatgggatggctgggtcaaatggcatttctagttctagatccctgaggaattgccacactgacttccacaatggttgaactagtttacagtcccaccaacagtgtaaaagtgttcctatttctccacatcctctccagcacrtgttgtttcctgactttttaatgatcgccattctaactggtgtgagatggtatctcactgtggttttgatttgcatttctctgatggccagtgatgatgagcatattttcatgtgtctkttggctgcataaatgtcttcttttgagaagtgtctgttcatatcctttgtataagattattagtggatttctcagaagaaatattgtagrccagaagggagtgaaaatatagatttaaaatcctgaaaggaaataaaaactagcaatgaaaaatactatatccagtaattttatctttcagaaatgaaggggtgataaagattttctcagaaagacaaaagctagatctgctttataagaaatgctagtaggagttcttcaagctgaagaaagaggatgcttattagtaatatgaaaacatatgaaaggataaaactcactagtaaaaataagtacattgtcaaatccaaaacactctagtagtgtaatggcagtgggtaaattaattatatctttagtrtaaaagataaaagacaaagaaagctattttaaaaactaaagctataataatgtgttaaggaatgcaaattattaaaatatgtaaactgtcacatcaaaaacataaaataggctgggcacagtggctcatggctgtaatcccaacactttgtgggggccraggtgggaggatcacttgagcccaggcatttgagactaacttgggcaggatagtgagatctcatctctataaaaaatttaaaaattagtaaagcatggtggtgcatgcctgtagtcccagctactcargaggtggaggtgggaggactgcttgagcctgggggggtcaaggctacagtaagcaatgatcacaccactacactccagcctgggcaacagagcaagaccctgtctcaaaaaaaataataatatgtaggaggaagggaataaaagtgtagagtttgtggatgcaataaaaattaagttgttatcagtttaaaatagcctgctaattttgtgtaagcctcatagtaaccacagagcaaaagcctatagtagatacacaaaacattttaaaaaggtccaaagcataccactacagaaagccatcaaactataaaggaagaatgcaacagaagaagaaaggatcaaaggatctaaaaaaaaaaaaagaaagmaagcaattaacaaaatgacacaagtatgaccaaagtccactgcttctttattactgatatagaatatctttcagatcttaagggactgattaattacttgggagagaaagtttgtgttgagaagatttgcttgtgttgcaatgagaaggggaagttctactcaacagaagctgtacaggcacatatgacaaaagcyggtgtaagctttttacagatggtgatgctgctttggaatttgcagacttgtatgagtttaggagtagctacccagatcacaaggaaggggaggaccctaatgaggctgaggagtcgcccttaggaaaggacttagaatatgatgatgaaagcatggaactgattctgccttctgatgccagagtgggtcatcactccttgatgagatactacaaacagtgatttggcttgtcaagagctgtggtagttgctaaatattgtraggccatgggccgagtgcttcagtaatagagagccctgggatagactggcaacacaggagcagctgttacatgaaagtgagacatgcattatatccaaaggatgaagtcaaaatggatgctgaagacagaaatgaagaacaatgccaccaagcagatgcactttagggtccaagtgagattctgagagtctgccamgattgagtgattgtctgctgcccaagtttcctccttgccctgaggaccagggaaagccagattgtatgatggacacttttgctgctacttcacttgctctaacataataataaaaatgaaaatctaaaaaatattttattgaagaatgaaggtgaaagaaatacattttcagacaagcataaacagagaaacttcaccattagcaaaagtccactaaaatattctaatgttatacttgagacaataaaaaagtgatacagaatggaaggcatgagagacaagatgggataaagagcaaacaaagttaaatatgtggataaatagagataagtatcataaaacatggtcaaatgttttatgagcgttaagatatatagaattgctttattcacagttggtttgctgtcataacacaagtatcatgaaaatcactgctaaatctaagccaaaattgggaaaggaaaaggttcatgtcactatcatcaacgttggacatgtagactcaggaaagttcaacactactggtcatctgatctataaatgtgatgtgatcaacaaaggaaccattgaaaaatttgagaaagaacctgctgagatgggaaagggctcatttgagtatgcttgggtcttggataactataaactgaacatgaatggaatatcaccattgatatctcctaaagaaacctgaggccaaaaatatcctgtgaccatcattgatgccccagcacacaggggctttattaaaaaaaaaaaaaaaaaaaaaaaacatgattagagtgatatcaccaaaatggtggatagaagcaatctggcttcactctcctccagaaaaaccaaaaacaactattcagtgtctagcttatcaccaggaatatcccataactcaaaacagaggctgtgaggatctgagtggccacatagaagagaaaaactgcaagcagaagataacaaaaatgggcctgtttaactgcagcatccccttcccaagctgccaggcaccatgcagaaaagttcccccagactgacagtatgtacatcaraaaaagtgacatctagatgaagagccagctttcccaccatcttgggttcctttgcagaaaaatcattcctgcctcaatccgtgggaagcagcctgattgcctctagggtaaaaaaatcctgagggcagctagagacaaaggatggaggcggggctagcaaccccagcatgcaaaacacattggctgctcttcatctaagccaaagaagacaccaaatgagagagaatgttcagcccgtggttcctctggacacaaaatcctaaccagatgtctcacccaaccaggatatccagtttgggacctcccccaaatcgggaataggcagtaatccaagccgttgcaagagctgcagcaaatctgggcttacagcaccatctagtgccaaaaaagaggcagtaatctcagagtaaggaagctctaattcatacataacctttagacaggcatactcctgaaaaaccaaactaagccagacacaaagactggaataaataacttagcattcatacaaagacatagatatatgtgcataaaaarcaagagcaaatagggagctatgacctctccaaatggaaacagcatggagccagtgaccaaccctaatgagatggcaaattgtagctctcaaatcaataattcaaaataaaagttctgaggaaactcaaagaacacaaaaaagcaactgagaaatttatgagataaatttaacagagaaatcaaaataataatttaaaaaaccagaaatgctggagctgagaaatacaactgaacggaaaaaaaaaatgcactggaaagtctaaacagcggaactgatcaagcaaaacgaacaatcaatgagctcaaagacaggctatttgaaaatacacagtcaaaggacaaaaaataattaaaaggaatgaagaacacttgcaagatctagaggactgcctcagtagaacaaatctaagagtcatgggccttcaagagagaaagagcaatgaataaaaagctcaaagaaataacagaaaatatttccaaacctacagagagatgtaagtatccagttataggaaggctgaagatcaccaaacagattcaacccaaataagactaccccaaggcatacaataattaaactctcaaaggtcaaagacaaagaggggatcctaaaaagagcaagaaaaaagaagcaaataacatataaaggagctccagttcatccgggaatatactctggaccagatgaacctacctgacattttacagaacattttatccaactactacagaatatacattcttcttatcagcacatggaacattctccaggatagactatatattaggccagaaaacaagtctcaacatttaaaaaaataaaattatattaagtatcttttctgactacagtagaataaaactagaaatcaatgacaagaggaacgtttgaaactatacaaatacatggaaattaaacaacatgctcctgaacaaccaataagtcaatgaagaaattaagaaggaaatttattgaaacaaatgaaaatggaaacaacataccaaaatgaatgggatacaacaaaagcggtactaagagagaagtttatagctataaatgcctacatcaaaaaagaaagactcaaataaacctggtaatgatgtaactcaaggacatagaaaaacaagagcaaaccaaacccaaaattagtagaaggaaaataataataataatcatagaaataaataatattgagaaaaagaaaacaatatgaaagaccaatgaaatttttaaaatggctttttgaaagataaaatttaaaatctttagctagactaaggaaaaaaaatgagagaagacccaaataattgaaatcaaagatgaaaagagtcattaaaactgataacacaaaaatacaaagtttcactagaaactattatgatcaactatatgccaacaaactggaaaaactagaagaaatggataaatttctggacacatacaacttaccaagattgaactatgaggaaatagaaaacttgagcagaccaataactagtaatgagattgaagcagtagtaaaaagtctggcattaaataaaagtccaggacytgatgacttcactgctgaagaaaaacttacaccaattatactgaaactatttaatattgcaaaaaattgaagagaaaagaatgtttccaaactcattctacaagaccagcattatcccaatacccaaaccagacaaagacacaacaacagcaaaaagaaaactacaggccaacttcgctgatgaatatagatgcaaaaatcytcaacaaagtactagcaaactaaattcaacaacacattaaaatgagtatttgtcatgcccaagggggattcatcctaggaacacaaagatagttcaacatatggaaatcaataaatgtgatacaccacattaacagaaggaaagacaaaaaccatatatttatttcaataaatgtcaagaaagcattgaataaaattcaacatcccttcatgataaaaactctcaacaaatttggtttaaaggagcatacctcaaaacagtaaatgttatatatgacaagcccacagctaacattacaccaaatgggaaaaaattgaaagcctttcctctaagatctggaacaagacaagcatgcccactttcatcaattctattaaatgcagtcctggaagtccaagatggagcaattaagcaaagggccttcaaattagaaaaaaagaaatcaaattccccttgtttgtagacgatataatgttatatttagaaaaacctaaacactccaccaaaaaactgttagaactgatcaacaaattcagtagagttgcaagaagcaaaaccaacatacaaaaatcagtagcatttctatataccaagagctaacaatccgagagagaaatcataaaagcattttcattttcaatagctataataaaaataaatatctaggaacaaatttaaccaaagaggtgaaagatctctatactgacaactgtaaaaccctgatgaaaggaattgaagaagacacacaaaaaatgaaaaggtatctatcccatgttcatagaatggaagaattcatattgttaaaatatcaatactactagatttcatgtattacctatcaaaataccaataacatttttcacagaaatagaaaaagcagtcttaaaatttgtacagaaccacaaaagacccagatatggtttggctgtgtccccacccaaatctcatcttgaattgtagttcccataatccccacatgtcgtgggagggacccagtgggaagtgattgggtcatgggggcagttttcccccatgctgttctcgtgatagtgagtgagttctcatgaaatctgatggttttctaagtgtttggcatttcccctgctggcacttattcccactgccaccttgtgaagaagatgccttgcttcccctacgccttccaccatgattgcaagtttcctgagacctccccagcaatgcggaactgtgagtcaattatacctctttcctttatagattacccagtctccagcagttctttatagcagtatgagaacagactaatacagtaaattggtaccgaggtagggggggcactgctataaggatacctgaaaatgtggaagcaactttggaactgtgtaacaggcagaggatggaacagtttggagggctcagaagaagacaggaaaatgtggcaatgtttggaacttcctagagacctggagggctcagaagaagacaggaaaatctgggaaagtttggaacttcctagagaatcattgaatagctttcaccaaaatgctgatagtgatatggacaatgaagttcagactgaggtggtatcagatggagatgacgaacttgttaggaataggaataaaggtggctcttgctatgctttagcaaagagattggcagcattttgcccctgccctagagatctgtggaactttgaacttgagagagatgatttggggtatctggcagaagaaatttctaagcaacaaagcattccagagtgacagagcataaaagtttgaaaagtttgcagcctgatgatgcagtagaaaagacaaacccattttctggggagaaattcaacccagctacagaaatttatataattaacaaggagccaaatgttaatcaccaagataatggggaaaatgtgtccagggcatgttagagaccttcgcagcagcccctcccatcacaggcctggaggcctaggagggaaaaatgctttcgtggcctgggtccagggctcccctgcagtgttcagcctgggacttggtgccctgtgtcccagccactccagctataagaggccaaagtacagcttgggctatagcttcagagggtgcaagcccccagcctttgttctgtgggtgcacagaagacaaaaattgaggtttgggaatgtccacctagatttcagaggatgtatggaaatgcctggatgtccaggcggaggtgtgctgcagaggcagagccctcgtggagaacctctgctagggcagtgaggaaaagaaatgtggggtgggagcccccacacagtcaccactggggcactgcctagtggagctgtgagaagagggccactgtcctccagaccccagaatggtagatccactgagagcttgcaccgtgggcctggaaaagccacaggcactcaatgccagcccatgaaagcagccaggagcagggctgtaccctgcaaagctaygggggtggagcttcccaaggctgtgggagcctgccttttgtatcagggtgacctaaatgtgagacacggagtcaaaggagaacattttggaactttcaggtttaatgactgccctattggatttcagacttgcatggggcctgtagcccctttgttttggccaatttctcccatttggaatgagtgtatttacccaatgcctgtacccctattgtatctaggaaggaactaacttgcttttgattttacaggctcataaacagaagggattttccttgtctcagatgagactttggacttggacttttgggttaaggctggaatgagctaacactttgggggactgttggaaaggcatgattctgtttttaaatgtgaggacatgagatttgggaggggccatgggtggaaacatatggtttggctctgtgtccccacccaaatctcatcttgaattgtagtatattgtttgtaaaaattcctgcctatccagagattttttwaaaaaaaacaatactttcttcaattttctcttacaatttaattttttacatttaactttttaatacttcctgtagactaaaagttattttggtgcattgtgtgaaccaaagatcaaagtagttttatttttttctgaaaacatctattcattttttcaattaattgattgtttatattaaggatctaggaggatctaaaattatggaattgtgggcaagggcaatttttgccttacatttcatgtaaggcaaaataatccccatgtgtcatgggagggacccagtaggaagtgattggatcatgggggcaggttcccccatgctgttctcatgacagtgagtaagttttcatgagatctgatggttttataagcatctggcatttccccttctgtcacctctccctcctgccaccttgtgaaaaaggtgccttgcttccccttcaccttccaccatgattgtaagtttcctgaggcctctccagccatgtggaactgtaagtcaattaaacctctttcctttataaattatgcagtctcaggcagttctttataccagcaggaaaacagactaatacagaccctaaatatccaaagcagtcctgagcaaagagaacaaagctggaggcatgatgctactttatttcaaactatactacaaagctgtagtaaccaaaacagcatggtactggcataaagacagaaacatatgccagtggaacacaacagagaacccagaaatgaatccacacatttagagccaactcatttttgacaaagtgccaagaatatgcattggtgaaagaatagtctcttcaataaatgatgttgggaaaactggatatccacatgcagaagaattaaactaaacccctatctctcactgtatacaaaaattaaatcaaaatggattagagacttaaatatacaacctgaaagtatgaagctactggaagaaaacattggggaaatgctccaggacattggtctgggaaatattttatggcctgggaaatatcaaaagcacagacaactaaagcaaaagtagacaaacgggattatatcaagctataaagcttccgcacaacaaaggaatcaattaacaaagtgaagggacaacctacaggatgggatgaaatatttgcaaactatacaactgagagggtattaataaccagaatatataaggaactcaaacaagtcaatggcaaaaaagcaaaggatcctattaaaaatgaacaaagatctgaataaacatttctcaaaagaaaacatacaaatggccaacaggtatatgaaaaactgctcaacatcactaattaccagataaatgcaaaccaaaagcacaatggatatttcactccagttaaatgacttttatcaaaaagacaaaaaataatgaatgctgatgaggatgtggcaaaaggggaatgcttgtacactattggtgggagtgtgaattagtacagatactatggaaaagagtatgtatgttcctcaagaaactaaaaatagaacgaccatgtgatccagcaatcccactgctggatatatatccaaagacaggaaatcagtgtatcaaagagatagttgcacaccaacatttattacagcaccattcacaatagctaggatataaaatcaacctaagtatacatcaacagatgaatggataaagactgtgtggtatatatacacaatagactattactcagccattaaaaagaatgaaatcctgtcatttgtggcaacatcgatgagcctggatgtcactgtgttaagtgaaataagccaggcatagaaagacaaatatcacgttttcacttacatgtgagagcttaaaaagtggatctcacggagatagagagtagaatggtgcttaaaggagtttgggaatggtatgggggggtgggatggaatgaagagaggttgattaataggtgtaaaatgaaggggtggcctgcccctcgtcacccacagtgacgagaaacactgtgggtgtttctcgtcaggtgggacgagagactgagaaaagaaataagacacagagacaaagcacaggaaagaaaagtgggcccaggggaccggcgctcagcatacggaggacccgcgccggcactggtctctcagttccctcagtatttattgatcattatctctaccatctcggagagggggatgtggcagaacaatagggtaatagtggagagagggtcagcaggaaaacatgtgaacaaaggtctctgtgtcataaataagtttaaggaaatgtgctgtgccctgatgtgcacgtatacaaacatcttggtgcattaaagagcagtattgccactagcctgtctcacctccagccttaaggcggttttctcttttctcagtaaatagaacatacaatcgggttttacaccgagacactccattgcccagggacgagcaggagacagatgccttcctcttatctcaactgcaaagaggacttcctctttcactaatcctcctcagcacagaccctttacgggtgtcgggctgggggacggtcaggtctttcccttcccacgaggccatatctcaggctatcacatggggagaaaccttggacaatacctggctttccagggcagaggtccctgcggccttccgcagtgtattgtgtccctgggtacttgagattagagaatggtgatgactttttttattattattattatactttaagttctagggtacatgtgcacaacgtgcaggtttgttacacgtgtatacatgcaccatgttggtgtgctgcacccactaactcgtcatttacattaggtatatctcccaatgctatccctccccccaccccatgacaggccccggtgtgtgatgttccccctcctgtgtccaagtgttctcattgttcaattcccacctatgactaagaacatgcggtgtttggttttttgtccttgtgatagtttgctgagaatgatggtttccagattcatccatgtccctgcaaaggacatgaactcatccttttttatggctgcatagtattccatggacaagcatactgccttcaagcacttttttaacaaagcacatcctgcatagccctaaatccattaaaccttgactcaacaccgcacatgtctctgcgagcacagggttggggctagggttacagattaacagcatctcaaggcagaagaatttttcttagtacagaccaaaatggagtctcttatgtctacttctttctacatagacacagtaacagtctgatctctctttcttttccccacagtaaaattacacttaaatagaagggataagttgtagtgttcgatattacagtagggtgactatagttaacaatgatttattgtatgtttcaaaatagctagaagagaagactgggaatgttcccaacacaaataaatgacaaatggttgaagtgattgatattccaattaccatcatttgattattacacattgtattcatgtatcaaaatatcacatgtatccccaaaacatgtacaattatcgtgtatcaatttaaaaatacatcatgataggcacctctcaggttgactgtactgtcctgattattgctagtggtgttaacaaatttgaagctagtatctttaagaacgggcagacccatgagcatgcccttctggtttacacactggaagtgaaacaactaattgttggtgttaaaaaatggatttcactgaactatgccatcgccaacagagctatgtggaaatcaataaggaagtcagccctacattaagaatactggctacaaccgcaacacagtagtatttatgccaatttctggttggaatgctgacaacttgctaacatgccttggttaaagggtggagagtcacctgcagagatggcaataccagtgtagcacaccgcttgaagctctggattatatcataccaccagctcatccaactgacaaggcttgtgcctacctctccaggaagtctacaaaattggtagtattggtaatgtctttgtgggcctagtggtgactggtgccctcaaacccagcatgattggtcagctttgctccagttaacattacaactgaaataaagtcttttgaattgcaccatgaagctttaaatgaagctcttcttggggacaatgtgggcttcagtgtcaagaatgtgtctgtcaaagatgtttatcatggcaatatggcttgtgacagcgaaaatgactcgccaacggaagcagctggcttcctgaaccatccagcccaaatcagtgctggctctccacctctgttggattgtcacacagctcacattgcttgcaggtttgctgagctgaaggtggttgatttccttctggttagaagctggaagatgacccccattgtgatttttattgctatggtttctttctaatttagtcttgaggtctctcccttgagaatggtcataagccaagagagccactttctaggagagtcctgaccagggggaaagttaagtttgagtgtgtcagcttggtgagacacaatgaggaagtaaaaacaaaataaatagtggaatagaatactaacaagtacctagaaataagtctagctaaaaatttgcaaaatgtctatggaaaaaaaaactatggaaatttactgagaaactttaaagagtacctaaataactttcaagatataccacgtacatgaattggaaaacatgatatttgaaaatgtcggttattcccaaactgatttatagattcagtgcaacctgaatgaaaatcccaagacgttccttttgtagagctcaacaagctgattctaaaattaatatgaaaatgtaaaggtttatgaatagccaagtccttcttgaagaggaagaataagatgagagtaattgctgtctaatatattgagacttattttaaagctataataattaaaacaatgtagcagttggtatagggataatcaaacaggtaaatgaaatagaatagaaaatccaaaactagtctaacacatatagaaacttgatttatgacaaaggtgtcacagaagtagagtttcaataaaatgctggaaaatgttggtatctatatagataaaacattacattggattcctaactcacaccatacacaaaaatccattcacattgcattacaagtctaaaagtgaaatataaaatcataaacattttagaaagaaaatgtaaaagaatatatcaataaccacagggtagggaaagaaagagaattgacatcaagatacaaaaagccctagccaataaggtttttttttataaattccacacattaaaattacaaacttatgctcatcaaaagataacataaaaacaatgaaaagattagccacggaatggtaaatgtttgcaatacataacacaaaggacacacaaaggaaacttatataatagattttaacaggcttctctgtgtccttcttctccagcaatcaaggaatatataaaaaagcatatcaaggatatatagggtactcttttgattcaacaagaaaaaagcagattatccaagagaaaacttggcagaaaaaagcttggataggtgctccacaaaagaggacatccaaatgactgctactcataagaaaagatgctcaacctcatagaacatccaaaaatgtaaaaacacagtcaataccagatatttgtaataatttggagcaaatggaactctcatacattgctaatgaaaatggaaaatggtccagctgctttggaaaacagtgtggcaatacctaccaaagccaaacacatgcatacctagtaattccgcccaacagaaatgcacatatatgttcaccaaaagatatgcaccagaaggttatagcaggtccatatgaaagtgccaaagattataacaactcaaatgtccgtgattagggtatattcatataatactatacaacaatgggaatgaacaaactatagctacatatgataatatagatgaatctcacaaccagaatgctaagtgaaagaagaaacaaaagaatatatgtagtatgttttatttacacacttcaaaacaggcaaaactaaactatatttttaaaggatgtatacgtaactggtaaaattataaagaaaagcaaagaaatgattatcataaagatcagaatggtggttaccttcagtgggaagggagaaagtatgattgaaaagggacatccagtgagtcttgtgggttgttggcaatgttactgatctgggtgatgattgcatttatgtaccaaaggcatttgtgttttatgcactttattgtatatgttttagttcacaatttttttagttcacaattttaatagggctttaaaaagtaaaaagaaaagagatccaagggcttgaccatgggactctcttatatttggagtatgtttataaactttacattcattcaacattcgacaaatattttttgagcacctactttgtgccaagcaccgttacaggtgctgggaatacaacagggaacaaaacagacaaaaccccagctttcatggaacttacatgctaataaagcttggcaagagtatttcaaggaagatgaagtggttaactatgcaaaatgcttctcaggcacctaggaaaatgaggatgtgaggcatttctacccacttggtacataaaattattgcttttcctctgctttttttctccagggctcagagtggcagtgtccctcagttcaagaaagttgttttccaggaatttactgatggctcctttactcarcccttataccrtrgagaacyaaatgaacatktsggacycctggggccatatataagagcagaagttgaagataatatcayggtgagttaaggacagtggaattacaagaaaattaattttatatatttattttcttgctgactataatgtattcccacttttggaaatttttaaagtatagaaaaataattccataattatctttgtgtacgttctatttttcctatgtatttttctccttatgtattcaaattataccatgcagaattctgattcttgtttttttactaaatatcacatcataaacatttcttacgtcattaaaaacacttcctatgtatgtttttaaaatactgcataatagtctattatatgaatttatggaaccatagtttatgtaaccatttattttgaacaagcttttagacagtttcttttttcactatataaataaygctgtaatcacaacagtttttctaagataaaattccagaagtgcaatgtatttgagcatcttaagagtttttcttattaattatttggtaatgtcccttgcacatttgtctttcatggaggaagtgcttttcttattgattatgttaccttatatattagatagtaaaccactgaacattttaatgagaggtactttttcaagtttttgttttctcttaattttataaatgatggtttttgaaataaaacaggttttaatttttaggtagtaacccatcaatctttactttttgacactttcattgcttttatgtttataaaaattcctgcctatccagagattttttaaaaaacacctatactttcctcagtttttctcttacagtttaattttttacatttaactttttaatacttcctgtagactaaaagttattttggtgcattgtgtgaaccaaagatcaaagtagttttatttttttctgaaaatatctattcgttgtttcaattaattgatggtgtatattaaggatgtagaaggatctaaaattatggaattgtgggcaatttttgccttacattttattttactttccattatattctatgataaatatgtataatttttaatctggaaagtaagccttttttaaaagataatatgcattcattctagaatttgtcatgaagaaccttaacttacatatcaactcctggcgttatggtctcttataacccctgcagtaacattttcccttttactctggaatggcttttatgtgtttaggaattttctcctttgcaactttgagttcataccttaaatttagaatacaaaacctcctcaggattaggtttgagttctaacagcatccatcttctgtaccacttcttccagggtattaaaaactttgataaagaccaaaagacaggtatttcttttagggatgtaaaccctaaggaccttaagatcctagaagattattcttgcttttttttttttgtcgttattgttctacaggtaactttcagaaatyagscctctcgtccctattccttctattctagcyttatttcttatgaggaagatyagaggcaakgagcagaacctagaaaaaactttgtcaagcctaatgaaaccaaaacttacttttggaaagtgcaacatcatatrgcayccmctwaagatgrgtttgactgcaaagcctgggcttakttctstgatgttgacctggtaagcaggtgtctattgtgctgaccactttttggtttaaaagaaatggtctttgtgtactaagaattttgatatttatcctacgtgcaataagaagctttaaataggagagttgatcattatatttgtgttttagaaatgtcattctggaatctactgaagaggatggattatatttttggaaggtgggaggcaggttggactggcataaaaattgatgagaaatccactctggttcataggtgagagagcttatactcataggattgatgtcttccctccctaggaaraadatgtgcvctcagdcctgattggaccccttctggtcygccacactaacacacygaaccctgctcatgggakayaagtgacagtayaggratttgctctgtttttcaccwtctttgatragaccaaawgstkgtrcttcactgaaaatatggaaagaaactgcagggctccctsvaatatccagatggaagatcccacttttaaagagaattatcgcttccatrgtaatatattccacatccaaacattatcactgtgaaatgcagattgcactttgacaaatgagacttgatccagggacttgaacattgtatttatttagagtatatctgtgggagtggaatcctcatagatgtcagtttttttggtggagtggagagaaagaaacttatataatagattttaacaggcttctctgtgtccttctccagcaatcrrtgsctacatartggatacactacctggcttwgtaatggctcaggatcaaaggattydatrgtatcygctcakcatrgrcagmaatgaaamcatccwttctattcatttcagtgdabatgtgwtcactgtayvaaaaaaagaggagtataaaatggcactgtacaatctctrtccaggtatgagcttgtttgtgctctttcttctacctactctatttgttgagtacttactttaaatggtctaggcactgggaacacaatcagtgawcaaagcagacaagctccatgctcttaagtaatactttttcaaatgctttttaaaccatttgttcaaagcaaatgaacaagataatttcagatatagaaaaattgctaaaaaggaaatagaacagaataaatggataattaatgtcacagtactttcctagggaaaaggaatttattcctttatcatttaccatctcaaatcccatagggcaccagtagtcatccaaagagtcatttgtttatgtatgtaaccagtatattgattaagcactactcataatgttgatcacaacacaattttattttggttcttcactgtccctttaaaatagatttggccaggtgcgatggctcacacttgtaatcccagcactttgggaggccaaggttggaggattgcttgaggccaggagttcaagaccagcctgggtgacaaagcaagacccccatctctacaaaaaataattagccagacatgtggtatatacctgtagtcccagctacttcacctacttgggtggctgaagtggaaggattgcttgagcccaggaggttgatgctgcagtgagctatgaaagtgccactgcactcaaacttggacaacagagcaagaccctgtctctaaaaaaaaaaaaccatccagtttaatagcgggggtaaactttccttatttcttcgtaaaaattctgataagccctgtaacttttctgctcacccttaagtaataaacaggactaaagtcactttatgtcacaaatacagttcaaatcagaaattacaatgtccatcccaagatattaatcaaaattgtraacttgatttaacttcaatctcccctcctccaacttgagcctgcatcaggctggaagtctgcattggaaaagggagacatggttgagtcctctgtttctgtaccttgtgatgatcgtgcttccccacaacccctttatagctgctgttttgaactccaacatggataggttaaaggtaaggggataagatagttcttacctatttacagctggcaccattgttgtaaastagcttaacactgtttgtgcctggcaatacttgttgactctttctcctgcagggcactttcagggaactctttagagactcccttacgtgactgtcatgaaatccccttgacatgatttcttccacctttactctgggtggtcacttgtgactcatttctcagccctcagtgttcacctgcagcttcttgttgctggggtaactttacccttgtaggcagctctagtggactggatccagagggaactcaccctgacttatctgtttcacagagtccacatctggccaatgggaaacacaccttttgctcagaaagaccctgggaatgtaggtcaatcataatgcagtagcattctcctgtcccaaccatcaaagaattcastcaccctgtttctcatctsctggggggaggggagtggtcagaactcaatctccacaacccccaactgtaagggtcacgtagcaagcactttgcatttgaggggtccaaaagtagtggaactaccaaatttggtaggtctactctgatatttcgcataaaccaatgtatctcatgctcattttttagtgaaaagaaataatttctgttcctgttggtttttataagstgtttttgagasagtgkaaatrttaccatccaaagctggaatttgkysggtggratgccttattgrcgagcatctacatgctgggatgagcacactttttctggygtrcagcartagtgagtagcaatgtgggcagaggttccctacctactcagcctacttctttacagctttcttcctttctggaatggttgcttgtgtcaggaaataaatacaagyttacatcattatcaaatttaaaatgaatattgctggtagaaatcatcagagttctcagagtagggcagatatacttgaagctttgaacactttgtacctgaagctctaaataattgacaaaaaaaaaataccacctcattttcacaacttggtaaagctcgaagatctccagtagcagattttggaatttaatgttgatttagttaccagataacttagaaatactacttggaagagtttggagatttaaccctaaacaagtaagagagccactggtctattatgtayggaccccagtttcttcagctgtaaaatgtgaatcattctagcacctgttaggattaattaaatgaactaatacagtaaaacgttgagtacagttcttggcacatttaaacactaaaaatagcatttgttgacgttctcccattttcattgacttacatttgagaagctgaattttgtgcactctagttactgtgttccacccgtttcatttcagagtrwcagactcccctggdaatggcttctggacacattagagattttcagattacagcttcaggacaatatggtaaatactattatttttgctccaagaacctgggctgattatatctttttttaataatctggtggagaatctcagataatgaatccatctccatgcttctattagttctattccataagtgcctctcaaatacatctcctcctctccacttcccactgtggccatcttaactcaggtcaccatcatttcttacctgggcaatgacactgcctccttaaatatcctccctaccttcagtatttcttccttgagtcaattcttttcagtgcagcaggaagctatactttcctatgagcagtaatggtaaagtttgactagggtctatagagaattctcagaaattgttttagagcactactgcccacaggctaaatgcagcacactgcctgtttttgtatggcatgtgagctatgaacagattttccatttttaaataattgtcaaaaagatgaagactatttcatgacatgtgaaattataaaattcaaatttcagcatccgtaataaagccttattttggaacacagccacgtccattaatttacatatcatctatggctacagcagcagtaacatagttgcaacagagaccatataatatgcaaagcctaaatgatttactatctggccctttacagaaaaagtttgccaacctatgttgttgtgaggtaaaaaaaaatcctcttgaaaaggaggcgtgagagttttacaccaaaatagtaacatttttcactaggtggaagggttacattttaaaatgtcttttatttgtatttttactwatttttacttttcattttctgatttttctacaatgaacatacattgcgtaataaataataggcggggcacgttggctcatgcctcccagcactttgcaaggctgaggcaagcagatcacctgaggtcaggagttcaagaccagcctggccaacatggtgaaactccgtctctactaaaaatacaaaaattagtcgggcatggtggtacgcgattgtagtcccagctacctaggagactgaggcaggagaattgcttgaactcaggaggtggaggttgcagtgagccaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgccataaagcctttatgtttttctctattttcaccacagtttagattaacctttctcaagacaataattttattctcaagtgtctaggactaacccagctgaatttaatctctgtttctttacttgggcaaaggacagtgggccccaaagctggccagacttcattattccggatcaatcaatgcctggagcaccaaggagcccttttcttggatcaaggttagaaaatgtaatcaatgatgggaaatgtatcacattcaatcaattgcattacttattcctcttgcaagctcaaaggattctatgaatatgagaaaactaaagaacagaatgccttaatgatttgtacaaaagcagtcatgaacaaagagatatggggatagaattgagtatattgatatgtcctgtttctgtattttagtccttctactgggattagaacatctgaatattttctataatattgaactcgtcatctctcaagacagtatatgttattattagatgcttccaactgcccacgtgtccttaagtactccaatcccctttattttaacataaaacaaatggttcacaaatgcaaaccacatgtgtacttttacattttctgtagccacgttttcaaaaatgtgaaattcactttaataatacattttatttaactcaacatatctgaaaatactatcatttcaacatatgatcaatgaggccccttcaaagacagacagatggaaactcttgggtctcttccatgcctcacaaaagctgagggcagcttggaagtgcctgctcagcctctccacctaaacataaggctagatgccttctagaagcccaaacaggaaatggagaaaacattttggtttccatctttgcaaatagcatgtctattaatgccacagcattgttttgtagacactgccaattttgactcaatctgagctgctgttcactaatccctaagtattttttgttggtttgtgcttctgccaaacaacatgttatgttcttcaccttgtatttctatggttattttcaaccttaagtgtatccctatatagagaacatgtttatctatttggccaccctgtgtctgtctgtgctatttaattttttgtaataacattcttatttgggagggcggaattatatcttcctcactagatacaacctgataagactagtaaatagagtgtcctgtctgtgcctagccaatgaaccctgaatgatatactctgttgtttccacttactagatttggcccattgtttcagcttgccgatcttcagtgtcccaaagtatttcctagtttttccagttactgatttgatcagtaaactttctaatactgcagcaaagtcatgatcaaaatattgaagtagacaagacttccttagtatgtgcacaatacaaatcaagctgttaagtccttactacaaccttgtgaggtagatgttactatcatcttcatttcagataatgaaattgaagcatagagaggttattgtggcccaagtcacatggctaataagtgactgagccaaaattcaaattctgatagttgggctccagaaccctaactggtaatcgttgtactacactgtttccggaatgctccctttaagttgataaccatctattaactgtcactgttcacttgtggtaattaaaccagttacaaatccacctagttatgttatcatctaccactattgaatcgccttatcttcaaggtggttttgccatctgtcctactaaggtccagctagactttttatagatctcgtaactttataaaataaaccatggagatggagttgaaagggggtgctgacaaggaagggagttggagaaggcatctattctcgtgagaaggcctgaagagtgcacaacagcctggccccaagacacaagagcactgggctggcttgaggagcaccaggtgaccaagaccaggcaatgcacagggggaagtcagcaggccccatggagatacgcagctgcagtgtttgtacttttatacagtgaaactcattaccaccttgcttacttcctagtagagagatgtgtcttgtagttacactgaaacacctggctgggcacataggtgaagctgttgagtctgtaattgtcaaactgctcccaggtgccaattataatgtagaagaggcacaagaagatgaagtggataagcctggcagtttgtcaagcattcatcagttgtcaagcatttgtcagttgcagaatgtaggtaggctgccaaggctttattgtagcctggttctattgcagctttattctagcaaggctgctggaaaatacaataatcactggtccaagaaagaactcttatactctatctatatgaagaaacagtaaaagtcaattcagtagaaatcatgatttttgtgcctggtgctttcacttttttatgccacaataccaagaggttaaaatgaagtgtctttgattgggaataccatctatctgggaaaagacagggctgcaacttctgaagaccttgacactctgtcctgttaccctgcttcatttttctcctgcgcttatcactacttgatgctataaacaaataaaaacatatatgatataaggtctatttctcctactcaactgtaagttccatgagggcagggctttctttcttgtttactactctattccctgtatctaaaacagtgcttggcacatagcaagtgctaaaaaatattctttgaatgagtgtatgaatggaacttacagtcagctgaaggagacagttattaagcataagagtgatgaccagtccaattgtgtgtgtcaggcatgtgtgaaaacgtgctaaatttgacttgcttattaggacagtaactgatacttctaatgttcttgcagcccatgacctcttctttaagaagtgtccattctgtactactttcccattattcactcattcattccaaagcatttgctatacagcagtattataccagataccatattaggtgctggggctagagagaatataaaagctaacattgattgagtgtttagtatgcgccaggccctgaactcagcacattacatgtattaactctttaacccctatggcagccctttgagataaaaactaatattatcttcactttacagataagttgagacacagaaagttaggtgactcaaatgggttcactgccttaaggatctcagtctaataaggaaagcagaaaagcaaagcaaccttataatatggtgcaataatttgctataatgaagttatatacaaagtgaagtagaagcatagaagaagcagcactaaatttgtctgggtgagtcagagaaggctaaccaggaaaaatagtttctgaactaacacttgaaggaggtgtagcagttcatcactgacagtgatgttggggtgggtctggtttcaggagaggggaggaaattggctttggtctgaggctgaggtgtgggcaaagcattagcttatgtgggtccattagcttatgtgagtccacaaaaggtgtgtgtgtgtttgtgtgtatgtgtgtgtgtgtgtgtgtgtgtgtgtgtgtacgaaatgggggctcaatgatttggtagtggtttggtttgtcaagaagcaggctgggaactcaataagcatctttccattcatttctactgtgtatcccacagcttcacacacacatgcacatttcaacattggtgactgcttcacttgcacacctaaggtaatgatggacacacctgtagcaatgtagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatcatcatgtatagtcttgatgggaagaagtggcagacttatcgaggaaattccactggaaccttaatggtatgtaattagtcatttaaagggaatgcctgaatactttaaagaattttggcagatttcagatattggacaaacactcttagcttccacaaacttaattccaaaaaataatttttcacttatgagcaatagagttattacggacatatcagcaaaaatgtagtagtgtcaaggctcatagatgatagaaatgaagagatgctgtattgatagaaatatgtgattcaggactgtgtggattgatgattgtgagcttgcttatggatatcctaggtttgaggttatagtaggacaatcaggttgaaatgtccagcaggcagtaggtgaaagacaagtttagrgggcaaaaccatggatggagatgaagattcatgacttccacataaaaggatgggtgaaactttgggaattgatgaattctctagaggtgagctcaagacccttaaaggcttaaaacctcagcgttattgtctactcttccctcatttttatgcccacaaatctggtcaatcctttatttgcaatgcctctcacatctctttcttctgtttccatttataccgctgttgccacagcccagggtcccatcacctcacacttgatctattgtattacattcctaactagtcttcccccgtttctaatctgttctccgataaaagctgcacatcattttcaggataatcatcagtcgcctgcctaaaacttttcaatgtcttcccattgtctttagaataaagttcaaagtcttcaaatgaccccaagcaagataacttttgtttgcccctttagatccattttcctgcttctctaccctgcttcttgttctgtgaggtgagcttgtatagaatacatcaacaggttaccttgtcctccagcttttggttggatttcaccaacagggagcactggcaaaagattggcatatttattcttctgactttctccttgcagaggagttcactgtatctccccacttaaggtcactgtttccctcagagtggctttttctacctgtactagctactattgctgtgtaccaagccacttcaaaacttgctgtcataacaataaccattatgttttgctcacagattctgtagatcaagactgggacacagtggggatgggtggtttctggagcctcagttaggattatttaacagctgggtgctggaatcatctggaagttccttctcttgcttttctggtggttggtactgactgtcagctaggacagaatctggggttgttgactgatgtaactttacatggattatccctgaggcctggccttccttacagcatgtttcaaggtagttggacttctttttgagggggggtaggaaggtggggggaggacagagtctcactctgttgcccaggctggagtgcactggtgtgatctcggctcactgcaacctctgcctcccgggctcaagtgattctcctgcctcagcctsctgagtagctgggactacgggctcatgccaccacacccagctaatttttgtatttttagtagagacagggttttgccatgttgaccaggctggtcttgaactcctgacctcaggtgatccgcccacctcagcctcccaaagtgctgggattacaggcacccggcctgtagttggacttcttacacgtcattttagggcctccaagtgtgagtgttacagttaacaaggtgaagactacataaccttttctgaccgagtcttctaagttatgtagcatcacttttgttgacaaaaagtgttgaactctataaaatatttgaagagatttattctgagccaaatatgagtgagtatggcccatgacacagccctcaggaggtcctgagaacatgtgcccaagatggtcagggcacagcttggttttatacattttagagaggcttgagacatcaatcaaatacatttaagaaatacactgatttggtccagaaaggcgggacaactcaacctgggggcttccgggctataggtgaatttaaacattttctggttgacaattggttgagtttgtctgaagacctgggattgatagaaagggaatgttcaggttaagataaacattgtggagaccaaagttcttttgaagtcttatagtggctccccttagagacaatagatgacaaatgttttgtattcagatcttagttaatctctttaggattgggaggggctgggagaaaaagatctagctatgttaatagagattctttacagttgcaaatttccctccacaaagaacagctttgcagggccatttcaaaatatggcaaaaaaacatgttttggggtaaaatattttgattttcttccttgtctcataatgttatgccagagtaaggttggaaagtaaatcatgacatataaggttaaataaaacccatctgatgagaatttatgatttgtagggcatgactccccagaccccttagataggaatttgggcaagataaaaaaaaatcagagtttagtcctcactttcaatacattctattggttataagcaaatcgcatatccacccagattcaaggggaagagacatagaccctaatttttaatgggagaaatgttaaataattggtggtcattttttaaagccactacaataatctatccaattctctctttcaggatgtttctctcttctgatcctttcaggtttagggattgtcaacaaacaaaaagttaaaccctgtaaaatacttgaagagatttattatgagccaaatatgagagaccaatggcctgtgacacagccctcaggagatcctgagaacatgtgctcaaggtggtctggctacaacttggttttacgcattttagggagacataagaccgaaatcaatagatggaagatgtacattcattgagtttggaaaggcaggacaactggaagcgaggcggggcttccaggtcgtaggtagattcaaagattttctgattggcaattggttgaaagagttaagttattgtgtaaagacttagaatcaatagagaggaacatcggggttaagataaggggttgtgaagaccaaggttctgtcatgcagatgaagcctccaggtagcaggcttcagagagaatagattgtaaatgtttcttatcagacttaaagagtctgttctatcagtctgaaggtctgtgttgatgttaatgctggtcagatttttctgaattccaaaagggaggcgggtataataaggcatatttgatccccactttcccatcatggcctgaacgtttttcaggttaactttggaaggccctttgccgaaaggaggggggattagaattttattttgggtttacaggatggtaatactctgttcccaccctcctaactagtatctttattaaaccttccacaaattatcctaatttccatgttttctgttccttgctggatcccttgtttcatacagtaattggtgctagaagaaaccccaggaaacagattttcaaaatgcaattctaaggttatgttgctaatatattcaagaaacacagagataacatatttgccaaggaagaaaatgagcagttagggaatccatgacatgtgttagtattatagtttctcagattatcaccagtgatactatgggatgagttgcagatggcaagtaagacactggggagattaaatgacagtggcatttagtcactgtggcaacaaacgtagcattacctgattgtagagtggtctgtcttcttacagccctagagggcatacacatggaaaaagaaatgaaatgttatgaatatatacaaaataagaacactgatgaacatacatggaaaatcaggatgcatgcatagagcttttgaggaatactccgtatcctgtggttgtaggcagatacgacttaggggctgagcataagttgcagagctgcagtgacaattaaatgcttaactccaccagatctattatgctgtggtaagagtaccggtgggaaggagtgaaactctgaggcctgagatggaggcatttaggcagacatggatgaggctgagaattgcaaacctccaaattcccctgaacctcctttgcctgaggaggcaaccactccccagtctctgaagcagtcatccctcttttgtgtaaaagcctttcagtggctataactgagataggtgcctcacaaaccagtgactattctccttagagaccctgtttggacactacgaaagccaggcgagtcacagaaaatgacagcagatcacaaatttaatcaggtggtgatgccaaaaaacaattgcaattccagatatcatatctctgttgaagcaaatttacacagccccaggcacctgatatggaagtattgacctagagaatgttttttcttcatttccatacattagtaaaatcagaatacatttgaatttaccaagtaggaacaagagtattaagtttactgcccatgcatcagggcaatgttagctctcttgttttctatcataatatagactcaagggacctcaaacatctttacatcccacaagcacaatgcctgtccattacactgatgacattatgctgacaggatctggtaaacacataacaaataagcctgtcttgctcttgactttaatgagaatgtaacctgtgtttcactgtttaatataatgttcactgttagtttcaaatactttttatgatgtttaaaaagttttctcctatccctattttatttgcaatggcaactgaattttatcaaatgcttttccagcatctttgacatggtcacatttctcttttgtgttgtcaaattatacttaacattcaatagtgtgctgacaagaaattaacaacccacaggggagcaaagtgagaagaggttaagaagtaaaggccttgatttatagcattggcagatttccctgacataaatactactcccatcatgcctggccccagggatgggaagagatgcttacttacaattggctctcacagaccagtgcaagagcactactgtgctccatttctgggaaaactttcgtcagtcatagtgtgttagttatttaaaacttagctggatccaatttgccaacatttcatttataatttctatatctatattcatgaatgaaatgggtttagctttttcagtagctctacttaccaggttttggcatgagggttatattaaacttgaaaaataaagtgggaaagcttccatttttttccatgaagactattgctctagaatagcttatttaatgtaggaatccagtatttaatgagagtaaatgaaaaagccatatgagccatgtgctttatttagtgagagatactaggctatattttccaatcgttatatgattattgctattctcatttgtgttgccttgagttaatgtctgcaaatgtgcacattagagtcatatatcccttcctgtgccatacatctatatctgtatacacacatatgtcttttctccttttttcccttctgtatcaagagttggcaagtgtttgtctattctattaatttttcaaagaatcagctcagttttaaacccaaacgtggttttgaaagagctgtttctagttcatcaatctctgttcaaaactttaaaaattctattttcctttcttttggtttgtttcctacaatctggaggtgaatgcttagttcacttattcttcaatctttgtattttaacgataaggataaattacttacagttattaactactctcatgaggttcattccttgaacagtcactgagcaactactatgtcctgggttctaattcaggggtgggcaaactatagccccagaatttggcccatagcctgcttttgtacggactgtgagttaagaatagtttttacacgttgaaaggattgcaaagacaaacatacaaagaaacaaagaagactgtgcaacagagaccacctgtggtctgtaaagactaacacatttctatcccgcccttgacagaaagagtctgtgggctgctggtctcctctaacggtggtagagatgcctgcacggttaacattaatccttggcaccagaatcctcagcacctaggaaccagatcttgcctaacacgctaatttcagtcttgaccaccttcctccggcgtagcggttctcaaacgtctttgtctttgtactattcacgtataaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggaaaaaaaaaaaaaaaaaaaaatccctattacaaataaaagctgttgtgatccagactgcatatacctctgcgaatggaaccagaaccgtgaattccaatgcaaatcgatgcatcggcaccagacccgctgcactggatgtatctgcattgcagtcacccgagtacggagcacatcatagatgatctctgcaggttcgttgcccacataggaggcatagcgcaaatttcaaaggaacgaatacatcctggagcccaaacagctatctggttctgctgctggcctcctgacaagtaggtaagagagtcacattttatagacgacggacaccaaaaccacacatgaggagtacaagagtagctttatcatggatttagggctgtggttacaaggaagctgtaaggaataaaatgactcccatgaagacgtaccgtgcggacgagtggaaggagaaatttggccattacaaagacacaggaatatgttaagaagtgaggggcaggatgaaatcatctagggtaggtatttagagggagggcgccgtgcaaaataaaatcctcactatgaaacaaaggcggaggcaggaggctgcgttrggtggaagcagcggaggaaggagacgaaagggattgtcattttcatgtcgtggctttttagaagacagccatgtcctctactctgattctatcaaaatgtgttctcggggtgctggtaacgttcagccaacgaaataattcctatggcggcagtaggrataacaaaacgcagaagcgggaacgatgtctttttattcctccccagacgcaaacgtggatgcatgaggtttggtaacaggcaaagtcatctggttaacgtgactgatgcaaaaagtccmggcctgggcaaaaagaagtcactgggtgaatgggatggatcagactccctgtcctgagggggagatggtttcttgcagaacgaggtgaaggaggtggttctgctcagcagtcaacagtggccacatctccacctgcagcgacttgatggcttccgtgtccttttcgtgggtagccatgaccaaagactggagcagcagaaagagctcctcgggaagctggccgctgctctcckgcccgtggctgtcaaaagcctcccaggagtacttctccagggtctgggcgtgctccggcagcagcttggcgggcggtggttgcaggaggagcagcagcagcacgcgggacacctcgcagcggaccagcacgtccgagaaggcgcccagggcggcrggagagggcgccgccgagccggagttcggaggaagcagcgcrgccggtagggcgggcgtcgccccgggcccgggctggggtgccggcggcgggggcggcggcagtgactgcaccgggtggctgccgtgctcccgcgccaggcgctgcatgcgcgtgaagaccgccagggcgccggtgtagtcgcgcgccagcagckggcaggaggcggcctcgccaagcgcctgcagcgcggccaggggcagctggggcagctggagctgggcggcgcgctggaagtgaccggcggcggcggccggctggcccaggtcgcgcagggcggcggccagctcgaggcagagggcggcggcggcggccggctggcccagctcgaggtgcagacgcaccgcggcgcccagggcgctggcggcggcctgcagcggctccccgtaggcggcggggcagaccaggcgctggcgcgcgtcgcgctcctgccgcaggaagaggcgggcggcctcggtgagggccagcgcctccccgggcccgtggaagagcgcctgctggcagcgcgccaccgccagctggcaccaggccgcgtagggcagacactcctgggcgcgcagctcccggcccagctgtccgaactgctcgccggcctccgccacgttcggcttccgcaggaaccgcttcttcagcttgttcgataccagccggtagcgggccaggaagtccccggcctcgggtcccgggccggcgccgccgccgcccaggcctgcagccgctgccgccatgctcgccgccccaagcacttcccgacgcgccgccgcagctggcgggcgggccggggcggggcgacgtgccctgcgtccccctcggcgggctgccgccgtgcccgcgccggctccccagcccgagcctgccccttgccctgrtgaggtgcaaagagcgggatcggaggcggggcctggccgggctgtgagcggcgtatgcaaatcgagggtctcggggatgcggatccaagaccctgggaaggtacgcggggcctggcggggcaccagctgctgctagctcggctgcaatgcaagtggtctaggttgctaaaggcatcccacagcctctccatctgaacatgacccaaaggaaactcgtgaccctaattccatgtctgcgcatttctrsactgttgtccccccccccccccgccccgactactcagtcctccgtcttccggtccagggccccttgccaagcaccgggtccacctctccgtccccaccccggttgccttagaagtccgtcctgtcscaacactgcagtcatggtcttgaggcccacccgccccaacgaacaccatcatgctgaggactttcccgggcaggccctgacttgctcagaaccagcgggggtgtccccttcccacccagggccactcccctgcactgtcacccggagagackgctcctctgtgccatccctggctcccacccaaccccagacccccaccacctctccatccctccagctgtggaggtctcacaaccccccaacccatctcaccgcccccccacccccaccccaaggcaaagtgactgaagcgggcagatggcttccttgaaacattttattgacagaattaatgaaggcccaagactttggggcctgggttgtggggggagggtgtttaaggccgggggttcaggccgggggatttggggccgggtgggtggacgagtggacctgtcaggtcccaggggccgggtgtcagaagctagtcctcgccaggggccacttgagagatggtggtcgtgttgmaaagggtgctcagtagcctgtcgttgtgaaccaccatgtccagcagcaggggagtgatgttccgctctccgctgttctgggcctcgttgcccgccagctccrggaccttggccgtcaggtactcaataaccgcagcgaggtagaccggcgccgtgcgactcaggcgctgagcgtagtggccctcccgtagactgcgctccacctggctcactgaaaacgaaagctccgctcggacggtgcgagagcaggtccgcccccggccgccagcaccggagrrccctcggcgtctcctcctcctcggcatgctgggcgttgagtgtgctatctcggcttggcccagctaggcaagatggctctcaagaggacagttaccgcgtccagtactgtgtatcctagcgaccagggcccagcccctcattggctagggagccgagaccaatgggcacgcacatccggcgacgggcacgcatgtggtgacggcccctcacaagggacacacgtccgtcaggtgacctcatcactttcccattggcctcgagggagcaggcctgggcctagaagtggctggagggccgtgggggtggggtggggcggggcagggggaatcgcgctggtgaccctctctttgccagtgggaactttccctttctactggatgggaacaccgtgggaaagacaaaggggtgggcgaggggaggacgggtaccacgccttcacaatgttgcacatccatcacgaccacctagttccaaaacgttttcaacaccccgaaaagaaaccgaaacccctgtacctataagcagtcacttgccgcacgcctccttccacaccaccactaccagcccccacaccctcccacacacaccccctgcccccgcccatacacacgttcccgatagtccctgrcaacccctagtccatctgctttctgtccatagaggttagcctgttctggagatttcctatagatggaattatacgaccaaatgtgaggccgtgtgtgtctggctgctttcacttagcgtaatggtttcatcagggtgcatccatgtagaggcatgaatcactacttccttcctttgaatgactgagtacgattctgttgtatgaataggaggccacattttgtttacccactcgtcagttgatggacaggttatttcccccttctggctattgtgagtggcactgccatgaccatctctctacaggtttttctttgaatatctcttttcagttcttttgggtctatttctagcagtcaaactgctggctcgtgtggtaattctgtttaacttattgaggaaccaccaaactgatttccacagcagctgtaatctttcgcattcccaacagtagtgcatgagagtcccaatttcttcacagcctcatcaaaacctgttttctgtttgcctcattttgttttgtttacagtagccatcctactgggtgtcaagtgctatctcatggtggttttcattcgtatttcccaaatggctaatgatgttgctgtggtttgagtgcatcccccaaattgtgtgtcttggaaacttaatccccaaattcacatgttgattggaggcgcagcctctgagacggtaattaggattagataaggtcatcggggtgagacccccaggatgcgactggtggctttataagaataggaagagargcctgaaacgacatacacgctcttgccctctcgccgtgtgataccctctgccgtccccagatgccgggtcacttcccagtccccagaayggtaagaaataaatttcttttctttataaattgttcagtgtcgggtattcaattatggcaacagaaaacagactaagacatcttttcatgtgcttctyggccctctgtacctctgctttggaggaatgtctattcaagccctttgcccattttttaattcggttgattgtattttggctgtgggcttctaaaacttattcatatattctggaaaatagactcttatcagatatgtgacttgcaaatgtttctcccattcactttctggatagagccctttgttgcccaaaagatttacatttggatgtagtccaacttgccaaatgaaaagatatctgtggctttgcctttggtgtcatactgaaggagctgttgcctaatccaaggtcgtgcaaagttacatctccgttttcttcttagagttttatagtttcagcccttacatttagatctgtgatccattttgaattaattctttacatgatgtgaggtaggggtccaggggccttcttttgcatgtggctatccagttgtcccagcgcagtttgttgaggggattattcttcccctccacccattgaggggtgccggaactcttactgaaaataaactttacataaatatatgggtttattcctgactctgagttctgtaacattgacctaatgtatcgatcacgatggcagtaccacccttttcggattactgcggttttgtagtacgttttgaaattgggaagtgtgagtccttcaacttttttcttttctgagattgttttggctatctgagccccttacattttcttatgaattttaggatcagcttgtcagtttttacaaagaaggcaggttggattctgacaggcatcacgatgaatctgtatattgccttggagattatgggcatcttaacartattaagtgtcccaatccgttaacacaaaatgcctttcgatttatttaggtcttctttaatttattttagcaacgtcttgaaattttcagagtatacatcttgtacacctttagttaaatttattcctcgacattttattgtttcgatgctactgtaaaatgaatcatttccttaatcttattttcatgttattcattgctagggtgtasaaatacaaccgactgttgcagattgatyttggatactgcaactttgctgagccgaatatgctttgctgagcatactcagacagggttggcatattagtccgttcctacactgctataaagaactgcctgagaatgggtaattcctaaagaaaagaggtttaattgcctcatggttctgcaggctgtacaaggcttctgcttctgggcaggcctcaggaaacgtgcaatcatggcggaaggcgaaggggaagcaagcaccttcttcacatgttggagcaggaggaagagagagagaacgcacrcaaagggggaagcgctgcacattttcaaacaatcatcagatcttgtgagcgctctatcagaagaatagcaarggggaagtccgcccccatgattcaatcacctcccactaggcccttccttcaacaggtggggattacaattcgacatgagatttgggtggggacacagagccaaaccgtctcagtttttttttttttcttttgttggactctttagtgtcctctatataagaacatgccatctatgcatctatgaatagagatggttttacttgttccyttccaatctggatgccttttatttctttttcttgactaattgccctgactagaactttgagtacratgttgagttacaagtggcattcctgatcttagggggaaatcaaccagtctttcaccattaagtatgatattatctctgggtttttcatggatgccctctatcaggttgaagaagtttctttctgttcctggtttgttgaatttattttcatgaaagggtactgcgttttgtcaaatgatcctttttgtacatgattaagatgaccatgagccccctcccccgcccccgctccgccatgcattctgttaatatggtgtattatataaattgattttcacatgttgaaccaaccttacatttgtgggataaatcctatttggtcatagtgtataaagagtggtcaataaacatttcgttgaaagaataggagtggatctggcaagcttcttggaggacaatgtgtgtgttaaagaatctgtagcatgatgagaagccaaggcaccggtgggaggaggggagttgcaaccaattcattaaggctggagagtacgatgccagtggagcagtagtggttgatgtggctgggaaagaggtaggcaggagccaagacatggaggttctattatgccatgctcaggttttagaataccctgtaggctacactgaacccactgtggtctttcagcttgggagtgacgtggtctgatttgcctctagaaatatcaccctggaagctgtgtggagaatagaacagagaggattgtgtgtggagaatagaacagagaggactgagattggaattagaaagctgctgtattataccagtcaagaaatgacagatatctcaactaagacaatggcattggtagataagactaggggacagagtccataaaaagtttaggtagtaaaatggcacacagtagacactcactacatattactcatactggtgaacctagctggagacatgataattcatgtgctcattcttcaaaaaatattgaagggtagtgccaggtatactgtgttaagcattgagacaacaccaacgagaaatattctgttgtataaataggccacattttgtttatctactcatcagttgatgaacagttcattaaatgatttccatggcaggggaggtaaatgttgtcctctatcctcttagattctccagctaggacttaaataagatagattaacaaaagaaaagcatacaaaattttatttggcattttttacatgtacatgggagccctcataagaaatacgaagactcaagtgattaattacagctgaatacttacatactagggtgggaaaagtatggtaaattgtgaaaacataacaagacattggggtttgggctaggagagttaattgtggaaaagtcactaagaaggtaagagttgtgtaacaaggttttttggtgcagctttccctcaagcctggactccccatctctggcaataagaatgtgtttcttcttcctggtatacagataatacctttcacatcagagtttcatctcttcctttcatgaaaaaaaaaggaaggtcagtgtgcccttcttgcatctgctactttcaagtgcctttaaacacaaaataatcaatatgccaaagtggcatattttgaggtggcatttgatcccctacattactgattggatagtgtgaatagtgctgccatgaacgctcctgtacaagtgtttgtttgaacagatgttttaaattgcagacgctcctcaacttgggatggtattatatcctgataaacccattgttagttaaaaccattattagtgtaaattcatttaatacagctatattagtccattctcacactgctataaagaactacctgagacttggtaatttatgaagaaaagaggtttaatggactcacagttctgcaggcttaacaggaagcatgactgtgaggcctcaggaaacttacagtcccagcagcaggtaaaggggaagcaagcacgccttaccatggtggagcaggagagacagagagtgaaggacggaaatgtcatacacttttaaaccatcagatctcatgagaactcactcactgtctcaagaacagcaaggggaaatccacccccatgatccaatcacctcccaccaggcctctcctctgacacacggggattacaattcgatgtgagatttgggtggggatacagagccaaaccatatcagcggctaacctaccaatcatcataatttagccaggcctaccttaaacatgctcagaacacttacaattaggctacagttgggcaaaatcatataacgtaaagccaaatttataatgaagtgttgactatctcacgtaatttattcaatattgcactgaaagtgaaaggcagaatggttgtatgtgtactttaagtacttttatgcatatggattctactgaatgcatgttgctttcataccatcataaagtcaaaatattgtaagtccaaccattataagctgggaaccatccatatttgaggtacatacccatgaatatatttatgggtttatttcttgcttcttaattctattccatttatatatatgtctgtccttatgccagtaccacaaagcattgataactgtagctttatacgaagttttgaatttgggaaatgtgagttatccagctttgttattttttaggattattttggctatttgaggtcttgcacaattacacatgaattttaagattggcttttccatttctgccaaaaaaaaaatggccattgggattttgatgcagattgtattaaatctgtagatcactttgggtagtactatcatcttaataatattgtcttccaattcatgaacacaggatatattttcacttctttatgctgtctctaatatctttcagcaatgttttgtagttttcagtgtacaagtcttttacctccttagctgaatttattcctaagtattttattctttttgatgctattttaaatagaattattttttattttgttaatttcatctcagattgttcattgctagtgtgtagaaatacaactgatttttgcacgttgatcttatatcttgcaactttgctgaattcgtttattagctctatagtgttttgtggattcttcggggttttccatacataagctcatgttcatctgagaataagatagctttacttattccttttcaatttggatgccttttatttctttttttcctaattgctctggctaagacttccaatacaattttgaatagaagcagtaaaagcaggcattcttgtctcgtttctaatgttagggaaatatctttcagtcttctaccattgagtgtgatgttagttttgggtattttatgaatgctctttatcatgttgtggattttctcttccatttctagtttgcttagtgggttttttttttttttttttttttgggcatgaaaaggtgctcagctttatcaagtgatttttctgcatcaaccagaatgaacttgcaggggtttttttccctatattttattaatgtggagttgactgggggattgattgtcttatgttgaaccagtcttgcattattgggataatttccacttgagcatgggctataacctttataacatgctgctggatttggtttgctaatattttgttgaagatttttgcacctagatgcataagggaatattatactcacatattcaattacatgcaatttgtaattttcttttcttgtgatatatttgtctggctttgatatcaagatatggtggcctcatagtatgagttgtaaagtttactctccttttctgtctcttggaagagtttaagaaggattaatgttaatccttccttaaacatttagtagaatttaccagtgaggccttctagcacaatgcctggcacataatatatggaatctaggatttgtatagtcagtcattaactatttgttgaattaataaattgtctccccaagcaggtttctaatcaaggcacaaagattgagtaacgaatgaaggcaaagccaatgtatacagggtattagttttctaatgctggggtggcaaattaccacaaacttaatatggcttaaaacaacacaagtttattatcttacagttcgatagggcagaagactgacccaagtcttactgggctaaaatcaaggtgtcatcagggctgcatttctttctggaagctctagaaaaggatcctttttcggtcgcctgtagtcccagctactcgggaggctgaggcaggagaatggcgtgaacccgggaggcggagcttgcagtgagcggagatggcgccactgcactccagcctgggcgacagagtgagactccctctcaaaaaaaaagaaaaagaaaaggatcctttttcctttcttttccagcttctagaggccacacacattcattaactcatggcttccttcctccatcttcgaagccagtaacattgcacctttgtgactattcttaagtagtcacgtctccctttgactctcctcttctgcctctctctctcactttcaaggcctcttgtgattacattgggccgacctggataatccaggatattctccctattttgacatcagctaattggcaaacttaattccatctgcaaccttaaatccctcttgccatgcaacataacacagtcaaatgttctggggattaaaatgtggacatcactgagagatcatattcttcctagcacatacggtttagtcacaagttaatgatcaacatttattagctatataatactcttaagttcaacataaactttttggatgctgataaaacggaatggcattttacattgatatatacttcatttcaaaacttcttctacttctcaatgattattctgtagcaacaaatttcttttaaatcagaaatttggaaacataacgagacctatctcaaatcaaagatgactatccccttttggagtcagactacacattcattattttagtcaaaatgagacataaaattcaggcccccaagagctgccagtacccacttacgcaggaggtagctagacgaaacaggtagctttctacaaatgattttgcaccatcccaccccagagaggtggtttggagtgtttacttattacctgggatttaattatactagctcttgcaaaagccaaatctaaaggccataaatagaaggtcaaattttctcctatatagaaaggagagcagcagagaaaacaaaatccttggtaaatctttaaacaaagttatatggtttgaatatgttattcattctattttaacccccccaatacagatatatttataaaaaagaatattgtgatttctggtataacttgtttaggaacaaagccacaaatttattaatattttctattccctgggaagaaaaaaatgctacatggcagaataattttttaaaatttccagccgggcacggtggcttatgcctgtaatcccagcactttgggaggccgaggtgggcggatcacaaggtcaggagattgagaccatcctggctaacacggtgaaacaccgtctctactaaaaatacaaaacattagctgggtgtggtggtgggcgcctgtagtcccagctactcgggaggctgaggcaagagaatggcgtgaacccgggaggcggagcttgcagtgagccgagatcgcgccacggcactccagcctgggcgacagagcgagactccgtctcaaaaaaaaaaaaaaaaaaaaaattcccatgatactaaactgatgtgtgatcatataatagacttacactgatacctattttagtgtattcaagcagataaaaaatcccaggtgttctatgagtgatatcattttcagtatttcttatgctgtatgccatggtttaaatctaggcctttcgaattggcattactaccatatttctcaaactgtattccctttctcttgaatatgttatgtaattttgtccagaacccagacatgtcaaggtgtcaaatcccacgttttggatactaacgtgtctcattaattcatacagtgggatcattcattaatgcccacattatagactctctctctctctacacacacacacacacacacacacacacacacacactacattcttagaagatcattctgagaccagggtggaggataggctgtgcattcccagtactctttcacagctgactgtgtcctctgccagtgttttcaaactttactgcttatgaaacagctaagggtcttattaaaatttagattctgattcagtagaactgacatggtgcccaaggaactgcatctcttttaaaaaatctttatttaggtataattgacaaaagttgcatatatttaagaggtacaacttgatgttttgatatattttgtttttcatatatgatgtttgatacattgtgaaatggtcaccacaagcaagctaattaagatatatctatctctttgcctagctacctttttttgtggtgagaacatttatgacctactcttttagcaaatttcaagtatacaatattgtttactatagttactatatcgtacattagatctccagaactaatttatcttgcataattgaaattttgtaccctttgatcaacatctccctgcttcccccacaccacagtccctagcacctaagattctactgtctgcttttatgagtttgaccatcttagattccacatatgaggtcatgaagtatttttacttcagtgtcggcttattacacttagcatannnnnnnnnnnnnnnnnnnntaatattttataattgtgggaatattccatcagatatatatatatcagattgtctttatccctccatccatcaatggacacacttaggttgtttccatatcttgactattgtgaatactgttacagtgaacatgggagtgcagatattcaacatactgattttgtatcctttggatatataacagaagtgagattgccagatcacatggtattcatttttagtttttttgaggaacctctatgctgtttttcataatggctgtaccaatttatttttgcagcaacagtgtacaaaggtttccttttctccacattaccaccaacatttgtcatcttttgtctttttgataatagctatttgctatggtttgagtgttttccccaaaaaacatgtgttggaaacttaattcccaatgcgacagtgttgggaggtagggccgaatgggagatgtttaggttatgaggactccaccctcatgaatggattaatgccgattacaaaagcacctaaggctgtgaatttgaattgctctctcttgccctctttttgcccttctgccatgttatgatatagaaagaaggcctttgccagatgctggcctcttgatcttggactgcccagcctccagaactgtgagccaaatacatttctgttcactacaaattactcagtctgtggtattctgtcatagcagcataataaattagagtccataataagttatagtccataacagactaagacactattctaatagatgtgagggaatatctcattgtgttttgatttgcatttcccctgtgggttagtgatgctgagcatcatttatctgttggccttttatatttcttcttttgaaaaattctatttgggttctttgcccatttttaattgggttgtttcttactaatgagttgtttgagtttcttacccattatcagatatacagtttgcaaatattttcatccattccataggttgtcttttcactctgttgattatttcttttgctgtgcagaaagtttttagtttaatgcaatcccagtttctatttttgtttttgttgcctgtgcttttggtgtcatataaaaaaattattgcccaaatcaatatcaggtagcttttttcctgttttcttctaggagttttatagtttcaggtcttatatacaagtgtttaatcaattttgagttgaattttatgtatagtgtgagaaaagggcccaatttctttcttctgcatgtggatattcagttttcccaatatcatttattgaagagactctcttttccccgttgtgtgttcttggcacccttgtcaaaaatctgttgactgtaaatgtgtgaacttatttctgggcttttctattctgttcccttggttgatgtgtctatttttatgccagtaccatactattttgattactggagacttgtagtatattttgaaatcaggaagtatgatgcctctagctttgttcttcttgcttaagattgctttgccaggctgcatgtggtggcccacgcctgtaatcccagcactttgggaggctgaggtgggtggatcacttgaggtcagaagtttaagagcagcctggccaacatggtgaaaccccgtctctactgaaaaaatacaaaaattagccaggtgtggtagcaggcccctgtgatcccagctaatctggaggctgaggtggagaatcacttaaacctgggaggcagaggttgtagtgagccaagatcgcaccactgcactccagcctgggcaacagagcaagactctgtctcaaaaaaaaaaaaaaaagattgctttgcctccttggggtcttttgtgatttcatattaattaaaattttttttttatttctgtgaagaacaccattgagattttgatagggatcacatcaaatctatagattactttgggtagtgtggacattttaacaatactaattcttccaatctaggaatatggaatatcttttatttatctgtgtcttctttaatttccttcataaatgttttctatattttcattgtacaagtctttcatttctttggttaagtctattcctaagtattttattcttttgttgctattgtaaataagattattttctaatttcctttgggatattttatagtgtatagaaacaccactgatttctgtatgttgattttgtatcctgcaactttacagaattcatgtattagttctaacaatttttttttgagtctttagagttttctacatgtatgatcatgtcatctgcaaaaagagataattttactattctcttctatttggatgctttttattttatttattttttaaattatattttaagttctgggttacatgagcagaacatgcagttttgttacataggtatacacgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtctgcatatctgtttggccccagtaccatgctgttttggttactgtagccttgtagtatagtttcaagtcaggtagcatgatgcctccagctttgtccttcttgtccaggattgtcttggctatgagggctctttgttggttccatatgaagtttaaagtagtgttttccaattctgtgaagaaagtcagtggtagcttgatggagatggcattgaatctataaattactttgggcagtatggccattttcatgataatgattcttcctatccatgagcatggaatgtttttccatttgtttgtgtcctctcttatttccttgatcagtggtttatagttttccttgaagaggtccttcacatctcttataagttgtattcgtaggtattttattttcttagtagcaattgtgaatgggagttcactcatgatttggctctctgtttgtctgttattggtgtataggaatgcttgtgatttttgtacattgattttgtaccctgagactttactgaagttgcttatcagcttaaggaggttttgggctgagatgatggggttttctaaatatacaatcatgtcatctgcaaagagagacaatttgacttcctcttttcctatttgaataccctttattgctttctcttgcctgattgccctggccagaacttccaatactatgttgaataggagtggtgagagagggcatccctgtcttgtgccagttttcaaagggaatgcttccagtttttgcccattcagtatgatattggctgtgcgtttgtcataaatagctcttattattttgagatatgttccaccgatacatagtttattgagagtttttagcatgaaggggtgttgaattttatcgaaggccttttctgcatctattgagataatcatgtggtttttgtcattggttctgtttatgtgatggattatgtttattgatttgcatatgttgaaccagccttgcatcccagggatgaagccaacttgattgtggtagataagctttttgatgtgctgctggatttggtttgccagtgttttattgaggatttttgtatcgatgttcatcagggatattggcctgaaattttctttttttkttgtgtctctgtcaggttttggtatcaggatgatgctggcttcataaaatgagttagggaggattccctctttttctattgtttggaatagtttcagaaggaatggtaccagctcctctttgtgcctctggtagaatttgtctgtgaatccgtctggtcctgtactttttttggttggtaggctattaattactgcctcaatttcagaacttgttataggtctattcagggattcaacttcttcctggcttagacttgggagggtgtatgtgtccaggaatttatctatttcttctagattttctagtttatctgcatagacgtgtttatagtattctctgatggtagtttgtatttctgtgggatcagtggtgatatccccaatatcattttttattgcatctatttgattcttctctcttttcctctttattagtgtggctagaagtctatctattttgttgattttttcaaaaaaaccagctcctggattcaatgattttttgaaggtttttttgtgtctctatctccttcagttctgctctgatcttagttatttcctgtcttctgctagcttttgaatttgtttgctgttgcttctctaattctttaattttgatgttagggtgtcaattttcaatttttcttgctttctcttgtgggcatttagtgctgtaaatttccctctaaacactgctttaagtgtgtcccagaaattctggtacgctgtgtcttcattctcattggtttcaaagaacatctttatatctgccttcatttcattatttacccagtagtcattcaggagcaggttgttcagtttccatgtatttttgtggttttgagtgtgtttcttaatcctgagttctaatttgattgcactgtggtctgagagactgtttgttatgaattcccattcttttgtatttgctgaggagtgttttacttcgaattatgtaatcagttttagaataagtgtaatgtggtgctgagaagaatgtataatctgttgatttggggtggagagttctgtagatctctattaggtctgcttggtccagagctgagttcaagtcctgaatatccttgttaattttctgtctcattaatctaatattgacagtggggtgttaaagtatcccactattattgtgtgggagtctacgtctctttgtatgtctctaagaacttgctttatgaatctgggtgctcctgtattgggtgcatatgtatttaggatagttagctcttcttgctgcatttttccctttaccattatgtgatgctcttctttgtctcttttggtctttgttggtttaaagtctgttttatcagagattaggattgcaactcttgcttttttttttgctttccatttgcttggtaaatattcctccatccctttattttgagcctatgtgtgtctttgcaagtgagatgagtctcctgaatacagcatactgatgggtcttgactctttatccaatttgccagtctgtgtcttttaattggggtatttagcccatttacatttaaggttaatattgttatgtgtgaatttgatcctgtcattatgatgctagctggttgttttgcccattagttaatgcagtttcttcatagtgtcaatgttctttacaatttggtatgtttttgcagtggctagtaccagttgttcctttccatgtttagtgcttctttcaggagctcttgtaaggcaggtctgatggtgacaaaatccctcagcattcggttgtctgtaaagaatttcatttctccttcacttatgaagctttaagaggtttaattgactcacagttctgcatggctgtcccataagtcccatgttctttcctcaggaaacctacagtcatagcagaaagggaaataggcacatcttacatggcagcaggcaagagagagtgtgtgaaggaggaactgtcaaacacttataaaaccatcagctctcataagaactcactatcaggagaacagcgtgggggaaaccatccccatgatccaatcacctcccactaggtccctcccttgacatgtgggcattatggggattacgattcaaggtgagatttgagtgggaacatagagccaaaccatatcagtatctaaaaggaaaaaccttcagtttttccacatttggttatgatatcagctgtgagcttttcctatatggtctttattgtgttaagttccttctgtatctatcttgctgaaagtttttattatgaatggatatctagttttgtcaaattctttttctgtattgatcgaaataatcatgtgtttttcatctttcattctgataatgtggtatatcacattgattgatttgcccatgttgaaccatccttgcatcctagggataaataccacttgttcatgatgaatgatccttttaatgtgctgttgaatttggttggctggtgttttgttgaggatttttgtatccgtgttcatcagggatattggcctgtagttttctttcttttcttttcattttctttttctttctttttttttttttttttttttgagacagagtcttgctctgtcacccaggctggagtgcagtggtggtatgatcttggctcactacaacctccacctcctggattcaagcgattctcctgcctcagcctcctgagtagctgggactactggaacatgccatcacacccagctaatttttgtatttttttagtagagatgagttttcaccttgttggccaggctggtctcgaattcctgacctcaagtgatttgcctgcttcagcctcccaaagtgttgggattacaggcttgagccaccacacctggcctggcctgtagttttcttttctagtgttgtttttgcctggatatggtatcagggtgatgttggctaataaattgtattttgaagtgttctctcttgtattttttggaagagtttaagaaatactggtattaatacttcgttgaatgtttgatggaattcatccatgaagccattggtcctgggcttttctttgttggaaggtttttgattactagatttaatatccctatttgttgttagtctgttaaggctttctatttctttgttattcagttttggtatgttatatgtttctaggaatttatccatttcctctaggttaaccaatttgttgacacttataatagtcccttatggttctgtctgtttctgtgacatcagttgtagtgtctcctctttcatttatattttatttatatgagtcttctctctttttttcgtagtctagataaggacttgtcaattttgtttattttttcaaaaaaatcaactcttagttttgtcagttatttccaattgtttttttattctcttttttatttatttctgctctagcatttattatctcctttgttctgctacctttgggcttagttttttttttcttctttttgtagttcctggaggtgataagttgggttgtttatttcatatgtttcttctttttaaatataggcatttattgctataaatttccctattagtatgcttttactgcatcctttaagttttggtatattatcaagattttggtttcttctgtgacccaatggtcgttcaagaatgtgttgtttagtttccacatatttgtgaattttcgtgttttcttattgttattgatttgtagtttcaatccattgtggtcagaaaatatacttggtatgatattaatcttcttaaatttattatgacttgttttgtgacctgaaaggtgatctgtcctgaagaatgttttgtgtgtgcttgataattctactgttgggtggaaagttctgtatatacattttaggtccattgggtctattttattcttcagttctgttttgtccttattgattttctgttgggatgatctattcattatagagagtggagtattgaagtcaactatattatattgttatctatttctccttccatgtctgtcaatgtttgctttatatatttaggtactttcgtgttgggtacatatatatttataattattacatcttcctgttcaagtgacccttttattatataatgaccttctatgtctcatgtcacagttttttacttaaagactattttttctcatacaagtatagccacccctgctctcttttggttacagtttgcatggcataactttctccaccccttcactttcagcctatgtatgtccttaaatcaaaagtgagtctgttatcaacaacatgtagttgggtcctgtttatttttgtttcttacttcccatctctgaattgttggctttttaaaaagcccattcagttactctgtgtcttttgactggggagtttagtcaatttacacttaaagtaattattgataggttaggactttctgttgccattctgttaatagttttctgttttgtagttttcttgttcctttcytctttttctttctttgtggtttgatgatttttgcttggatgtgttttgattcttttctctttatcttctgtatatctactgtgtgggggggcggtcgggggggttaccacagggatcaaattgaacactttatagttatggcagtctgttttaagctgacracaccttcaatcacatacagaaactctatactttactcattccccccgccacaactttatgtaatcgacgtcatattttacttccttctatattgtgtttccattgacaaatttctgtcactatagttactattactatttttgtcttttaatttataaattaatattaatagtgatttataacaatcattatagtgttacaatagtctatgtttctctttatatttacctttagcagtgaaaggattcatatgcttttgtgttactgttttttttttatttcaacttgaagaactattagcacttcttataaggcaggtctcatggtgacaaaccccctcagtttttgtttgagaaaggctttatctttgtgttcattcttaaaggacagtttttccagataaagtattgttgattggatttttttctctcagtactttgaatatatcatcccactctttcctgacctgcaaggtttctgctgagatatccactcatagtcttatggagctcccctataggtgacaattcactttcttcttactaccccaaaattctcttttgtctttgttgaaaatttaattataatgcatctcactgtagacttctgtgggtttaatgtatttggttatctttgggcttaatgaatccagatggcacttcccctccatagatttggggagttctcacctattatttctttaaataagtttcctttctctctctcttctccttttaagatttctataatgcatctatcattttgcttgatgatgtcccataagtcctctgttcttccttcactctttctcattgttctttttattccgctaactagataatttcaaatgacttgtcttcaagtttacaaattctttcttctgaatgattgagtctgctattaaagatcgctattaaattttttagttcagtcattcttcagctatattcagcaatattctttagctacaggatttttatttggttcttttttatggtttttatttctttattaaacttctaatgttgttcatgtattgttttcctcattttgttagtcgtcttcctgtatcctcttgtagctaattgagcttctttaaatgattattttgaattctttgtcaaaaatttcatgaatctccatttcttcagggttggttactggagctttattagttccctttggtgatgtcatatttgcctgattcttcatgatccacatagcctagcattggtatctgtgcattggagtgagctgacacctcttctggtctgaagttgggtactcagacaatgggcccattaccagggctttggataggtgtagctctcactgggtccttgagtgggcaggactgcctgcagaccatgatgcagtgggcctggagctgggtcaaagggctgcttcagggtccccacttgggcccacagtcagtgggcctgttatgggggcacaggtaagtgtggattcaggcaggactgtctccagaacatggtacagcaagactggagttggctcacagggttacttctgagtcyacagtcaggtctagttggtgggcctgcttccagaggtggactggcatgactcccacctgtttcctaagtaggcaaaacttccccaagaccatggtagtgtggtactgaagctgctttaggtacagggctgcttcagagtccacagttgggagccctgttactggggttgccaatgggagttgctyctcccagattcctgggcagatagggatagtggtaggaccacatacaaacaactctggagctaagtccccagggtggtgggctgcttctgggtccacaaccagaactacagttgacaggcctgccgctagaatgtgggcctgccttattaaagtattcatctttgttcttgagctctaccagggtttctcaacctcctacctgaatcccaaggctcccacaaagacacttttgtccatagatcattgtcaaattattgttcctgtgggggaacaagagctagggacctcctatcccatcaactcactgataccgttctcctgatgctgcattttgaattgccctcaggtgatgctgctactcctggtctgtggaccatgctggagtagcagagcccaaatggcttcctcaacttttatgagccttttacaggaactcaaagtagaaaataacttcacttgccccagacctaataatttcctttgttcccacttcttcttggtgctttcctcctttgtgtctaccatcgtaacatccatctaaccatagttgtcttatgtagatgttggatgctgttgagaaacgcacaaagcaaattagaaggaagatatgattgacagaaattgctttttactctgtattcactttccatgtatttgtgctaatctctccatacaggtcttctttggcaatgtggattcatctgggataaaacacratatttttaaccctccaattattgctygatacatcyrtttgcaccvarytcattatagcattykcagcactcttcgcatggagtbgatgggctgtgatttaaatagtaagtgccaagtcatcccatatccttcttccctcaaccatgggtagggtgactaactgttctagttatcctgagactgggggaggggttcccggtatcaggacacaaaattgtcagtgctaaaaccagcatagtcctgggcaaacccagaaataccattcaacccagcagtcccatcactgggtatataatcaaaggaatataaatcattctgtcataaagacacatgcacgcatatgttcatttcagcactattcacaatagcaaaggcatggagtcaacctaaatgcccatcaacaacagattggataaagaaaatgtggtacatacataccatggaatactatgcagccataaaaaagaatgagatcatgtccttttcagcaacatagatgcagctagaggccattatcataaatgaactaatgcaggaacagaaaaccaaatatcatgtgttctcataagtgggagctaaacattaaatgcacatggacacaatgatggacactcaggaggggagaggttgggaggggggtgtgggttagaaggttatgtattgtgtactgcactcactacctgagtgaggggatcattcatacaccaagcctcagtgacatgcaatttacccatgcaacaaacctacccatgtacccctagaatctaaaataaaagtagaagaagaaaagaaacaaagaaaattaaagagtcacacaaagtgggaagagctggctggaaaacagatagcaataacagaattggccgggcgtggtggctcacacctgtaatcccagcactttgtgaggccaaggcgggtggatcacgaggtcaggagatcaagaccatcctggctaacatagtgaaaccccaactctactaaaaatacaaaaaattagccgggtgtggtggtgtgcgcctgtagtcccagctactcgggaggctgaggcaagagaatcgcttgaactcgggaggcagaggttgcagtgagctgagatcatgccactacactccagcctgggtgacaaagcgagactccatctcaaaaaaacaaaaacaaaacaaaacaaaacaaaaaaccaataacagaatctgtgcaaaagttaaaacctgagaaatgatattatgatgacagtagccctagaatatcagtggaagctgctcagtataactgaggctgaagcatgtccttgtgataaccttcttttttcttttctttgagkttgcagcatgccattggkaatggagagtaaagcaatatcagatgcacagawtactscttcatcctaytttaccaatatgtttsccacctrgtctcyttcaaaagctbnacttcacctccaagggaggagtaatgcctggagacctyaggtaagaggcaacagatttactgtttaactgactcagagcagtggttggggaaaaaatckgggaaggccttgactgtttcttctgaggtatttctgtcaactgttagttctaaaaagtgtgtcaaggaagtttggttatgggcagacaaccacacaggcatttgggggaaatgatctctaattgaacctcctggaagaagaatctctatatctagtactgagctaatatctgtcaaagaattgtagaagctaaagtccattttacagataaatatcaacaattagctttctttccaggtttctcattacatcaatgaaaagtaaacatttactgcacatcttagtatccctaggatgagcctagggatacaaaggtgaattgtgaaaaattttggccctgaagttgcttagagttgaataagagagactgactagccaatagaaagtggaggctgggtgcggtggctcatgcctgtaatcccagcactttgggaggctgaggcgggccgatcacaaggtcaggagttctagatcactcttttgctgaggcaggataatcgcatgaacctgggaggcggaggttgcagtgagctgagatcatgctattgcactccagcccaggcaacagtgcctgactctgtctgaaagaggcagagagagagagagagagaaagaaaggaaagaaggaaggaagaaaaagaaagaaaggaaggaaggaaggaggccgggcagagtggctcacgcctgtaatcctagcactttgggaggcctaggtggcagatcacctgaagtcaggagttcaagaccagcctggccaacctggtgaaacctcatctctactaaaaatataaaattatctggacatggtggtgggcacctgtaaccacagctactcgggaagctgaggcaggagaatcggttgaactcgggaggcagaggttcagtgagctgagatyatgccattgcactacagcctgggtgacagagcaagactccgtctcaaaaaagaaagtagagtgagaagtgctgtggtatggttaagagggatttgggaatttctgggagtaaatggtgaccaagaggctactagtccaactctattgccctcagrtgaataatccaaaagagtskctgcaagtggacttccagaagacartgaaagtcacaggagtaactrctcrgggagtaaaatctctgcttaccagcatgtatgtgaaggagwkcctcayctccagcagtcaagatggccatcagtggactctcttttttcagaatggcaaagtaaaggtaagctggtctccttggaaagaaagaaagaaagaaaaaaaataccacctctcctagagcttaacataacataaaaaggttgatatatgaccaaattttcagagcaaaatttattaagtacctatggtagcaagacattgtaaaaggcattctgagagaacacagtgactttaagaaaaaggyaaaatactgagaaaagggcagagtagatccaagagttaattctcctcatcagcaccttgattcccaagcctttttgacctttaagtttagtggtccaggaagtcttcattcttaatctgggtttgctggataattcaacaaattgtcctgattaaaagacatgacataaagtcttatcaccccatgagtaatgggggaaggaatagttcctctctttggtattttttatattcttttttcaccaagaattaaccatgatgtggtccttaccaatctctctaatacagtctcttgccacttggctctttaagctccatccatactaagaaattctcaggtcactaaatacagccattatatctcataccaggcttttaaatagatactatttcttctacctggaacatttttctagctaccctctactgccactttcacctgactcattcgttaagtctcaggtaaacatcatgtccaagaagaattcccttatccatcaaggctggatgaaagacttcaccaaactggcagtttggtgaactgaagtctagacattggatattctagaagaaaaattcccatttaaaaaaggttatatctctgattagtgccacaacatgatgaactttcaaaatatgctaagtgaaggccgggcgcggtggctgatgcctgtaatcccagcactttgggaggctgaggcaggcagatcacgaggtcggtaaattgagaccatcctggctaacacagtgaaaccccatctctactaaaaatacaaaaaattagccaagcgtggtggcgggtgcctgtagtcccagctactcgggaggctgagacaggagaatggcatgaacccgggaggcagagcttgcagtgagccgagatcgcaccactgcattccaacctgggcaacagagtgagactccatctcaaaaaaaaaaaaaaargaaaatacgctaagtgaataggccagacataaaaggatagatattatatgattctacttatatgagtgtgttagtcagggatatccaaagaaatagaaccaataggagattctgtctgtctgtctctctctctctgtctctctggatgagctaaactgttttagttcaagactgaaagcaggaaaaagctgatgttccagtccaaaggcagwcaggcagcaagaatactttcttacttggggaagactcagtctttttgttctattcaggccttcaactaattggatgatgcctcccacattagggagagcaatctgctttactcagtctactgacttcgatgttaatcccattcaaaaacaccttcacagaaataaccagaataatgtttgagtaaatatctgggcaccttatgaccaagtaaagtagatacataaaattaaccatgacaagtccaccccttgtcaatgtagcacccatcatacacatctcctttatctctaagtagagacaaaaatgaggtcataattccacctaacatgatataacaaaacttggctggtattgataactaccttcttctactacccattctgtattgactttgccttcagcaagcatctcagctgattgtggttctttacctgatgaggtgacccaaacctttattcctgaagagcctgggccactagtagtcctgcatggattgggttgctgtagtttcccattgaccagaatcatagggcctggtaatactaagagacactctaagggatctattgtattccagacacactcttccatacctccattgtgaagcagtagttcagtttccttccaggaaggacaaaacgctgccccttccatgatgaacatattccaatgtaatcaacctgctgccagatagctggctgatcatcctgggaaatactgccatactgaggactctgtgtttgtctctactgctggcagattgggcacttagcagtggccatagccaggtcagccttgttgaatagaagtccatgttgctgagcccatgcatagcctctatccctgccaccatggctactttgttcatgagcccatcaggcagtgacataggtggctgagtaaaaaggatgactggtatccacagaacaggtcatcatatctactttttttttgagatggagtcttgctctgttgcccaggctggagtgcagtggcacaatctcagctcactgcaacctctgcctcccaggttcaagcatttctcgtgcctcagcctcccgagtagctgggactacaggcacgcatcaccatgcctggctaatttttgtatttttagtagagacagggtttcaccatgttggccaggctggtcttgaactcctgacttcaggtgatcctcccgccttggcttcccaaagtgctgggattacaggcgtgagccactgcacccggcccatcatatttacttgattattgaaatccttatctgctgaggtcacccttcgttgagcactcacatgggacataaatatattcacatcctttgcccattcagagagatctgtccacatacctcttccccaaatttctttgtcacctgttttctaatcatgttccttccaagtccctatctggacaaagcactgactacagmccattacttgacatataattgcacacctggccatttctccttctaagcaaagtccacaaccaggtacactgcctaaaattctgcccactgtccttcatgggtatctcagatcgggactgtccacttttgtgtagtacctgcatatcgtgcagaaccgtctgtaaaccaggcccaagactcctcttcctctgtaaactgatcatagggaactcccaatggggccataagtgcaggctgggagagagaaggcagggtagcagaaacaggcaccatggacatttgggctacttcttcatgtaatttacatgtgttttcagtacctgctcagacatgatcatgtatataccacttccatttgatgatggagtgccattgttcatacccaactttatggcttggtgggtcagataacacctagttcatgatgggcagttcaggtcacatggcaacttggtggtctgtggctaagcattcagtatctactaaggcccagtagtaggccaagagctatctcacaaaaggagaacagttattcacagaggattacaggaggatttctcactacagtagcccctgctccataggtcagggaaccaatgtgaagatcctgctagctgctcaatatatctgttccaattacgcattccaggactggggaaataaccacaagatagtctcacagatcctctgcatccactttgagatggacttgagctaaaattccattgatcatttgaccctccataagcccatactctgactggtggaccacagtgacattttgggtctcctgaaattagtgccagttcagagccattgtccagtagtccctgaaaggtctgattaattatttttcttcagtgcacatttattctgatagaaaggccatatgtccctttggggaaggctgagagaaagagtggcagtattcttggcagtgtaccagagtccttcctcaaggagactgagcctccccttcattcaaggagtgctgggtctgtaaacctgctcaagtctgggaattgattgagaggccgtgactctgtttttattattcaggttagacttttgttcacttgacctagaacttttccacttatgcagttcaagaatttggtaggcattctatctatatcacatctaggaacactataatctactagccaacaccataggtctgtgcaagtcatactattctaactgctgctttgactctgctgtcccttatggtaaccacacttaccttgcctttggcagttgagtgctgcccattggccccttccaccccaggatccaattattcccattgtatttaggttttctaattcagtgactgcaggtcctgctgtaaggtgtcacctacagagaagagtgatcacagagcccttcaaggatgctgaggttcccctcacaaatttattcctcaaagtaatagtgagatctgggtcttctgaactctcccagtgttggtgagtatgtcttaaatgacaaattcactctagcatttcaatctcctttcttctacattaaaccagggcaagtctgaaatttctagtttgctcactgtgggccatcttttggtctgtgtttcagccaaccaattaaactgttagaggccttcctaattccctgagatgcaacattaagtccagaatctctgcttagtgggcccatgtcaataaatttggcctaatccaactttacgtgccttccaccgttatctcacatccttagtacccattcctatacatattctctggattcctgcttgtgtaaattagaaaactcaagtcatgattttggagtgtagtgcaccttgtcatgggtcacyttcatacctcacytcgcctgmtgggacttgagtgtagttatagatctaataacaaagaggggtggtagggtgggtcctgaagggaatcagcattatcttgcatggcagttgcctcaggggaagccattacagtttcctcaggcagtgcagggttaatccacttagactggagtagagatactgccaccacagggctggagagaaaactttcactgacaaagaagactcatcaatatttaggagctcaatgtccccagcttaatcagggtcttccacacatacctaatccaacttgtagtgccccattctttcccaatcactgcccttgctttaacagtagacaccctgcaaagctgggagtttggcttgctttgtaattcagttagtcacaggatgagatttggcatttgattttcagcaatcctcagctctgtggctacagtagataagggtctccttcagggcatacatagaatctgtcaagtcatttatgcagctcttgagctgggaattcaaattcctgagctcctccttttctttcatcactttttccagcaacattaggagcaaccgactaatcccatcatattcattagtttgacaaatatgttcacaagtgtcaatatacatagtcaccaagacccttgcttcttaaaagtagttgattaggagtatccaatggagatattttgcatatacatattttttgagatggagtctcgctctgtcacccaggccggagtgcagtggcatgatctcagctcactgcaacctccatctcccaggttcaagcgattatcatgcctcagcctcccgagtagttgggattacaggcacctgcctaatttttgtgtttttagtagagacagggtttcatcatgttggccaggctggtctcgaactcctgacctcaggtgatccatccacctcggcctcccaaagtgctgggattacaggcgtgagccaccgcgcccagcctggcctacatatttctattgccagatcatgccatggacaatttttactactgaaaatagtcattagtgtctttaaatttcatcaggttacagaaccaattccagaaatccaataacaaatttataaaatttatccttaaaattctgttcctttagaatcactcttggtgtgaaaatctgtattagtcatggttcccaaagaaacaaaaccagaaccaagaggagatacatacacacacacacacacacacacacacacaaggaattagctcatgtgattatggagtctgccaagtctcaagatctgcagggtgagttggcagcctagagaccccagagagctgattcgtagttccagttcaaagaccagcaggctacagacccagaaagagttaaaatgttttagttcgagcccaaaggcaggaaaaaaactgaagtcccagtttaaaggtagtcaaatagaaggaactgtctcttactaagaggacagtaagcctttttgttatatttaggccttcaactgattggataagttctacccacactggggagaacaatctgctttacttagtctaccaattcamatgttaatctcaccaaaaaacactctcacagacacacataaaataaagtttaatcaaatatatgggcaccccatggcccagtcaagttgacacataaaattaaccaccataatgaggtatctagagcaggcaaattcataaagacagaaagtagaaaagaggttaccagggtcttggaatggggaagaaatggagagttatttttaatgagtacagagtttctgtttggggtgatgaaaaagttctggaaatggatagtggtaatgggtgcacaatattgtgagtatacttaataccactaaattgtacacttaaaaatgattaaaatggtaaattttatgtatattgtacaacaataaaaaaggctatatcactgacaatgcattgttgtatttagcaaagaaaggggaatctccagcctccccatcaacaaaaacccccacaaacttctattttaaaataatgagctgaaatcatagcggagaggtgaataatgagcaaatataaaaaggaagacctttcctcagacagaatgcccatattaatgttgttactggaagactaagccttgagcaaaatgcaaggagaactcagtgtgagaattctgcattgtcatgaatcccagaaggaagctagagaagttgcagataaatattatcctctggcacctggaagaaccattctcaacctactctagaaaaaaagcacctccagtttaggcctccaggattcctacatattaaaattataagatcacagacatagatcagcaaacatgcaagacaacaagacaacttgagtacaagtgaacagaaacaatcaattcagatttaaaacttgaagaacaccagatattgacattatcggatacataatatgaaataattatgtataaaatctttaaagtaataacatatggaaacatgaaaataaaagacaaattatccaacattattaggcagttgaaaaaaaccattgcaggttacaaagtcaacatgcaaaaatcaattgtatttttatatactaacaattacaaatatgaaaaggaaaacagaaaagtctatttacaatagcatcaaagataatacaatatttaggaataaatttaacgaaggaggtgcaagtcttgtccactaaaaacaaaaaaacccagttgaaagaaactaaagaactgtctggtctgaagacagcaaatatggaaaattagcaactagaaaaaaattaaaaattaaaaattaaaagagaaattaaataactaaataaatgaaaaggcatcctggatttatggatttgaagacataatattcttaagataagaatattaccacaaaccatttgcagattcaaagcaagcattctgggtttttttgtttgtttgtttgttttttgatttgagacggagtctcactctgtcgctcaggctgcagtgtggtggtgcaatctccactcaccataacctctgcttcctgggctcaagcgattctccrgcctcaaagcattctctatcagaatcccaaaracatttttttttttgaggaatagaaaaatctatcctaaaattcagatggaatttcaagggaccctgaatagccaaaacaatcttgaaaaagaacaacgttggaggagtcatacttcccaatttcagaacttactacaaagctacaagaatcaaaacagggcagtacttacataaatatagacacatagatcaatggaatagaattgagagtccagaaataagcctatacatctatggtcaattgattttcaataaaagtgccaagaccattttgtgggaaaagaatagtctcttcaacaaatggtgctgggacaattggatatccacatgcaaaagaatgaagttggatctttaccatatacaaaatttaactcaaggctggatgtggtggctcacatctgtaatcccagcactttgggaggctaaggctggtggatcacttgagctcaggagtttgagaccagcctgggcaacacagtgagactctgtatctacaaaacaagaaaaaaaaattagctggcatgatggtacacacctgtagtcccagctactagggargctgggataggaggatcgcttgagcccaggaggtggaggctgcagtgagccatgatygcaccactgcactccagcctgggtgtcagagcaagaccctgtctgtaaaaaatcatttaactaaaaatgtatcaaaaaactaaatataaaagctaaaaccataaaactgtaagaaaaaacaaagaggtaaattgttatgatactggatttggcaatggtttcttagatgtgacaccacaatcacaagcaacaactctataaaaatatatatagtaggcatctttaaagttaaaagcttttgtacatcaaagaacactatcaagaaagtaaaaagatgatctacagtataggagaaaaaaattgcaaatcatatatctgataaagggcctagtatcccagaatataaaaagaactcttacaactcaacaacagaaagacaaccaaattttaaaatgggtaaaggacttcaatggaacttctccaaagaagatatacaaggatccaacaaactcatgaaaagatagacaacatcattagttattagggaaatgcaaatcaaaaccacaatgagatagcatttcaaacctgctaggatggctaaattaaaaaaaaaacaaaaacaaaatgtcaagcgggaaaataasaagtgttagcaagaatataaagaaattggaaccttccttgatgatgagaatgtgaaatagggcagccactgtagaaaatattttggcagttcctcagtaaggaaaacatagaattaacatagacccagcaattctactcctgggtgtggacccaaaagaattaaaagcaggcactctaacaaaaactaatatacaaatgcatatagaagtactattcataatagcaaacaggtgaaaacaattcaaatgttcatcaagtgatgaacagataaacaaaatgtggtctatccatatatggactattatttattcataaaaaatcaaagtactgatccatgctaaaacatggatgctccttgaaagcattatgctaagtgaaagcagccaggcacaaaaggccacattccacttatatgaaatacccagaatagcaaatccatagagacagaaaacagattagtggttgccagaagctggcagaaggagtgaatgtggagtggcttcttaataagtattgaatctccttttggggttatagaaatgttctggaactagatagtggtgatggctatataacattgtgaatgtactaaatggcactgaacttcacactttaaaattgttaaaatggtaaattttatgtttgcgaattttgcaatagataagtcagaagacatgtacattaccataatgagtaacaaactgacagctgatttctaaataatagcaaatatcagaaaataatgaatgatgtcttcacaatgctaaaataaacaatgtgaacccctctctcaaaaagaaaacctaatgaaaatatcttttatgcgttaaagcaaaagaggaaattaggacacagacaggcacagagggacgaccayatgaagatatasaaagaggacagacacctacaagccaacgagagaggccttacaagaaaccaacccttagccaggtgtggtagtgtgcacttgtagttcttgttacaagggtgcagtgagctagggttgtgccactgcactccagcctgggaaacagaacaagaccctgcctctaaaaaaaaaaataaagagaaggagaagaagaagaaaaggaaaagaaaaaaaaaaagaaccaagcctgctggccaggcgtggtaactcatgcctgtaatcccagcactttggaaggctgaggcaggaagatcatctgaggtcaggagttcaagaccagcctgcccaacatggtgaaacccccctctactaaaaatacaaaaattagctggacatgctggcatgcgcttgtaatcccagctactcgggaggctgaggcacaagaattgcttgagcccaggaggcagaagttgcagtgagcccagatcgcgccatcacattccagcctggactacagagggagactccatctcaaaaaacaaacagacaaaaaaaaaatacacacacacacacacacacacacacacacacacacaaaacaagcctgcctaccccttgatcttggacttgtagcctccagaactgtgagaaaataaatttctattgtttaagccaggtgtgcgtgtgaaaatttagaacatatgacaacagcaaaaaagtcagcatgtggataaatagaataaaggattctaaaatccatgtattatctaggaggtaaagatgttaatattaaaccttcataatttgattaatgttgtagtttataggatagccagtaagtaatagaaatacacacaatgtaagactcccaaaatggtagaagaaaaaatatgaaaggataaaatatactcarcaaacctaaatgaaagcaagcaaagagagataaagaaacataaaacaggtaggaaaaatagcaagataagatggtatatttaaattgaaatataacagtaatcatatgtaatatgaatggaccaaatatttcagttaaaagacaaagattgtcagattgataaaaaagcaaaagtagctgggtgtgatggctcacacctgtagtcccagctacttaggatgctgatgtgggaggatcacttgagcccaggaggttcagcctggacaagatagtgagacttgtctctttaaaaaaaaaaaaaaaaaagcaaaagtaaattgtgtgcattttatgagtcatatctaaaacattagatacagaaaagtagcaagacaaaaatgggaaaagaaattatgcaaatatctaaaagatatcgattacagctctattgatagcagaaaaatagactttaaagcaagaaagtattgctgaagattaagaatgtgatttcatggctggacgcggtggctcacacctgtaatcccagcactttgggaggccgaggcaggtggatcatgaggtcaggaaattgagaccatcctggctaacatggtgaaaccccrtctctactaaaaaaaaatacaaaaattagccgggtgtggtggcggacacctgtagtcccagttactcaggagggtgaggcaggagaatggcgtgaactcgggagrctagattttaacacatctctcgtcaattgatggaacaatgtatagaaatagaacaattaacatgattcacaagtttgatcttatagacatatttagaaaatagcaccttgaaattgcaaaattacaagggtggttccaacatggccgaataggaacagctccagtctacagctcccagcatgaatgacacagaagacaggtgatttctgcatttccaactaaggtaccaggttaatctcactgtggcttgtcggacagtgggtgcaggacagtgggtgcagcccaccgagcatgagccgaagcagggtaaggtatcacctcaccygggaagcacaaggggtcagggaattccctttcctagccaagggaagctgtgacagatggcacctggaaaattgggtcactcccatcctaatactgcgcttttccaatggtcttagcaaacggcacaccaggagattatatcctgcacctggctcagagggtcccacacccacggagcctcgctcattgctagcacagcagtctgagatcaaactgcaaggtggctgcaaggcagggagaggggcacccgccattgctgaggcttgagtaggtaaacaaagcggccaggaagctcgaacttggtggagcccaccgcagctcaaggaggcctgcctgcctctgtacgctccacctttgggggcagggcaaagacaaacaaaaagacagcagtaacctctgcagacttaaatgtccctgtctgacagctttgaagagagtagtsgttctcccagcacagagtttgtgatctgagaacggacagactgcctcctcaagtgggtccctgacccccgagtagcctaactgggaggcacgccccagtaggggcagactgacacctcacacagctgggtacccctctgagaccaagcttccagaggaacgatcaggcagcaacatttgctgttcagcaatattcgctcttctgcagcctctgctgctgatacccaggcaaacagggtctggagcggacctccagcaaactccaacagacctgcagctgagggtcctgtctgttagaaggaaaactaacaaacagaaaggacatccacaccaaaaccccatctgtacatcaccatcatcaaagaccaaaggtagataaaaccacaaagatggggaaaaaacagagcagaaaagctgaaaattctaaaaatcagagtacctctcctactccaaaggaacgcagctcctcgccagcaacggaacaaagctggacagaaaatgactttgacgagttgagagaagaaggcttcagatgatcaaacttctctgagctaaaggaggaagttcgaacccatcacaaagaagctaaaaaccttgaaaaaaaaggttagatgaatggctaactagaataaccagtatagagaagtccttaaatgacctgatggagctgaaaaccatggcacgagaactatgtgacgaatgcataagctttagtagccgatgcgatcaactggaagaaagggtatcagtgattgaagatcaaatgaatgaaatgaagcsagaagagaagtttagagaaaaaagaataaaaagaaatgaacaaagcctccaagaaatatgggactatgtgaaaagaccaaatctatgtctgattagtgtacctgaaagtgacagggagaatggaaccaagttggaaaacactctgcaggatattatccaggagaacttccccaacctagcaaggcaggccaacattcaaattcaggaaatacagagaacgccacaaagatactcctygagaagagcaactccaagacacataactgtcagattcaccaaagttgaaatgaaggaaaaaatgttaagggcagccagacagaaagttcgggttacccgcaaagggaagcccatcagactaacagctgatctcttggcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcttgccctacaagagctcctgaaggaagcactaaacatagaaaggaacaaccggtaccagccactgcaaaaacatcccaaattgtaaagaccatcgatgctaggaagaaactgcatcaactaatgagcaaaataaccagctaacatcataatgacaggatcaaattcacacataacaatattaaccttaaacataaatgggctaactgctccaattaaaagacacagactggcacattggataaagagtcaagacccatcagtgtgctgtattcaggagacccatctcacatgcagagactcacataggctcgaaataaagggatggaggaagatctaccaagcaaatggaaaacaaaaaaagaaaagcaggggttgcaatcctagtctctgataaaacagactttaaaccaacaaagatcaaaagagacaaggccattacataatggtaaagggatcaattcaacaagaagagctaactatccaaaatatatatgcacccaatacaggagcacccagattcataaagcaagtccttagagacctacaaagagacttagactcccacacaataataatgggagactttaacaccccactgtcaacattagacagttcaacgagacagaaagttaacaaggatatccaggaattgaactcagctctgcagcaagyggacctaatagacatctacagaactctccatcccaaatcaacagaatatacattcttctcagcaccacatccaaaactgaccacatagttggaagtaaagcactcctcagcaaatgtaaaagaacagaaattataacaaactgtctctcaggccacagtgcaatcaaactagaactcaggattaagaaactcattcaaaaccgctcaactacatggaaactgaacaacctgctcctgaatgactactgggtacatagcgaaatgaaggcagaaataaagatgttctttgaaaccaatgagaacaaagacacaatataccagaatctctgggacacatttaaagcagtgtgtagaggraaatttatagcactaagtgcccacaggagaaagcaggaaagatcaaaaattgacaccctaacatcacaatttaaagaactagagaagcaagagcaaacacattcaaaagctggcagaaggcaagaaataactaagatcagagcagaactgaaggagatagagacacaaaaaaccctttaaaaaatcaatgaatccaggaactggttttttgaaaagatcaacaaaattgatagaacactagcaagactaataaagaagaaaagagagaagaatcaaatagacgcaataaaaaatgataaaggggatatcaccaccaatcccacagaaatacaaactaccatcagagaatactataaacacctctatgtaaataaactagaaaatctagaagaaatggataaattcctggacacatacaccctcccaagactaaaccaggaagaagttgaatccctgaatagaccaataacaggctctgaaattgaggcaataattaatagcttaccaaccaaaaaaagtccaggaccagacggattcacactcaaattctaccagaactacaaggaggagctggtaccattccttctgaaactattccaatcaatagaaaaagatggaatcctccctaactcattttatgaggccagcatcatcctgataccaaagcctggcagagaaacaacaaaaaaagagaattttagaccaatatccctgatgarcattgatgcaaaaatcctcaataaaatactggcaaaccaaatccagcagcacatcaaaaagcttatccaccatgatcaagtgggcttcatctctgggatgcaaggctggttcaacatacgaaaatcaataaacgtaatccagcatataaacagaaccaaagacaaaaaccacatgattatctcaatagatgcagaaaaggcctttgacaaaattcaacaacacttcatgctaaaaactctcaataaattaggtattgatgggacgtatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaagaaataaagggtattcaattaggaaaagaggaagtcaaattgtccctgttcgcagacgacatgattgtatatctagaaaacaccattgtctcagcccaaaatctccttatgctgataagcaacttcagcaaagtctcaggatacaaaatcaatgtgcaaaaatcacaagcattcttatacaccaacaacagacaaacagagagccaaatcatgagtgaactcccattcacaattgcttcaaagagaataaaatacctaggaatccaacttacaagggatatgaaggacctcttcaaggagaactacaaaccactgctcaatgaaataaaaggggatacaaacaaatggaagaacattccatgctcatgggtaggaagaatcaatattgtgaaaatggccatactgcccaaggtattttatagattcaatgccatccccatcatgctaccaatgactttctttacagaattctaaaaaactattttaaagttcatttggaaccaaaaaagagcccgcattgccaagtcaatcctaagccaaaagaacaaagctggaggcatcacrctacctgacttcaaactatactacacggctacagtaaccaaaacagcatggtactggtaccaaaacagagatatagaccaatggaacagaacagagccctcagaagtaataccacacatctacaaccatctgatctttgacaaacctgacaaaaacaagaaatggggaaaggattccctattgaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaagaacttcatgtctaaaacaccaaaagcaatggcaacaaaagccaaaattgacaaatgggatctaatgaaactaaagagcttccgcacagcaaaagaaactaccatcccagtgaacaggcragctacaaattgggagaaaatgtttgcaatctattcatctgacaaagggctaatatccagaatctacgaagaactcaaacaaacttacaagaaaaaaagaccccatcaaaaagtgggtgaaggatataaacagacacttctcaaaagaagacatttatgcagccaacagatacatgaaaaaatgctcatcatcactggccatcagagaaatgcaaatcaaaaccacagtgagataccatctcacaccagttagaatggcgatcattaaaaagtcaggaaacaacaggtgctggagaggatgtggagaaataggaacgcttttacactgttggtgggactgtaaactarttcaacaattgtggaagacagtgtggcgattcctcaaggatctagaactagaaataccatttgacccagccatcccattactgggtatgtacccaaaggattataaatcatgstgctataaagacacatgcacacgtatgtttattgcggcactattcacaatagcaaagacttggaaccaacccaaatgtccatcaatgatagactggattaagaaaatgtggcacatatacaccatggaatactatgcagccataaaaaggatctgttcatgtcctttgtagggacatggatgaagctggaaaccatcattctcaaaaactatcacaaggacaaaaaaccaaacaccgcatgttctcactcgtaggtgggaattgaacaataagaacacttggacacaggtaggggaacatcacacaccggggcctgtcatggggtgggtggacaggggagggatagcattaggagatatacctaatgtaaatgacgagttaatgggtgcagcacaccaacatggcacatgtatacatatgtaacaaacctgcacgttgtgcacatgtacsctagaacttacagtataataaaaaaaaagaaattgcaaaattacacattctttgtaagcacacaaaggaaacatgttagaattttccattttaagctacaaataagctacaaataaagtagtctcaaatttcagataatataaaacatgttttctggtcacaatacaattaaagttgatataaataagaaagataactataaaatcttcctatgttagaatcaagaactatacttttaaacccatgtgtcaaataagaaatcataaattagaaaatattttaaactgaatgataacaaggcatgacatattaaaatgtgggaatcagctaaagcaatatttagaaagaaatgtatagcgttaaaaacatatattggaagagaagaaagcctgacaattaatgagctaaggtatgtctcaagaagctagtgaaacagcaaaataaaccaaaaggaagtagaagcaaggaaataataaagatatgaagtaaatgaagtaaaaaagaaacatacaatagagagaataaagaaaaccaaaagttggttccttgaaaattgacaaacttctggcaagagcaatcaagatgaaaagaaggcacaaataatatcagaaactttaaaaaactggacatcaataaagatcccacaaaaatttctgccaatataaaaatataaaaaatgaggatacttattaatattaaatgttctttcttgttgtatttaccagggattaatccattttacctaattttccaaacttagtgttaaaaggttattaatttaaaaaatccagatccagatggctacactaactatattctaccaatttttcaaaggagaaataatattaaccttgcaaaaattctttcagaaaatggaaaaagatggaatgttattcaattatcttatgataatagcataaccttgacaaccaaaccsaacaagaacaatattagaaaggaagataataggcccgttttattcataaacataaatcccaaacaaaatattagcaatatggatccaaattggatttatgctaggaatgcaagtttggcttatacattagaaaactgatataatttatcacagtgacagactgaaggattatacatattggctgtcctaagcagtgcaataagatgagaaaaagaaggaaaatatgtaaggattgaatatgatgaaacaaactcattgtatgtggaagatatgatggcatagatagaaaatccaaaggaatttatatataaattattagaatttttaaaatttttcaagcttgctgaaaacaaaataaataccaaaattaattgtatttctgtatacctgaaacagttggaaaaatagttttaaatagcatttaaaaattccaagcaggagttgcacattcctgtcagataatggcagctgcctaaatctctccacagtcttcaaaaaccatacatacacatacacacacaattttaaattatgactaaaaccacccataacccatctatagaataaccagaagacaaaaagtactataagtttatatttacaagtagaaaataaatatataaatctagccaaccttgctccagagagaaaccctgtctcaaaaaaaaaaaaaaaaaaaaaaagaagaaagcaaatgttggaaattaactgtcctataaaaacaaaagtgaattactaaatcacaagacccacaaacctctttggtcacatctattaaataaattacacttccatttatcaacagtagagggtactcctggctaagaaacctagtaagccacccagccctcatgtctgcctgcataaatcacctcttattgctgaaacaagaaaatgtaaggaatttctaaatgaacagaaaatagcatatgaagcagatggtattaatgttcttgagtttttattccctctttccttgaaaacctcatcaactttaggcatggccgtacggctcatcttgatcaatagaatgtgattggacatgacatatataccacttccaaatagaagctttaaatgtgattttgtgtttgacacactcttttgtgcctctgctccaggctccagactttaagcctctagaacgataagtgaataaatttcttttgttttaaaggcaccaagtgtgtggtgaatttgttacagtagccctagaaatctaatactaacaaaaagaaygttagagttgaattagaagtgtcagtgagaacttaggaatttaaaaaatcatattcttagcactgttcactgagggaatctagaagtaattacactgcagtaataacgagcccatcccatgcccaaatcttggtctctaactaccattttccagtcaaaagaatctgagctccctagagaaatgactttttcaaggctggatcaaggaaactgccaggcaatcttagatgatcttggtgatcttgatgtgccagaagattaatgggatcatgtgaaaagaacacagaaactggyctgaagggcttcctgttggccagatttgagacaatttgagcatcaaaaggaataatgagggtaatggatcataactggaaaatcagtttgcaaccatcaatgtacttactattgaatacttgtaaagaactttaagggttgctaataccattggataaaagcttgttgtgaaacagaatatttgcatggtctcaaagtctcactccacagattgttaggaaagggaaagggttacctttataaatatagagattaggtggacatcttaaccaagtgatcaaacttagcatcatcaataatgggacaatctggcatcgcatgccccctgatttaatgcagtaaggattaagtctaacaaaagatgtacaaagcctccaaatacagcgtaaacatttgtaaaataatctcagaacagggaccttaatgtttctcaaaaatttttccaaatacagaactttatttctatagatgtttatggtatatttgccatgctatatacattatgctatatattctatgtgctgaagatacaacaatgaccaaggtctttgcccttgtggaactgacatttggtggcgragacagaggaaacagtcaataagcatgtaaagagataaaggaaaagatactgaatgctacaaaggaaacaaataagttgagatttagaacaaaaaagagtcctattttacaagaggaataatgaggaagacctttctaaagaggtagctcagcactttgggaggccgaggcgggtggatcacgaggtcaggagatcaagaccatcctggctaacacagtgaaaccccatctctactaaaaatacaaaaaatgagccgggcatggtggcgggcrcctgtagtcccagctacttgggaggctgaggcaggagaatggcgtgaacccgggaggcggagcttrcagtgagccgagatggtgccactgcactccagcctgggcgacagagcgagactccgtctcaaaaaaaaaaaaaaaaattgaggcagaatttcgctatgttgcctaggcttgtctcaaactcctgggctcaagcaatcctcctgcctcagcctgctgagtagctgggactccaggggcatgccactatgcttagtttaagaggtggtatttaaactgagacccgaagggtaaaaaacatggataaaagaagaaacagaaggggtaagagccttccaagcagagggaatcacatatacaaaggctctcatgttaaataaaacaagagttgacattgttgagaaactgaaagatcagctcatctgcgatgcggtaaaataggaggaatgcagtgggagaacagatcagagacttgggcaggggctatattaggcagaacttggagaccagagtaagggggccaaggtgggaacagaccgattaaattggcatctcttgggggggtgggggggkggggaagctaacccatgcatcattttttaaaagctccaaaggcgattccaataagcagccagggttgggaacctagggggaaaatgtagctagatgaatgaagatggcccaaacgtcttttgttctgatagctaaactctctgtaggatcacagtgttacttcacagtgcatttgccaggaaaagtctcttcccatttggaatccgaagtaaaactgacaccacacttgaagatgccaggattgttagaggaaaatgtcacccaatagctccaggaagcaggagccctactgttgctgtttaaccacttctttcccattttggtggcaagttgcctccttttacacaaactgcctcaggagatcctaaagatatcatggtgtctgtctgtccttgcaagagcatgcattatggtaggacattgccttcattctgttcctttttctccaagactcttgcttattctcaccatttggctggactttctactgtaggattacctcggaatccacacaaaacccacagggtttyagagttgccttgaattacacgttttgaacattcagatcttcattttcccaaacatccacccagttataggtgacctttgctccaaagtcctggagtagcaaggtgccttgagtcttagactcttcccacttctttctctcttctgcatcccctcctgccaaggttgcccagccacactaaattgcatgccttgctgtgttgcattcgttatcattctaaagttgtcaccaacatgtgcgaaaccagtttatctaataacgatagctaccattttctgagctcttgccatgtactcctcttgccacagcaaatgcattgacaagggagtctgctggccaaagcctgactctcatctccagatggtccaacacagatgctgtgtgtgacccaggacaaagcacttaatgtcactgaggtttgggaagtgggtgagaacactgtagatataaggcctagctagagtgaaggcctccaaagcagggtgctcttaattctagatgtcccagatgcgtaggacagagtcatctagtcatcttccagggtttaatcctggactactggaaacaactagaagtgagaaaagcgtctgtgctttgcagtgaccattgtcctgtcagacaaccaataaatgctatctttcctctttcaggtttttcagggaaatcaagactccttcacacctgtggtgaactctctagacccayygttactgactbrctascttbnaattcacccccmgagtygggtgcaccagattgccctgasgatggaggttctgdgctrcgaggcacaggacctctactgagggtggccactgcagcacctgccactgcygtcacctctccctcctcagctccagggcagtgtccctccctggcttgcyttctacctttgtgctaaatcctagcagacactgccttgaagcctcctgaattaactatcatcagtcctgcatttctttggtggggggccaggagggtgcatccaatttaacttaactcttacctattttctgcagctgctcccagattactccttccttccaatataactaggcaaaaagaagtgaggagaaacctgcatgaaagcattcttccctgaaaagttaggcctctcagagtcaccacttcctctgttgtagaaaaactatgtgatgaaactttgaaaaagatatttatgatgttaacatttcaggttaagcctcatacgtttaaaataaaactctcagttgtttattatcctgatcaagcatggaacaaagcatgtttcaggatcagatcaatacaatcttggagtcaaaaggcaaatcatttggacaatctgcaaaatggagagaatacaataactactacagtaaagtctgtttctgcttccttacacatagatataattatgttatttagtcattatgaggggcacattcttatctccaaaactagcattcttaaactgagaattatagatggggttcaagaatccctaagtcccctgaaattatataaggcattctgtataaatgcaaatgtgcatttttctgacgagtgtccatagatataaagccatttggtcttaattctgaccaataaaaaaataagtcaggaggatgcaattgttgaaagctttgaaataaaataacaatgtcttcttgaaatttgtgatggccaagaaagaaaatgatgatgacattaggcttctaaaggacatacatttaatatttctgtggaaatatgaggaaaatccatggttatctgagataggagatacaaactttgtaattctaataatgcactcagtttactctctccctctactaatttcctgctgaaaataacacaacaaaaatgtaacaggggaaattatataccgtgactgaaaactagagtcctacttacatagttgaaatatcaaggaggtcagaagaaaattggactggtgaaaacagaaaaaacactccagtctgccatatcaccacacaataggatcccccttyttgccctccacccccataagattgtgaagggtttactgctccttccatctgcctgaccccttcactatgactacacagaatctcctgatagtaaagggggctggagrcaaggataagttatagagcagttggaggaagcatccaaagattgcaacccagggcaaatggaaaacaggagatcctaatatgaaagaaaaatggatcccaatctgagaaaaggcaaaagaatggctacttttttctatgctggagtattttctaataatcctgcttgacccttatctgacctctttggaaactataacatagctgtcacagtatagtcacaatccacaaatgatgmaggtgcaaatggtttatagccctgtgaagttcttaaagtttagaggctaacttacagaaatgaataagttgttttgttttatagcccggtagaggagttaaccccaaaggtgatatggttttatttcctgttatgtttaacttrataatcttattttggcattcttttcccattgactatatacatctctatttctcaaatgttcatggaactagctcttttattttcctgctggtttcttcagtaatgagttaaataaaacattgacacatacaaacaaatgcctttgagaattgtgtttttacactggaaataaaaatgtgaacactgatttttaaaacaaataggggcactgaatagcaagatggacactctagaaaaccaaattagtgagttagaaaaccagattaaattgaactcagagtaaaaatgatataattcatgagagtctgaataaaataaatcagaaatggagcctcaatccaggagaacagcttatatggagagagagagactgagagagaaatgggagtttctgttcaatgggcataaagtttcagctatgctgctgggcacagtggctcatgcctgtaatcctggcactttgggaggccaaggcgggcggatcacctgaggtcrggagttcaagaccagcctagccaacatggcgaaatcccgtcgctaataaaaatataaaaattagttgggcatggtggcacatgcctgtagtcccagctacttgggaggttgaggcacaagaatcgcttgaacccgggaggcgggtggaggttgcagtgagccaagatcgtgccgttgcattccatcagcctgggcaacagagtgagactccatctcaaaaaaaaaaaagtttcagttatgcaagatgaattaagttctacagatctaatgtacaacattgtgcatatagctaacgataccatactgggcacttaaaaatttgttaagagagcagataccacgttgtgttcttactacagttttacaacaatgcaaaaatgcattgtaaacactatgtgcaaatagaatagcaaagaatgtatacagtgcccatgagcataacattctagtggacccacaatgcatcagagttcagtgagactcaaagggagaagaatgttggcaaagtcagtggggaggagaaaatgagtgtgatgaaataggcggtctcattaaacttcccttacaaaacacaagatcaaagataaaattattaagaatttcgagacagtgacatcagagcaaacgaaacatagggcccctcagggtgtggggccctgtagacctgcatagatcaaactcccatgaagccaatcctgagtcccaggcaagctgggacttttggtcatcctagcaatagtcatgtgagtgcaccatcttggaagtagatcctccagtacagtcaagctttcagatgactgcagtcccagcagatacatgactccaatctcatcatccactccaaaactaacctacagaaactataaggtaataaatgttttcttcacagttgctaagttggaggtcatttttcattcagctaaagttaacttatatgacagccatattctttttacaatggaaaagtcagacaggcatacaatgctcattttcagcttattcacattgtcactattttgtggggttacctggtgggcacaggacagtgaccaagtttgcaggtcctccagctcctgctggatcttttagcttctccaaatcctagaaaagttgtgtgtttagctctttcagaaaacacctgaccttctcatgcatgttactccaccatcgaagttagaagcttggagataacatgagactgatgcaggttttagtccatttcatgggctcttctcttttcaggcttccagtgtatacttgctttctccacttcmcctcacctttccttccacagaaaggtcagggtatggagctcatatgagggtttagaggaatttggctcaagggccagggccagcttcctccagtgtttcgggtcacaacctagatacacctttatcagcgcctgggaatgttcaaggtcctaattttcattcaggcctgttggctgggtcacagaatgatcaagccactccatgattttctagcatgacacagcaagaaactgggggagactggaggactctacaaaaactttcattttatgtatttcctggtagctctgttttctgatagaacctaactgagataccatttttgccagttcttctatggataagtattatttttttaatttttttaatattttattttttgtagagacagtatcctgctatgttgcctcgacttgatttgcattttttttttttactttaagttctgggatacatgtgcagaacatgcatgtttgttacgtaggtatacatgtgccacggtggttgggtgcacccatcaacccatcatctaggttttaagcccctcatgtcccccaggctggagtgcagtggcatgatcatagctcactgcagcctcaatctcccaggctcaagccaggctactgcctcagcctcccgagtagctgggactacaggcatgcaccaccacacccagctaatttttaaattttttgtagagacaggatctcgctatgttgctcaggctggtctcgaactcctgggctcaagctatcctcctgtctcagcctcccaaagtgctgggatgacaggcgtctgccactgtgcctagccagtactatttctttttaattagtttgtaagagttctttgtacgttaacaatcttaattgaatgtctgtcgtatatgctgtgaaattacttaatttgtcattaaccttttatcttttttaaacaatgttttgctatatgaaagctttacatttttatgttataaatttatcagcattttcatttatggctttgggttttatgacatgcttagagtagctttttctgcaccaagattataaaaatatccacacatagaattttctatcataaaagtatgacagaaaatgtcatattttgtatataattttattttttgtttagtcctggatccatctagaatttctattttgcatagcatggcaaagggctcacacccaacrtcatattaaataaggtctttttccctgatatgaaatgccacatatatatgttattataatgcatagttagataccatgtggtgaataaaatatcttagaattattcaagcctaagaggatagaactactgcaaggatgggttttggtatcaacacagatgtttatacatagagagaaaatgatgtctgtgtgcttagctgtcaaataaggagactgggggagggttaaatgtaatcartgatatcataaggagtggtggaattctgtttggaacttcagagacctaaggagaagactgaccagcttcttctgaagacttctgccctctaaagactaaggcctaattccactggtttctttgaattccgtggtcctaagtccattttcaggtaagtggtttcccgctggatgtgggtctctttaagccrtatcaaacagtaggtgagtgtatcagttataaatgtcttaagtaataggaggcccaaattataatggctcaaataaaagtatatttttctcataccatgcagtccagaagtaagcagatacaggtgttagtttagtggcttgaaattatcagagcaacttcaggcaacatttcttaagcaatattcaaggcagcataaagggaaaatggtagcaccatctcttttatcaagacagcaaaaagccttcccaaaagctatccatcagatttcccttatgtttcattatccagagctatgtcacatagccatgcctaacttcaaggatggctaagaaagggaggattcagctttttcagcttatctagttggatgtagtaaatgaaaaatgggtgggaacaatatctgccaaaagtcgccattcattcaaaaaatatttattgagcacctggataccctatgtgctaggtactgtttagcagtgaacaaaacagacaaaaatccctgcactcatagagcttacattatattcaggagatacatataataaagtaaagtaaaatatattctactaggttctgatgaggttctggagaaaaatcaagcaggtaagacaattaggaagtttgtaggagggtggtacaattttaacaatgggatctaaggaaaatcctcattgagaaggtgatatttgagtacctgacagaggtgaggaaataaattctgagaatacctgggggaaaagcattccctggaaagggaaaagcaagttaaaaagccccaaggtaggaacatgcctagcttgttcaaaatgaaatgaggctaagttggagtgatgatcaagaggagactcataggatatgtggtcagcagtaactaggacataatctgacctacaacctaccaagatctctttggccactcactggagaagaggcttaagggaggcaaggacggaagcagaaagacagagatgatggtgggtagcagtggaggtggtgtgaagtggcaggattctggatacgttttgtaagtaaaggtgactagacttttctgatggataaagtgtatgagagaaaaagaagagtcattactatatatgtaaatctaagcaaacatttactttttaaagcaayttaaagtttgttacttgaatatataaaatatatcatggagttaaaaatatatagaaatttattatatttggtatctaaagtagtcaaattcatagaaacaaaaatgaggagctgtttagagtttcagttttccaagttgaaaaagttctagagatctgttgcacaacaatgtgaatgtacctttttcagcctgaacaggtgaaagagtttctactaattgagttggggaagattgaaaaggtatcaggtgtaggaaggaatgtcmggtatctgacctgatagagcatagtcaggttttgttttgttttcttggaggggatatattttgctttggaaactgaccattttcaggagtcacctgtgtaagtcagtcaattgtccttatgttcgtgatggtgagaagatttttggaatatgagctaaaccatcattgtctaacttttcagacaaagtttctgtggaaagacctacggacaaagacatctctccttggcagagtgagctaggattaccagctcttcagccgcagctgaaggcgggagtccatggaaccccagaagctgctgayaattggatttctgctatgctctctaacttgcctcttgttggagacagtagcttcctctcctttgcctttgtctgccttgggaatacaagaaaaaacaggatcgaaaccacgctcagggggtgtgtttgctgttaggatgaatgtttctttcttcataggacttaagattcatgtttcagttcaggtcaggtaaaatgaatttcatgtttaaaaagaatgttcataggaaagcaaactattctggtttggttcaatttagttcaacaagcattaacctacctactacgtaccaagcccttttctgaactacatggattaggaattgaacagcctctgttatgaaggagctcacagataggcagacaaagccatagatgccaaccttccatggagtatgatcaatgctcccaggggacaaggggataatttaaattgttttgggggaggggtcaggaaagacttgacaaaggaggtgaaattgaaaataaacctgatggtccactgatccacaatctaggttccaacatgcacacacatgctattcaagtgtcttgctggttagtggtgaatcctctcaactccatgctgcagacactttcgttttcccctccttctttcttcagggtcaaagcactgtaccttcctcccccagttgctaatgaaaagacccaacatccccagccttacattgatcagcaaactccccctagaggtccttcttccagtggccctggcccctttctcctctgctcttagggctggtggccttctcctttctcttcctgggatactccctctcctcagcctcctgcaggactcccagatatactctaggcaacaacacyttagtaaagactttcttgttatcaagtcatgcttctctttcaaaaagtacccaatatactcaagatatccgaaacaacaattattgttcctatttgacttacaaggaggcaaaaattatatccatctcaggatactttaaaaacaaaatgtttgccctttgaacatcttacagccagcacagcaaagtagtttagaatatgggct

SEQ ID NO: 13234 - DNA, 93112 bp, Homo sapiens
  misc_feature (1)...(93112): n = A,T,C or G, or insertion/deletion polymorphism (see Tables 1-2)
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattagtgatcgagagccatttttgctggtggcaatcatatggtacttttaatgggaatattagaaaggcaccggtaatgaccttgttgcagcacaaaggagagagtgtggggtgcccctgcatgttgtcccacctcttgtgacgtgtatcgttttggaatttccagtggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaaggtaaggagtctgtggccagacatctacacgcttcsatgctggratgaaaagccatggaaattcccactgatgcagccgccttcaatgktaaacggatgctcgagtgttgcctgagttctaccatgttgggggaagcctccgtgtactctctgggggagccagcggagtgatttctggtgcaacgtggttgggctttgtctttagaatgggcacaaaccctccagggtgatcgacttcacaattcaccttgttctaaaatgggctacctcagtgtcccagccaaaatttttattgtaacgtgctgtcaggtgtgtgactctttcagtccagtaagsttttccggggatttcttcaagtagccagcaktcagwgcartcttcagcattgcagattcagagaaatgtggctctggagcctgtcatcctcgagaaacctaacagggctgcattaattccatatggtcctgggtctatggagcagtayatgagctcccaatgctctaaggctcttcagtcctaggctttgaagggagtgatttctcagtgttcttaaacctctttctgatggcacttgtacctgtgaggggtctagagagaaaggttagtagacttctcctttactgcaattcaggatgcagggcatgagaggattccctccctcstccaagggaagaaggttttggcgtgcacacatccttgagaagcaaagtgtctttgccttcagtcagatatataggatcgttttctgccccatggcctggaagccagaggcyttggctttcatgatcaacgatctagggaaacatgcaaaatttccrtgtctttcccctcctctgcccycgacagccaattaccacctgcatcctgcattgccaaatgcagtgccctttgtatgaacattcagtakagtttcatagaaaggtgctacttcgtgagcgcactttgcagtgagaagatctgttctgttctgtttttctaaggatttcaggtgaaatatttcctagaacttactacagttctagattggtaggaatctgtrggtttgctgtatgttttttggttggttttctcccatccatctgcctacaggtaagggaaagataamgttcrtaattctcatagactcctttctggttktgtcataratgkcttcacatatttcgttattctcagagatactcagtttatttcttgtgttttcatttcagcaccgactgagcagaggcctggggtgcaggagtgctaccacggtaatggacagagttatcgaggcacatactccaccactgtcachggaagaacctgccaagcttggtcatctatgacaccacactcgcatagtcggaccccagaatactacccaaatgcgtatgtctttgttctttaccataagagaataaagggccaactgaagtttctgtgacaagagacatgcttcaagctgagttctccgaactcaacttgtgtcagattcagatggygtagcaaaatgtctcaggatgatttccttggagctaagggtctgagagaagagaaatgttaagctgcctcaccttcctcctagttttgtggagcagaagggaaatgaggaggcgaggagatcaccttatgaagaaagtcagaatgacraacsaccaaacacttagattacccttgcccaacacccactaagcgtcaatgaagactttccagttggaattccgttattctgacttccaattcctgaagggaagattgtgtttgccttttctgtctgggctcatgaggaaagtttatgtgcttacttatggacaggtgaattgatctgtttctatttctacctgtattccaatagggagaaaatctcttggtcctaagtaccagtggcctgaarggatagaggttcccagcaagagaagatccaaggaaggaaggcagatgagagtcagcacagagagkgatgctgaaaagtaaaagggatgggtagatggatagaagccctggyctgaccaccccatggccaatcatttggccataatcaacaaccaaagacatggaaaaatggtttctacatgtgggacaacagatsgtagaggacctagagaattgagagagggccaatgatgagctcaactccatagatgccttggctttcttcctggatacccttcctgcactgartagcaaggagatggagctcaagcagcctgtagccatctagctgagcagaggagagggattggagtttgggatgactctggtatwttctaggtccgctacaaataagaactggtttgtggaggaaaggagctctacaaatacgcatagaagtctcctccagtagytggcctcacatgacactgcatgtgcacagaaaatggttctacagaaagtgtggcaaagaacatttactgagaaacagcaactacaagagaacagcaagctcaattaagaagatagagatcacatagcactctgtgttattggagttcttaccagctagatgagagagtgctcacggaacacattgccaattcagtggagaccccagaacagccataatttcaaagtacaattagtatattactagaataaaggcagctgcagacaaccccttgcacagctgaaaagcaagtgtccaagcatcaaatgggtttccaatcaatgaagtgcctgtgagaggaaatctcaactctcttcagaagtaaacaacaaagtcaattgcctcarctatgcggtatccccagagtgagtcctaaattaaaaatttgactacgtgtagaaaagaatttcgtgtgatccatgaccagraaataaatcaggcaatacaaacaggctcagaaatgacatcgataattagaattgcatgaaaatttgacatatcagtatgataactgatttcagatatttaaaaaaagtgcaacaaagcaggtatcatatcaagacaaattaatagtatagaatagccaaatcaaattaaagaactattatacaaaaagtatgtcttaaatgaagaaattactgtatgtccgcctgaaaaatttagatgtttcagaagaaaaaattaaccaaaaacaattctgcagaacctacagaatgagcyacacacacacacattcaaaacacacccatacacacacacatgcaaaaactcacaagttctaacacacacacaaacacacacacacatgcacatccctaaagaaatagggaaatataaaattaaccgaccctcagagacatgcaggaaaatataagaagatttcctgcatgtgggaagcaagtcacagtaaagagcaagggagtttggagtagatacaaataccggaatcacggatggctgataacttttcaattatgaagaacgttagaaaaatcacagattcatgaaactaaagggatcaaataggaaatttcgagaaaaaaaactacatgatgcacttctctacatcacagttcaaaggtaacaaggcaaggatataagaagaagaaacatctcacgagaaactggagraaaaagagctgtgtcttcctagagtacagtgatacaaattgctaatgcgttcacctcagaaacactggaagccagataccagggaatattattaaaatgataatgaggaacaagaagagatcaaccgagaatgctgaatccagcaataaaatgccttgaagatcatccatgttggataaatgcatattgtgcactgcccaaaacaaagaaactggaaagtgtaagactttggaatcagcaggcttatgtagcaacagaggtgacccraaagaattaggtataagaagaatagaagaattgcatgaaaatttgacatatgactaagataactatttcaawtatttaaaaaaagatgaatatgtaataaaacagataaaatatcaaaagaaagtaacagtattgactagccaaatcaaattaaagacttagtgtaaaaagctatgtcttaaaagaaaaaattactggatggctgcctgatcaatttagacatttctgaataggaaactaaccaaaaatcaattctacagaaccaactacacacatatatacacatacaacacacccatacacacccacgcaaaaactcacaagttcacacacacacacacacacacacacacaaccctcaagaaatagtgaaatagaaaaccaaccgaacctcacagacatgttgcaaaataggaaaagatttcctgcatatgggaagcaagtcacagaaaagagaacgggagattggaaacagaarcaaataccggaatcaaggatggccgaaaacttttcattgatcaagaatattaacaaaatcgcaaaaacacgaaattcaatgcatcaaataggcgtttcgaaaaaaagaaaaaatctggtatgatgcacttttgtacttcacattttcacggtaagaagacaaagatataataacaagaaacttcttatgagaaactggggaaaaacaagctgtttcttgctagaagaacagtgatacaaattgctaatgcattctcgtcaaaaacactggaagccagataccgggaatgttattaatgtggtaaacaggaacaagaagagatcaaccaagaatgctaaatccagcaataaaatgccttgaagatcatccatgctgcataaatgtatgttgtgcactgccccaaacaaagaaaccggaaactgtaagaatttggaatcagcaggctgatgtaacaagagaggtgacccaaaggaattaggtagaagaagaatagtacaagaagggaactttctgcagcccatgtaatgaagaacccagcaattggcaaatgtagatgtaaatgcaaaagtattttcttgaccaaatttctatatatttttaaatgagcgttgactactggaaacaaaatgagagcaagagatttaattttagcctcggtagaggtaagaatttgaacaagtagcgtaaatcatgtagggaataattagaagtgtaccattgtaagtttcttacctcatgcacaatggtatgtaatattaataaaatgttactgtgtgggttcaaggagatattgcaaatcctagagcaatcacaaagttttsaactctgaggtatattgtataataagaatattccatgtattcaaaagagagaagccaaggaagaaagaaatttgtcacgagtttgggctcttagtacatcctgtagctcattgaaccagcttcctggaatggagggtctgggattgacactaggccacatgtatagagtctctagagagacagtgtttcatccccatggcycgtaatacatttcccattttctcaggcagccacaggtcaygaatgtgaggatagagagaggttggagcaacgttcttgggaggcataaggaagagcaaatgcttcaagatccccgcagcccaaactcctacctgctttgccccctaatgcagtgttcctccgtagctgtccgacctcttcagatctcttagtctaccctgccatcttcctttatgccatgggtcccactgttctttcaactcatcccccttwccctcagtgcagagtagctgcggccagcagagggtagactgagagcaggagagaaggtcctgcccaggaacccattctagagatgctgcattctgcctgggagcaagttttccagggcagctttgagaagtcttgcagaaacaaacctatttgacccacatgatatgggaatgacagaaagtaatacaatttgcacagtgcttttccatgggaaaagtagagccttttcgcgaggttttgagtacatagagagtgaaggttgacctggaaaggttatcctcctggatcccatgttttttctgaagaactacctgttagttgcaacttgcacattagaatatgaagtcctaccgagagagatacggagaactagataaatacagatacttttgtatgtgaataaacgattccacaatacacacatcaaaatccataccagttattccagagagatggattgggcagaaggcagaaggagaatactctgatcgttttttgcccacgtgtatgtattatctcagtgtttctaagaagcgtttgctactttagatttttttttataataataatcttttaagtatgagaaatgtgcagacaggattagtgattgagagccatttgtgcttstggcaatcatatggtacttttatgggaatattagaaaggcactggtaatgaccttgttgcagcacaaaggagagggtgtggggtgcccctgcatattgtcccacctcttgtgacgtgtatcgttttggaatttccagtggcttgatcatgaactactgcaggaatccagatcctgtggcagccccttattgttatacgagggatcccagtgtcaggtgggagtactgcaacctgacacaatgctcagacgcagaagggactgccgtcgcgcctccaactattaccccgattccaagcctagaggctccttctgaacaaggtaaggagcctgtggccagaaacctacacgtttcgatgctgggatgaaaagccatggaaattcccactgatgcagcagcctccaayggtaaacggatgctcgagtgttgactgagttctgtcatgtaggaggaagcctccgtgcactctctgggggagccagcggattgatttctggtrcaacgttgggtgggctgtgtctttagaattggcacaaaccctccagggtgatcgacttcacaactcacctcgttgaaaaatgggctatctcagtgtcttagccaaaatttttattgtaacatgctgtcagatgtgtgactctttccaagccagtaagcttttcctgggacttcttcaattagccagcattcagtgcaatcttcagcattgcagattcagagaaatgtggctctggagcctgtcacccttgagaaacagggctaacagggttgcattaattccaaatcaccctggttctatggagcagtacatgaactcccaatgatctatgtttcaggacttcctcagtcataggtgggctctgcagccctaggtttttaagtgagtgactgccccgtgttctggtggcagttgtacctgtgagcggtctggatagaaagagtcggagacttctgtattattgcaactcaggatgtgggtcatgagaggatttcatctctcctgcaggggagtaagctgttcgcctccacccatccctgataactgaagtgtctttgtctgcagtyctagacgaaggactgttgtctctcccatggcccagaagctgaagaccttgccttttgttatgaaacgttcattgttttcatgtctgtccgtttctctgcccctaacacccaatcaccatgtatggcctgtacccccaaatgcatcgtgctttgctgtttgctgccccatagtcctcatgaacattcagtagaaattcccataaatgtgcttgcacgtgagcacagtttccattgagaagccctctcatytgtcctttttttctaagcttttatgtgaaatatttctaagaacttactacagttctaaartgttaggaatttgtttctttggtgtttttgtttgttggttggttgttgcttttctcaagtccatctgcctacaaataaagaaacaagaatgttacttgtcatattctcctgaggtcataattctcagagacttttttctggtttgtgccataagtggcttcacatgtttgtctcttcttggaaacactcagtttgatttcttttcttttcatttcagcaccaactgagcaaaggcctggggtgcaggagtgctaccacggaaatggacagagttatcaaggcacatacttcattactgtcacaggaagaacctgccaagcttggtcatctatgacaccacactcgcatagtcggaccccagcatactacccaaatgcgtatgtctattttctttaccataagtgaaggaagggtcagtggaaatttctgttagtagagtcatgcttcaagctgagtgttcaggactcaagttgtctcagatgaacagtgcatagcaaaatgtctcaggaacattgtctttgagcaaagagtctaagagaagacaaatgttaatctggctctccttcctcctagtttaatggagcagaaaggtatctggaggcaaggatatcacattaagaaacaagtcaagatgacaaatgatgaaactcttagagtacccttccacaacacccactaaggttcaatgcagccttttctccttggaattctattaaactaaactccaattcctgaagtgaaggttctgttggggttttctgttttggcttacaaggaaagtatatatgtatatctatggagaggcaaatctatctctttctatatctacgtctattccaatatgtagaaacacagtcggttctgaccaccagtggtctgaagggatactggttgttagagaataaaartggcaggaaggcagatgagagtcagcaaagagagagatcctgtaaagtaaaagggtggatagatggacagaagcccaggtctgaccagcccatggccaggctttmggccataagtgacaccaaagacatggaaaaatggtttctacatgttggacaacagacagtagtggaccaaaagaatagtgacagggggaacaatgagatcaactccatagataccttggctttcttcctggaggcccttcttgcactgaagagyaaggtgatggagcccagatggactgtagccatcttcctgaatgcaggagagagattggaatttgggactactgtggtagctaggattttataggcctgctgagaatgagaatggatttgtggatgaaaggagctccaggggcacgcatagtagtctcctcgaatctttggctaaacatgacgttgcatgtgcccagaaaaaggttccacaagaaagtagagaaaagaatatatcctgaggaatagcaactgcgattgaacagtgagctcaataaagaggacagagccctcatagcattctgggatactggagttctgaccagctggaggagagacctcactgaacctcttgggaatacagtagagactccagaaaagtcatactttaggagtagaattagtaaatttctagaaaaaaaggcagctctagacaaaccctgrcaaaactgaaaagcaagtctccaagcattaaaatcatttccaagtcaattaactgcctgggagaggaaaaccctctttagaggtaaacaacaaagtcaagtggctcagctatgtggtgttcacagtgtgagttctaaatttaaaacttgactacacatagagaagcttttagtatgaaccatgaccaggtgaaaaatcagtcaatacaaatagacctagaaatgacagaaatgattagaatggcaaaaaatttgacatatcaatatgtcaactgagttttaggttttaagaaaacatgaatacggaatgaagcagataccatatcaagagacagtaacagtatagaagagccaaattaaattaaagaactagtataagaaggtatgtcttaaatgaaaaaattactggatgtattcccaatggagtgagatgtttcagaagtaaaaactaactgaaaaacaattttataccacctacagaaccagctacacatacacaaatgacacacacatatacacacatactcacacatgcacaggcttagaaacatgcacrcacacacacacacacacacacacacacctccacaaatactaaaaaatgaaatccactgatcctcacagacaggcgggaaaatataaaaagatttcctgcatgtgggtaggaagtcacagaasgagaggaaggagagattgctacaggaacaaatactggaagcaaggatagctaaaaacttttcaaataagaagaatattaaaaaccacagattcaagaagctgaatgaatcagacagggaatttccaaaaaaaaaaaaaaaaaactgtatgattcacttttgtacatcaccgttcaacagtcagaaggcaaagatataataacaagaaacatctcatgagaaactggaggaaaaagagctgtgtcttgctagaagaacagtgatacaaattgctaatgcattctcatcagaaacactggaacccagttaacaggggatatcattaaaatgataaactagaaaaaaaagagatcaaatgagaatgctacatccagcaataaaatgccttgaagatcatccatgttggataaatgcatattgtgcactgccccaaataaataaaccaaaaactaataatttggaatcagcaggcttgtgtaacaagagatgttgcccaaagaaaattagctagaagaagaatagttcaagaggagaactttctgcagcccacrtaatgaagaacccagcaaatggcaaatgtagatgtaaatgcaaaatattttcttgatcaaatttctatatctttttaaatgagagttgactacttgaagcaaaatgatagcaatatatttaactttagmatatgtagaggtaaaaatttgaacatatarmctaaatcatgtggggaataattggaagtgtaccattgtaagtttcttaccttatccaygatggtatgtaatattaatgaaaggttgaatttgtgggtccaaagggatattgtaaatcctaaagcaatcataaaattttgaattctgagggatattatataataagaattttccatgtatccaaaagagggaagccaaggaagaaaaagaagtctttcaagtactcaagctctgagcacatccagttgctcwttgaaccagcttcctggaatggagggtctgggcttgagactagstcacatgtgtagagtctctagagagacagtgttggatccccatggcccataatacatttcccgttttcccaggcagccacaggtcacgaatgggaggattctgagaggttggagcaatgttcttaggaggcataaggaggagtgaatgctctgagatttccccagcctgaggtcctccatagctgcccgacctcttcagacctcatagtctgcccagctgtctccctttatgccatgagtgccactgttctttcaactcatcccccattccctcagtcccggaattgctgtggccagcagaggatrgactgagagcaggagaggaagtcctgaccaggaacccatcctagagatactgcatcctgcctgaaagctaggtttccagggcagctttgagaagtcttgcagaaagaaacccacttgacccacctgatacggtatcgacagacaggaatactttttgtgcaatggttttacatgctgaacatagagccttttggctacattttgagtacattgaatgagactgctggcctgggaaggatatcatgctggatgccatttttttctctggagaactatgtgttagttccaactcgcacattactatatgaagtcctacacagagagatacggagagctagacagatagagatacttttgtatgtgcataaccaattccacaatacacacgtcaaaatccataccagttattccagagagatggattgggcagaaggcrgaaggaggatattctgatccctttttggccacatgtatgtataatctcagtgtttctaggaagtgtgtgctgcattagattttttttctttaaaaaaagtgataatatattaagtatgagaaatgtgcagagaggattagagattgagagccatttgtcattgtggcaattgtatggtatctcttttgggaatatttcaaaggcaccagtaatgaccttgttgtagcaaaatatacagtgttcctgcatatgtacccattttttgtgatgtgtattcttttggaatttccagtggcttgatcaagaactactgccgaaatccagatcctgtggcagccccttggtgttatacaacagatcccagtgtcaggtgggagtactgcaacctgacacgatgctcagatgcagaatggactgccttcgtccctccgaatgttattctggctccaagcctagaggctttttttgaacaaggtaagaagttgtgccagacatttacctgcttggatgctgggatgaaaagccatggatacccccactgacgcacaasccttcagtgctacactggttctcgtgtgttggttctgggtctgccatgtgggaggaagccttagcgcactctctgggggagccagaggtgtgatttttggtgcaacctgtgcgagctgtgtctttaggatgggcggaaaccattctgggtgctcgacttcaccactcccctcattgtaaaaggggctatctcattgtcctagacaaaattcttattgtaatatgctgtcagatgtgtgtgtctttccaagccagtaaacttttccagggatttcttcaagtagacagcattcagtgcaatcttcagcattgcagattccgagaaatgtggctctaratcctgttatccttgagaaacctaactgggttgcattaattccatatctccctgggtctgtggagtagtacatgagctcccgaagctctatctctcaggtctttttcagtccgaggcaggttgtgcagttcttagctttgaagggagtgattttttcgtgtgcttttgcctctttctgatggaacttgtacctgcggggggtctggagaaaaagagtagtagacttttgctttattgcaatgcattatgctgggcacgagaggattccctatcttattgtaggtgataagcttttggcctccactcatccctgagaagtgaagtgttgttgcctacagttttagctgcaggactgttgtctgccccatcaccaggagtttaatgctttcttttttgagcaatcatctagggacacatgcaaggtttttatatgtccttgcctcctccccaaaaaaccattttaatgcttggagacttgcttttcagctttgccaaatgcatcaccctttcttctatgctgttccatgtcrtcatgaacactctgtagagattcctagaaatgagcttccatgttagtggagtttccgatgagaagcaatctgatatttcttttccactaagttktacrtgaaatatttctaagaacttactacagttctagaatggtaggcatctcttactttcgtgtttgtttgtgtgttttctcatgtccatttgcctattaataaagaatagagaatggttgtaaatctcagtgactcttttttggtttatgtcataaatggcttcctgtatttttctgttctaggaaataataagcttgatgtcttctgttttaatttcagcactgactgaggaaacccccggggtacaggactgctactaccattatggacagagttaccgaggcacatactccaccactgtcacaggaagaacttgccaagcttggtcatctatgacaccacaccagcatagtcggaccccagaaaactacccaaatgcgtacgtctttgttctttaccataagcraaggaagggccaatggaagtttctgttagaagagtcatgcttcaaggtgactgctcaggactcaacttggctcagatgcagaggaacatttcctgtgagcmaaagttcttagagaakactttgtttttttgagacagagtcttgctttgttgcccaggctggagtgcagtggcatgatctcggctcactgcaagctccgcctcccgggttcacaccattctcctgcttcagcctctctagcagctgggactacaggcacccaccaccacacccggctaattttttgtatttttagtagagacagggtttcactgttctagccaggatggtcttggtctcctgacctygtgatccgcctgcctcagcctcccaaagtgctgggattacaggcgtgagccaccgtgcctggctgagaagacattttttaagctggctctccttcctcctagttttatgkaagcagaaggatatatggagttgagaagatcttattaataaaacagccgggatgacaaatgaccaaagagttagagtatccttctacaacatcggctgagggttaatacaaccttttcaccttggaattctatcattctaagctctagtccctgaagtgaatgttgtgttggccttttgcaycttgggtcacagggaattgatacttgcacatctatggagaggcaaatctttttctatctacttctttttcaatgggtacaaacacacttggtcctgagcaccagtggtctgaagagatacggtctgcccagaggagaagaacaaaggcaggaaagcagatgagagtcagcaaaggggcgatgctgaaaagtaaaaggggcgggtagatggacagaagccatgatctggccattctatggccagtctttcggccataagtgactaccaaagacacggcaaaacggtttccacatgttgaacaacagatgctagaggaccaagagtattgcaagagggagaaaatgagatcaacccatcaatgccttggctttcttcaaggagacccttcctgcactgaagagcaaggagatggagcccaagctgactgtagccatgttgctgaacagaggagagtgattggactttgggattactcaggtagttaggattttctagccatgctaagagtaagaatggacttgtggaggataggagctccaggcatagaagtctcctcaagtgttagtctaaacataaagcagcacttgcatagaagattttccacaagaaaatatggcaaaaaaacaccatatattgaggaacaacaactacaagggaacagtgagcttaataaaggtgacagagctcacatagtgctctggaatattggagttttgaccagctagagrgaagagacctcattgaaaatcttgggcattcagtagagacctcagaaaagtcagactttatgagtagactttgtatattcctagaataaaggcagctccagaaaaaacctagcaaagctgaaaagcaaatctccaagcattaaaatggtgtcctagtcaattaactgccttctagaagaaaactcaacactctttacaggtgaacaacaaagttaagttgctgagctatgcaatatccacagtgtgagtcctaaatttataactttactacacataaaaaagcatttagtgtgaaccataaccaggaaaataatcagtcaataaaaatagaaccaggaatgatagaaatgatttaaatggcatgagaatttgacatattagtatcataactgcattgctggatttaagaaaacataaacatggaacgtaacagatatcatatcaagggaaagtaaaaggataaaagagtcaaatcaaattaaaggactattaaaaggtatatcttaaatgaaaaattcactggatggtctcccaatcaggttagttgtttccagggaaaaaattaactgaaaaataattcaatagaatctacagaaatagctgcacatatatacacacaatggcacacgtgcacacacccacacccacacaggtgtgaatcctagagccacacsagcattgaaacatagagaagtaaaaattgttcattgaggaatatgtagcaatgctcaatgtgttttaccctaataagagcttttgtgatgtatgattgaaaaactgacacaactgaagagagaaatagataagcccacactctgagttagagatttccttgattctctcactatggttataaatctttcccaaacacaacaggctagaacaaatatgcagaaaattagacatagtatctttgttctcaataaaaacgtcgacctatttaacattataccgaactaccgartacacattaaagtgtgcatggagcattcactgaggtgtactctacacatgaccttccagcaagtctccatagatttaaaagaattaaagtcatacagagtgtgtcactttattctcccagaataaagtgagatatgaataatgagaagtttgccagcttctcaaatatttgggagtcatayggtgcatttcaaaatactctttgggacaaagaaaacatcactaaggaatttagaaaagttttgaactgagtaagaatataacacaatttatccaaacttaggagatgcagtgaatgtctttaggcttttacataattttagatgctcttagggaaaaacagaagcatgtaataatcaagatttcaaactgcaattctcaaagtgtagtctagagaaacctgaggacctttgagtaccttcagagacagtccatgaggttaaaggactttgctacgtgaaaagtaagatgctattggccctttttactttcattttccaacaagagaagaggggagttttccagcagttacataatatgtaatggcatcatgtctctgatggctaagaaaatgggcaattgttgactttgtgtgttaaaaaaattctcagtgttggtttcttatactataaatattcatcttgtgttttgaaaaagaaaagctctttggaatcccctatgaacaaagactttgacagttgttgatctaagaccacagcttaartatctacacaagaaaaaaaaaaaaagcaaataagagccaaggaaagcagatggaaggaagtagtccaaaccagtgacattcagtgaacaagaaaagagaccaacaagggagtaaactcttgaaacagaaagttgattctttgaaaagatccatatgattgaacacagtctggctaaacaaatgacagaccaatgagggtgcacaaccatcaccatctggagtaacagaggagaggtgccattactatagcatcttccagttctgaaagctgaaaagaagattttgagaacaattgtatgtgaataaattcaggaatgttaatcatgtgggmcaattcctgaggaagacaacaaatcagcaaaccagatgctgaatagttagtgtagtcctgtagagagacatacagagaggctgacagagaaatatttgtatgtgcataaaacaatctacaagacacacttcaaaatcaatctcagttaatctggaggaacatatttcacagaaggtggaaggagggtattctgatcctcttgtacattgtacaacattgtacaatgtacagagtataattgtacaagtacaattgaagttgtacaagtacaagtgcaacttgcacaatgtacagagtaaacattgatgtttactctcaattttcttatggagcacagatgactttggatgtgttacaatatgaatgataatttgtctttgagatgttcgcagttgtttagaagttgaggaccatttgtgcatattatgggacctttagtgaaaatatttcaaagtctctttttacactttgttacagcaaaatgtagagggcgctaagtgcccttgaatcttctcccatctctggtgacctgtgttgttttgaaatttgcagtggcctgascaggaactactgcaggaatccagatgctgagattcgcccttggtgttacaccatggatcccagtgtcaggtgggagtactgcaacctgacacaatgcctggtgacagaatcaagtgtccttgcaactctcacggtggtcccagayccaagcacagaggcttcttctgaagaaggtaggaagtctrtggccagacaaccacaccctaggacgttgggatgaaaasagttgcaaaatcttagtgatatagaagccttccatgctcacacaattccaagtagaatgtggactcagggtcagccactgggaaggaacactcagcgccttctctgggagaaccagagctgtgatgtttggtaccctgtgaaagggtggtatctataggaagggtgcagaccctctagggcactggacttaccactcccctggttattcaaaggatcattttagtgtcttagccagaagaatattctaacattttgccaaatttgtgaagatttaccaagctcatgataagcctttcatggtatttcttcaagtagtcagtgttcrttgcatctttggctttgyggtttcggaggaatgcggtttttgagtctgtcatccttgagaaacctaatatgacttttcttagttccatatacttctgggtccaggtagcagtacatagccaacaaatgctccatcgttctggcctatctccatcttaagccagtcctgcacaactaggctttgatgggagggatctctcagtgttcttgcccctccttctcatggaacatatatctgtgttggtctytgagaagaagagtagtggatatctactttgttgcaatgcagaatcctgggcsaaagataccagccatccctccaagggaataaaattttggccagtagccctctctgagagacaatttgtctttgcctacgagtcctagatgcaggaccgcttcctgccccatcttcaagaagctgaaggctttggctttggaggatcagcagtctagggaaatgtgtgacggtttcatgtctgtccccactgacagtcaatcaccacctacaacctgcacagcctgatgcatagcagtctagtttcctgccttattctcaggaacacccagaagatgtctatattaaagagcatgcacatgagtrcaattttgactgataggcactctgatctttcctttggtgcctgtgttttaaaggaaatctttctaagaactcgttaaagttctagaatgctatgaatctttgggttttattattggtatgtccatctgcctgctagtacagaacagagcatggtagtctttctcagagacaatgatcctgtttcagtcacagatttcttctgatgcttctgtgttctagaaattactcagcttkatttctcctctttgaatttcagcaccaacggagcaaagccccggggtccaggattgctaccatggtgatggacagagttatcgaggctcattctctaccactgtcacaggaaggacatgtcagtcttggtyctctatgacaccacactggcatcagaggacaacagaatattatccaaatgggtacaaccttgagttttcttcaaagacagacagcagcccccttacatttctcttggaagggccatgcttccaactaacttcttatgacaaatttatctcagatctggaatgttgggtagaatgtctcaggcttctttcttcaggcacagtgtctgaaaggagagaaatgtcaggccagctctcttttctcatagttgacagaagcaggaggatatttgaaggtggtgagttctcatgaatagaaagctcaggacacatggccacgtgcttagaaatagcaccattccacaatgcccactaaagaccaatgcaatagttcaaccagggatttctgtcattctaatctccaagtcctgaagtgaaggttgtattagccatgttcatcttgggcaacaaataaaggatatctatgttgacatccagatcttccaatcactttctcctctaacctgtacctgggttctgagaacaaggtatctgaagagctatgtgttgccagcacatgaggggcaaaagtaggaaggcagctgagagtcaggaagtataaagattctgaagagttacacatgcaggaagatggacagaaacccagttcagaccacgtcagcgtttctgccatgaaggactatcaaatacataggaaaagtgttttcataggttggacaacagacatgacaggcctgagaaaattcagaaagggaatcaaaggagatcaaccttatcatgtccctggcatccttccttgagacccttgaagggcaagcagatggagcccagctgaccacagcagtcttgcttaactgaggagagagactggagtttgtgatgcctcaggcatctgacgtattctaggctggctaagaatgagaggggatttgtggargaaaggagctccaagaatacacaccgaagtcttctcaaggctttggctaaatacaaagctgcgtatgcacaaggagagttttcacaaagaaagaacaataaagaaaagctactggggaaagaacaactgcaagggaacagtgagctcaatggagatgctagagctcacatagcactgggggatatttgagttctgaccactcagaggagagacacctcactgaacatcttgggcattcagtagaggtcaaagaaagccataatttgggagtaggatcttcggattcctagaaataaggtgactccagaaacactccagcaacccttcttccaagccagtctaaaaggatccaaatgatttccaagtaaattaactgccttccagaaaaaagtaaactcaaccctccttagaggtaaggaacgaatacaagtttctcagttatatgacatccccagagtgcaacttgcatttaaaaatttactagacacaaaagaagttttcactgtgatccataactgggagaaaaatcactcaacacaaataggcccagaaataatagaaattatggcattggcaagaacatttaaaatgcacctctgagaactgtgtttcaggaaaatgtcagcaaaagctgaccatgagagaaatgaatgcataatatcagaaaagaaaagaattgaagagccaaatggaaatttaaaaactgagaaaagttatatctgtaatgaggaattcactggatggccttataaccagtttagatattatggtaggaaaaggtgaaygagaaaatgattcaattaaagctagacaaaccacaagacagacagacagacacaaatacacatacacacaatgactgaaccaattaatcaacagagcctcaaggacatctaggaaaacatccacacatttaatatatgtgttaggcaagtcacagaaagagaggaaaaagataatgtgacagaagttatacttgaagccatgacggctgacaaatttccaaacatacagaaaatgagaaattcatagtcatgaagctcaatgactcaggtatagatttttaaagagcaaaactctgatttacyggggtacatcatagttaaattgtctgatttcaaagctaagaagaaaaaaagggggttcctatgaacaaacattttgacagttgatctaagaccacagcttaaatatctaggcaaggaaaagcaaataagacacaaggaaaggggatggatggaaatagtccaaaccaatgacattcagtgaacaagaaaatagaccaacaaaggagtaaatccrtgaaacagaaagttggttctttgaaaagattcatgtgattgaccacagtctggctraacagatgacagaccaaggagggagtacaaccatcaccatttgaagtaacaggggagaggagccattgctataccatactccaggtctgaaagctgacaagaagatatcaagaaaaactgtatgtgaataaattcatgaatgtagatcatgtggatcaattccttaggtaaacaacaaatcagcaaaccagatactgaatagattgggtactcctatagaaagacatacagatagccagacagagaaacatttgtacgtgcataaaacaatctacaagactcacttcaaaatctctcagttaatccaaagtaacatatttggcagaaggtggaaggagrgtattctgatcctttcttgtacacattgatgttttctctcggttttcttatggagtatagacgagtttggatgtgttacaataagaatgataatctgtctttgaaatgttcacagttgtttagaagttgaggacgatttrtgattgttacaggacctttagtgagaatatttcaaagtcactttttaccactttgttacaacaaaatgtagrggatgtctggtgcccttgtatcttctcccatctctggtgaactgtattgttttgtaatttgcagtggcctgaccaggaactactgcaggaatccagatgctgagattagtccttggtgttataccatggatcccaatgtcagatgggagtactgcaacctgacacaatgtccagtgacagaatcaagtgtccttgcgacgtccacggctgtttctgaacaaggtaagaagtctctggccagacaaccacacccttggacgttgggataaaaagagttgcaaaatcttagtgatacagaagccttccatgctgcacgggaatctgaatgtggactcagggtcagccaatgggaaggaagcctcagcgccttctctgggggaaccagggctgagatttttggcaccccgtgacagggtggtgtctttaggaagcgtgcagaccttctagggcactggatttaccactcccctggttattcaatagattatttcagtgtcctagtgaaaatggatattctaacatcctgccaaatttgtgatgatttaccaagctcatcatgagcctttcctggtatttcttcaagtagacagtactcattgcaaacttcagctttacagtttcagaggaatgtggtttttgagtctgtcatccttgagaaacctgatatgactttacttagttccatatcctcctgggtctaggtaacagtacatagccagcaaatgctctatctccctgtctaccttaatcttaggcaggtgctgcacacctaggctttgatggaagggatttcttagtgttcttgcccctccttctcatggaacacgtatctgtgttgctgtttgtgaagaagagtagtggatgtctactttgttgcaatgcaggatcctgggcccaagatttcccgccgtccctccaagggaataaaattttggccagtacccctctctgagagacaatgtgtctttgcctggaagtcctagatggaggaccacttcctgccccatcttccagaaacttaaggctttggctttggaggatcagtgctctggagaaatgtgtgacggtttcatgtctgcccccactgacaaccaccacctacagcctgcaccgcctgatgcatggcactctggtctcctgccttgttctcaggaacacccaaaagagatctttgccaaagaacaggcacatgagtgcaattttgactgataggcactctgatctgtcctttggtgcccaggttttaaagaaaatctttctaaaaactcattgaagttccagaatgctatgaatctttgagctttgttattggcatgtccatctgcctactaatgtagaacagagcatggtcgtcattttcagagatgatgtcctgtttctatcatggattttttttctcatgcttctgtgttctggaaattactcagtttgwtttctcctctttgaatttcagcaccaacggagcaaagccccacagtccaggactgctaccatggtgatggacagagttatcgaggctcattctccaccactgttacaggaaggacatgtcagtcttggtcctctatgacmccacactggcatcagagaaccacagaatactacccaaatgggtatgtctttgagttttctcccaagagaaasagccacccacttaaatttctcctggaagagccatgcttccagctaacttcttatgacccaatttctctcagacccagaatgttggacagaatgtctcaggcttcttgctttgggcacagggtctgagaggagagaaatgtcaggccagctctcttttctcatagttgatagaagtaggaggatacttggaggtggtgagktctcatgaatagaaagctcagaagaacatatgaccatgtgcttagaaatagcaccattccacaatgcccactaaagaccagtgaaatagttcaaccagggaattctgtcattctaatctccaagccctggagtgaaggttgtgtttgccatgtttgtcttgggtaacaagtgaaggatatctatattgacttcgagatcttccgatcactttctcctctaacctgtataaacacaytgggttctgagaacaaggtgtctgaaaagctatgtgttgccagcccatgaggggcaaaaggaggaaggcagctgagagtcaggaagtatagagatgctgaagagttacacattcaggaagatggacagaaacccatgtctggctatgccagcctttctgccatgaaggactatcaaatacatgagaaaacagttttcacaggttggacaacagatatggtaggcttgagagaactgagaaagggaatcaaaggagatcaacttcatcattaacctgtcttccttcctggacacagtgttggattgaaggacaagcagatggagcccagctgaccacagcagtcttgcttaactgaggagagagactggagtctgcgatgcctcaggcagctgatgtgttctaggctggctaagaatgagaakggatttgtggargaaaggagctccaggaatacacacagaagtctcctcaaggctttggctaaatacaaagctgcgtatgcacagggagagttttcataaagaaagaacaacaaagaaaagctacttgggaaagaacaactgcaggggaacagtaagctcaatggagatgccagagctcacatagcactgggggatatttgaattctgaccactcagaggagaaacacctcactacattttgggcattcagtagagaccaaagaaagctgtattttgggattgggatcatcttattcctagaatcaaggtgactccagaaaaactccaacaacccttcttccaagccagtctaaaaggatccaaatgatctccaagtaaattaactgcattccacaagaaaaaaaaaactcaaccccccttagaggcaagggacaaatacaagttgctcagttatatggcattcctattgcgttacttctatttaaaaatttaatagagacacaagaagctttcactgtgatacataactgggagaaaaaatcactcaacacaaacaggcccagaaattatagaaytgatgacattggtgagaacatttaaaatgcacctctgagaactgtgtttcaggaaaatgtcagcaaaagctgaccatgagagaaacaaaagcagaatagcaagagaaaagaaaagaaccggagagccaaatgaaaattaaagaactgagaaaaggtacatctctaatgaagaactcactggatggccttatcatcactttagacattacggtaggaaaggtgacctagaaaataattcaataggagctacacaaatcacaggacagacagacagaccaacagacagaaacacacacacacacacacacacacacacacacacacacacacacacacaaagactgaacctattaatcaacagagcctcaagggcatctaggaaaaatccacacatttaatatatgtgttaggcaagtcacagaaggagaagaaaaagatatcatgacagacattatacttgaagcgatgatggctcrcaacacgccaaayatacagaaaacaagaaactcatagtcaagaagctaaatgactcaggtatagaattttaaagagcaaaactctatgatttactgggatatatcatagttaagttgcctcaattcaaagctaaaaagaaaaaaagggggttcctatgaacaacagctttgacagctgttgatctaagaccacagcttaaatatctaggcaaggaaaagcaaataaggcacaaggaaagaggatggaaggaaatagtccaaaccaatgacattcagtggaaaagaaaatagaccaacaaaggagtaaatccatgaaacagaaagttaggttctttgaaaagtctatatgattggccaaagtctggctaaacagatgacagaccaaggagggagcatatccatcaccatcatgagtaacaggagagagatgccattgctatagcatcctccaggtgtgaaagctgagaagtagatattgagatcaactgtatgtaaataaattcatgaatgtagatcatgtggatggattscttaggtaaataacaaatcagcaaatcaaacactgaatagatcatgcagttttatagagacttacagacagcctgacagataaacatttgtatgtacgtgaaacaatctccaagacacacttcaaaatccctctcggttaatccaaaggaatgtatttggcagaaggtagaaggagggtattctgatcctttctggtacacattgatgttttctctcagttttcttataaagcatagattactttgaatgtgttacaataagaatcataagctgtctttgaaatgttgacagttgtttagaagttgaggaccatttgygagygttatgggactttagtgagaatatttcaaatttgcttgtttacactttgttacaagaaaacatagagggtgccaggtggtgctgtatcttctccaatctctggtgacctgtattgttttggaatttgcagtggcctgaccaggaactactgcaggaatccagatgctgagattcgcccttggtgttataccatggatcccagtgtcagatgggagtactgcaacctgacrcaatgtccagtgatggaatcaactstcctcacaactcccacggtggtcccagttccaagcacagagsttccttctgaagaaggtaagaagcctgcagtcagacaaccataccctcggacattgggataaaaagatttgcaaaatctttgtgatgcrgaaaacttccatgctgcacaggaagtcgaaggtgaagtcatggacarccaatgggaaggaagcttcagtgccttctctggggggaccagagctgggatgttgagtgccttgtgagggatggtgtctttaaaaggggcacagaccctctaggacactggatttatcacttccctgttatcaaacgaatcatattagtgtcctagccaagatggatattctaacatcctgccaaacttgtgaagatataccaagctcctaagcctgtccagccctttcttcaagtaggcagtgtttattgcagtcttcagctttaccattttgaaggaatgccatttttgaggctgttgttcttgagaaacctaacatgtcttcattagatccgtattgtcctgagactttgaagcagtacatagccaccraattgtttatctccccagcctaccttcatcttgggcatgccttccacacctaggatttgagggaagggatttctcagtgttctcatccctgcttctcatggaacatttatctccgttgttttttgagaagaagagtagtggatgtcagctttcttgtaatgakggatcctgggcccaagattccctgtctcccctcctaggctataaaattttggcctgtactccttctccctgagaggcaatgtgtctttacctacaagtcctagatgcaagatccttttctgccccacaccccagaatctgaaggcttttgctttggaggagcagtggtctagtgtgcaagggtttcatgtataccccccactaacagccaatcaccacctatagcctgaacagcttgatgcatggcaccctggtctcctgccttgttctcatgaacacccagaagaggtgtaagcaaaagaccattcacatgagtgtaattttgaagtataggcactctgatctgttttttgtttgtttctttgtttgtytgttttccagggttgaattaaaatatttatgactacttattaaatttctagaatcctataagtctatttgtatttttattctacatttcaatttgcatgctaatatagaagagtgtaaattgttaatcctcagattattccactttgtgtgtcataatttttttcacatttcccttttctaggcaatactgagcttgattttctcttttaatttcagcaccaactgaaaacagcactggggtccaggactgctaccgaggtgatrgacagagttatcgaggcmcactctccaccactatcacaggaagaacatgtcagtcttggtcgtctatgacaccacattggcatcggaggatcccattatactatccaaatgcrtatgtctatcatgttagccataaaaggaacaatagtcaactaaaatttctcttagctggcccatgctacaagctcacttcctaggtccaaatttctcatagactcagagtttgtagcaaaatgtctcaggaaacttacttttgagcaaaaggtctgaatgaagagaagttttaggattgctatctttcataacaatttgatggaagcagcaggatatatggaggtggtgaagtctcattaatgtaaagctaaggagatcaaatgaccaaatgctgagacaaagtatcattccacaatgcccactaaaggtccatgcagtctttcaaccatgcaattctatcattctatcctccattccctgaagtgaaatttgtgtttgccatttttgacacgaatcagaagtaacaaattcaggctgggtgcagtggctcaggcctgtgatcccaacactttgggaggacaagacgggcagatcaccagaggtcaggagttcaagaccagcctggctaacatggcaaaaccccatctctacgaaaaattaaaaaattagccggtcatggtggtgggtacctgtaattccaactacttgggaggctgaggcaggagaarcacttgagcctgggattcagagtttgctgtgagccgagaacatgccactgcactccagcctgggtgacagagcaagactcaatctcaaaaaaaaaaaaaaagaagaagaagaagaaaagaagaagaggaagaagaagaagaggaagaagaagaagaagaagaagagtaagagaaattttttggagccgcaggaggagccagaagaagaagaagaagaagaagaagaagaagaagaagaagaaggargaagaagaagaagaagaagaagaagaagaagaagaagaagaagaagaagaagaagaagaagaagaagaaaatagaaatgagtgcatatatttatatatgagtactagcctgtatgaacacactgggttctaagcaccagttttctgaagggatatgggttgtcaggcagagtaaaagcaggaatgcagatgagagtcaggaagtaaacagatgtggtgattaaaatgggcaggtacatggacaaaaaaatgcatgtctgacaaaaactggcctcttgccataagtgagtatgaataatatggaaaaactgtttgcacatgttgaacagcagacagtacaacctgagatagtttagaaagggaaacaaataagatcaaccccataattacccttcctagacttaagggcaaagagttttaaccaaagcattccacagcagtcttgctaaactggggagagagactggagttttgtttactaataaaaccgagattttctaggttaggtaataatgagaaagtatttgtggagaaaaggagctccaggaatacacacagaagtctcttcaagtctctggctgaacagaaagctgtgtatgcacagaaagagtttccagagagaaaggagaacaaagaacagctactggggaaagaacaactgctggggaacagtgagctcaatgaagatgccagagctcacatagcactgggaggtatttgagctctgaccagcctgaggagagacacttcattgaacatcttgggcattcagcaaagaccccaaaaaaccatacttcaggagtagaattaatgcattcctagaataaagtctactccagaaacaccctagaaaagcttagaaaccaagtctaaaaagatccaaatgatctccaagtaaattaattgcctgtcagaagaaaacaacctcttcagaggtaaacaacaaaattaaattgctcaattatatagtatgcacaatgtgtggcatacatttaaaaatttgctaaacatacaaaaagcatttagtgtgacccataaccaggagaaaaatcagtcaatacaaatagacccaaaaatgataaaaataacagaattggcaaggagatttaaaatgtatgtatcataattgtgttcaaggatttaaagaaagcgtggacaagaaataaataaatggataatatcaacagaaagaaaaattgtaaaaggaccaaatggagagtcaagaactgaaaaaaaagacatctctttaatgagaaaatcactacatggccttataatcatattagatagtacagatgataaagctaactagaaaatattagggtggtgcaaaccatagcacgcttatacaaagcctgagaagataaacagagcctcaaggacatctatgaaaatatcaaaatatttaatatttgtttaaagcaagtcacagaggargggaaagagatattggaacagaaaaaatacttgaagcagtgatggctgatgactttctaaatatggaaaaaatgataaactcacatagtcaagaagctcaatggatcagatataggattttaaaaagtaaagctgtatgatttatttggacacatcataattaaattgtccataatcaaagatagaaagtaaaatcttatttgaagcccaagggaaaaaacatacctttacatagagtaacagtgacacaaatgactgatgccttctcatcagaaacaacacaaatcagaaacaatagaataacacctttagagtggtaagaagaaaaaaagatcaaatcagaaacaacaaaataacacgtttagagtggtaaggaggaaaacaagatcaaatcagaaacaatggaataacacctttagagtgtaagaaagaaaaaaagatcaaatcaggaacaacagaataacgccttcagagtggtaagaaggaaaacaagataaaatcagaaacaatgaaataacacctttagagtagtaagaagaagaaaagatcaggtcagaaaaaatggaataayatgctaagaagaaaaaaaaagatcaagtcagaaacaatggaataacacctttagagtgaaaagaaggaaaaaaacccagcaagcttaaacgctatgcacagcaaacaattccactgaaaatgaatgttacgtaagtacatattctgtcctcctaaaaacaaagaacaaataaaagaatgtttcatcagcaggattatgtaataaaagatgtgaaagaatgctatgtaagtagaagaaaaataataccatatgggaattggcatcaaaaccacaaaatactatcaaaacaaaaaaactttattgataaatttaacacaatatgcaaaagaactataccatgtatactacataacattggtgagaagaaaattagaagatctaaataaagacacatcatgcttatagattaaaaaatccaatgtcacttttcacaaaactgatctttagyttcaacccacacccaagcagaattcctgcagtcttttcttgaaaacctaacagaatgtatatgctagaatcaccaagacaatctttaaaaagaataaaaaacttggaataaaatcacaagtttgtgggatagatgcatatggtaatatggaaattctcataaagacacagtaatcaagacatgtggtattggctgggacgcttggctgtaatcctaacactttgggaggccaagatgagaggattgcctgagatgaggagttgcagacaagcctgggcaacatagcaagaccctcatctctacaaatatttaaaaaaattagccaggtttggtgccatgtgcctgtagtcccagctattcaggaagctgaggtgggaggatcactggagcccatgaggtggaggctgaaatgagccatgattgtgctactgaactttagcctgggagacagattaaaaccttccctctctctctcaaacaaacaaacaaaaaatacatagtattgggcaaaacatatgcaaacaaaaacagaaaagggtcagcataaatttacatatatggtcaatttattttcaatacaggtagcaaagcaatttaatgaggaaatttttttccaaaattggtctgaaacaactggatagccatagaaaaaaactataacaaatgtgacgcttgaatcctactgtatgactcaaattaaattaatttgagatagctcttagacctcaatgtaacagctaattctgaggctgaaatataagactgctatgaaaaagtatagtatcttataaccttggagaaggaaaaattttttgagggaagaaccagaaaacactaactgtaaaagaaaacaaatgataatgtggacattcattgaataaaaacttatgctcaccaaatatgactgttaagaaaataaataagtaagtaacacactggaagaaaaacactctcatccatatatctgacaaatggcctgtatccagagtatagaaacatttctcccactcactaatcagaggacaaacaacctaatcaaaatgggcaacaggcttgaayagtcatttcttaggagaagatgcacacagagccaacaatcacctgaaaaagtgcacaacatcttagccatcaaaaatcaagagttataaccctcataagatgacactgaacatccagtgtacatggatatcattaagaagacacaataataagtggtgtcaccgatttggagctagaatgtgycactctctcatatgctggtggaagttcaaaatcatacaacaaattaaaaaatcagtctgatgctttcttataaagttcgataaatatgcatctatcctacaaacctgtaattctattcttgaatatttaccccccaaaatgaaaacataagtccacaaaaatctatataaatattcatagcagctttatgttttataaactcaaaataaaaactatttcaatgttttcatcaaaagaaaatgaaaactatttaaatggtttcatcaaaagaaaatgaaaaaagaatttccagtatatttatacaaaggaatactattcatcaacaaggaacaagttactgatagtctcagaagcatgaacaaacctcraaaatatattaaggaaagaagccagacgtcaaagtgtatagtctgtatgagtccattcatgtgagtttatagaaaacacaatttatggtgaaagaaaccaatagcatttgacactggccgtgggaagagggtagcagagattgattgagcagccacacaagggagtttctggggtggtgaaaatgttctgcattgtgagggcagtgtgggctacacaagtatatgtatttatcaaatctcatccagctacatttaagatctgtgcatctcactctatgtgaaaatatactcaactgaaaaacagagcaggtatctgtttcaggtgctacatcacttgatacgtccagttgtgttaaaaaccactgcctaacatcctcaaatgggggatctgggcttgagactaggtcacatgtgtagagtctctacagagaccgtgttggattcccatgctccataatacgttccaagttttctcagacagccacaggtcatgaatgtgaggattctgagaggttggagcaacgttcttgggaggcataatggggaaggcattctccaagattcctccagcctggggtcttcacctgctgtgcctcttactgcattgttttctgactcatccatagccacttgaccccttcagatcccatagtctacctagccgtctccctttatgccttgggtcccgctgttctttcaactcatcacccattccttcagtcccagagtggctgcagccagcagaggatggactgagagcaggagaggaggtcgtgcccatgaacccatcctagagaagcagcatcctgcctgggagctagttttccagggaagcttttataagtcctgtagacccaaacccacttgctctaccagatacagtatttatagtaatactattttcatgattattttatattgcaaatgtagagcatttatgctacactatgagtaaatagagtaagggggctggcatgggaattatataatcttggatgccacttcttccttggggaaatgtatttgagttccaacttacatattactatatagtcttatagagagagagacaaagagctagacagacagagatatctttgtatgtgcattaaaaaatctaagatacatatttcaaaatctgtgtcatttattctggaggaaagtatttggcagaaggtgaaaggaagatattctgatcctttcttgtacagacatgtattatctcagttttcatagagagcatatactacttttgatgttttaaaacaaaaattataatctgtgatgtgtccacagttgtttaaaagttgaagctgaagaccatttgtgcttgtggcaatattattgtggtataatgggaatatttcaaaggcacttgttaacactttgttacagcaaaatgtagagggcgctaagtgcccttgaatattctcccatctctggtgacctgtgttgttttgaaatttgcagtggcctgaccaggaactactgcaggaatccagatgctgagattcgcccttggtgttacaccatggatcccagtgtcaggtgggagtactgcaacctgacacgatgtccagtgacagaatcgagtgtcctcacaactcccacagtggccccggttccaagcacagaggctccttctgaacaaggtaagaaatttgtggttagacatctatatactgggatgaaaaaccatggaaaatcttactgatgcagaagccttcagtggtacactggagggttggttgagggtctgcaatgtggaggaaagcctcagcgccctctctgggggatccagaactgtgatttttggcacgctgtgaggaggcagtgtctttaggaagggcacggtgtctttaggaagggcacagacccgccagggcactggacttaccactcccctggttattaaatgggtcatttcagtgtcctagccaaaatggatattctaacagcctgccaaatatgtgaagatttccaagccaataagcctttccagtgatttaaagtagrcttttttcattgcaatctacagtttgcagtttcttaagaacatggcctttgagtatgatatcctagagaaacctaaggagactgcattatttttctattgtcctggggctgcatagcaggaggtaaccaacgaatgctgtctctccctggyctatctcagtctttcacaggctctgttcacctcagctttgaagttagaaatttctaggtgttcttgcctcttcttctcatgaaacctgcattggcagtgagtctacagaagaagaggaagagaattctgctttgttacaattcaggactctgggcactagaagattccctatctctcctccaagggaataagttgtttgtctctaaccctccttgagaaacaatgagtctttgcctgcactcctaaatgtaggatgatttcctgcccaaattttcaaaagattaagccttttgccttggtatgagcaatggtctagggaaatgcgcaagggtcttgtgtcggcccctgactgaccaccagtcacctcctacagcctgcaccaaggaatgcattgcattctggtcttctgccctgtggttctcatgaaaaccagcagagattcatatgatggagctgcacatgaatgtaatttccaatgtccagcattctcctctgttctttatctttagatttaaaaataatgtttctatgaacttattaaaattctagaatactatgaatctactgggtcttttcacatccttttgctactagtagaaaaaagaatagtaataattttcagaggctactgtccagtatgtgacataaattgtctcccatgtttctctgctcatgcaattactgagtatgatttattttattttaatttcagcaccacctgagaaaagccctgtggtccaggattgctaccatggtgatggayggagttatcgaggcatatcctccaccactgtcacaggaaggacctgtcaatcttggtcatctatgataccacactggyatcagaggaccccagaaaactacccaaatgcgtatgtatttgattaaaacmataagaggagcaacagccaactcaaatattggttagaagacccatgctttaagctcacttcctagggacaaatttctcttagactcacattttggcaaaatgtctcaggacctttgcttttgagcaaagagtctaagagaagagaaattttaggcctgctatttttcctaatagttttatggaaggagtagaatatacggaagtggcgaagtcatattaatgtaaagctcagaagataaatgaccaaagcttaaacacagcaccattccacaatgcccactaaaaatcaatgtcatctttcactcgtgcaattctgtcattctaaatttcaattcccgaaggtttgtttgccatttttgtcatgggtaataagtaaaaaaaaaaaaattaagatgtgtatatatatatrtatrtatatatatayayacacacacacacacacacaaacatctgaatatttatatatatgtctgaatatwtatatacttgtgtataaaacttatatttaaatttttgcataaatttatatatttttaatatttcaytaaaaattatattgtttcactatgtatgtctgagtatttttatatattttaatataacattttaaatattyatatataaatattcaggtatgtaactgaatattcatttacacacacaaatatatgtgtgcatgtgtgtatatatatatatacmcatatatatatatatatatacayatatatatrtatatatatatagtatatatatatatatatatatatacacayatatatatayatatatrtgtatatatatatrtatatatatayacacacacacacacacacacatacatacaggtataaacacactgggcctgaagcaccagtggtctgaaaggacatgtgttgccaggacttgaagagcaaaagcaggaaggcggatgagagtcaggaggtacacaaacgctgaaaagtaaaatggacaagtacatggacaaaaagcaggtataagcataacagccttttggaagtaaatgactataaaatatatgaaaatactgttttcacaagttgcacaacagatagtagtgtattgagataatttagaacagaaaacaaatgtgatcaaccccataagtgtgctgtatttcatcatggattgaaggaaaaagagatggagcccaagaagaccacagcagtcttgatgaactgagagacaccagagtttgggattacaaaggcagctgggattttctacacttggtaataatgagaaagaatttgtggagataaagagctacagtcatgtacctagaagtcacctcagtgtaatataaatctgcatatgcacagggagtgattccacaatgaaagtaggacaaagaacagctactggggaaagaayaactacaagggaacaatgagttcaatggagatggcagagctcacaaagcactgggggatatttgagttcttaccagctagaaaagagacctcattgcaaatcttgggcattcagtagagaccccagaaaagccactctttggaaacagagttgatgtattttaagagcaaaatctactccacaaaaatcctagcaaaattgaaaagcaagtcagaaagaccaaaatcctctcaacataaattagttgcccatcagaagaaagcttaacctcttcataggtaaacaataaaatcaaattgctcagttatctggcatccacaatatgtgacataaatttaaaaatttactagacatacaagaagcatttagtgtgatccataaccaggagaaaaatcattcaatacaaatagacccagaaatgacagaaatgatagaattagcaaaaacatttaaaatatacatatgatcayttgatcttgtgatcagatatcacaagagaagaaagagatacttgaacagaaaaaatgcctgaagcaatgatggctgaaaactttccaaatatgaagaaaaaaaarctcacagattcaagaaaactaatcaatcagaaatatgattttgaaaagtaaaaatgtatgatttactttggcaaatcttcttggttaaattgtctaaaatcaaagaaagctaggaaaattttataagccagaggaaaaaagattgtttatataaaggaacagttacacaaatgactgatgccttctcatcagaaacaatgaaagtcagaaacaataaagtaacatctttaaagtaatagaagaaaaacccaagaggtragggatcrtggcagacaggaggcaggactagattgcagctctggacagagcagcatgcagaggctcatattgtgaattttagccccatattgactgcaagaacagaccagcaatcctgagaggacccacagaccgtgtgaaggaagcagactgctcctgcaggataagggagacaccccaaatactgtgagttccccaactgcagaagtggaaaagggaggccttactccctcaaacacaccccacaactggagaagctgaaagtctgtttgcaggagaagttcccaactttacctgggcctcagtaaatttagagagctgagccaagcaaaatataggggtagaggaagcagcagagaagacctcagagcttgctggatccccaagcagctcattcctgcctggcaccacagagatccatcagaagtgtggccaaaggaacagagggtaaaactccacatggaggactgctctacctgaactttctaacaatttgaacagggggagaagcctcctggccagaacttgggggagggcatgaatctggtttgcagacttcacaggtgggggaaggactaaagcccttttctttcacagctgggaggtggaaagcctcaggcaagttttcaagcctgactttccccccacctggaaacagacttggagctgttgcggggttgggggcatggtgggagtaagaccagcccttcagtttgcatgggtgctgggtgaggcctgtgactgacagcttccctccacttcccygacaactcagatgactcagcagaggcagccataatcctcctaggtacacaactccagtgacctgggaacttcacccccacaccatacagaagcttcagtaagacgtgcccaaggaaagtctgagctcagacacgcctagtcccacccccaactgatggtccttccctacccaccctggtagcagaagacaaagagcatataatctttggagttctagggcccacccacctctagtccctctccacactagtatagctgatgcaggaggccaaccagcacaaaaatagagcattaaaccaccaaagctaggaacccctatggagtccattgcaccctcctccacctccaccagaacaggcactggtatccacagctgagagacccatagatggttcacatcacaggactctgtacagacagtccccagtaccagcccagagctgggtagacttgctaggtggcaagacccagaagacaggcaataatcactgcagttcagctcacaggaagccacatccataggaaaagagggagagtactacatcaagggaacaccccatgggataaaaacatctgaacaacagccttcagccctaccttccctctgacacagtctacccaaatgagaaggaaccagaaaaccaaccctggtaatatgacaaaacaaggctcatcacactcccagttcaccagcaatggatccaaaccaagaagaaatccctgatttacctgaaagagaattcaggaggttagttattaagctaatcagggagggaccagagaaaggcaaagcccaatgcaaggaaatccaaaaaaaaaaaggtataagaagtaaaaggtgaaatattcaacaaaatagatagcttaataaaaaaacaataaaaaattcagtagactttggacacacctttggaaatgtgacatgctctggaaagtctcagcaatagaactgaacaagtagaaaaaataaattcagagctcaaagacaaggacttcaaattaacccaatccaacaaagacaaagaataaaggataagaaaatatgaacaaagcctycaagatgtctgggattatgttaaatgaccaaatataagaataatcgtggctcctgaggaaaaagacaatactaaaagcttggaaaacatatttgggggaataactggggaaaacttacctggccttgctggacacctagacatgcaaatacaagaaacacaaagaacatgtaaatacaagcagcacaaagaacacctgggaaattcatcacaaaaagatcttagcctaggcacattctcatcaggttatgcaaagttaagacgaaggcaagaatcttaagagctgtgagacagaagcaccaggtaatgtataaaggaaaccctatcagattaacagccagtttttcagcaggaactgtacaagctataaaggattggagccctatcatagcctcytcaaacaaaacaattatcagtcaagaattttgtatccagcgaaagtaagcatcatatatgaaggaaagatacagtcgtttttggacaaacaaatgctaagagaattcaccattaccaagtcaccactagaagaactgctaaaaggagctctaaatcttgaaacaaatcctagaaacacatgaaaacagaatctctttaaagcataaatcacacaggacctataaaacaaaagtacaagttaaaaaacaaaaacaaaaaacaaaaccaaagtacggaggcaataaagaatatgatgaatgcagtggcacctcacatttcaatgctaaaattgaatctaaatggcctaaatgctccacttaaaggatacaaaaagagttggtggctggcaagatggctgaataggaacagctccagtctgccgctccccgtgagatcaacacatagggtgggtcatttctgcatttccaaccaaggtacccggctcatctcattgggactggttagacagtgggtgcagcccacagagggtgacctgaagcagggtggggtgtcacctcacctgggaagtggaaggggtcagggaactccctcccctagccaaaggaagccgtgagggactgtgccgtgaagaccagtgcattctggcacaaatactatgcttttcccacggtctttgcaacctgaagaccaggagattcccttgggtgcctacaccaccagggccctggatttcaagcccaaaactgggctggcatttgggcagacactaagctagctgcaggagttttttttcataccccagtggtccctggaatgccagcaagacagaaccattcacccccgtgaagaaagggctgaagccagggagctaagtggtctttctcagtggatcccacccccatggagcccagcaagctaagctccactggcttgaaattcttgctgccagcacagcagtctgaagttgacctgggacgctcaagcttggtgggaggaggggtatccacaaatactggggcttgagtaggaggttttcccctcacagtgtaagcaaaacygctaggaagtttgaactgggcagggtgcactgcagcttggcaaagccattgtagcaagagtgcctctctagattcctcctctctgggcagggcatctctgaaagaaaggcagcagccccagtcagaagcttatagataaaactcccatctccctgggacagagcaactggaggaaggggtggctgtgagtgcagctccagcagacttagtttcctgcctgccagctctgaaaagagcaccagatcccccaacacagcactagagctctgataagggacagactgcctcctcaagtgggtcctggtttcagaagataataagaaactcctctgagctaaaggagcatgttctaacacaatgcaaggaagctaagaaccttgaaaaaggtcagaggaattgctaactacagtaagcagtttagagaagaacataaatgaccttagggagctgaaaaacacagcacgagaacttcatgacacatacacaagtatcaatagcaaaatcgatcaagtggaagaaaggatatcagagattgaaaatcaacttaatgaagtaaagcgtgaaaacaagattaaggaataaagaatgaaaaggaatgaacaaatcctccaagtatgggactatgtgaaaagattgaacctacgtttgattggtgtacctgaaagtgatgggagaatggaaccaagttggaaaacactcttcaggatattatccaggagaacttccccaacctagcaagacaggccaacattcaaattaaggaaatacagagaataccacattcaaattcaggaaatacagagaacaccacaaagatactcctcaagaagagcaacctgaagacacataatcgtcagattcaccaaggttgaaatgaaggaaaaaaatgttragggcagccagagagaaagtttgggttacccacaaagggaaccccatcagactaacagtggatcttcctgcagaaactctacaagccagaagagagtgggaggccaatattcaacattcttttttactattattatactttaagttctagggtacatgtgcacaaggtgcaggtttgttacatatgtatacatgtgccatgttggtgtgctgcacccattaactcttcatttacattaggtatatctcctaatactatccctccccactccccccatcccatgacaggccccggtgtgtgatgttccccactctgtgtccatgtactctcattgttcaattcccacctatgagtgagaacattcggtgtttgratttctgtccttgtgatagtttgctgagaatgatggtttccagcttcatccacatccctacaaaggacatgaagtcatccttctttatggctgcatagtattccatggtgtatatgtgycacattttcttaatccagtctaccattgatggacgtttgtgttggttccaagtctttgctattgtgaatagtgccgcaataaacatatgtgtgcatgtgtctttatagcagcatgatttataatcctttagatatatatccagtaattgtatggctgtgtcaaatggtatttctagttctaaatccttgaggaatcaccgcactgtcttccacaatggttgaactagtttacagtcccaccaccagtgtaaaaatgttcctatttctccacatcctctctagcatctgttgtttcctgactttttaatgatcmccattctaactggtatgagatggtatctcattgtggttttgatttgcatttctctgatggccagtgatggtgagcactttttcatgtgtctcttgactgcataaaagttttcttttgagaattgtctgttaatatcctttgccaactttttgatggggttgtttgattttttttcttgtaaatttgtttatgttctttgtagattctggatattagccctttgtcagatgggtagattgtaaaaattttctcccattctgtagcttgcctgttcattctgagggtagtttcttttgctgtgcagaagctctttagtttaattagatcccattggtcaattttggcttttgttgctattgcttttggtgatttagtcatgaagtccttgcccatgcctatgtcctgaatggtattgcttaggttttcttctagggtttatatggttttaggtctaacatttaagtctttaatccatcttgaattaatttttatataaggtgtaaggaagggatccagtttcagctttctacatatgkctaggcagttttcccagcaccatgtattaaatagggaaacctttccctatttcttgtttttgtcaggtttgtcatagatcagatggttgtagatgtgtggtattatttctgagggctctgttctgttccattggtctatatctctgttttggtaccagtaccatgctgttttggttactgtagccttgtaatgtagtttgaagtcaggcagagtgatgcctccagctttgcttttttggcttaggattgtcttggcaatgcatgctcttttttgttccatatgaactttaaagtagttttttccaattctgtgaagaaagtcattggtagcttgatggggatggcattgaatctataaattaccttaggcagtatggccattttcacaatattgattcttcctatccatgagcatggaatgttcttccatttgtttgtgtcctcttttatttcattaagcagtggtttgtagttctccttgaagaggtccttcccatcccttgtaagttggattcctaggtattttattctctttgaagcaattgtgaatgggagttcatccatgtccctacaaaggacatgaagtcatgtatgggaatgcttgtgatttttgcacattgattttgtatcttgagactttgctgaagttgcttatcagcttaaggagattttggtctgagaagatggggttttctaaatatacaatcatgtcatctgcaaacagggacaatttaacttcctcttttcctaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctatgggtttgtcataaatagctcttattattttgagatatgtcccatcaatacatagtttattgagagttcagcatggagagctgttgaattttgtcaaaggccttttctgcatctrttgagataatcatgtggtttttgtctttggttctgtttatatgatggattacatttattgatttgcatatgttgaaccagccttgcatcccagggataaagccaacttgatcatggtggataagctttttgatgtgctgctggattcrgtttgccagtattttattgaggatttttgcatcaatgttcatcatggatgttggtctaaaattctcatttttgttgtgtctctgccaggmtttggtatcaggatgatgctggcctcataaaatgagttagggaggattccctctttttctmtgattggaatagtttcagaagaattggtaccagctcctctttgtatctgtggtagaattcggctatgaatctctcctggactttttttggttggtaggctcttaattattgcctcaatttcagagcctgttattggtctattcaaggattcaatttctttctggtttagtcttggtaggktgtatgtgtccaggaatttttccatttcttctagattttctagtttatttgcacagaggtgtttataatattctctgatggtagtttgtatttctgtgggattggtagtgatatcccctttatcattttttattgcatctatttgattcttctctcttttcttctttattagtcttgctagtggtctatcaattttgttgatcttttcaaaaaaccagctcctggattcattgatgttttgaaggtttttttgtgtctctatctccttcagttctgctctgrtcttagttatttcttgccttctgctagctttttaatgtgtttgctcttgcttctctagttcttttaatggtgatgttagggtgtcaattttagatctttcctgctttctcttgtgggcatttagtgctgtaaatctccccctacacactgctttaaatgtgtcccagagattctggtatgttgtgtctttgttgtcattggtttcaaagaatatctttatttctgccttcatttcgttacatacccagtagtcactcaggtgcaggttgttcagtttccatatagttgagcagtttttaatgagtttcttaatcctgagtcctagtttgattgcactgtggtctgagagacagtttgttataatttctgttcttttacatttgctgaggaatgcctcacttccaactatctggtcaatttcagaataagtgygatgtggtgctgagaagaatgtatattctgttgatttggggtggagagttctgtagatgtctattaggtctgcttggtgcagagctgagttcaattcctggatatccatgttaactttctgtctcattgatctgtctaatgttgacagtggggtgttaaagtctcccattattattgtgtgggagtctaagtctctttgtaggtctctaaggacttgctttatgaatctaggtgctcctgtattgggtgcatatatatttaggatagttagctcttcttgttaaattggtccctttaccattatgtaatggccttctttgtctcttttgatctttgttagtttaaagtctgttttatcagagactaggattgcaacccctgctttttttgttgttttccatttgcttggtagatcttcctccatccctttattttgagcctatgtgtgtctctgcacgtgagatgtgtcttcagaatacagcacactgatggatcttgactctttatccaatttkccagtctgtgtcttttaattggagcatttagcccatttacatttaaggttaatatttttatgtgtgaatttgatcctgtcatcatgatgttcgctggttattttgctcattagttgatgcagtttcttcctagcatcgatggtttttacaatttggcatgtttgtgcagtggctgataccgattgtttctttccatgtttagtgcttccttcaggagctcttgtaaggcaggcctggtggtgacaaaatctctcagcatttgcttgtctgtaaaggattttatttctccttcacttatgaagcttagtttggctggatatgatattctcagttgaaaattcttttctttaagaatgttgaatattggctgccactctcttctggcttgtagagtttctgctgagagatctgctgttagtctgatgggcttccctttgtgggtaacccgacctttctggtgaatctgacaattatgtgtcttggagttactcttctcgaggagtatttttgtggcattctctgtatttcctgaatttgaatgttggcctgcctttgtaggttggggaagttctcctggataatatcctgaagagtgttttccaacttggttccattctcctcgtcactttcaggtacaccaagcagatgtagatttggtcttttcacatagtcccatatttattggaggctttgttcatttctttttactcctttttttctctaaacttctcttctcgcttcatttcattcatttgatctttaatcactgataccctttcttccacttgattgaatcaactactgaaacttgtkcatgtgtcacgtagttctcgtgccatggttttcagctccattagatcatttaaggtcttctctatgctgtttattttagtctgccattcatctaaactttttcaaggtttttagcttctttgcaatgrgttcgaacatccttctttagctcggagaaatttgttattacagatcgtctgaagccttcttctctcaactcatcaaagtcattctctgtccagctttgttctgttgctcgtgaggagctgcgttccttcggaggagaagaggcaccctgatttttagaattttcagctgttctgctctggtttctccccatctttgtggtttatctacctttggttcttgatgatggtgatgtacagatggggttttggtgtggatgtcttttctgtttgttagttttccttctaacagtcaggaccctcagctgcaggtctgttggagtttgctggaggtccactccagtccctgtttgcctgggtattaccagtggaggctgcagaacagcaaatattacagaacagcaaatgttgctgcctgattcttcctctggaagcttcatctcagaggggcacccagctgtatgaggtgtcagttggcccctactgggaggtgtcccccagttaggctactcgggggtcacggacccacttgaggaggcagtctgtccattctcagatctcaaactctctgctgggagaaccactactctcttcaaagctgtcagacagggatgtttaagtctgcagaagtttctgctgccttttgttcagctatgccctgcccccagaggtggagtctacagaggcaggcaggtctccttgagctgtggtgggctccacccagtttgagcttcctggtcgctttgtttacctactcaagtctcagcaatggcagacgcccctcccccagctttgctgccgccttgcagttcggtctcagactactgtgctagcagttcaatctcagactgctgtactagcagtgagcaaggctctgtgggcatgggaccctctgagccatgtgcaggatataatmtcctggtgtgccgtttgctaagaccattggaaaagtgcaatattagggtgggagtgtcccgattttccgggtacatctgtcatggcttcccttggctaggaaagggaattccctgaccccttacacttcccgggtgaggcaatatcccgccttgcttcggctcactctccgtgggctgcacccactgtctgacaagccccrgtgagatgaacccagtacctcagctggaaatgcagaaaccacccatcttctgctttgctcatgctgggaactgtggactggagctgttcctattcggccatcttgaaacctcccctctctcacgatcacaaggtcccacaataggccgtctgcaggctgaggagcaagaaaagccagtctgaattccaaaactgaagaaattggagtctgatgttcaagggcaggaaacatccagtgccaaagaaagatgtagaatattcaacattcttaaagaaaataattttcaacctagaatttcatatccagccaaactaagctttataacaaaggagaagtaaaatcctttacaaacaagcaaatgctgaggaattttgtcaacaccaggcctgccttacaagaggtcctgaagaaaacmctaaatatggaaaggaaaaaccagtaacagctactgcaaaaacataccaaattgtaaacaccatcaacactataaagaaactgcatcaactaatgggcaaaatagccagctagcatcataatgacaggatcaaattcacacataacaataytaaccttaaatgtaaatgggctaaatgcccyaattaaaagacacagactgggaaattgaataaagagtcaakacccattggtttgctgtgttcagaagacccatctcagggtgaaaagacatacatgggctcaaaataaagaaatgaaggaatatttaccaagcaaatggaaagaaaaaaaaagcagcggttgcaatcttagtctttgatgaaacagactttaaaccatcaaagatcaaaagagacaaaggagggcattacctaatggtaaaagtatcaatgcaacaagargatctgactgtcctacttatatatgcacccaatacaggagcacccagattaataaagcaagttcttrgagacctacaaagagacttagacttccacacaaaaatagtgggagactttaacaccccacagccaatattagatcgacgtgacagaaaattaacaaggatattcaggacgtgaattcagctctggaccaagctgacctaatagacatctacagaactcgacaccacaaatcaacagaatatacattcttctcagcaccacattgcacttattctaaaattgaccacataattggaagtaaaacacttctcagcaaatgccgtagaatggaaatcataacaaacagtctctcagaccaaagtgcaatcaaactagaactcaggattaataaactcactcaaaaccacacaactatatggaaactgaacaacctgctcctgaattactactgggtaaataacaaaattaaggcagaagtagataagttcttagaaaccaaagagaacaaagacacaatgtgccagaatctctggtacacagctaaagccatgtttagagggaaatttatagcactaaatgcccacaggagaaagcgggaaagatctaaaatcaacaccctaacatcacaattcaaagaaccagagaagcaagagcaaacaaatacaaaagctagcagaagacaagaaataactaagatcagagcagaactgaaggggataaagacacgaaaaccctttaaaaaattaataaatccaagagctggttttttgaaaagattaacaaaatacatagaagcctagccagactaataaagaagaaaatagagaagaatcaaatagacacaataaagaataataaaggggatatcaccaatgatgccacagaaatacaaactaccatcagagaatactttaaacacctctatgcaaataaaatagaaaatctaaaagaaatggataaattcctggacacatacaccctcccaagactaaaccaggaagaagtcaaatccctgaatagaccaataacaagttctgaaatcgaggcagtaattaatagcttaccaaccaaaaaaagcccagaccagagggattaacagtcaaatcctaacagaggtacaaagaagagctagtactattccttctgaaactattccacacaatagaaaaagagggactcctgcctaactcattttatgaggccagcatcattctgataccaaaacctggcagagacacaacaagaaaagaaaatttcaggccaacatccctgatgaacatcaatgtgaaaatcctcaataaaatactggcaaactgaatccagcagcacatcaaaaagcttatccaccatgatcaagttggcttcatccctgggatgcaaggctggttcaacatattcaaatcaataaacataatccatcacataaacagaaccaatgacaaaaaccrtatgattatcgcaatagacgcagaaaaggcctttgataaaattcaatacccaatcatgctaaaaactcttaataaactaggtattgatggagcatgtctcaaaataataagagctacttatgacaaatgcatagccaatatcatactgaatgrgcagaagctggaagcattccctttgaaaaccagcacaagacaaggatgccctctctcaccactcctattcaacatagtattggaaattctgtccagggcaatcaggcaagagaaagaaataaaggtattcaagtgggaagagagggagtcaaattatttctctttgcagatgacatgattgtatatttagaaaactctatcatctcagcccaaaatctccttaagctgataagcaacttcagcaaagtctcaggatacaaaatcaatgtgcaaaaatcacaagcattcctatacaccaataagagacacagagccaaatcctgagtgaattcccattcacaattgctacaaagagaataaaatatacctaggaatccaacttacaagggatgtgaaggacctcttcaaggagaactacaaaccactgctcaaggaaataagataggacacaaacaaatggaaaaacattccatgctaatggattggaagaatcaatattgtgaaaattgccatactgcccaaagtgatttatagattcaatgttatccccatcaagctaccattgatttcttcacataattagaaaaaactactttcaatttcatatggaataraaaaagggcctgtatatccaagacaacctaagcaaaaagaacaaagctggaggcatcatgctatctgacttcaaaatatactacaaggctacagtaacaaaaacagcatggtatggtactggtaccaaaacagatatatagaccaatagaacagaacagaggcctcagaaataacaccacacatctacaactattggatctttgacaaactggacaaaaataagcaatggggaaaggattccctatttaataaatggtgttgggaaaactggctagccatatgcagaaaactgaaactggatcccytccttacaccttatacacaaattaactcaagatagattaaagaattaaatgtaagacctaaaaccataaaaaccctagaagacactttgggaggccgaggtggatggatcacgaggtcaggagatcgagaccatcttggctaacacagkgaaagcccatctctactaaaaatacaaaaaattagctgggtgtggtcgtgggcacctgtagtcccagctacttgggaggctgaggcagragaatggcatgagctgaggaggttgagcttgcagcaagccaagattgtgccactgcactccagcctgggcaacagagtgagactccatcaaaaaaacaaaaacaaaaacaaaaaatcaaaccctagaagaaaacataggcaataccattcaggacataggcatgggagaagacttcatgactaaaacagcaaaaccaatggcaacaaaagccaaaatttacaaatcagatctaattaaaataaagagcttctgcacagcaaaaaactctcatcagagtgaaaaagcaacctatggagaaaaattctgtggtctakccatctgacaaagggctaatgtttagaatgtacaagcaacttaaacaaatgtacaagaaaaaaaaaacaaccccatcaaaaagtgggcaaaggatatgaacagacacttctgacaggaagacctttatgtggctgacaaacatgaaaaaagctcatcatcactgttaattagagaaatgcaaatcgaaaccacaatgagataccatctcatgcccgttagaatggcgatcattaaaaagtcaggaaacaacagatgctgaagaggatgtgtggagaaagaggaacacatttacactgttggtgggagtgtaaattagttcaaccattgtggaagacagtgcggtgattcctcaaggatctagaaccagaagtaccatttgacccagcaatcccattactgggtatatacccaaaggattataaatcattctacaataaagacacatgcacacgtatgtttattgtagcactattcacaatagcaaagacttggaaccaactgaaatgcccatcaatgatagactggataaagaaaatgtggcacatatacactgtggaatactatgcagccataaaacaggatgagttcatgtcttttgcagggacatggatgaagctggaaaccatcattctcagcaaactaacacaagaacagaaaaccaaacaccatatgttctcactcataagtgtgagttgaacaatgagaacacatggacacaggaaggggaacatcacacacaggggcctgttggggwgttgaggctaggggagggattggattaggagaaatacctaatgtagatgatgggttgctgggtgcagcaaaccaccatgacacgtgtatacctatgtaacaaacccacacattctacacatgtatctcagaacttaaagtataataataataagatacagaactgcagaatgaataagaactcaccaaccatctgctgccttcaggagactcatttaagacataaggactcacataaacttaaagtaaatgggtggaaataataataagtggtgtcactgatgtggaggtagattataaaactcttatcatatgctggtggaagatcaaaatgataaaacgaattaaaaaatcagtcagatggtttcttaaaaagttccatcaatatgcctctatcttacaaacctgcaattctattcctgaatctttatcccaaggaaatgaaaaagtaagtccacaaagagttctatatgaatatttataggagctttatttattataattcaaactgtaaaaataatttcaatgttcatcaataacaaaatgaaaaaataatttgcaacctactggtacacttgaatactattcagcactgagtatcttaaatagcatggatggagctcaaaaatatactcaggaaagaagccatgtrtattctgtatgagttcatttacatgagatcatttacatttcctccaaaagaggaaaaactaatttctgttgaaagaaaccaatgtatttgcctctggcagtggtaagggggtagcacagattaattgggtagggactcaagagagtttctggggtcacagaaatgttccgtgtggtgatgggagtttgggctccacaggtataggtgttgatccaaaatcatcaaaaaaacaacattgcagatctgtgcatctcactctgtgggaaagtatatctcaactgtaaaaagggcagaaattgcttttaaacgctcagccttttagcacatccagttgcttggagaaccagcttactcaaatgggggtctaggctggagactaggtcacaggcatagagtctctaaactttcccatggcacataatacgtttcaggttttctcagagagctgcaggttagtaatctgaggattctgacaagttgggtcaacgttcctaggaggcatgaatgggagtgcattctctaagatccctccaccccagggtccttgctttctgtgcctcttactccattgttttctgactcctctgtagccactcgacctcttcagatcccattgtctacccagccatcgccctttatgacttgggtcccactgttctttcatctcatcctccattccctcagtttcggagtggctgccgctagcagaggatggactgagagcaggagaggtggtcctgcccaggaacccatcctagagaaatggcatcctgtctgggagctagttttttagggcaggttttataagtcttgtaaagccagacacacttgatctacctggtatgttatttacagtaatactattttcataattgcttttcactctaaaagtagagccttttagctacactgtgagtaaataaaggggctggcctgggaatggtatcatgttggatgttgtttcttccctgaagtaatatatatcagttacaatttacatgttactgcagagtcctagagagagacacagagaatgagacagataccaatacatttttatgtgcattaaaaaaatctaaggccaggcgcagtggctcacacctgtaatcccagcactttgggaggccgaggtgggtggatcacgaggtcaggagattgagaccatcctggctaacacggtgaaaccctgtctctactaaaaatacaaaaaattagccaggcgtggtggcgggcgcctgtagtcccagctactcaggagactgaggcaggagaatggcttgaacccaggaggcagaccttgcagtgagccgagattgcgccactgcactccagyctgggcgacagagcgagactccgtcacaaaaaaaaaaaaaaatctaaaatgcactcttcaaaatctatgtcatttattctggaggaatgcagttggcagaaggaggaagatattccgaatttttcttgtatacatttatgtatgatctcagtttttttatggatcatagaccaattttgatattttaaaataaaaattataatctatcttggaaatttacatggttctttagaacttgaggaccgtttttgcttttcggaatattattgtacctaaaatgggaatattacaacgtcactttttaacactttgttataacaaagtttagacagcgctgggtgcccctgaattttttcccgcctcttgtgacctgtgttgttttggaatttgcagtggcctgaccgagaactactgcaggaatccagattctgggaaacaaccctggtgttacacaaccgatccgtgtgtgaggtgggagtactgcaatctgacacaatgctcagaaacagaatcaggtgtcctagagactcccactgttgttccagttccaagcayggaggctcattctgaagcaggtaagaagtctgtggccagatatctacacatttgaacattgggatgaaaagagatrgaaaatctgactgatgcagaagccttccatgctacacagaaacttgagggtatggcaggtggaaagaagcctcagcactctctctggtggagcaatttttggcgcaacgtgcgtgggcggtgacttcaggaatggtgcaaacccacctgggcacttgacttaccactcactttgttatgaaaggggttatctcggtgttccagacaaaattccaattctaacatcaggccaaatttgtgccaaatttcacactagtgagtgtttccaggcatttattaaaatggacagtgttcattgcaatcttcagcattgcagttgctgaggtatgtggccgctgagtttgtcatcctggggaaacctaatatgatgatatttattccatctaatcctggggctatttggcagtaaataccacagaatacactatttctctggcttatttcagtcttaggtaggctctgcacacctatgcttggaaggcaggaatttcttggtgttcttgtgccttcttctcatggaacgtgcatctttggtgtgtgttgagaggaagggtagtagacttctgctttgttgcaatgcaggatgctggaacaagaggattccctgtctctactgtaagggaataagattttagcctccatccttctctaagaagcaatgtgtctttgcctccaagtactagatgcaggaccatgaactgccccgtccaccagaagcttaaggctttggcttttcaggagcaatcatctagggaactgtgcagggttttcatgtctgtcccctactgacagccaatcaccatacagcctgcataacctaatccatcatcgtctggtttcctgcctcattgttttcatgaacaaccagtagagagccatacgaaagagcttgcacatgagtctttgttccaattgtaagagcactgataggtccttttcccaccaggttttgaatataaaatttctaagaacttattaaaatattagaatgytattaatctattgtttttgcttcagcatgtccttctgcttgtgagtatactaaagagaacagtcataattctgaaactactgtcctgtttgtgtcataaattgcttcacatgtttctgcatactagtagttactcagcttgattttgtctattttcagcaccaactgagcaaacccctgtggtccggcagtgctaccatggtaatggccagagttatcgaggcacattctccaccactgtcacaggaaggacatgtcaatcttggtcatccatgacaccacaccggcatcagaggaccccagaaaactacccaaatgagtatgtctttgatgttacttgtaagaggagcaacagccaacttaagttcctcctagaagagccttgcttcaagctaacttgttaggacaaatttcccttagacccagaaggtgtgtcaaaatgtccagacaactttgcttttgatcaaagagtctgagagaataggtattttaggcttgctatcttttctaatagtctgatggaagcagaaggctacatggagctgatgaggtctttttaatataaagctcaagagatcaaatgatcaaatacttagagtgccattctacaaggctcataaaagatcaatgcactctttcacccatgcaattctatcattctaacctcccttctctgaaatgaaggctttttgccatttttgtcatgggtcacaagtaaataattcacatgtatatgagtatatatataaccaggtgtgtttattcagactagtatgtatatatatacatatatatgttcatataagttagtattcatatatatgttcatatatatatgttcatacagactagtattcatatatatatacatatatatayacacacacayatatatatatatatatatgttctagggaaacatgcaaggtttttatgtctgtccctgactgatgaccaaataccctatagcctgcacagctgcaagctgtatagccatacaatttgcaggacacacacacatacacacacacacacacacacacacacactaacwtataatataatataatataatataatataatataatataatataatataattaatatatataaacctgtgtgaacacactgggttctaagctccagttttctgaagggatatgggttgccagkagaggaagagcaaaagcaagaatgtagatgagaattaggaagtaaacagayatggagattaaaatgggcaggtacatggacaaaaaaccaggtctgacaaaaactggctttctgccataaatgactataaaagatattaaaaaacactttccacatgttggacaagagacagtacaggactgagataatttagaaaaggaaatgaatgagcgcaactccgtaactattatgactttcttcctggagaaccttcctggactgaagggcaaggaattggagccaaagccaaccacagcagtcttgctgaactgaggaaagagactggagtttgggatagctaagaaaatgtgtattttctatgctaggtaataatgagaaagaatttgtggtgaaaaggagctgaaggaatatgcatggaagtctaatataaactgcatatgcacagggagaaattctacaaagtgggacagagaaccactactggggaaaggacaaattcagggaaacagtgagctcaatggtgacgccagagctcacgtagcactgggggataccggggttctgatcagyccgaggagagacacctcattgaacatctcgggcattcagtagagaccccagaaaagtcatactttaggagtaggatttatgccttcttagaataaagactaccccagaaacaccctagtaaagcttaaaaaccaagtctaaaaggacccaaatgatctccaagtaaattaactgcctgacagaagaaaactcaaccatcactggaggtaaataacatgattacagtgctctgtaatgttgcattcacaaggagtgacatcatttaaaaatttatgaggcaggaaaaagcaattagtgtgatccataactaggagaaaaaccagtcaatacaaatagaccaagaaatagtagaaacgatggaattgacaaagaaattaaaactgtatatatgataattgtgttcaaagatttaaagaaaacatgaacatgagggaaacaaatgcagaatataaaaaaaagcaaatgcgtaaaacaaccaaatggaaattaaagaactacaaaaaagtataaccttaataaaatactcactggatggccttaatattagtttatacattacagaagaaaaagtgaaccagaagataactcaatgaaagccatacaatctgtaagacacacacacacgcacacgcgcgcgcgcgcrcrcacacacacacacagagagagagagagagagaaagagagagagagaaaggctgaaaaaaataaatagaaccttaaggatatcagtgaaaatagcaaaagatttaatatatgggtaaagcaagtcacagaaggacgggaaggagatattgggacagaaaaaaatactcaaagcaatgatggctgaagactttacacgtatgaagaaaatgataaactcacagtcaagaagctcaatgaatcagaaatagtatttttaaaagcaaaactctatgatttacttgggtacattatagataaatcrtccaacatcaaagataacaaggataatcttataagccagaggaaaacaatatcatttacatagagggacagtaatgaaagtgaccgatgccttctccttggaaayaatggcataacatctttaaagtgataaagagaaataaaaacagatcaacctaggacgacatgtccagccaaaacaaacaaataaacaaaaaaaccctttaaaataaacgtgatgtaaatacgtattctgccacctccagaggaaacaagsaaaaaaacaaaagaatgtttccaaggcaggcttctgtattaaaagattttaaggaaagttattcaggtagaagaaaaataataccagatgggaactttaatccatactaagtaatgaagagccctggaaatggcaaatggcaatgtcaatataaaatactcttatttatctaatttttaaatgtatttaaaggacaatttgtgatattaattaaaataataggaatatattgttgtttcaacgtatgtagtagtaaaattcataaaaacagtagcacaaataatgcagatgataactggaagtatactgttaatgagttttttgcattatccatgaagttatataatattaatagatggttgaatgtgatagtttaaggtgggatattataaatcctaggacaaccaaaaaaatttaaactgagaggaatggatagtaagaggaatagtccttttatgcaaaagaaggaagaaaaagaggaataaagaatataaaagatatggtgtaaacagaaaatacatagcattattgtagacacaaactgaactaccttatgagtatattaaatataaaaggattaagcattacaaataaaaggcagagattgtaaattgaataaaaaccacagctaagtgtgttctttttagaataaatactctttaagtgtaaagatctactttaaacaccaaaatatgaaaaaggatatataccatgaaaacctgaatcataaataagctggagtggtgattaatggatgcaggcactcctaaagactaataagtgaatgtggtcaaattgaagaaacaaaagtatatacgtgctcaatgtgcaaaaactttttctgtatacatgctatgatcctttggaaaattaaagttttaaagcaatatcactgacaatagtatcaaaaccaaaaaatatttagtgataaatttcacacactatgctcaaggactatacaccttgcactagaaaacaatgttgaggaaagaattaaaagatctaaatatacaccatgcttatagattaaaagactccatatcagttctcgtgaaattgatctttggatgaaacccacacccaagcactattgcaacagtccttttttggaaaaaaaaattggaggacttatataccttaatataaagacttataaaagtacaggaatcaagacatgtggtattggcctggccccttggctcatgcctgttaccccaacattttgggaggctgagtctggaggatggcttgagcccagatgttcaagaccagccttagcaacagagtgagaccctctctctacaaaaaataaacaattagatcgatgtgatgacttgcacatgtagtttcagctactcggaatgctgaggtgagaggattgcttgactcaggaggtctagccatgagtgagcattgatcatgcctctgcattccagcctggatgatggaatgagacactgtctcaaaaaaaaaaaaaaaaaaggatatgtgttattggccaaaaaagtatgcaaacctaaaaagggatggcccaccaccagacccacatacatatatggtaaatggattttccgtatagatggcaaagcaattcaatggagacaaaaatgttttacaaaatcattctgaaccatttggatatccatgatacaaaacaaaagcagaacttgacttttgcttttcatctcaaattattttgatatctcttccacctaagtgtcagagctaaaactgaacctgaaatatgaaagttccatgaaaaaatataaaatcttcacaaccttggagaaggcaaacttttttgaggcaggagtctgtaaacactcactataaaataaaacaaattataatgtgggctttcatgaaaactcatgcttaccaaaagtcattgttaagaaaataaataggcaagtaacacatgagaagaaaaatgctctctgtccatatatctgacaaatggcttgtgtccagaatataggaacatttctcccactcactaaacagaggacaaacaactaatgggcaacagattgaataggcatttcttggggatagatagatgtacacatagccaataagcacctgaaaaaatgtccagtatctcagccatgaaaaataaagagttataatcatcatgagatgtcaccaaacacccaatggacatggatattattaagaagacaccacagtaactgatgtcactgatgtagagcaaggatgtgaaactctctcatatgctggtgaaagtgcaaaatgatacaaccacttttgaaatcagtctgatagtttctccaaaagttcaataaatgcacttttaccctacaaacctgcaatcctgtttgtgaatatttaccccacagaaatggaaacataagtccacgaagacatctccaagaatattcatagcagctttattttttataaccccaaactgtagacaatttcaatgtcaatcaataagaaaatgaataaataatttgtgaactagtcatayaatggcatactgttcagcaataaaagggagcatgtttttgatactctcaaatagtatggaagatgctcaaaaatattacattaaagaaagatgccagataacaaaaatgaacattatgtatgagtctattgatgtaaggttccagaaaggtaaaactaatttctggtgaaagaaaccaatatcatttgcctctggccatgggaagagagtagcagagattgattgagcagtaaaacgaagtttttttctggggtgatgtaaatgtcctgtattgtgattgaagtgtgagttacacaagtgtacatgttcatcagaagtcatcaaactacatctaagatctgtgcatttgactatacatgaaaatatacctcagttgaaaatagatcaataacctccctcatatactatacttgctaacacagccagctgcttggagaaccagcttgctggaatggagaatctgggcttgagactgggtcacatgtatagagtctctacagagacaatgttgcattcccacggtacataatacatttcaaggtttctcagacagccacatgtcatgaatgtgaggattctgagaggttggagcaacattcctgggaggaacgaaggggagcacattctccaagatcccccaccaccggggtcctcaccggctgtgcttttttttttttttttcttgacagagtctcgctctgtcgccaggcaggagtgtaatggcccaatctcggctgattgcagcctccaactccagggttcaagagattctcctgcctcagcttcatgagtagctgggactacagatgtgcgccactgcgcccagctaatttttgtatttttagtagagacggggttttgccatgttggccaagatggtctcgctctgttgacctcgtgatccacccgccttggcttcccaaagtgctgggattacaggcgtgagccaaagcacccagcctgtgcctctyacttactcaattgtttttctgaaccctccatagctggtggaccttttcagatcccatagtctagccagccctctcactttatgccttgggtcccactgttccttcatctcatcccccttctgtcagtcccgcagtggctgtggccagtagaggatggactgagagtaggagaggaggttctgcccaggaacccatcctagagaaacagcatcctgcctgggacctagtcttccaggtcagcttttataagtcttttagactcaaactcacttgacccacctgaagtggtattgacaataatgctattttcatggttgtttttcactgtaaatgcagagccttttagctacacgactagtacagagagtaagggaggctggcctgggaatgatatcatcttggatggcatttcctccttggagaaatatatgttagttccaactcacatgttactatacagtcctgtagaaagagatacagagagttagacaggtatagacgcatttgtatatgcataacaatctataagacacacatcaaaatccgtataccggttcctctaggggtatgtgcttggcagaaggtagaaggagggtattctggttcctttcttttgcacatttatgtatgatctcagtttttatatggagcattgatagggtttggctatgtccccacccaaaatctcatcttgacttgtaatctctataatcctgataatccccatgtgtcaagggcaggaccaggtggaggtaactggatcatgggggcagtttctcccaggctgttctcatgacagtgagagagtctcctgagatctgatggttttgtaagtgtctggcatttcccctacttgcacttactctgtcctgccgcctgtgaagaaggtgcctgtttctcccttgccttctgccatgactgtaaatttccagaggcctccccagcaatgtggaactgtgagtcaattaaaactcttttctttgtaacttacccagtctgtctcgggtatttcctcatagcaatgtgagaacgggctaatacaagcatatactacttttgatattttaaaataaaaattatcatctatctttgaaaggcatgcacaaatgggaagttgaggaacatttgtgttgtggcaattgtatgatacctttaatgggaatatttcaaagacacttgttaagactttgttagaacaaaatgtagagggtgctggatgtccctsaatattcttccgcctcctgtaacttgtattgctttggaatttccagtggcctgacaatgaactactgcaggaatccagatgccgatacaggcccttggtgttttaccayggaccccagcatcaggtgggagtactgcaacctgacgcgatgctcagacacagaagggactgtggtcgctcctccgactgtcatccaggttccaagcctagggcctccttctgaacaaggtaagaagtctgtgtcttaccttgtctagcacatacctctctatgtgcttggacaacgggatgaaaagacatgaaaaaccacactgatgcagaagcctttagtgctacacgggagctcgagtgttggttgaggttctgccatgaccaaggaagtctcagtgccgtccctgggaaagccagagctgtgatttttggcacaacttgtgggagtagtgactttaggactggcgcaaaacctccagggtgctcaacttaaccactcaccttattctaaaatgggttatttcagtgtcccagtcaaattcctattctaacatgctgtcaactgtgtgattatttccaagccaataagcatttccagtaatttcttaaaatagtgttcattgcagtcttcagcgttgtggctcctgaggratgtggcccctgattctgtcrtcctagagaagcctgacatgactgcattgattctgtatcgtcctgggtctatgtggctgcctggctgtctgtaatcatctgttttatttttatttttttctacagaytgtatgtttgggaatgggaaaggataccggggcaagaargcaaccactgttactgggacgccatgccaggaatgggctkcccaggagccccatagacacagcacrttcattccagggacaaataaatgggcaggtctggaaaaaaatgtaagccactttgatttggactctttttccctttgctgacaaatcttttcaaacagaagaggggcagaggaaaatactggaaagacttcaggaggctaagcgtaattagccttagcatggaaagtgcaagcagcacaggccagcaaagccccacgcgtgtgggggttctcaggcctcttctcttttgacatttctttactgtttccattgttgggtgctgtttctcgtttctagtgcttgtcctctaagccaggggtccccactccagtactggtactggtactggtactggaactggtaattatctgtggcctgttaggaactgggctgcacagcaggaggtgagcttcgggggagcaaacaaagcttcatctgtattttctgctgcttcccatcactctcatagctgcctgagctctgccagctgtcagatcagaggcagcattagattatcatagcacaaaccctattgtgaactgcacatgtgaggaatctagattgcatgctccttatgagaatctaatgcctgatgatctgtcatgcttccatcacccccagatgggaccacctacttgcaggaaaattagctcagggctcccactgattttaccttatggtgagatgcacatttatttcattatatattacaatgtaataataattgaaataaagtgcacgataaatggaaggtacttgagtcatcctttaaccatcgccccctcaccccaggtgcacagaaaaattgccttttatgaaactggtctctggtgccaaaaaagttggggaaccacactgctctgggttctagtagtcagagatgccctctatgaggcttaagtcagatttttctagaaaagatttggatgggccatcaggtcaccatgagacttcccttagcctcatgcattctctgtgatggtttactttggggcctatgaatagggaagactgagatataggaaaaaccaaagtgtctgtgttcccccactctcacacccatgtaacataacacttctcacaccagatatggggggatttctcctcacaccccaagcgagtctccagcagataccagctgggtgtcctacaatgtaactcggtcctgacactctatctggagacagtgtcagatcccacaagttaaggctcagtcctacaagactgccccactgcagatgccaatcccaagttscaggctgtgacctgtacttctgcccagctggataaagatctgtttttctatatgaccctccatgggtttgattactttgctagagtggctcacagaactcagggaaacacgttacttttatttacccatttattataaaagatattaaaaaggatmctggtgaacagccaggtggaagagatgcacagggcaaggcacgtgggaaggggctcagakcctctatgccctctccagtgcaccagtccccagtaccctaagtgttcagcaacccagaagctctccaagtgcagtcttgttgggtttttatggaggcttcattacagaggcacagttgattacatcattggccatcggtgatcggctcaccttcggcccctcttccctccctggaggttggagggtggggctgaacagttccaaccctcaagtcacatggttggttcccttggcaaccagcccctggggctatccaggaacccaccaagagttgcttcattgcagctcccttcacccaggaaactccaagggatttaggagctctgtgttaagaactggggggcagagacccaatatacatttcttattctatcacaatatcacaggaagctaaggatgatactgcctttgtgtgtcttggctgtggatggtgcataatgcatggaagtaagcatttctgaatcaacagcaaacaggctttatcaggtagaagacccctcagcgccccagggacaaagctcatcaatgatgtcccactgtcctctgaggctctagctctaagacctccagtgggtcaagctcctggagaagtggcacattctccaaagacccttcagggtcaccacaccctggttaagggtgtggcctcataactccttttgactatgactgatggcttacagcatagaaagaaataactttgtcaaaaaatataataatgatagaaaggaagaaggaacgctcccttttgtcttctaagaatagatgtgaaatgtgtgtgccttrgaatatcttctccctctcctgctccacgtgagctggagcttacatgcctgcttgttttcagtactgccgtaaccctgatggtgacatcaatggtccctggtgctacacaatgaatccaagaaaactttttgactactgtgatatccctctctgtggtaagttgccttctgttttggtaaggaaactgcttccttaatatggatttggaaaaaaaaaarcaaaaaaaacagaaaatggcttttgagctgagtgcttctggggaggagatggctgccctctscaccagagcctgcttttcatcatggccaccttgaacctgccctactattggccccatttgttaggaaaacacccgcccctcccaccacacacacataaataaaataaatgtcaaattcccaaagggcaaacttagaggtgatctaatcagcccgggatagtcccaccgaacccttctttgtctagcgtgggatgcatgaaaaacaaatttagagtcattatgatgaaaaactgycctcttctgcagctgagaagaaaaaaaaaatwcgagcagcaggaaacagctaagcatgtaatgcacattgtaaacctcagatggccatcctaggaaatcaatgaagggtagtgcagctctttagccccagatggcctttctcgtaagattactactcatgagtcccattagcgacattgcttagagactgcttgttaggttccttcctcattgctctgagactcttattgggagtatgaggcttggatcaggggaaggggaattgacattagatcttaaatgattggggtaacaaatccatgggggaaaaaaagccacttgtacttgttccctattttcttcctgctgaccaatcaacttgtctgtccgagttacagaacaccaccctggacttttcttttgtgtaatttggttgcttgtggttgggtctgccatgtgaagggaccttgagctgggggaagaaggttggcctccaagtccactgaagaccagcatcctgagattgcctggggaggtggtacagggcagtgatgaagatcatgggagccacactgcccatcgtcacatttgggccactcctggggagagcaagagggaagaaggagaggttagggtgataggaaagattctacttggccaatattattataatgtggcattgtggtctctggatttagtgtgagttgatagctgacttttttctcgagtgggtgcttttgttctattttgtcggtgctattgcagaagcatcttggtggttcctctacctcaaagtctcttgatggggtcagttccagttctccgcttctggccccatctagtacacgccactgcctctcactgcctgggctctctatccttgacaggctgccttgaatttaagcccagtctgacttacctgcctcaaacacccacagtagtgcctgggactcatgcacctttgactcccatggaagggaagtgcagtagcttcccaggtgcaattctgctgtcctcacccacattgaggatgtatgagaatcaggttcttagagattggagaaagaaggaagaatgggaacaagatttcttccaatggactgtgaggttccccaccttactttgatgtaagacaagtgaggttaaccccaagcctggtgaggagggttcccatcagacacttggaaatcctgaggactgtttcctgcagaaggatgtggttggtgggatattcaggtttgactcatgattgagaaagttagagcctctggttggagaaagagtttaataactatttcatttccaccaacacattcagtacgaataataaataagtaaaaataaatagaaacattcagttttattttgaatagtaggagtagggtataatttctgtagttactcttttagtacaatgatgcatgtttactgtatgtaaggcatactagcagaaattgagctcagcactagaaaagatgattgcattccatgccatgcttcttttttacaaaagacttctatagatagattctcaaaacaacccacagcaaatgaaaagttatttggaaaactcaggttccagattcactggagtgtagaatctctggttggttggggaggaatttcctcttgcagttgttattaataattatatgaataattattaactatattaatatttatagttttgaagaccttgaagggctggagacaacagagaagcatttttgaacaccctctgtagcccctgcactgttgtaggcattgatgggtggtaccaaagatgggacactttccctacctccagagaccttgtgggcttgctgcagagagaaggcagggaggaggaaaagaagaatagaggcacatgtgtgtaaattacccccacagcagtcagttagtcatgggaggctccccagaagaactgtcctgaagctggctgagagaaggcaacatttcaacataggacagttatccttgctacataaaatcacatacacacatgcacatatgtccacacacagagactcacatgcaaaagaatcctttgtgcctttcagtaaactttacatggtttagaaagaacttatatttccttgaaaggagagtgtcctttgttgtttactaccactttttaaacttagaaagaaaaatctaaagagtgtttatsattttaccatttaatttcacctttgagatgtgaaaaactagtgcttggaattcgtcctgaattaaacgacacaattgctaacttggactcaaatgcgacttcttttcccaccttgtgccacagcatcctcttcatttgattgtgggaagcctcaagtggagccgaagaaatgtcctggaagcattgtagsggkgtgtgtggcccacccacattcctggccctggcaagtcagtctcagaacaaggtaagaacaggcccagaaaccatctatactgtccttccatgtaagccccacaaaacccttctacatttacacagaacccacacagctgatgcatcaatacctgcctctctgttttctgaaggaggaaaaaatatagaaaaattaaaaaaagttatattattataggttctctacttggaaaatagccaaaatacaaatctttttcttgatctgggcagttccatcaaaatctgtaggcacagtgatttgcaccaagttccaatacttttggaaaatattgaagatgctctgagggtttctatggatatccattgtctcactgtcagatgaaaagaaagggaagtttttagaaatgtgacactttgcagtgagggaggacaagagcaaacttacctacagtctatcacaggcacagatttttttttacacttttgtgaatcattgaattcaatgccgaggctattcatctattcacaaacacatgaacaarttatgggttgtgatccccataaatgaagagtaatcagtccgaacccacagaacctggacattttgggtatcgtttcagtggaacatgcaattcgtaagttcagtttgcttgggtgtctcttaggaagaacacataggacacagacccatctgcctgcatgttttgcttcctcatctcctttctacaccagggcacctgtgctcaattgctgttctcctctaaagagacttccttctgtaagtttgtgaaatgccatcgacaaacctgatcgcatcgcatttcactctgctgttgagttgatttttctttactttatcgtttgtaacttcttgctctacagagctttcaccttccacatatttcagattcattctttcctaaactgtgtggtggtctatgtcctcactgactatcaacatactgccatcatgcacttcctatctctattcctcttcgttgcaatctggctccaagtggctcacaccattattctgatctatcaactgcctacacagtcctagaaagtaagtgagtcaagaaacatcccccaaaagtaaacttttcaggtaagatcagaagaccctcatgagtcactgctgctcaggatcgtatctggctccttgaagagtgaccttgcatagatcttgtcataaaaaatgaaagagaccttgggaaggtcttgggctggtcacttttgtcagagtccagggctgtggggtgaaagccrcagctatagagcttcattctggagtcacttagctttgctctcctggggacaggctgtgcctattcttgcctcaggcatcaaaaaaagtggcacagatgggcccttctgaaaaatctcactactggagcacagctcgaagtttctactatcctgacgttgggcggtagtcctttgctttgggaatatgaacatgatcaaaactgagtgaacttgtcttcctggctttctgtacaatgaagtagaacaaaccatccaatttgaccaaagycttggcatgttttctttctaggtttggaaagcacttctgtggaggcaccttaatatccccagagtgggtgctgactgctgctcactgcttgaagaagtaygtttaagggaaaactgacatggggtcttatcttcaagacttttttcctccctctcttcctccatcccttctttcttcccaccctccccttccttcctccccacctctcttccttttctggaaggaacactaggaaccagggaatgcatgcagaatcctgaggcagaatttccagggcaattggatgagagaggagggaagtgtttctagagggaatctgcagagggaagacccagtgcaagtgattttttggacctgtataaaccgcaggacagagctgttcactaccagaggcatcaatctgtattgcattgctctagagcaatatctgaggctgaataatttataaagaaaagagtttaattggcacatgtttctgcaggctttacaggaagcaggatgctgtcatctcctctgcttctgtgtgggcctaaggaagattacaatcatggtggagggcaaagtgggagcaggcatgtcacatggccagagcaggagcaagagacagagagagatggggtgggggtgctgcacaataccaaatgaccagactttgcaagaactaagagtgagagctcactgatcaccatgaagatgtggcccaagccattcaagagggatgcacctctatgatccaaacccctttcacaggccatagctccatcactggggactacagttgaacacgagatttaggtggggacaaatatacaaactatatcacagtctctgatgaaacagattgagaacagaccttaactgtcagtttccagcaaattgtgaattttgtttcttgccactcataagtcactgattctgggtggccgagggtgtcagagggacagcgccaagttcatggcacagaggatacctgaaggggctggaccatatttttctcttgacatcctcatcttttctaggtcctcaaggccttcatcctacaaggtcatcctgggtgcacaccaagaagtgaacctcgaatctcatgttcaggaaatrgaagtgtctaggctgttcttggagcccacacaagcagatattgccttgctaaagctaagcaggtactcgctcacctgtggtcttcaccccacgctggtgaagatatttgctttatgtctgggttttatgggccatggccactgcatggcagtggggaggaactgtctatcacatgaaaggctcaagggctttggggacagcatcaatcttcaaccccagccctgccacatgttagttgtgctctttaaaaaggcagaaggattcgtttcctcacgtggaaaaagagataccctgttacccgtaaaacttacttaatgttcaccagttcatccacattcatgatcagggaaaggttgttattccaggctaactattctcctttcataataatatgctggagagaatcaaatgagattgcatttcaaagcgcttgaaaaaccaccatatcgagccatgcttagtgtgggcgcctctaatcactgctattcaggaggctgacgaggaagaattgcttgagcccaggacttcaaggctgtaggcagctatgattgtgccactgcactccaggctgggtgacagatcaagaccctgtctcaacaaaagaaaagaaaacaaaacaaatgaacagaaatattccacaatgtcaaaaaaaaaaaaaacccacacaacatacaatttacaaatgcaaataataatattattgttgtcttctttgattttctctttcctggtgaaattttgttttattaagcctgacaaagtgatacctttgcttacrtcacttaaagttagtctatttggacctaggtgacagtacaatcagctaagaaacagtatttgtaggagaggcaggtttgggacaggtgacaaggcatgtggggtgctcgctgtgctggtggctctggaaggcagggtgtcaatgcagacagggatgagcatggcctggttgggaaggcatggggcaggcaggagcctgagctgctctcctgggcctggtcacaagcccatggcagcttctctgggtctgtgaactgaggggtgatgtcctggaatcctctgacactctaggaaggagagaagggcctttctggctcagcctttataaacagtagctgatctccctcttgctccccagggtcctccccaccatcccagcaaatgtgcaaatacaagatctctgctcctcatggtcctcagagagctggggtgttctgatggcttgaacaagtcacttaggaaatgtggggttttggaggcattctctgataggctgatacgttttgagtttagagttcccaccgcacawccccacacccytagagtstagggcatttagtgctccatgagggaacctgtagagtgaggacatctgcatcacaggctgggccttctagtgtccagaagcagaaagtgtgtctgcttcaaagttggtgctaatgatgatttttggtcagaatacggcatttctcatttccattcctttatccccttgaacttactaaagtagaatcaggtctaaaaaccagagttctaatctttaagagtccctgggattctaaggtatatgaatgtccttggaaaacaataccatttagttcatgcaaggtgcttatttcccatcctctttcatttgatgtctagcattttactgcattcttaccaccacggtttagtaacattcacgaggaggaagtggaggatccagatggagcaacttgctctgggcacacaaggcatttgcaattttataccctcttgatgatgtctcagccagacattctgcccagtcatcaatgccctcttcaattaatatgaaaggacacacttggcatgagattccaatcgtgcacagaatatacatgagaagtgtgcctttgtcatccctactttcaaaggctaaggccaccctcagtttcttgcatgcaactgatgcctttcaaatgaaaccttacatctgtgtagtccataggcaaccacaggcaaatgtgagggtgaaacgctgtgttctacattgttctgtgtcagtgaagcaaggcagtgccagctcagagggctctggggcttcaaggcagggatgcctggttgtaggtactgccacttccagctgggcagtgaaacataactgctaatactttccttacaggcctgccgtcatcactgacaaagtaatgccagcttgtctgccatccccagactacatggtcaccgccaggactgaatgttacatcactggctggggagaaacccaaggtgagatcaattccattgcccacgtaacaaattgtttttgaccttcagtgcatgttacaaaatgagcattttggagatagttgtacaaattcctacccatgaatgtggtctacccactcctgactttgcctggacacctgtctatgtctccataatcagtcttcaagggacttgggcaaggggagcggtgccatttccttgagtctctctcttttttgttttcagaatcttttaattttttttgtaatgattgtatgtttcccttacaacaaaaacaaacaccagtagaggtctttgagtctcttaatcataatttcagcattcatattgcttccccaggtaagtggggttttgacccagccctcaagttaagggtgttagattatttttcatgtgaaattagacagactgcgtttctaaacatggtgcaaaacagtaacgacaaaagttgtaattaaactattcttcttcccaaatacccacatgtctaatgtgtgtgtgagggtgttaggcaggggacctgaagctgggggagaggcagacagttcccatggccccaagtctaggatggcatttggtattggttgatgggtgagagcaagagagggaatatttttgtgcatgatgtggtatcagcacctgtactacattttatggattccttcttctctttgcggtatgccctgacaataattatatccgtcagccttacccccttggcagtaggaaaactraaactgtcttaaagtctcagctctactttctcagaggtgcaggcaagggcactgggagtctggggccctggaaaactgttctgactctgccacttgccagatagacctgaactagacacgttacctctttgtaccacttggctctaatcccttatctgtaaaaccagcattttcaaatggtgctttgcacatcagccttttgcataagctttgatttgataaaatgttttttgtgtttttaaaaagattaaaaaccacaggtttagataatttcaaagtaggcttccctttttctgtcattttcctattatttttaaaacctcacctccttgactccttgttccctttttctgcactgctgagtctgggagcactgaggccagrtaaaaggaaacttggcaaatgaggggcacctatgggtgtgggaggctgctcctggtgtttgcatattttaaartttaaatgctacaaaccactgtgagttaggtattattgttcctattttaccattgaggaagctggggctcagagaaggtggagggtggtacagacaaacctgaattggaaccctggctcctgcctatgggctgtcaggacttagaaaagtcgtgagctctcgctgattgtttcctcagctgatgtgggctgcagggctgttatgggggaaataataagaaagtgcatcaagtgctgagcacatcctaagcactccatcatggcagctcstactactaataaagaatagaattatatctaacatgattctttcttgcaagtgacagaaaatccaactcaaattggattaagcaaaacaagggaaattcttagtgagctgcaaagttttcaggctcacatgatggccccaaatcccaggtcctcccaatcatggagtaggcactatttgggggcacaaaggtgacattcccatggctgcagatgctgtggtgctgtggctgtaccgggaaagaataagaaaggccactctcccaattatgtgaacaatagtctgcccactctgagaagtcaaacttgggtcaccgtcctgcccctgaacccatcactgactggctctgacctgcaccaattgttccatgttggaggtgaaggcaagaccccactaatacccataaggggcaaaagttagatagatccttcaagaggattatgggaggtagggcaaaaagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccatctccaataccaccatcactgtaaccatcatcaccaccaccatgatcactatcaccatcatcacaatgatcactgtaaccatcattactacccaccaccatcaccactactccaccaccatcaccattatcattaccatcaccattatcaccaccatcatcatcaccagcaccaccatcatcaccagcaccaccatcaccatcaccatcattaacaccatcactatcaccattggtttaatcatcaccaccatcatcataaataaacatcacataaccagggtgtagctgggtgttgaccccagagcccactcactgtttcctctctcccacccccatccacacatttctaaccaccatcctgcactgggctcccagtctcctctggtctcacccacatgtccactgagaaaaggattttcagaacaccaactagaccaggaggagccacatacataactcaggcctgcttatcaactttctacatgttaataatgacatcagatcaatgggtgttctcagcttctcagaaggaggtcaaaattctccccctctccccttcatgtgtccagaccttcccggatttggatgtaccaagtgcagagtggtgttgaggccaaggggctcatccatgtaagtctcatctgcaatcactgggctgatcccgtggccctgtctccagggcgccatcagagagggcttcaatcctcaggttacctgtggcccaccctgccctcagaggtgccatctctacattggccacgagatggcagcacatactcatagactgcattaatttcccagcaactcctggtgggttttccctcttatcaggatgtttgccttgctcagagagcaaatctgagagcagtgacacctaacttaactttcagcaaaatattttgagaagggtgcccctttacacatctgtgcagtccaggtgatgcatcccatgcccaatgctcggtagtcaggaggagcttcctccatgcagctctgcggaagagactcttccacgctgctcatgtaaactccagattcggtgtcagttttctgacaccgaagacaatgatctaagtgcagtcaagggctttggggaaagcaggagagagtgcctcagttctagcctgtgccatgcttgcaaagttttgcaaaattctaatgagagctgggcttgcaacattggaaacttggattatttgtgagagcactgagaaatccctgggcatgtccatctggaaaaacagcatttcctctggcactttarcagaggttctgtttcaatttggcgaaggaaattaagcagtttttcacaaaagaagaactacaaygaggagaattgtccctagtatttcttctccctaattgtcaaggaagtgtaaattagaaaatgaatcaggacaatttccacctactatgttagctaatattttaaaaattgaatatcacaagggtgaggcaaagtaattgttttccagtgacattttccactgtcacacccttttagagaataatttggcaatgttactgtgagatagaaatatgtctatataattatgggaactgagayttcagaaagtaataaggaataagaatgaaatttatgaacaaacatgtggaaggttggaagcaagagtggggccaacacgcatggggaggaagcatttgggcagygactccgcagacccagactcaagctgagctatacaacctccttacgcctcagtttcctcaactgaagaacaggaatgacaagtgcctgtttcataggaccgttgtgaggattaagtgagatataccacattatgagcttgtgcctggaaaggttgattcttagtaaatgatgactattcttttttattgcaataaaatttatacaacatagagttactattttaaccatttttgcaggtaccactgagtggcattcagtacattcacaatggtgtgcaaccgtcaccatatttccaggacatttttctcatccccaaaggaaacctcatgcccattaagcagtcactcctcattaaaatattagttatgaagactgtakcatttttttaaaaactcatgatataacattgattgaaaaaatcagtataggaaattgtgcattatgatgtaatagtaaaagaagcatataaaaatctgaaaaaagtatataaaaagaatagcaattgtatttctcagactctctttacattgtaaaaatcattttgatagcttcaaaagaaaagcaaaaagtacacaaacaacaaccaaccccaaagcagcatgacaaagcccagattgttgaatccaggtcttgggaacataaaatcttatatgacatttgcactttaatgggtcagagagtccagtggcattgggagctgccttgtgttctgcagcctcacggacagacaggaggtccagctccactgctctgttcttctggaatttcctcgtgaacaagctttggcctcagtaaccatttctttcatctttttaaacacaggtacctttgggactggccttctcaaggaagcccagctccttgttattgagaatgaagtgtgcaatcactataagtatatttgtgctgagcatttggccagaggcactgacagttgccaggtaagaaaagatcaatagatcaaagtcttgtgctctcccgtctcagtctcagtcccttagacgtcagtcccaaagtggcaaattcaggaaggttttgtcagtggaagaccccagtctaagtgttgctcagaaactccccagatctgtccctgaatgcatattcagatcatctaaggagacgtcttggggcttgagttccagatccatarcaagggagccgtaagtgccataactacctcaggccactcaccttcctggtgtgtgctggtcaccagtgactgaagtggtggcttttccagtagagaggaaggtagagggtacaggaccgagacaaattacacacacttaacaatgatgtccaggctagcccagtctaaaggaaacaccaagttaggaagcaatgcatgcaggattcacaagggattattttttttcccaggaaaaaactaagtgatgtggttttgttgaatagactttgctaagtacttaagcactgcagatgcttgagtaatatgctcataagttcctttctgatttgaattactgggaaaatgtacatatggataagagaaggatggcatcccatattaaaaggttggcagcttaaagctcacatgaattttcccctacctctgtttagggtgacagtggagggcctctggtttgcttcgagaaggacaaatacattttacaaggagtcacttcttggggtcttggctgtgcaygccccaataagcctggtgtctatgctcgtgtttcaaggtttgttacttggattgagggaatgatgagaaataattaattggacgggagacagagtgaagcatcaacctacttagaagctgaaacgtgggtaaggatttagcatgctggaaataatagacagcaatcaaacgaagacactgttcccagctaccagctatgccaaaccttggcatttttggtatttttgtgtataagcttttaaggtctgactgacaaattctgtattaaggtgtcatagctatgacatttgttaaaaataaactctgcacttattttgatttgaattaattttggttttggtcttcaaaattttcatgctcttttcatcccatctatttttatttttattttttagactttacgtcctggggtacatgtgcagaatgtgcaggtttgttacatagatgtacacgtgccatggtagtttgctgcacccatcaacctgtcatctaattcggtatttcttttagttctatccctcccctagccctccaccccttgacaggcccaggtgtgtgatgttgccctccctgtgtccatgtgttctcattgttcaactcacacttatgagtgagaacatgccgtgtttgtttttctgttcttgtgttagtttgctgagaatgatagtttccagcttcatccatgtccctgcaaaggacatgaactcatccttttttatggctgcatagaattccatggtgtatatgtgccacattttatccaatctaacattgatgggcaattgggttggttccaactctttgctattgtgaatagtgccacaataaacatacgtgtgcatgtgttttcatagcagaatgatttataatcctctgggtatatacccagtaatgggattgcagggtcaaatggtgtttctggtgctagatctttgaggaatcaccacactgtcttccacaatggttgaactaatttatgctcccaccaacaatatcaaggcattcctatttctccacatcctctccagcatctgttgtttcctgactttttaatgatcgccattctaactggcatgagatggtatctcattgtggttttgatttgcatttctctaatgatcagtgatgatgagcttttctcatatgtttgttggctgcataaatgccttttttggagaagcatctgttcatatcctttgcccactttttgatggtgttgtttttttctggtaaatttgtttaagttctttgtagattctggatattagccttttgtcagatggatagatggcaaaaattttatcctattatgtaggttgcctgttcactccgatgatagtttcttttgctgtgcagaagctctttggtttaattagatctcatttgtctattttggcttttgttaccattgcttttagtgttttagtcatgaagtcttctcccatgctatgtcctgaatggtattgcctaagttttcttccagggtttttatggttttaggttttgcatttaagtctttaatccatcttgagttaatttttgtataagtaatgcccttctttgtctcttttgatctttgttggcttaaagtatattttatcagagactagaattgcaatccctgcttttttttttytttttgctttccttttgcttggtaaatattcttccatccctttattttgagcctatgtatgtctgcacatgagataggtttcctgaayacagcacaccaatgggtcttgactctttattcaatttgccagtctgtgtcttttaattgggggcatttagtccatttacatttaaggttaatattgttatgtgtgaatttgatcctgtcattatgatgctagcgggttattttgcccattagttgatgcagtttcttcatagtgtggatggcctttacaatttggtagtttttgcagtggctggtaccaattgttcctttccatgtttagtgcttcgttcaggagctcttgtgaggcaggccttgtggtgacaaaatctttcagcatttgcttgtctgtaaaggattttatttctcctttgcttatgaagcttagtttcgctgggtatgaaattctgggttgaaaattattttcttttagaatgttgaatattggcccccactctcttcgggcttgttgggtttctgcagagagatccactgttagtctgattggcttccctttccgggtaacccaacctttctctctggctgcccttagaaatttttccttcatttcaaccttggtgaatctgacgattatstcttgaggtggctcttctcgaggagtatctttgtggtgttctctgtatttcctgaatttgaatgttggtctgtcttgctaggttggggaagctctccttgataatatcctgaagagtgttttccaacttggttctattctccccatcactttcaggtacatcaatcaaatgtagatttggtcttttcacatagtcccatatttcttggagcctttgtttattccttttcattctttatcctctattcttgtcttcttgctttatttcattaagttgatcttcaatctctgatatcctttcttttgcttgatcgatttggctattgatacttgtatatgcttcacaaagttcttatgctgtgtttttcagtcagatcaggtcatttatgttcttctctaaactggttattctacttagcaattcatgtaaccttttttcaaggttcttagcttctttgcattgggttagaacatgctgctttagctcggaggattttgttattatacaccttatataatagcctgatataactataagatttttttgtaagcaccatcgtaaccacaaagcaaaaacctaaagtagatatacaaaagataaaaaggaatcaaagcataccactagagaaaatcacttaatcacaaataaagatacgaagagtggaataaaggaacgaagggtctacaaaacaaccagaaagcaattaacaaaatggtgatagcagatcttacctataaataattatcttgaatggaaatggattaaattttccaataaaaagacatacagtggccaaatagattaaaaaataagatccaactatatgatgcctataacacactcacttcacctgtaaggactcaaacagactgaaagtaaagggatggaaaaaatattctatgcaaatggaaacaagaagatagaggggtagttatacagattgagtatcactaatccaaacatctgaaatctgaaatactccaaaattaaaaatgtttaagtgccaacatgatgttcaaaggaaatgttcttcggagcattttggatttttgtgtttagggatgcaaaaacagtaaatatataatttgtattagtccattctcacactgctataaagaatactacaaagagactgagtaattataaaggaaagatgtttaattaactcagagttccacaggcttaacaggaagcatggctaaggaggccacaggaaacttataatcatggcggaagatgaaggagaagcaggcaccttcttcacaaggtggcaggacggagtgtgagtgtgtgaaggaggaactgtcaaacacttataaaaccatcagatcttgtgggaactcactcactctcacaagaacagcatagggaaaaccgcccccatgatccaatcccctcccactgggctcctcccttgacacatggggatcatgagggttacaattcacgatgagatttgggtgggacacagccaaaccatatcataatgcaaacattgcaaaaacaattcaaaattcaaaacatttctggtttcaggcattttggataagggaaactcaactcaacatgaggtaaagcagactttaagtcaaaaactgtaaaaagagacgaagaagaatgtaataataaggagatcagttcattacaaatatatagcaattataaatatatattaatatatatacccaaaattgtagtacctacatatagtaactaaaacaaacattaatagatctcacaggagagctacactgtaatataatcatagtagcacacttgaatagctccactttcactaatggacagatcatccagacagagaatcaatatggaaacacgagacttaaactacactttagccaagtagacctaacagaaatatatagaacattccatccaacagcagtagaatacacattattctcaagtgcacagggaatattctccagaatagatcatatgttaggtcacaaaactagtcaaaaaatgtaagaagattgaaatcatatcaggttttttttttagatcataatcgtatgaaactagaaatcaataatgggggaatattggaaaatccacaaatagatagaaattaatcaatatgctcctgaacaatcaatgagtcgaagaagatattaaaagaggaaattttaaaaamtcaagacatgagttcatgtcctttgcagggacatgaatgaagctggaaaccatcattctcagcaaactatcataaggacagaaatccaaacaccgcatgttctcactcataggtaggaattgaacaatgagaacacttggccacagggcggggaacatcacacaccagggcttgtcagggggtgggaagctggtgaagggatagcattaggagaaatatctaatgtaaatgacgagttgatgggtgcagcaaacyaacacggcacakgtatacctatgtaacaaacctgcacgttgtgcacatgtaccccagaacttaaagtataataataaaaaaagaaatatttgtttttgatttatatgccaatcagacaaaatgtgaaaagccctactgaaattaagtatcaccatgaaagataaattctggataattttttcaagttttaacaatgtagctttaattggagaaagctatcatttggaatgagttaatctatcctatactaaaataagtcacttgctttaaaacataataaatatgattttgaattgaaaacaaaaacaactcaagacaaaggaaaatggacacactaacataccaataatttatagtatgcagcaaaagtggttttaagagggaagcttttaccaataaacacttccattaaaaaagaagatctcaaataagcaacctaagattacacctcaacaaactagacaaagaactaactaacccaaaagttagtagaaggaaagaaataataaagatcacatcagaaatagtaaagactaaaaaactgataccaaaaagaaataaaactactagttggttttcaataaaataacaaaattgaccaacttttagctagattaagaaaaacagagaatactcaaataaaaccagaaagaggagacattacaatagatactacagaagtacaaacgatcataagagactactatgaataattacatgccaacaaattggataacttagaagaaatggatgaattcctagagcaaaaaacctacaaagactgactcagaaagaaatagaaaatctgaacagaccaataatgtgtacatgattgtatcagtaataacaagtctcccatcaatgaaaaggccaggacctaatggcttcactgctgaagcataccaaacattacaaagactaatatcaaccctcctcaaactcttcttaaaaactaaaaagaaggaatgctttcacattcattttatgaggatagcattacactgatactaaacacagaaaaataatacgctaataaaagaacattacaggcaatatccctgataaacatatgtgcaaaaatccgcaacaaaatactagaaaactgaatccagtagcactttaaaaagatcattcaccatgatcaagtgcgatttgtttcacgaatgcaagaatagttcaacttacacaaataaataaatgaaaggatggatgataaaaatgtgtatctatatatatatgttttatacacacacacacacacacacacacacacacacacagaggaatattattcagccttaatgaagaagaaaatcctgcctttgcatcaacctggaggacattataataagtgaaataagccagacacagaaaggcaaatactgtgtgatctcgcttacatatggaatctaagaaagtcaaattcctagaaatagagagtagcttagtgattgccagagccgtggaagggggaaatggagagatgttgatcaaaggatacaactgtatagctttgcaagataaataggttctggagatctaatgtgcagaatggtgactagagttaataatactgtattgcatacttgaaatttgctaaaagagttgatcttaagtgtcctcaccatatacac

SEQ ID NO: 13235 - DNA, 105550 bp, Homo sapiens
caagtttgtgtcttaaaccttcagccatgctctaatcccaaatgtcaggaacaaagactctgactgatcaggattgctttaggtgtctactacggggtcgaatcagtcctgggcatgggaagtaggggtcacatagtacaactgtggctgccagaagctgctcttcacaatctggatgaaatattcagagaaggaactataacttgtgggktgggccacaaatccaaaaagggtcttgtgagtattatcgtcactgaataaaytctcaggtgctgyaaagagaaaatggtgttatttctagtcagaatatacaaccatctcacaatgatactctaaggaatcaaggcatagtcctatgcaaatctaaaattgtccattgaatagccacrgtccgagtctacacatttaaagttgtcttattctaggattctaatttgtcagagggctgtgagagtcaacattctccattctctaccttagcaatactcttttcacctcctccactccaacaaaagcttccaaaggaaatcttccttcttaaaagaaactgatttccatgattcagaataaaatttagtaaagactratgaattaggactccattaatttagcatttttgctacatcaagaatcaaaaagggattaaacttttctatccccatatctcttaaagccaggaaagatttgctaagtgaaataaaaatgtgactttggacaagttttgtaacctctctaagactttgtttccttatctgtaaaatagaaattaacttttcataggattgttgtgacaattaaatgacattaggcttgacatgtagaaagtactggctattagctatgatgttgaagataatgttggttgtagtgatggtagtaataactctagtggtgatggtggataatggtagtggtggtggtgatgatcgtggtgatgatagtggcagtggtgatggtggaggtggtagtggtgatgatggcaatagtggcagtgaaggagtggtgatgattaattatgacagaaccaagaatgtataaattgttctcagcacatagtagtcacatagtaaatgagtgcagagaacaagcaatttttagataattacaaggctcttagttaccatttacataccaaccatggatatgtccaaaacaaatcatgcttaaatgttcatcaaaacagattcctaaagccttccaatagatgtttaaccactttgtatgaagtggagagaagaggaataaatatgaattttagttactacatgaacataaaataaatataattaaaaataaatataattacattcccttaartaatagtgcataaaatatagactgttttgcttgtgttccttccagttagcttgctacataaagccacataccattaattcaaatttcatcgtcaaaaattcacatttctaagtttgttatcatccaagtctaggaattgtcctatctgcatactattttaacctccaaaggtctgcgtaaaacccattttgtggctaacatggatctatctaaaaaatccagttgcatctctccccttgggacttccagggtgcagcagccacaccaatttctttatttaccataatttgaaagccttattaatcctaaaggctcagctctataatcacatttggttagcttgagactaatccttagaggttatttatttttcatgaagattgcttcccagctactggtttatttagactttactaataattatttcgcaagagcttttttcaccactgctcatttatatgtgtagaattcacactgtgaatatgaactaaggatgaatttttttaagagttaaggtttaactggaatgtcattttttctttactgtgccagatcattccttttctgggaagctgtcccgtgaaataattaaatattgtccctttaaaagagtctgtgacctgctgcatttgtaatccttgaattccatgattcagcccaagatctcccagctttccatttcacactcctgctcacatttggtttagatttggcttttctttgctcgagaggaacaggatttattactaccagtcagaagccatcagkccccaatatttcagcaaagaaccctagtctgccagagtgagtaatgctctgtttgcactcaagtctccctgaaccagtcaccccaaataggatgtcactgcttgcatttatttagaaactgtcaagttgtctatgtgtttcctcccaccagttcatgtgattcctgaaacacccctatgcgctttgatgggagggaaaaaaaataacagtccctcatacatttatgtaatgcttatttatggagcacagtgtatatgttagggactgagagctgagtatgtgctggcaccccagaaggacatgtccctgttctcaggtagcttagaggtcattgagtcccaccatgaggcaggcacaccaggaaatggtcttgatgtcttctttcactgactactcataataaactatgggaaaggtctgattacccttgttttgtggctgggattaccgaaactcccagaggttaagtcatcctctgataagggggaaagccaatgctcagacctggactttctyggtccaaggctgctgattgaattctggattcttcccaaatagtgtaatctcgtgtcaactcaaatcaattcaagtttcctttccagtttcccacatcccatggtttggcttagaaagaaagatggtgcaacacacaacagatatcaagcatctaagagtttgggaagggtttgtgtgaccagtggtgtgggcagggtgtctttagaatggaaagtggatgagaggggagctcaaagaggtgatccaggaattcccaaaggtggaccttgactcagtaagtcaccaggtctgttatttgaaatgagtcatttgtggtatgggggcaaatgacctcagtccctcaccaaactatcgggaagcaagcaaacaaaataatccccgcttctggggagaataatcctaattacagcccctagaatttgcatgcccttctacagtttgcaaagcactttcacacctatattttccttggtggaattgtttactgcactaatggagaagggaccaggacttgatatggcctagtttgttggtttttatatattttttaagaataatcatctgtcaaaatgtaatttcatgcaatagtctggtatataaaactgatgcaagtggaacttctgtggttgggatgggkcctggggagggagaggcacagcttactcctcagcttttactctgaccactaggtctgcttctgaggggtctctaaggaacctccaggttccatgaaacacagtaagacagacattgttcctagtgactccccacgtcacttcactttcttgctccaagaaaaggaagctgaaatccctggaggttgcatgaggtgaaaaaagctgctccttgtcctgtattcttgtgcatggaacctaccagggctggtttcctcacatgagtagggactgaagccttatctgrgagccagtttgcccccagttgtttcaagaaataaagtgtcctcttggtcacagacagcagcagtaacaactttttcctgcggactggcagcattttccaagcacctgctcttcaggtgggagttacgggtcactgycttcattccagacgggyrgctctttgagtcatggcatgccagcttctgagtggctgaggactagatccagacaaggatttttcagtcccaaacactcttcctgaaaatgcaagaggagtagtctttagtcaaacagaatctccacaactgaaaaatttataccggactagacagtggtagtggttgcacaatattgttaaagtactacacgtcactgctataaacacttttaaatgggtgaaatggtaaattttatgttatgcatattttaacataacaatgataataattttaactaagtacgttgcctccttatttcctacagggycaagttcaaactccctggcatagcttacaccttgtagtccccatacctgtaacctcatgtctgctatcttcccccagccccttcatctgatctatgttcagatcagctcacattgctctctattctctggacaagccatgttctttcacttttctatgctcaaacacaattttgcttttagtaatgatagcaaacacttatttaaagtgcttactgcatgcatatgtagacataaatctacggcttaatacatgcagggcttttgagtcatttaatcctcaccaattctatgaagtaatagaattgtaatagtaataatagatactattattaagcccattttatacttgagcaaattgagctaattgccttaggcaaggtcacacaactaagaagcagccataatagggtttggatctaggtgttctagctcctgaatccatgctgttcgtcactacactgtactgcctgtggatgacttacttgtccctgtagtttcatctgaagaattcctcctccttttcctttgaggcctgcctcaaatatcacttcccctgtgaagactgcctggtgttctccaggagagagtgtgactcccttctctaggaatggtagcaccccaaacacacacattttgcagcatatttcaccttgcatggtaatggcctgcttgtgagttttattccgtaccagagggtgagggctctgaagatagcgccaggtcttatttacctcgataccccacaacactcattacatgtctgatgaatgaatgcatagggggatggctgggtgcatttctctcaacttttcaatttcttgaaataaataacaaaatcttaccttccctcagaagtcctggcrtggttcctttcatcttgccacagccactgataatcactttcattttctgtgtaactcaccaggcaagaagtccatgcagatttacttktagtagttcacatgacaaataaatactgcgtttgatttccaaacattaaaccatagtatattatagatagatatagagttatcattcaaagtatgatatttcaatctcaaaaggcttcccctgaagaatattacaaactcttcctctctttaagatctgctgggtaggaaagatgggagaaaatgaattaatgtttacacagaaaggaggataatgggggcaaaaataatagatgaacgtatgggtggatgagagaatggataaaatgataggtggatatgttgatcttggacagatgggaaatgagtggatatatcaataaacagatatgtgggtggatgggtggagaagaggatggtggatggttgtggttttatgaagagatgtgaaaaaggaagtgtggaatgatggatgagaagttgtatgggaagatgaatagaagaataggtggttgaataaattaaaaggtgtgtggttggatgaatgaatgagtgggatgatagatggacctaagtggttagtggatggacaggaggatggatggatgtgagagccccagaaggacataaggaaagatgggtggatagatggatgggcggatggaaggatatttaggaggatgaatgagcatgtgtgtggagagaggtgcccattcacactggcttgaacacatgggttagctgagccaaatgccagccctatgacaggccatcagtagctttccctgagctgttctgccaagaagctaaaattcattcaagccatgtggacttgttattgaggggaaaaagaatgagctctccctctttccacttggaagattcaccaactccccacccctcactccccactgtgggcacggaggcactgcgccacccagggcaagacctcgccctctctccagctcctctcccaggatatccaacatcctgtgaaaccmagagatcttgctccagccggattcagagaaatttagcgggaaaggagaggccaaaggctgaacccaatggtgcaaggttttacggttcggtcatcctctgtcctgacgccgcggggccagcgggagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgckggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcrctccggacaccatggacaagttttggtggcacgcagcctggggactctgcctcgtgccgctgagcctggcgcagatcggtgagtgcccgccgcagcctgggcagcaagatgggtgcggggtgctcagcgcggacccggcggcagcccctccggctgagtcggccctgggggactggagtcaagtgagctgtctgcgaagtgcattgggctccggaaagcagggctgggatttgcgcyaaaccgttggagaatgtgtctgtggaagcaccatttggttgaaagaaaaagagaaagagaagaaagtttgttgggcaggctgccggcgcgcagttttgggcgaggtcgctagagctgcagcacatggcagaaagtaaccgttctcccggatgcgcacagtcgttgtctggactaacaggctcctgtgcccaagggctcgccaagccccaccrggctgtgtctaggcagggcagagctgggcggggcagagactggggctggaacagggcgagtggctgttatcaaggtggtcacagaagggatcacaattccaagtgtgagactagctggcaatgggttttccagaraggggtcctgggttctcccagctccccactgagccttgttccaaagcttacagtccgcagtgtcactgccaccttagcgctgtggaagcttgaaccagctctgcggtgaggtcttgggtctccatgagattccagcctgggatagggagcatgaatatgagaggcaaccactggaccagctgcttggtcctcaccacctcctgcttctgccaatcagtgtggggaaatctcaacagtaaggtggctyatattccctgcctggcagcctcagagcagagagaagagccttgataccagggcaacatcagggaccctggagctagggctccaatatctcatccaaacagggtcagtgctttgtggtggctatggaggggaggggctgcgtgtaaggtatattctagcacggctcaactccaagcattctctttctttgtctatgtatgtacagataattacatggccgatttgcttatcgctggccaaaattaatctttcttttaagaagtgccagctgggtcattaagacagctcagcctgcatgcagtaaattctactcagcaaatatttattaacccagttccacgggagtactgagaaattgaaacacayagtctcacccaggtagtttagattgagtacccagtataaagtatcttgaattactttctgctttctctatcttcctactttctgcagtaggaagaaagtgaccctaggtggaggctaggcaggatgagttctctgtgcatatgcatctccctttctgtgtgagtgagaggtctttgctaggtggggatttggggatctaggatttatactactgaagctgaaataataataataatgatagcaacaacacagcctgtcatggtggcccatgcctgtaatcctakgactttgggaggctgaggcagcaaattacccaaggtcaggagtttgagaccagccttggccaacatggtgaaaccccatctttacaaaaaatacaaaaattagcagggtgtggtggtgcacacctgtagtcccagctgcttgggacgctgaggcaggagaattgcttgaacctaggaggtgaaggttgcagtgaaccaagattatgccattgcactccagcctgggtgacaaagcgtgactctgttaaaaaaaaaaaaatgaatacagtgctagctaccatttactgtatattttcactgtgccaggcattatgttaaatattttccatgtgttatctcattctaccctcacaatggcctagtaagaagcttcctgttatcaggcctgtttgacaggaggaaaactgatgcttagagacgttaagtgacttgctggcattcacatagccaggagcagtgctggatggaaacccagctccacygagctccaaagcctaggcttagaatatgttagactgtataagatggacgaacttggaaggatttcagggagggaaggattttggtggactctaggccttagggaaagttccaaaagggactggagctcaaataagcccttgaaaagtggaaacattcaggatgggagagaagagtcaagctggagatcagggagagccctgggcctggcctgaaagaagagggccctggtggtttccctatagtctctagggaagtttatttgtatgttacctaccagtgccatcttctgctttgtctttgggcattctgacycctgactccttccaacctgtctccccgttccttctaaaaggccccacttccaaatatttggcactgtcctaacccttgaggttctcccagagacccgcagtctccctcctgccccgtgtttccacggcccctttgcgcagcatcatttagaggaagtacaatgaagtgccagtagcaataactgccccggccctcgctttcatgtgcttgtaaagttgtttggcaggaactgggacttggaaaggagacatgactttgtcagagggcttggggctgggcatggtgtgrgtggcgaaggggagaaggaggaaaggggaaggaaaggagctcttgttgccccattctggrgagtggtggactctggacaaccaygaggaaactttggaaaggagcaaggctttgaggaggagtccagtctttgtatgggaaagcaaaaagtggagaaatggccaaatgtagttaagtgacattggacccagaaactctgagttggggaacagatatcttgaattcggggtcttgtgcaggaggaagaaagtggcccttggtggaggccaggggggatgagtccttcatgcacatgcatctccttgtctctgtgggtgaggggatctttttttttaattattattatactttaagttttagggttcaaccattgtggaagtcagtgtggcgattcctcagggatctagaactagaaataccatttgacccagccatcccattactgggtatatacccaaaggactacaaatcatgctgctataaagacacatgcacatgtatgtttattgtggcattattcacaatagcaaagacttggaaccaacccaaatgtccaacaatgatagactggrtgaggggatctttgcttgggaattgcatgcctggtgttgagaaagaggagagcgtctgagagccctgggtcttagggctggcacacacctttctgctcccttctctctaattgagcattagagactccgccccytgctgggagttagaactttagctgtgttttcccatgtgaaggagcaaagaggcaaagcttcatctctgttggggctagcatcaactaattcaggtattccccatttacacattggacatctacttgctgcaaaggcatggtgacaagtccttgtgtgggaggctggcagccagtaggaaaatgttccatttgttttttcccaaatttccccacaaaggaggggatgctggacagcatgaaattcttagttcatgacagattcccttccattcattcaggaactatttcctgactcattgtcatagactcagagatgggaactctaaggatcatttagaaaatctgaaagagagggactagtgacttcccctctctgcgacttgttaagatattagggcagggcatttctctcatgtatctctatcatgaggactgtgggagcctcaaccccaccccctgcagtgggtggggagggtgtggtctactggggtaacaacatttgtttcacaccttaaatactaccttacagactcattacagttttatatattactctacaatatacccaatttgagtttaatacaataataatgatatatatttttgaccatatagcaatgttggtgttcgacaatgattctctgtattgtcctggggcttctagcacctcctggaacatcgctagatggtcaggagcaccaaagttttaaaaacctgatgctctgctgtggtaccatatggtcctgtgtaaagcagggtcctaagtcctgagtctctaggaaatactgctcagtgagcactgactctatactagatgtgaagccgggggtagcacaggatatcttatctaagcctcccaacagcccaatacacctagcactctctttaactccattttctagataaagagatcgagacttgtggagatggcatgacttgccccaggatccagtggtggagttgggatttccgcattatctaacatcctcccatgttagactccaatgcttatgctccttcaattcattaygtgtctggaggactttggaagctatacgtggctctcccacactacctgtcccctgtggccagcataagtgaactcttgcatgggtggcttctctctccatccccggcaggctgtggactcttggctgccctgccctggcctgtctctccccaggtttggccaggtttggccacagatatcagagatgccaaccaagttatttgtaactaaaataaatcacatcccttatcagagtccagctgccctcccagatatgctctgatttacaggcttggaataaagagagaggtggttgcttgtctacaggacaagttagggcaatgccctctgcctgaatattaggaaagcagcattacaggagctctcactctgaccaggcaagcatttcacatgcacagacccagagacccactcctcacatgctcattagtaggttgtgcgaccctgggtaggaggctgacatgggtcttgaactgaaacccagtgtgtggctctaggtgacatgtggccacccaagtgaggtttcggatccacctgcagtgtcagatgcttcaaggctggggtcccctgatggagagraggtggttggagatcacctgggcctcctcagcactgcctcctggctggggctggggctggggataagagagtaactgcaattgtgcttccccrgcaccttcgctttaggtcactccaccgaagagcctgaaagggaagtggttcttgcgaaagaatgagctgaagcaggtggcagatgctaccaggcaccgtgtagttttcaaaggggatctttttctgcctcagagagaaattctggggtttgcacagcaagaaaccgatgactcaatttcctttgtgtccctgctttaatgggaaggttgtaggcgttctttagaatggcagggtaggttgataccttctaccttaaatttgaatcccacttttcactcacttagcaggttgaattttttttaagtgtaccccccacagctgcccaactgggtttgcgaggcaagcccaacttgccagagtaaaccggaaggggtgctttctaaagtttgtggttctggagtctggccaggcatggatacagtcattgtgcgttccagattttctgggagagtcaggatctcaaatatgcaaacactctaccaattgatgtctagtgcatattttgactaaatgtttatatatttttccacaaataaatacatgacttaatgtaattgaaagtcaaacactttttaaaaatgctttttgcataaagaaattcacatctttacaactccttaactaggatggtgtcaattaaattaatgtttgattcaggacatgtgtactttggaggtaagtatttcatattcctcccctctccattgctcaattgccccactgggtgacgtaccaagataagccacatgtttgattcttgtttgctggatgtggacatatgcacattgcaggtatgcctataagtacatgcctgaaggatctatgtgtgtggtgggaattggtgatgccaaagaatgctaaagactttcatgccccttaaaggggaaaataaccacaacaaaacaaattccaatgtatcttctcctgtcttctgcagcactgggggagtcccctgataacagggatcatgtcacattcatttttgtgggcccagatcycagtaatattgacccataactgttgaactgcaatgaatgtctagaatataaaagtcatgatatctatatatatggaagcatgctgtcagtatgggctaaggtgcaaatacatttatgtgtaagtgagaaccatggtgatggctgtgttgctcaggacagggctgacttggctggctgactgcccaccacaggcctcatgtttggtctaccccaaacagtgagctcacccatctgtttgtttgcggctttggtggctgcctgctgtgaccgctggggacatctggctaaagacagggttactagatagttgggctgagaagggagtgggagccagtgagatgaggacaccaaccccaaatttaagcctcaaaacaaaaacactccccagcagcagccaccttggggttctagttattttggagatactgatacgaggttgagatccttgggtgagaggcccacactcctccaacccccatgtctgcttctggaaggtggtggcagaggagagaagtagaagtactatatgggagatgcgggagattcttgccttctctgtcrgtctctttgggcaattatcaagctgtcatctgaccagatactaccatagcttcttcgggggcaaatccgtagggaatcctgacatccgacggggagccactttggcaatggcaaacggtgtctcctctccacagagcttgtgatgtcagaaattacccataactggggcaggttttgtcttyccaaagattgtctgcccagctagacctgagagacagggagacaaacacagaatgagggggtgggtcttgtgggggtggggaacgatggaaactcacagagccagatctccccgagtttgagttgcactggctgcctgggtgtgtcctcctgaggtaagtgtccctgcgaagtgcaagtgtgggcagacagatctcaggtgggtggggagggactgagtcaccaaggaggtgatttgcaaaactcaggtcccagaaactttcaggtcttcagcttttaaaagtaaaggttaattgcaaaactccggggttgagggaagagattattcacatagaccagtcattttgagcatctgctgttgtggcattgcaagtctccttcgcagtgcctgaaagttcatttgtttttgagagctcttacgctttttctgtttgcatctttgcacaagttctatgtttctgagaaccctcaccactattagtaataatagcaaacacttacagagtgttgaccatgtaccagcgccattctaattgtttcctatatactgccttgtttaatccaaacactgacttcatgaaggtggtgctgttattatctgtcttttacatatgaggaaactgaggcacagagaatttaagtagcttgcccaaggccatgcagctgataagtgatggcgctgggattcaaactcacatctggctacagagttcatgctctttgtcactatgttagagtgcttctcttggtatattaagatatcgaggcaccctagaaatccagacgattgtacctggaagtactgtagttgttttcaaaamyttcatttgggaatctagttgtgggtgaggtcataacatccactgagcttttaaacatgatgtcagaggaaggggttagaattgcaaaaatgaaggaggaggaagttgtaatggaaacttctgccaatgcatattctgagttgactcattcattctgatctctgaatagaagctctactctcttcyatgtgatggaaagttgaggatagggtagggctgagagggatgtgaattgagttgtttgttcattaggataggatagggctgaaagggatgtgaattgagttgtttgttcattatcacttcattatttgtcacctggatgaaaggtraaggtggctgattagtgtttctccatcagctagaactttgactgggaaatgagccaatcaaatagcagcaaaatatttgccctcaccttacaggcccttggttccagggtcttctctccaccggctagaatggatgagggagggagagaaactctgagaaaagaggctgtcaggagtagggctgtacatatccagggcacaaggaatttggcaaaagctggaagtrtactatagcccttctctccagccctagcctaaaccagatgaccaggcttctatttggcccagcatgtgaccatcccatcagggagcaagagagtttcctctgggtacccctcactgagaaaaaagccacccaggaagggaggaggcaaggccccctgggaacatctggctcagtccacaggaagggatgcaggccttttcctgggaatgaggactcatcccatattccagcccccttcccccaacttttttttttttcaattttagtgcatctctttacacttaacaggtctgcagtgacttctaggaggatccacacaccaatcgtggaactaggcagcatctttttccacttcctttccaagatagtagcacgataacagtaaagcccctttgcaagtgttcactattatgcacattaagatgccagggagagggctgggaaaggtggctcacacctgtaatcccagcactttgggaggccgaggcaggcggatgacctgaggtcgggagttcgagaccagcctgaccaacatggagaaaccccgtctctactaaaaatacaaaaaaattagccgggcatggtggtgcatgcctgtaatctcagctacttgggaggctgaggcaggagaatcacttgaacccgggaggcagaggttgcagtgagccaagatcacgccattgcactccagcctgggcaacaagagcgaaactcggtctcaaaaaaaaaaaaggtgccagggagaaatgaacaattccatgcagccaacacctggtctcctgcgtttggcttagaagggcatttctgcccaagcccccagctctagtctttgcacactttaaatgagtagctactacatgccaatcacagatgttgcctctgctgagtatccagtcaaaaaaccagaatctaacagagctaactaagcaccatcttrcaggaaaccagctgacgtcagctccgcagccaccagtgagttactgggcccacatctgcctgcaagagggggaggggaattcaggtaacccacaagaggggataaaagttcggggaagaaatctcctgtcaaggagtttgtttttgcagtggatcctctgcagtgagactagttgtctttacaatatcattagaggtcaggtacattcctgtagactcccttaagtgacttgctttctcctattgttccccctgaaaattcataaaaacctcacaaacacatctccatttaaaaagagaaagtttaaaggatgccatgtaatggttatctcttttcttttgccagtgagcataaaagctccttagggaaaagcccaaaccctctatacattttcatattcatgatagccctgagcggtcagcacagttccccaattatagtgggtgctcaataaacacttggatggcttactgaattaataatgtttctagacttggctagcaaagccatctccgttacttatcttttgtgatttttataggttctgtctaattctttttcttcattttttttctttctggtctatacaaatcttctttcatttttctctattgctacttgtagcgatcctcaacccgcctcctcccttgaaatttctgttctctgcactctcttcagtctaaagagatctttcttgaggtttgaaatgttacacaaggcaggggaagtttagagctaattgtattttgtccagtagaacggggatctggatttcctataggtctggctgcctctttgtctacacctttacttccaaatctggcctcatgtataaaaagaccccaaaccttaaaatcatgttctcaacaatactcagagaaaaattgttggctttttggtcaccatgctagaggaataaaagggcagttgtttctttcggtcaatggtttgaaaacctcccagactaaaaatcacctccatataatcagatgcttggtgtggtgtaatgaagatgaggaggtctggctttgataagagtcatttagaaggtataaaggcagtggaacaagacrggaggacccatacaccagttgattcccctcttgccacttaacagcagcgtgagcttgggcagttgcacttgttaaatgtctggaacaatacttagcacrtaatttctaaagcttaatgtttagttcacagaaggtatcccaagaatagaaatgattattatattttagcttctctctattactgattcactatgtgctgctaggcaaagtatttcacccccatttacttctatttttccatgtgtaaaatgcgagggttggattctagttgatctgtcaagtcctttccaggcctcatgttctataaattcaccactctgtgggcttactaacacctgagcctcataaaacctaatggaaagaataacacaaaaccaccataaggcagtgtcaaaaaaaattgatgcctgatttgtattaaatgtcaaaagtgaattattaatccatgccagaaataaacatatggacccaattacactctaactccaatgggcaagagtgttgtagggacaaagtgctttgcccgtagtacttcatagaatcctctagaccatgtggaaggtgagcagatgaagcagctctgrccagagaagttaggaacatgtcccagtcacacaactgaaactgcaggaagtcagtcctgggattaactgcaggatctgaacactgtactctttatattgtactttaaaaacattgcttcacatggccagaaaagccaacctctgaagaagagaaaaattgttcccttcactctcagagcttcatgagcaccttggacttgccagctttcctcaagcaacccctgtaacttgttggcacaaaattaaccacaatattcagacaaagcagtacttacagggtgagtgctagtatcctatgcaactagggtagcctgagaatctaggggaaaaaaagctagaccaaacaaaagattatatataatctttccccaaatcaaggcactgagcaaggcaggcctgagagatggtgaatttctgcttctactgagagtcctccagacccccagtaaaaatttcttttcatcataaaaccagagaaactcttgctcaggaaaaagaaagaaaaatggaaatcataaagattgcacgacttaggattttgtcaaaatgtgtcagaggctataatataaggctagtttttggcattctgtcagtcaytgaatgtccttcrtcagatcacagctccttttggttgtgctgactttatacccatctggaatccactgaccattagctgaaataaaatcccagatgtgctcagatctcacatcctgtgcaatgccctcagttattgctgatacggttcagtcatctgtctctccagctaatcatacagacacagtattctaggagaagtgagaacccactcatagccaggagagcttctccctctcagtcacagggtgactgtgggcaaggtccttcccctgttggttgcctctgtctccccagttataagatggtgacaaactgaccaacttaaaatttccttaaaatgtattggcactgtggacagaaatgaggaaagtggaagacctagtttctgtcctcagggagcttaccatttggtggaaataaagttaaacaggtgaaagaattatgcaagagagcataaccaagtgtcagaagacaggaaaaacagacatctcgattgcatgtgaaggcttcaaggaatttgaggatgagttgaatgtggaaaagaagayagacagagagaggggagaggagagaaacccagggaaaggcaaaacatgagccaggtgtttaaagtgggggaataagaatggcttgattggggccaggggaggggtcwgtctgcttggataagagaattcatgaaaagaacagtgagagatgaggtcggacagattccaggcaatcaagtaacagtggcactgtccactggcagaagatccaatttttctgccccagaaactcagaagttctcatgaatcaccctctcagacagtgctagacagagttcagaagcaggccagctccaacagtgagaaagaactttggcaactttgcctgggttagagagtggcaatttaagtgaatcccaaacaagacctactgtggcaatagcaaatagattttagctcaaggaacatttcccattgactcctagaggcttcccaaaatgctgtactaagaagtcaaaccttggctcaggtatggagagtgctgtgatccattagtgatgtctgctatgggcacaatatgaaggatttgacccccatgcatcacatggacatcaccgtagtggagcagcaggctttctttgttaatgtttctgagagttgtgtgtatagtcctctgggagtttagccattctagaatctgtccagctagccatactatagactctatctccttctagaacagtaaaaaagcagtctcttgcccagagggcagaggttagtcacttgagccttttgttaggattcactcccattctgtcttcccatttacccacatgaagttagatgctgggagccagatatttcctgtgtttgaacaagggccagacttcctggcaaagggtcccttcttcccatcagtttcttcaactgcaaactgagaagacaaaagtgatgcctcacccgtggtggcgacaggaggaataactagctaatgcgaggaaagcttttgaagatgaaagggtggtatgtgcatgttaattacaacttttatcagccctggagcctctgcattctcagctgccactggaagctcttctgtgcctcccaaatgcaaacagcagccacattccatgagctggcctcactaagtcctgcttagagcatccaagtcaagaaggttggattttgagctcaggctggccagctggctcactctgggccactcaagtttcccactactcatccccaagggaaaaagtaggctagctacctgggcaggtaagataagatagaaccaaggtataaacaaaaggctccatcaaaagtctaccagaaatagcccctgggtaagattaggacactctgctctaattcccaccctgtgaaagcctaattgtttgaccttgggctattggctttatctgtctaatggttcaatatactgtgtgaaccatttggggataataatccctctgcctcccctagacctctccacctttgcctgctggtgtgaaagtgttttgtgctagtaggcagaarcacgtgatataaaactacaaggtcctattattacctaggataactttcgcctctatctatgtctcctgttgctggttgaccccaatcattgaaactgtattctttggaatgctcagcagtctcctccaagctgccattccctccttatctaggtgggcccagtattggctcaggcttcttggttgtgccacttcctaaggcttgcaaatgcattcagcctgcccttgctctcagtgccagctctcagtgcccttgctgggataactcaataaagggctagaggtgggaatgggataatcatcagatgctttgctagtgctgacgggacagcttagaaggtataaactgagctgggcccatgcagcaacaccaaaatatgtgttcaaagagggagaagaggagaaaaagagaaaggaagttatcgtggtctgataacagggcatgtcagaatgggaaagrgtgttaggaattatgtagccaacttgtttgattggaaagataaggaagcctcaagggctgcaagtgactttcccaaggtcacaaaactaattggtggcaaaaccgtggtcttctgacttgtccggtttcctttcattttatcctttgagacgataaaggagaggacactaactaaacaagaagacaatgatctgatcaggacaagaagacttggagtacaaaatgagaagaagataatagggkaatggattttttagtggcacagtgggaaatggcgtaggtgtttacactgcactggagccctcactgtgcttggaactggttccctgtgcacagtcttgcacacccatatttggtatttttttatcctttttgacttaatgagcatttggaaaccataaggcccacagcaacctgacctttgacttgcccagactctctgagcaattytgtgagttgagtcaacaatcaatggttttcaaattattcaattgttcactcaacgcatactagttgaacaccaatatctgtgctctgctaggcactggggataccactgtagacaagagaggcatagtctcctctctcctggaacttacagtctatctggaagacagacagtaaacaactaatgatgcctttgtttaattacacttgtggtaagtgctatgaagragaagcactggatcttgtgagagcataatagggagatctcatctgatttaaagcaccagggaaagcctcccaggacctgttggatgaatagcagtaaccatgtctccaggatccccacarttccttgaggacccttgttgtcagacttctcagagctgtaccagccctctcactgtctcaccattgggtcttctgagtaagaaagcaagaaaaaaaattttactcctcaaaattctgaaagcaagtggtttatcatgtctgccctgtaatagtggtgggaagaaaatcatgagaacctctaagctgactcaggattttagaagcacacatttggggagaagggaaacaaaaattctggagaagcaaaaagtgtcatatggtatagaagttattttaagctactggggaaaattcataatttacttagggatcttgagtgtcaagcattggtttagagacaaatcttatccatttcgttgaaagttccttgatcttgtggctgaagcttgggcctagggttttattagtgtacatttaggggatggtttacagggtgtctttcaaggtcatacaggtgcctcttttggggtcaggcaggaggaataggacaaactctgggatacgaatgtacaaccatttggctcctagggcctcagtcctttagctccttgcttctggtgacttcttggagacaagagtagactttttcagaacagcgagatagttgtgctgacaaaacaaaaacaaaaacatcatttaagatgccttcagatgcaagtacatgtcataatagaaatattyaaaaattagtagagtataggcactagctaattcaaatgcttggttgtaaacaactatgtcttgtaaatgagaataaagtttattctcycaatgacgatgataacatctttctcactcacttttactcaaattggctttattgggcaggagagacagagatggagttataggtatcatgattgaacttaagctacaacccatctatgcatcaaaccatcatgtgtctcgtgtgattgttatctgttgtgtatattttggtatatccctatctgtacataccagctgaatatttctgtaagtaacagaacaatcagctctcataaaatattacctcccagggcaagaagtctgggatgattccaggaagtcaatgatattatcaagactcaggtttatttttccaactttcaattctgccactcccagtgtcttcctgcaatttagcacccctcatgttcctaaactaaatcccacagttccaggcatcctaggaaaaaaaaaatcmatatttagcagcagaagaaagagtgtatattcacaaacatctcttctaaaattggaggagcggctttttgggaagtccttaattgacctctccttatttctcattggatgaatggggtcacatgcccacacctaaccaatcactggcaagaagagcttggaccacagtgcttgacttagaccaatcatgatccacccactggagctgggatttgaggtctcacctgtcctgaagcacaaattcagggtttctgaataaaattgcacttcaggtagaatagaataactttttttgcattggtaacaatgtgggctacaatgagtaagggagtccatttacctgctagagttgtggtttgagactatttgggctaaggaaagaaggcaaagctaagtttttgtgcctctgtgccacaccctcaacctttttctgaaaagacatgcctcatgggtagagctcacatgggggacacactgcagtttgaggtttagatggtctgtggcttatactcaatgataatacctaaaactttatcctttcctgtcttctacaaaagagaattatatcagggaataatcttaaatctgttataatttacaagaaatagccagtcttctgcacacttgagtactttattattagaaactcattacttgcaacccatctcagcactgttggagctacaccatgcatgaggaccgctgctctagagtcatccattaaaaaagaattcctacgaacctgaatgagcatttctttctctaaattatgagatgatgaccctcaagggaaatggccgtcttcccttttctactgcactcttagagtgcattaatgtgtgtgaagtgttttcggttccattatctaaagcagccctcatattaacatcgtggttggcattaytggcctcctgtatgggatgaaagtttaatgacttctgcaaggttatgaaaggtcaagatcacagctaattagygcaaattcaggatttgaattctagtttctaccccagagctgatgtccatgtcaccatggacatcatttgctcccaatatacctgatttactttcaaggggtctggaattgactattggattttatattaaaaattgctctttcataggcaggaaaaagtccttcctaatagtttgagtccaaagcttaagggtctagcatctcaactttttaatgaacmcaaaaatgaacaggagggttttctgagccagtcccctgcctccacacagttagctcatgaatccaacatcatgggrggaagtcttcaggattttgtttcccattccttttttatcacctaaatatagttaaaggatttgtgatgactgcatccagagatgtttaaaaatggacctgaaggatgtgattgtgtcttaggcaggaagggtgccggttcttttcagtatctaatgatgaacgatctaaaggaaatggattctaaaccatttgattctaaaccaaaatggtgtatgtttcttttgagggtgaatttcctgatcatgagccttgttgagcattagactggccggctggttcctaatccatccttcagttctcagctgcagtgacatttccttagagagacagatctcctttggggacagcacaggacttgagaaaaaaggcttccctttccactgagcttggctccaactacacctcatgtgtctgttacatttatcatgctgtgttgtcaacttgtttaatgtctgtcagtggctcatgcctgtaattcagcactttgggagcctgaggcaaaagacttactttgacagcagaggtttgcagaggttgctgggcaacatagtgagaccctgtctctacaaaaatatatttttaattggctgtgcatggtggcatgcacctgtagtcccagctgctcaggaggctgaggtgggaggagtgcttgggcccaggagtttgaggttacactgagctargattgtgctactgcactccagcctgggtgatggagccagaccctgtctctaytaaaaattargaaaagaaatagcctgtctactctattggtccataacctctatcragacagtgaccttgtctgctttattcaatgcctggatcttttcctagcacagtgcccagcacatggagacwctgaatttggattctcctttttgaagtccccatatccacttcagtattggggtgattttgatgggattgtgacttaccatggtggatgcakcctgtgagttccaaactcaacttcttaaaaaaccttgtctatcatctatccatctatctgtctgtctgtctrtctrtctatctatctatctatctatctatctatctatctatcatcygtctgtattctatgttccatctatcatctatctgtcatatatctatctctatctattaattatctctatctttatctatttatatctatcatctatctgccatatatctatctctatctcttaattgtctctatctttatctatttatatctatcatctatctatatctatcatcttttaacctatctgtttctattggaataagagacaagtgcttgaaaagcagaggagagtcaatacacaggccacatcttctctcactccctccttcctcctcatagctgtgagccaccccagtccctgtacctgcttccttggctggcatcatctaagaaatcatctcttccacagtttcctgcaagggcatcaccccaagggaagctgaacacatgcaacatctgcccactcaggataagtgtgagggataaggaggaaacatttttcctctagagacaggactgttggggcaagggctggggaagcaagacatggatactccaggctacttcttgctggggctgaggggagtgctcggtgtggctcccctctgggacgtgtttagggcagctctctcgcctctgaaacaagcctcatcagatcatccccaggcttccttccgcatagtttctgatgatataggaaaggagcccgattatctgtttgagcttcctgttctttgtattgtttggaaggctaaagtcaacagccacttttgtattctgcattgtttgcrttgttaaaaactctggaaaactcatctggtttcttctscaaaagtagcttcccagagccctgggagacactcagaaataagatccttttcaaataggccagcagggaccagggtctctcagaaccagctttcctatcttcttccaaaggccggaattgagaaggtttactccagcccacataattgagtctctgggctgtcaaggacgcattggggagtttgcttctggtgtgctgggtgcttagaaagccgtatgaattgcagagatagagttgggttccagttctgccagtcaccaattatgtggccttaagcagtttacttaacttttctgagcctcaattttctcttctctaaaatagagttgtaatatacctatggcttagagttgtgtaaggactgacgcgatcacagacttgaaacccttgatagaacgactggcatggagtaagcattcaacagtcataattaaggtcattgtgatgattacacttggggcctctccattcaccatttgccccaactgtgttcctgctgcacttgaaaatgattccagctgcctctggaagattttcatcccatttctgggaaaaacattagcyaataaaytctcattgaatttggcagggcgggcacaccagcaagctgacactatgtgcatacaggcttcctggaacaactgttgctgagcaaatgaagcagcatggaatgttccgggaagcaggattattgctgtagctggtgaaagtgaactgggaaacgcactccaggtcctgtctttacttgcacaattacagtcaatccccaaggctgcttgtctcagcaggatcagcctcttcctgccttctgtcctggcagtgggtggtggggctggaggaagaaatggtgttttcctccctctcccattgcaattgtttccttacagtgctgttctctgaggccagagaacagaagggctctttccagaggcagtttaacagagtagcttccttttcattctgagaagtttggagtttcccagagtccacttcctccctagaagcgcaagcttggaatttcttggttgccaatgaggtgccagcttctgagtgcataaagtgtgtccatcgtttttaatcaattctctcatctccaaaaatacctttaattgcctttagctgcttagttctgctgtcctctaaagaaaacaagatctggccactcccagccacacctcagaagtgagtaaggcttttgcaccttttaataggagtatttacatgtgtgtcggtttctcatctgcttttaatttcattagagtgtgattttggactgttgtttgagatgaaagagcagattatcaaagtgcagatgattttttcatggtgcaaacacatcataaattagaaactatgagacccctttgcagcggggaagactggggccagtcatccaaggtttcatcttcctgtaggagaagggaaaaaaaacggacatttattaactatctgttatgatccagactctctactggtgctttttgtatatttattctctaactcccatcaacttctctttgagagaggcagcaaatgacaactgaataaatgaatggctgaatttcatcagagccagtttacaggcagagaaactgaggctcataaagcggacgtaacctgcctgagatgtctcagcttttatatggtggggctggaattcaattcagagctccttctcccttttaacactacactgcaagttcccattcagcttcatgggattaatcctgttcttctgtccctagaatggagccttgaaagttcaaggtgtctccttttcctaagaaactggatttttctggctccttgagaattgaggagctcaaaacaattgagaactcttgggaggcatcttcaggaaaggaggtggtggaaactttcctctcctcactctccccaggggcaatggggcctccaaggccaycaaagatcaaggtgccaggtgggggatgcctcccagcttcccattcatttttcagttgggggccastcagcagctcctcaggtgaggattgtctcagaactgaagaatggttcaaattggcccaagatgctgaaatttattgcagggatcactgggacagtgtgtagcaatttakgaggcttctctctaagggaatcagtagctgctgcatttctcttaattgaaaccactctttccctccagcttcgatggggcaggttctcatatctgcgtgctgaaaggcgtttatttggtgtattctgagagcaggatgctggtaacactttcttttgtgttttgccaattgtttctttttactggctagtccaccctgtctgacgcattcattataccatamccmccttgacaccagagtgaaatgccatttctctgcaggtaggagagagtcacacggattccttgagtgtttgtagcgtaagtgagaaagatatgtagccttcttctagaggcagagggatgggttggctgggacttagagatattcaaatccaactctgttcttgtctgataaagtaaacgaggcctctgaaggtaaagtgacttctgtaagtactcacagcttatcagtaagaagcctgatattaaaactccaggtcactagaccttcaacctaatgttcttcccactaaaccaagttaacatttattgtacaccatactaaatggcagacactggggacacaaagatgaataaggcatggtcccagtggaacccactttggttatatgggttaggacacttgaggcaggatcctccttagaatggtgttttataaagtctctctttctctttctctctctctcatctctctccaatctatcctctctatcaagagagaacacatgtaatgtagagtgagagcccatgtrttggataattaggcttctggctcctaattatcaggaagcctggaggtcttgagtggttgtaaccaaggatactgaaagtggttgaccagttaataaagaattaagttagagtaagagrcactttacttttaagctgcctttaatacactttaatctttgagatgattggctaatatctgttaagtaccaggctctttgcagagagtcaggtcctttgctaaatgatttaggtatatttcttcatctaatactcaaaaagcaccccataaggaaggcattacttttattttactgatgaagagactgaggcttaaaggttaagaaaacatagcatgcataacatcccacaagagctcaagccaggacttggacccaagtctttcttggatctttccgatccaagccatatggttactgcaatctcacaatacaatgagggtaaatccttgcaatcaccagttaccagcaattgtgaarcaatggatggcatagatgtcagggggtcaggagagccttgcaagcrttcagagggcttgggagtggacacatcacagttgcactctgctgggcagcgctgtaagtctctgattggattttgccttgaattttttctggtcaagactcagaaaggatggatgtagcttcacttacaccaattctacccagcttgtgacccaaatggaactcttatcccttaagccaggtcattcagttgttgtagcctttgccttccaagtttcccttgtctaccctactgagtctgaattctaaggacatcttcttatggactgtgggaggcaaagatgaattccaaatcttatttaatctgtgtgctgggggggaagaggagtgtatttccttttgccaggtatctgagcctacaaaaagccccataaayaagtaaaatgtgtccatgagttcataaaagagtgagccttagacatacagaccacctgtcaaaagagccctgtcattctctattatattatcctcttttattttctgtgtaacactatgagtatctgaaattaccgkattcatgtattaatcatttacctgtatactatatcctcactctagaggtaagctctttgagggcacagatcgtgtctgactccccagcccccaagattgtatctggcttgtatcaaccatatcatagggaaggtgctgtgaattgacaccttgcaccatgctttatggaaactaatggtgctttaagaggcacagatttcatagaaagagacccagttgttcccaccctgatggttctaggtctaggtctaggtcaccaaygtctatggtgaaagaatgggcttttgcgaggtatggtctcctgtcatgtatgagggtcatttatttaagggaaaaccaagaccttattttctttgacaactgcacacaagggtcatttgtaatgtccttcatttccaagcctctggatctttgcatggatcatgctccttaaaagaaggaagttatgtttggcctgcttcagctaagcatggaatggtaaagattttggtccaaaccctgtgacttgagttggatttaaaagcttgtcagaaatgagttctctggagcttggcatttgagactggcatccgttgttccagatgagatttcacggattgaaagctcaggaagaggtgtgaattacaagcaattagttcacagggcagttggaactgtagtaatcctggaaaccttttggcccacattttaaaaatatccccacaatccagcttctccctctgtagggcttctgcttgggaaagtttgtgtaactccccaaaacatctgaagagtgaatagcagtagkgttcttggactgcgaaggagaccctgcttcttatgtgcatgctcttgtgcacacagacagaaacacacacatacatgcacacacacacagacatgtacacccatgttcgctttagcatctgatagaaaaagaggaacatgaggaaagacagagattgagtcaycaacatgtgacctggtgatttctgwgtcctctgactttgaaatcagtggaaatttagagctctactttgtcacttgtaatgctttgttgttgcaaataaatatttttgcagctgcatcacttcattgctaatatatttgaagaaggcaagataacctaaaggcatgaatcttgttctgttttaatccacctgtaagtcagtgktggttgtaaggtaaattgtaagtaagagctattggccaccaagtgccaagggttatgaatgatttacctttttttttttttctaaactgaagsaaactcatggttgttcctagaaaaacatgcacactcacttgcttgcattcggataagcttctttgagtaacagggaagaggccactaggattacaaggcagttagtgcccattggagtgtgactggcattgtgcaccctgtgaatcatagtggtggtatggggaaaggggtaaawaagcatcaatctatggagtatgcgaaccagatggcatctgtcctgggaagaacaaatrtccttcataggagaattagaggactatactagtcaggcagaaatccagtccattcatcaagcttttcctcttgctgtggtccctacagggtcagccctgtttaggctcaagcctcttaaatcccagtgcaagaccaatttctctatgaaattctccctgtcttctttggtctcatggctacttcctgggaggaaaaagtagtaatcagctccctccccccagctaaatgtgcatggtrttagcaaattctaacccaagatgttaaaactatctgagaagaggcatgattctgcttcttgtctgtaccctcctaaagtcaaggtgcagcaaggagagagacatttgcatgtggcccctgagaaagaagagatttgtctgcctcaccccctgctggtgcaaacttgcacctctctcagcctcagttttcttatrtgtatcaagtttcaatgatcgcaatagtacttatctcatgtgactactgtgggattgaaacgagatagttcatgtgaagtaccgagcacagagcctggcacasagtaggtactctattagtgttaatatcactggaaaacccagctgggggctcagcagtagaagctgccagagccttagtgttacagccacatccattaccccaccattcacatacatttcatgccccagggtgagaatccacatatcccaagcagagaggcacagctttggtaaactgagtcttagctaactcatgtcagaaaccaagtgttatcctggggtttgactcctggctcttgccacattcatagcaggatgctgagtggattgtactcagcctcacttgttgcatctgtgaaatgggggtgattttttgacttctcaaggtatagcatctattaaggcacatagactacaatctgacacaaattarcagctccatacattgcagaatcttttctttttcacttaaggagatgctaaaagaggcaagaggaaagaaaatcaaatttggagatgccgtggsctgtgtgttgaagttgggctctggtggaattggtggtgaccttttgcttctctccatctggatggctgtatcttcaaagacaacaagtcttaactgcagtttttgattgtataaatctggccaagtccactatttacccagcccagtctccttagagtaggattggaaactcaaactttgctatctcctctgcagagtgagcaagggacaatctttatgaaaaactttaagttgcaagatatttgtgttcttaataatgaagggaagaatacaaaaatgataatactaagcctggctcatggatagcatttttgcacaatatatttcatttgggctgcagcctttgagctgtactaattgctctgagcatctgtttgtatgtccgttgcatgggatgatttaccctcctaggtttccaaatgctttggagcccctggtttattgcaggacttactaagtggtggccatcgtcactttgattggcccctaccacagtattttccagacttttccaccaaggctcttagggctttgtggtgggtgccagaacaattgatggggtagggtgggtgctggaagagaatgagcatctggtagattgagtctctgggtctgcccttccaccctcactccagcccccattagctcagcttgattttcaaccacttgaaatactgtggttgtgcctaagacatcatgtcagggagagaaagaaacatctgaaaaccatcaatcttctctctgaatgcttccactggtcccatttgcctgttgacaacccaagttgaaaaggcagcaccagaggggaatggggaaaattagcagaactggaaaatctgagttgagatctgggtttaccaaactctccgtaagactttgagtctgtgaaacttatgtccattagtttcttcaccttttaaatgggtctgtagtacctaccctctgggcctcacaggctgcttttgggtgtgaaagtgctttataattggtgaaggaaactgctacgtggcaagaatagcaaagcctgatgtactttaatccattcggttctgctgagggtggagccccaatgtgtcttaattcatatgaggtttctgagaagctttttgagattttaatactgtcccaggtatgcacatcaaccttctcacttttatcccccaagctccaaaatttcataactttttatttcatcttgggtggcaggaaggcaaggtgtgcctgggggagctacagggagttattcaaggtcacataattagcttataattaacagagtttaggctagaacyagtgcatcccactcccagatgggggcccccggcttatctcagcatgtcagcaacccawgaatcagccctgaaatatagatattacctatgagtaacagtttctcatcctacctcaactgttacgaaagtcttccctcaaactaaagctaagcagttccacaaaatgccagctatagacattagcagaaactgtatattgattaggtgatgtatcagtcaytgtaactacccagaaaaaaaaatacaatgacaaaaccaagtggcccaaccttattttctacttgcaagaggaaaaaccctatttgggccccaagatgcttttttcatttcatttaccacatcctgggtttgtgctagtcaatctgctaaatcaataagatccgaaaaagcagaaaacaaagatcgtgaggccagaggatttcctgatcaccatggcaacacacaggggtgggtactgtggtttctctgcctgaagacgcactcgtcaaagactacttggtgttacagaattctggtgcagtgaagcaacagttctgggacatatactttcttttgccagaaagactctgttggatccaggaccaggagtggggggttaaacagttctccataccctcacctccaagtccccatcatcccattaggagacagggacagtactgttctccaaactctcaaaacaacccaagagctttctaggctgtgcattgggttgatcatttggtggccttggctgaagggccagggtaacagctaggagaacccttgggattcttctccaatgtgacaggcccctccatgttggttcagcgttgactgccatgacaggctccaggctccacrgaaaaaaggcagagaaatcagggggtccagccaggcgccaagacgttggggtgccttgcatttctaagtgccaagtgatgaatagctcagttgaaagyaacccagggcacattctggaggaaattctctgggtatgattgtgcatgactgttttctctgctcattaaaccctcatctgcctccagggcaattccgggagagactgagtcactcaagactcatggtctgcactgggcagccaaaggcgattcggccaccaagtgtgattctggcctcattcagaagtggatgctaaacaatacaccctttcaccagsagcccatcacatgggcatcaggagatgggggcgagtgatgtgccagccttctagactggcaggcctggggggcagcagagggcacaatagctagaaagactcccagatgaaaacttctgggctttgaagccttcgaacaaatgaagaagaaaatgacttcttcgtgtcctattaagacagtgagttgtggcttttttgagagcagcttgctcagacctcttatgaaagatagatcagtagcaasagcactggtgtaggagtcagaaatctgcaattatgaaccactgagttttgtgtgtgtgtgtgtgtgtttttgtttttgttttttgtttgttttgttttgttttttaacttgctggaggaccatactcggctatccttgattttattttctcctgtgtcacaagagaaattggttagaagcttcccattgtgcctcctggctttaaaaatagataatccaattaacaataatgctttaaaacaacaaaaccttgtccttttcccttcctacttctgatcagaaccagctcagtaagatttattagttgtgcaatctgttttggacwtgagctcagcaaatcagaggacagaaatagaatcctggctttttaatgataaacactgtaaaaataaaaaakttggagagcttaccagtgcttctggctgcccaagtggtttgtgtgtggttgactcccaggagctcaatcactttgggtgcagtccacccagagagcyatgttccagctacatcaacctggagccttagcttggtcagtctagatttttgggtttggctgcagacatctcgtaatgtcacaaggacagcctgtgtccttggtgacccaaccctgggccaaccccaagtcctggagtcctctcctaagagccctgcctaattgtagagagagcattcaggctgtaaagggcaggaggcctgggggctacgactaggtttgggctttctaaattcccaagagtatgatgggaagaccaacaggcagaatcagagagaagcagtcagcccactgctggggaaagccagtcaaggtcaagacttcagaatctcctctctggagagagagtgaaaattccattagtgaagtttgttccactgaagccttaccaggccttggtaaaggcccctatcttgtggtccagaatcaagggacttctgatcttaaaataatattcaataagctcaaattcttctctctagggctctcttttcatgatcacctctccacactttattaaaaaatcacatgaagggtaagtgggcttcctgtcatttcagtgtctgacctgtgcataagttggaatttaacactggaaaatgatcagccagattgcccagtctgaaacccaggtcccccagtgactagcacaagttacttacatcttctcaatgaatcagttacctcttgtgtaaaatggggataataaaaatgcctgccacacaggattgttaggaaaattaagtgaaatattaggtgtaaagtgctgaataccttgaacccagactaggcactcagtgagtgctcactgtggttatggaccaggagctgcaggaattagaacaccattgagtagcaggaactggctttattctcatcttcatgataaagcaacttctccttacatatagcttaatctggaaccaaaaatctaattctgcctcatccctcctgaggagatgacaaatagggatcaggcacacctgggtggctcaagttagaaaacaaattaactcattttgcagaatctggagacgtctggtckggagaactgayagtgccctctctttgggcatagyatgactgtaggttgtctttgggtggtcttcatatggaatgtactgtgtttgccatgttccctaggagatctggcctcagaaatggccctgtgatggtatgtgaacatactgtcctgtaactgagatgatagcttgcacattcagacagacaaagccagttacaaaactaaaagttggtctctgaaacatttgctttcggggaaaacagcaaatgttcacagaagcaaagttctgggttaaagacattttaagtatccaataaggaattctcagcaaacaccagctggtgattcctcagatatgatgtgggaaaggaacctgataggtgatctttttgcaccctataagactgcagcctgtcgggggttgggggcagaaagagagcatttattaattcattatttcattcaacatttgcctaccatgggaggctgtactaggtactgggaatataattgtgaagaagggagacaccatttctgttgtcaacgaagcccacagagaagttccaaaatttcagaatgctggaatttctggttactagagaccttgragataataatttcttgtaattctttacctggttgtgtcacagactttgaaaaccaatgaaaaccagagatgttgccctacctaaacacacacacacacacacacacacacacatccatacacacaatcttgcatataatctcacaggtccatggatgtattgaccagctcctggattccatattgaaaatcccttgcagcccagctccaatactagtaccaggccactcacctctcaggaaagtttgggaagaygtagataatggcaacttgggtgaaaattacacagtgctctcttcccagcacatgttgtgattttctacaacttcagaaataactggggtggaccaagaagctattattcctcgcaggccmtacaatctaggcaaagctttgaaatgtgctcggacaattttatcagagatctattttccttgawctgaggcttagggggcagtatagatgagattaatggcatttgggatcagtgatggtttatccaggagagaatgcatagtacctgtaaccaggagcctgaataggaggcaacatagcatagaggttagaatsctgactttcccacttggatgacattgggcaaaggacttcaccactttgtgcctcagtttcctcatctctaaaatgggtttagcaatagtgcctacctcatagcatttttatgagaattaaattagctgaagtacataaggcacctaataagtgtgcaatgctcattggctctgattattaagtgtcaaacaccatatcaagtgtttgacataccttatttcatgtaatagtcccataaaccctgamaggttcgcattgtcatcccatcaaggaagaggtggagagtcagagaggttaagtaattaacaacctgtgtcacctaaagtgagtggcaggktcaggaattgaaccaggtttgaggaggtcctaactaggttgaactactgaccttmataaaagtttggcactacagaccagctttataggacaaaaaaaccttctttcagagctcctttttctcgccttcctgacagctccctagcagacctcttcccatgygggtagggagataaggttcctagacactgggacactggtctccatgacccctctgtgctgcccacagccctatagtaatgagcgtgctaaaggcctggtggcatttctaccacgggaagtctcctctccaaatccaaaagtggcctcaaacagtcagtgttttcagttgarctcatttatcgctcagagggaggcacttgggacattttattcattacatgatgcaggagatttattggagaccagagggctcaacggaaaacattcttgrtttatttccagccagaaaggcttgtttgagagatgcaatcagccatttagtattagcttcttgartcaaagtggatcctgaatcacagagttctctgtttctcaggagagacacacagacatctgaggagtcttgcctctctatagtggtttgcagcatggctagcaccattgccagagacactggcactctgtcaagcaatgttctgtggtccatggctattcacatcttaaccttgccttaattctacttcattgtgagtttgggcatgtttctttatttcttcccctctctgtgtgttagtttctccatctggaaaatgaggatactaatattacccacctcataggaatgttttaaggataaaatgagtaaataattctaaagtgcctaaaatagagcctggcatatacayaatgaatgcacaataaatattagccactgctcttgctgttggcattattaatatcctcccgggtaataatttgggtttgcgttagtatcaaggaaacctgatgaaatgtcttcataaattatcagggtttgaatgacacacagccttgaaaatgttggctccttttaagtcaagagggacctagagtagaaggattgtgaacattcacaggatagttgaccagaaatgaagtatttgacaccattcttgcaactcctaagtagctaaatagcgtcagggttaggagttggactttctcatgagatcaagataaatgtaagctgtggaatttttactttgcataggatttcttcatccaatcagcagccctttgcagatacctacaatgtgtcagaacctgcttaagccttcacatctaggaaggctaaaggttgagtttgtctgtttcatcctgtcttggctgatcacatgcacatacaaccacacactcacttgcatacamacatataagtatgaggagaattcaaaatgttcatggaaaaatgagattaaaagataaaagtttaaagatgtaaactttacttctcaacataagcaccatcacattcaagatactgttataagctatgatagcggccatttagtccatccctaaagaactgagggtcctgggaatttaatcacatcaatgcaatctttcttacwttgttaactaaagaaaaatgggtgccctttgaagatttttaaagattaagtaacaaaaaaaaaaaagtcagaaggagtcaaatttggactataaggtggatgcctaatggcttctccatagaaattctcaaaaaaattgcctttgtttgatgagaataatgagcaggagcattgtcatgtcatgatggaggaagactctctggtgaagcttttcgatacattttttcttcaaaagcttgggctacctttctgaaaacactctcataattagcagatgttatcgttctttgaccttccagaaagttaacaaacaaaatgccttgagcatctcagacaacggctgccatgaccttggctctacactggtccacctgctttgactkgtccacttttgctttgactggaccacttccacctcttggtagctattcctttgattgtgctttgtcttcaggatcacacacataaggccatgtttcatctcctgttataattctcaaagaaatgcttcaggatcttgatcccacttgtttaaaatttccattgaaagctcagctcttggttgcagctgatctgggcacaatggttttggcaaccactgagtggaaagtttgctcaactttaatttttcagtcagatttgtgtaagctgaaccagttgagatgtctatgatgctggccattgtttctgctgttaatcattggtcctcttcatttaagtcacaaataagattaatttttttctcccaaattgatgtggatggcatatcgctgcaggcttcatcttcaacatcatcttgtcccttcttcaaacaagttatctgtttgtaagctgctgatttctttgggacattgtcctgatgaacttttcataaagcatcaatgattttttcattcttccacctaagcttcaccaaaaattttggtgtgtgttcttgcttcaattttagcagaattcatgttgctctgagagaggatcttttcaaacatgtcttatccttgttagtgcctcaaactagatcctgttcagatatatcaagttagtgagagtttattttggtgcaaaaaaaaaaatttgaaatctatgtatagttttttcatagcacgtatttttcatggaacttttggaagacccgtcatatagacacactcacacaatggatgcatgtattgtcagtgaagttatgttggcttctgaaactcaagggattttgctgaaactcatgaaactcaagggattttactgaaaagtctcagcctcaattggttcctcttacatttgcatattctgtctgccaggtggcaaggtagaattgactgtaataagaaagaaactaccattgagctccaattattgtccatgcctcagagttgatttttaacctgagagtgacagcagccacctgggccaggggcagacaggtagtttgcctcacctggaatcagaggctcccctatcagccttatcttcaagaagctgataggaatgctttgtttttcttttgtgtgctggacaaggagaggccccggaaggtctgtcatgtagattgacagtttccttttgtaagactggccaactgaggccaaagttgaaaatgtcagtaaaaacaaatagtattgcaaaagggccttatgcatttccttctctatcctctcattgccccatcagccgagtgctgcatgagtggcttaagagaacaccattaggcttgaaaaagagtgaactgcaaaaacacattttctccatttcacctagttgttattttccccccatgtgctaatgatgcaaacaaaagaaaataaaaataatagacattggcttaygtcttttcaagttccatttcttgtttcttcttttactattttcagaatcaaggaagataatacagaattttaacagttttcttacctcattttgcatttgttagacattgtttcctcgtggttgagacctgcttcctgctcaggaaagagaaagcagtggttgcccatacaattcaataataatgactctttgtcattatttaacagttgtttaggtgtgcctctctcctttcttcagttgcactaatgatagaaaaggatccttgggcacatagtaaagtggttcaaatcatgggtttgggtggtaaacaggtctgagatagatttcctgctctgccacttaagagctgggtgacgttggggagtcatttaatttttctgagcttcacccataaataatacatacatacataaaactcacctttcaggtttctgaagatgatgcaacacagaatctcaaaggtactgggtacccagggacactgcagtaataggtcccctctcctattgctgtcagctcagaaatacagaacagagcaactgggattcagaaaggagactataggctctagatagaggtactcactcacttccttgggcaactcacttccctgagcctcaactttcttgttggtaaataagtggaatcttcctacccaccactagaactgtgcaaggaagagatggagctggttaatgccagttctgtctgattccagacctggttcttaactaacaacaaggagtggtgcctggccaggcacttggggcattgtcccaagasgatgtcaacatgtcttcttagagaaggacagtcattgaggcctraggaagtgttcaggaggaataagcttcaccaggatagtttcaatgacttaaccctttgcatgcagtttcctcaagtgtaaaccgggggtcatatagtcccargagttttcaattacagcctttgaagtcttttgagattgttacacaggatcaagtagaagaggatgatttctagctctctattggaatttcagattaatgtctacaaaactcactaaagtccttgtattgaataattctttacccaactgatagcagttaggcttcattttcaatgccattaactctgagagcaaacgacaggcttttggtctgccaatatattaaaagtgtgtttctgaggaaatttcaatgagtcattcgtttatataacaaatacttgttgagcatctactttctattgggtactgttatagggattagagwtaacagctgcaagcaagtaaaaggcccttgctttctcagagctttcattccaggaaggagagaaagagagtaaccacacacatcaatagatgaccaggctgttgtgaagacacaaaagccaaatgagttgagggagagactgggggttagacaagggtgtttagggaagcactctaaagtgaggtgacgtggagttaaaattctgaatgataaaaaaaatgaaccacctatgtgaccatttgaggatggaacattccagacagagaggaaggcagatacaaatattctaggatgggaaggagctcagaatgtctgagagaattgaagacaagctttgtgcttagagcagagcaagctactttgaggttagagagggagccaggagccagattatgttggttttagccataataagaacatttatactgggtatgaacataaactcttggaggttgtaagccagggagagatcacttgattgtgaaaaaatgctcataacataagattaagtggaaaaatgactcttaaatctagaactgtatattcagtaccatttcaattatgcaagcatatgtgtgagtatgtatatttgtgtgtatgtgtgtatgtgtatatagatacatactttatgtatatatgcataaagtacgtgtgtgcatgtgtgcacgtgtgaatgtgtgtattcagtaaacaaactggaagaagatatagaaaagtgtttgctgtagtttttgtagtggtggacttattttccttcattgctttcctgtgttttgtaagttttctgtaagtttgtatgacatcaataatcaaaattaaatcatttgctttttaaaaactttgttgcagagcaatcaatggagagaatgtaagagtgatattattttaccatgtcttttctcagatttgagcttaatatcatggtgctttggaatgctggagtgaattttgaaggctctggctagyagagaagtttatttggctttttgtttgtttgttcyttttttttttttttttttgagatagagtctcgctctgtcacccaggctggagtgtagtggcatgatctcggctcactgtaacctctgcctcctggttcaagtgattcttctgcctcagcctcccaagtagctgggactacaggcatgtgccaccacacctgactaatttttgtatttttttttttttttttttttgaaacggagtcttgctctgtcgcccaggctggagtgcagtggcgcgatctcagctcactgtaagctccgcctcccaggttcatgccattctcctgcctcagcctccggagcagctgggactacaggcgcccgccaccacgcccagctaattttttatatttttagtagagacggggtttcaccgtgttagccaggatggtctcgatctcctgaccttgtgatccgcccgcctcggcctcccaaagtgctgggattacaggcttgagccaccgcgcccggcctaatttttgtatttttagtagagacggggtttcgccatgttaaccaggctggtcttgagctcctgacctcaggtgatccacccacctcggcctcccaaagtgctgggattgtaggcatgagccaccgcgcccggccttatttgrctttttaaggagtctgtcctaaactgaacttattactgtctccaaattatttatgcaaaagaatctaacatttctrtttcttcccatagatttgaatataacctgccgctttgcaggtgtattccacgtggagaaaaatggtcgctacagcatctctcsgacggaggccgctgacctctgcaaggctttcaatagcaccttgcccacaatggcccagatggagaaagctctgagcatcggatttgagacctgcaggtaagagaccagcacccgaccactggggaaagctggcggcctgggaccaggcagctgggcttagaactggaaggctcctttcccacagctgaatggattattgcctaaggagtcaaccccacgtattaatttggccaagtcaatctgcaayctgtatgacaactggagtttaaagtcagctaaagacacctttgtgaatcatagagcgggaacccagaggaagccattaggggtcctctcggctggaatcctcttgtctaacctgcttccacagagctctcctggctttgaagaagctgcagtatcattgtcagaaccacaagaaaacataaaccaaataacagtgtttgaaataaatatgtggctgttagagtcttggccctgcagacttggatcaaagcagacttttcaaactactctctcttactctctcttaaaaaaaattttttttggtttctcttctatgtttctctggtttgaaaaagtaaataaaaaggcatgaaagttattaagctatattatattaagatatattatttttgggagccctgagagggctcctacyagttattctagagctgcatagagccttcctcaaactatggctccaagcaagataawcacaacaagcaaggactttattttttgaatttccaatggccttgcggtaagcggtgcacaagaagagcaagccacggtggcaatcacagtgaattgttgtggttcgatttgttttcactagaagaggactgagtaacctctgcaactgctctgaagtttctaccccagcctgtagctgtgcttttgcagtgtctttaggtaatatgattcccctttctctgcaacacacactcacatgcacacagactgcttttgaaaagtcaagctgcagaactctacggaaaccatgaagtgtaagttaagtgcttctatcctccaacactggktacagtcatgcacccacattatgagtgatggctgagactcttgctgaaagggaaaaggaaagtcttttgcctaaaattgccctgtctgatatggtagccactaaccacatgtggtgacttacacttaaactaattaaaatactaaaattaaaactttagttcttcactagcactaactacattttaagtgctcggttagtcaccgatggccagtggctactgtactggatgacccaggttagagaacatttccatcattgcagaaagttctattgaggagcactgctctaaaataaagagcagatgtacatagacatctgtatgtgttcagagctaggtctgggggaatatgaaaggagcagagagagggagaaagctctggtggctactgaacttgcactgtaggatgcaatgaaaaaaggccatttagcaaatccattattctattcccaaggctaattgtttaattatggccctgactaggccactggcctaagaaagtgaatttagtaagctgaactttgattgtgaaatacaaacaaggcatacttgcaaaatatagatatgctgccatgtgctgaggaccaggggagttcttacaactgccactggccaatcatcaagcacttagatgctgggagccctrctgcccacctggccaaacccctcacttaatcctcaaactgcagtattggtcaatattatcacctcattttatggatgaagcagccgaggcttagcgaatttgcacacacagcctgcctatggaggagttaggattctggttctgcttagcctcagcccaggacaggattttaatgaccaagtcctcctcaggggcttaaaaggggaggaaagtatgcttcctggatttgctgaatattctttcctccttgtgaacagtaacttactcatgccacatacacacatataaactttaatatccccaatttacagttagcatgacccataaaacckgtaggcaacatgaggtggcaaaaactcagtaatagcttacaaagagaatgcaatagmttctagaatgttggtgttatccatacttgatgacatgatgtgatgggggtgagttggygggtaggttcaccaagaagtattatttagaaaaactgtgccaaagaaatctatcatttcacccataactggtattaagtattgcaaaactcatttccataatttctctcaggtagctatgaatcagctttctgccacaggacagatggcagagtctcatgggttaggataaaaccttagcagctactctcttttgtctgccccaccctgattggtagcaactcttagatatatgaaaactyattaccatttaattgtgcccacaccccctgccaagctaaggaggctttggggaaaccagtttgtctgttcagatgagaaattagtcatgcgagctacaattgccacataggtaggagttctgtgtgcttggaaacttcagactcacagacatttccatgggtcgtgcagggtgatgcactccatgctgttgcccctggcaggaaagatgaaaagcatcaatgtgcattttagccagaattgcattttgaaaaacctgctggatttagcttcctcctctctgccctcctgctgcaccacagcttcccttgcacatggcattttctcagcccacatctcattttttgagrcatttwatattcaaaaaaaattgtgtttttagcacaattaaaaaataagcaagtttttagccaccaggatgctgctagaagaggctgggctgtgtatgttgtatctgtatgtcgtatccagctgtaacacactcccagagataccttggtggggagagaggggctatgcatttctctggctgtgctacttctggaaagttcctgagctacatgagccgttgctatctgcttacttaattgctatgactcccattgtaatgatggttaatttattcccactggcaatagaattatgcctgcaatgctcaggaggcagtgtgctgtgctgtgtacttggcatataaacaaggcttcatgtttagggcaatggagtatggagtaaggggactcacaggaaaagttgtggctgagaaagaagtgggggaatgggacatgaggcaggtctggaatgtgtgcactgaaataaagaagcaccccttcctatctatggaagctggccattttgtgtattttctggaaaacatgaaggtattccagagccagcatgaatcttacatcaaaacttctctcwtctgtgactcaggcttccttctgtttgttcaaatagactcaamactgctgaacacaaattttaactgaaactaattattcctttcatgatttttttttaaagctctttataggtctctaaataaaatcactttgtttctatcagtcttgttgatctctttccctctctatgctgttatttttggatttcaaataactcggttgttgaaacctccgatatccctaggggtgaactgaatgaagtgttgcacggcattaaatgtcattgaatgggatattatgaaattcccatcttagccatttaggtcaatatcctgttgtttytctcttacaggtatgggttcatagaagggcaygtggtgattccccggatccaccccaactccatctgtgcagcaaacaacacaggggtgtacatcctcacatmcaacacctcccagtatgacacatattgcttcaatgcttcaggttggtyctcaggggggtgtctgttggygtgaaaggctgtgggagcctggtctttggagctcagcttaagtggggattcatgtagcctccatttacataacaaatgctcactgaatatctgtacagcagagccaacattcctgtctccatggagcttacatgctaaattggggaggcaaacaataaacaaataaatattaaataccattcaggactgtccaatcttttggcttccctagstcacattgggagaagaattgtcttgggccccacataaattacactaaaactaagagtagctgataagctaaaacacaaacaaaaatcacacaaaaaaaatctcataatgttttaagaaagtttacgggtttgtgttggaccacattcaaagtcatcctggaccacacaaggcctgtgagccgcaggttggacaagcttgccctatatgaagtctgaaagtgataaaagtkctataaaaaagaaagcaaaatacgaggctaatgagtgctagggatgcttttattttctgagaaggtggtcagggaaagtgcctcctggactgttctgagaatatcagtgctcagaagggagaatgccaaggaataaagtcagagagctaagcaagggccagctaacggggtgattcattctcagtgtgatgggaagtcattacaggttttgaataagggagtgacatgaatctaatgatagctttggggtgtaagtcaaatgtcttagctgagaggtatttattatatgagagggctggaaaaaagccttggagagtatatggtatgcctttgaccttcttaaatatcccttacccaacagttgaaagaaccagagaagaagaaacctaagttaagatgtagatgctaggacacaggccagcctttctctatgtctttgtgactttctcccaaccattaacctagaaaatcaggcttatgagccttattcaagtcctagcaaaattaaagaattctatgcatcatgaattttcagaattttttgagaaggatcaaaatataaatgtcaaatatctcgatgccaactatcaaaagtcttacctcttaaactgggccttctgttcccatggaaggtttgaakttgggtgaagggaaagatgaagccttgaggtaaacttggtacatcttgctggagtgtcagttttccctaaagatgtgaaggggatgttaaattagctggaaagggacttaagacattatcagcctgagacaaacacagatwtatacatatacatatatatatatttatatatatatttatttatatatatttataaatatttatttatatttatatatttatattcatttatataaatttatatttatatatttatatttatttatataaatttatatataaattatatttwtatatttaaatatatattataaatatataaaaattatatttatatataaatttatatatatatattatatataattctatatataatataatatataatatatattatatattatattatatataaattatatataatatatataaattttatatatataaatattatatattatatataaatttatatttatatatatgtatatatgtatatataaatatatacacatttatatatataaaatcaagatatcacagatatatataccatatacatcaaatataaatatacatataccatatatatggtagtaaaatataaaaagctgcatggatttttaaactataaaaaggacatcaacttaattatgagatctttcttctactcactactaaaaaaaacccaaaaattaaaattaattgtgagattacatcagtggctttagtctacaccacctaccctttgttgtgtgaacagtagggatcagagtggaaattcagagaagaaatctagagtttaggacaaagtatcagggctggctagttgaaatggagtgcgtgaagccagtagattttgacaaaaatttacaggtcactgaatctatcgagagacatacgaaacaggaacagaaaactgtagaatgtttactcctccctgttatatgagtgaagaacacaaatggagtttgactaaagggaagggagtccaattaacactaagtagtacacgactcatacatactcagttcccatacccatgtctagcatgtcgttctaatgatattataatgagaaaaccacatataaaaaagtaagaaatagacatagagcaacatgtggtctagctagctccatctcagtgcaacaggtcagagggagacattgggaaaagcttgtgctttagatgaagaggttgactcattgggaaagggctggcatgaggctatacactcctgagtctctgggcactgcttattgcatctcccattgagtcttgctgagtgaatgtatgcaataaattatgtagttgcatacccacattgtcttacctgttttgcaagttggtttcacttgctaaaaggaacctcaactcagatagaagctcacactgttttattgcctggcatcgaagccatctaggcaggctgcgactgagacttgtttctatccttaattttgttcatgaggttgggcccatacctggagttgggagcaagagcattgattaattttcttctctttggagggttagttcagttgaaaagcttgagaagtacagggggtatgttccttactaaaatggatgaattaaataataaagctagaagtaatatttttccttttgtctattttccaaattgactcgatattgatggctacttttgtaagtttttatttaagtttaaagggaatatttattgatcacctctatgtgctcagtactgcactaggcagagatggagtaagaaagaactggaggctacatttcttgtcttaaaggagttaacaatcttgttgaagcaatgagacaaaaaaaaaaaaaagaaagaaactggagaagaggataaatgtgtttaaggataaataaattctgaatgtcttggattagagtcagatgataggggtattaagtgagctaaagattttgataaactgccctatgcaaagatttcattgcaaggatccctgaatctaatttagcctgaaagctgctagcaggtggtcatgtcccagtgctgtgatcccccccataaaacggctacagggataaaagtcagcttgatcttagtagatagcttccataagcttaagttttagcagtatttttagaaaacatggcctgtggctaacaaatgaaaataaggcagaacttgaaaaggcctttgtgattttttttccctcattttcagtggttgaggcccaacgtgagcctggtgacttctgtgtgaacacagaactgacttgaattgattcatttattaagcttgctttcagtcaagtgcctcattttcttttgagggtagaattaaagggaagattctacatgtacttgtttatccatttcctcctttattcaacaactatttgagaatatttatgagatacctaaaatgtatcaagcattgaagagggtgcctttctatctggcaaccagagattagtggttagactgaataattaatgtttctcttggttattttggtgtgttgaagccaaggtttatgagaaagcccacctcagagaatttctaacaagtcctcagattcaggaacacctcaccaggtctagctttccaagcagtacagagctcattaaatggaaagaaaggctatctaataaggccctggaatccgacatgagagcatgagtctgttaattgcacatttgggtcaatccactaagcatatttgccagatttgatgttctttataaaagttaaggtgaattggagcatgaagggggtccatgtgaacaaatgctctaataatttacaaaactgtcttagggtttgtgacatcatgctccattctattacaacttgctgcctggaaattcccagtgtactgttacttgcagttatatttgaagttaggggagattgtttcatccctggcatcaagaagccataatccaaagcctggttccaggtatgcacaacatacaaatatcagaagcatctcataggttgcgtcagtttctgctgatatttccaagagaaacaagatagatactcccctaaatctcccaggttggctatatgcccttattttcaagtgtaataattttggaaaatatttttgaaaactgtaaaaagctaaattaatattaattattacagtcccccatgaccttgtgagtttatcagaagcagggacagaaacatgctcatcttcttttctccttttatatggtctggcatataagtgttgagtagatgcttaaaaataataaatgaagagttatatctgtaacttcctttaattatttcttatggcattaccatttaaggataatctaaatgcgtgacctgtacatatttggagatgcatttagggggctaacatcttargtgtgtttactggaagaatagacccttgggaaattatatcggtacttttttcttttttcatccattcaacacatttttattgcatgtttctctgtccccatcacacataaatgttctggccaagacagataaagttattactcatctgtggagcttatacatttctagggagggaggcaggtagcagaaggcagagattgagagaagtgccatgaacagccatcaagtaagatgaacaagataagtttatatggtggtaaacatgaagaagaaatgagagcaagatgctatgtgatggtgacaggtgtgggggagtgatgaagcagtttagattggatggtaaggaatggcctcgccaaggaggtgatacttctctttaaagaaatctgagaaatcttttaggacaggctttgcaagaatggtgtttcctaaaactttctgtttttttccaattgaatgtataaaactgccagttagttccactaactgcccaaagaaatgggcaggttaaggttatcctttttatctgtgggaaaagatgctcccaggtactaggaagcaaacaaaacctgttttgttcaacttgtgtttctatccacttttataagtacacaaaaattatagcaggacacttaaaatacttgtgataacagcctttcttgtgatagcagtctgtctgtctgcctgcctgtcttcctccctccctctctccatccatctatccatccatctccatccatccatctccttcttcctctttgccaggagcaattctgggagaaactaacctaacaaataaatttccattttaatttaagtatgcacacacacacagaataaaagctgtaatgcacaaatggacttaacctttctataaaggcaaaaccagtttaaagctctctgaggttttagagctcaatacaaggtatagtcacagaataaagcactttggcatgaatagaaggttgcttcagctacactgcagtctgcttttaagacacaaggaatggaatgcagggtggaagtttcagggcctgttatcagaccgcttgagacagtrctgctcagagggctaccagtaacatctgtggatgatcagtcaggcccaagattcaggcagaaatctttattcctaaagcaagggatgaaagagtagaggataaaacgagaacaagagaaaaaaaaaaccagaaatgcccatgatgagatatgccaaaacagtaaccttgaaaaatattctgggcacctaggccaaaggtggtcaacctcagaagcaacatgctgagaagcagtctatacagagtaagcacytaaaagatcagctaaattaataaatacattattacattaatgaaagactagagattcatttggtttttaatatttcaactgagtaaattctttgttgtgattatgttattttaaccttcagattgtcatgctgttcatgttgataaacatttgattgtgtgtctgccatgttttctcatcatttctgtggacttcccagattataaatgattttctcatgatagttcatactttacttttaaatttttttacaatgttcctgcattacttttgtaatcacaaattttaaaaatcctccctaatgtgtttgcattagagaaggagccgtgtctatcttatttaaaattgtacccccaggcttccacagtgcctgatatagaatgtatatttattaatgaatgaattcactgtggtgggaaaatttccggaaacttcataagttccagaaatttatgaaatcaggtaaaaacggaaaatccatcaggaaaggcagagaaattcctagccaacttaggrgtttcggaaaaagaaagttatttggaataagttatagtaaaactccattctaactgactaataaaaatgagggtagattttcctcatgtttttaaagggttctcatcctttttttcctacctcatagctccacctgaagaagattgtacatcagtcacagacctgcccaatgcctttgatggaccaattaccataagtatgtctctcttctaatcttaattaaattttcctattttggggaaagggctcaggtgtgttctctgtggtatatttgaatagaatattaggccaggtgtggtggctcactcctgtaatcccagcactttgggaggctgaggtgggtggatcacttgaggtcagaagtttgagaccagcctgaacaatatggcgaaaccttatctctactaaaaatacaaaaaattagctgggcatagtggcaggtgcctgtaatcccagctgctcaggaggctgaggcaggagaattgcttgaacccaggaggcagaggttgtaatgagctgagatcgtgccactgcactccagcctgggcaacagagtgagactccatttccaaaaaaaaagaaaaaaaaatattagtcatttccctaagactaagtaaggacagttggctttaattcagtgtcccttcctttttttctgcaatgacttgaaactgctctctggtttacactcatgcatcgttcctcaaacttcagtcatttgaaaaccactttcacattttttttggcatctctatatgtacaatgctctcatttacttgatatttttatttaaatgatccactgttttctaattaaaatacacttatttttaaaaagaaattgcacatggaaaaccaacatcacatcgtaaatagaaggcaaccttaataataaacttaaatgtaagaaaaattaaataatgttcttaatttgcagctgctgaaagctctgggtctgagtcatgttctctcttataaagagggattaataagtgtcaggtgtaggggcattttggccctaattagcaattttctgtttgatataactgaagtattgaaagataatcatgaaggatataaacttcctgatacgtgttttgacattgtttataccacatccatcttaaatcatcctgatatatgattatccacagatgtatatattcgggcactttttaaaaatagacatgggggtctcactatgttgtccaggctggtcttgaactcctgggctcaagcaatcctccttcctcagcctcccaaagtgccaggattacaggcatgagccaccatgcctggcctattccagcactttagaaatcagaaaatctcaaccagaactttcaaataggctaactgctaaccctgatcttacggcctctgagcttcatttaatgggaaacagtacagtgttgagaggtctgatttctgcttcctcacagctggatactgacagtgtgcacaggcatgatgttggcagtggcagagggatgagaatcttcgtagaccatacaaacccagccccacattgttatgtaaggaattgtccctgacctgtgccttgcaataggaaggggaggcttcacaccatgatggctacgacatgagatgtgctgtctcagcaggcctggtatgaaatcctagttccctcaccatgtgtgagattttagaggagtgactgatcctcagttttctcattcatataatggaacaacctatgagaatattcaggaaatttgtaaaagacactatgtctaatgtatgtccagcccatagtagaggtttaataaatgccctgtttctttgatgcccacagttctcttttgaagtccagacatgtaagagtgtggtcaacaatatttccttgtcaaatcctcacctgcagagattaccagggtgactgagaccttgattttttttttcatttatgtattattaatagttccacttgaggcttgccacagtggctcactcctgtaatctcagcactttgggaggctgaggcaggcagatcacctgaggtcaggagttcaagaccagcctggccaacacggtaaaaccccgtgtcaactaaaaatacaaaaattagctgggtgtggtggcatgcacctgtagtcccagctgcttgggaggctgaggcaggagagttgcttgaacccaggaggcggaggctgctgcacactgagattgcaccactgcaccccagcctgggcaacagagtgagactccatctcgaaaaaaaaaaaaagtttcatttgagcaagctaaatatgtggccaaaaagaacctttagtcccatcaatgcaatacagcagaaaataatttcatctaaatgcacacctgcatagtgagtggcccagacttgagagcagcaaatacttctagggaggaataatgaatgaatgcattcaggctttttcttctccaattcattctagtcatttgttgaaaccacagatgttgatcttcatgtatatctgtgcttgttaatttccaggttgaatttcacagagaacggcaaatgctcttctgtatttagacctgctgrtttcctagccagaagtgggtgtttgcacaagtggacaaaacttgccccttaaaaaagaaaatcaaaakcttcatcattttgcagatgtatcttccctgctgaggctattagtctgctacttcaaatccttttcggaggaatatatggaattaatagcaacacattttatatgtacttcagaagggagagtagggaaacaagtgggagaatgattatttattgagcatccactgtattttgaatactgtgctgagcactttacttacaatgtatcacataatccccattttacaaatgaggaaactgaagctcagagttgccttgtccagagctctatgaagctaggattcaaacacagggatgggactctccagtacttccttgtttcctgcctcatccccagggtgtgtgggggatgggagggtgcactttcttagtgcatctgccactctctcccaccactggatagataggtgtttctcattacaaaggaaaatagctttgaagtcactatgttaaacgctaatccacatactcaaaatatgagctgtgaagttctgtaagtaccttttctctctcccagctattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtaaggagaataaatcactgtgcttcccaatagcaattccctggcaaaatgtctctgaccttcctgagcattgcacactcacgtgctgattttctcgtctctagacagctggaagctggtgatgccattcagggaggtgggctcttgtggttgtcartaaactgcctgcattgactactactgcctaccttttttcctcatctataactgtttttcttaccttagcataagaagtgccatattggaagttttattttggggagagccctccttattctcttatccccaggtatacagtaacaattcaagcctgatatgaaaactgttttcattttttcatgtttccttcttgttcttatccacctatggataagattgttttcataaagttgggatcatagagtttgcataccactccactagcaccttttaaaaaacccacttatgcctgaggttgcaattttttgaatttttgcaatcagaccttggtgatgacaatgagcagtaggatataaataactcccacatgcttagctttccaataatggaacagtaggcatacgtgggtcaactgtggctttttatgttttaacttgatttacattcatactattgatagtgtaatattcagtgattttcaccaacgataatttactcaacaattcctttgtttttrgtccaaggaagcatatctggaagagttttctggtgaaattaaatcagcttaagagctctataatccagcctgttggggaatgttctcaatacttacttggtgtgtgggggtaattcattacttagggttgcaagagtggaagtatgtaaacattgcgttccattcctttggagtttgcccctcgcgcttcagctccactggaaagtgtttacatctctcttgtctcctgtttccctctttgcttttcttctatggtttgttttgaaatgggctcccagatgggccatgttcctcctgtggaggattaatcaaactcaaatagggcatctgcctctggagcggttttcctagtatggtgtggatgttctcttttcctggctatagctcctgaggggtgaaacttgggcctccaaagagtgtggcagaaatgcgctggcttgtgaatactcaagacagggcccttctctattccttgtcacccagaagccagggaaacccccacagtactgtgatttcatttaaggtcacttgcgcaatagtgttttaaatttctgtcagtctctggctgagggcatgatacaaataggcttggggttcccatcactccctgcacattctttgaagctttttaaaaagcagagttttcaagctgcccatactttcttgggttattggccctcttgagtttgcatcggcttattgttggtagtcccgtgggcaacccttcttgagagaggcttctgcaaaccaagcrggccgtgctgctagctactcactgcttcttgggttccctgtctttttaaagtaaccatgtcgaaggtgcttatcattatggtakgcaattttgtcggatgttagcgaacacaataattagtggtctcagcaggaaggagaataggtctaccctaaagtaccacttcccaccaaagaagaaaatcctgataaaacataacttgggactatatgtagttaacattcaaaccactaatagcctatataaaatagtatttcatgtgtgttttaaaaacacacatttcattaacccctatagaatatctcttaagaactgtatcttcccttcctaagttartcagcaaacgtattttgagaacctactacgtaccaggcctattagaatgcttgggatcgaaggataaacatagttaggaagtaatattgaagagaggcaaggattactgagatatttattcattcaatcaatatctgaggtcttctgtatgccagacactgctctaggatgctaggaattcagagttggacttaccttcatggagactacatattattggtttagaaatcagggaaaaggagtgtttatgagatttaactaaaacatagttcaggatttgagctgagaaatgaattgtgcctttctcctcccagataaattagttaagtttccttcagcagctaaaaaagaaagagactaatgagtctaccaaatgagtccagggctaacctgagagtcactgaagtactataggacccaatgggaccagtagcagctccaagtggatcacttcatgcaaagaaacataccaaggcaaacaacctggtggaaacttgaacgtagcataatggcatgccaggaaaagtcagcactgttaggttcctgagtagaatcgtatttctaaagtccagtgaggagatttgcaaaaccttatcactgttggactgagagctgggacagagtgacagggagtgattgcaaagcctccctcatgcattgcaggagggcaggggtcaagaggagtgctggctgagagcacagaagaagcggtctttggctcggctggctcattccttcctgaagggcctgtagtgggtggcaatagggacagctagtaagaataaccatctgggtagctttaggcttccagcaggctgtttatcttgagtgtcatcagcctcttcctattggtgacctggaactctctgggatcaagaaacctaaactaattcaggaagcagactcctgccttggaacactgtatttccttgtcttctgggtgtcaaaggaattctttcttttttttttttttttttttcagatctggtatggcctatttgggtggggaaaattagaaattctgctggctaggcagtagctttttccatttttccccctcataccactcctttcaggaagacaaaaataacgcctatttctatcttgttcttgtaggtttgtttcctctggtactattttttcctgttgtactattgggtgagggtggtgggaattatgcatctttaataaagtttctgaggtgagaatgtggtgtctgtggattttcccggggatgctcaggtttgtctggaggcttcatgggtaaaattggctcctatttctctactctctgttctgaactaatgtgtcctttgcagcaggggtgtccagtcttttggcttccctgggccacattggaagaagaattgtcctgggccacacataaaatacactaacactagccatagctgatgggataacaacaacaaaaaaagcttataatgttttaagaaagtttatgaatttttgttgggccacattcaaagccatcctgcatcacaggtggcccacaggctacgggttggacaagcttgatttagaggacagaacatactgtgccagctgttggcattttatatagatagagtcaaagtttttaacctagggttcatggaccttcagtaggttcaatggtagaccataaggcattctagaactatctgaaataatatgcaaaattttgagtgtgtatatgtagcatcacttttttgaggaaggaggacataacgtagattttcaaagggatatataatttaaagtggctttttaaaatctcagctggcttaaattagatatttatcctgatggtttttgccattccatttcaataagaaaacatgctggactcaagtcaaacttgagagtcgaatgagagattttaaattgcaaaatgttactgatgatattttctctaatttgagaaaagtctggaatttctctaactttggcaactctagtttttggtagaaacacatattgaattagaataaaaagtgacagaaatgatagatggatacctgaggaagttttatctgatttcgacactttgaacacattttctttgcaaagttcctgctcaagtatgaagtttgacctgaggctgatgcgtgtgggcggagctttgaaatgccagttgtcatcacaaactacctgggtacaatgctagacagatgtgaaaaatacacactagcaacccaaagataatccaaagataaatgcatgaaagcagtcgtttgaaatgctgcttcgaaaacctccagctcatggctcagtcgcccaatcaagtaaatagaaaatctctttccttcacaggttattaaattgctgcttgattttgctttgatcakgaattcaggggattcagtttgaagaatgagtagcatgaaatttatacccatgaggaatttgcatttctgatgttgtcctaagattgtgggagacattaggagtctggaaagataaaaccaggcctagattttcttttctaattatcattcaataatagatacagacatcatatataggcagaactgaaagtaaagatttgtagagggaatatcactaagtgatactttcataattgatccagttacttcaactgtgcactcaaacagccacgcaacagctcaggagcaaaataactagatatggtcctggtttggtaattcacagcctaagactcaggatctcacaacaacagcaacgacaggtaaactgctttgtcttttgcttatcagctctcctggatgtcagaccttttagtgttaggggagaggacgtccattatcacgtcaaatctccttcatcattcttagtgagaatagggtcttgtaccacttcatatatcagaaaggcctgtggatctggggatatgattgatattcttaaatgtcctgtatgttttccttttggcaatgtgtatatagaatcagaatgatttttccatcagaggaaggaaaaactatgaatcaatagttttgaatgaatgaatgaaattatgaaaaactacaaatgaatgaattgactgtgtgattcaatgagaaaatgtcctttagaaagaagtctgccggaaagtgcasgcttctcctttctgctgatctgattctcacagccagtaataagagaaggaaatgcagatttctctcatcaaagtgtaggccctgaacccttctttggacacttaaaatctcaactgtaaagtgtaggaaatgacctgttgctccatatcagaatctaggcctctaaccagctccctgggtgtgtggctcttagctctatatccctgcaaagtgtattgttacaggagctttggggaaaaacgattcaaggcctgtaaatatgggagattacaaggacaccctcatttattaactttcattgatggagttaatggccatatttcaaaataactaggcattctttctgcagagggggrtaataaacatggaaaaattattctttacatttgtttgccttatatgacattggataaattatattctttacttctataaataatcgtgaggaaaatagtgctcatgttatgttatggttgycatatcacaatgtctaagatcatgcaggggtggggaggggggatacagagattgcagaataaagacaatgctatttttaaatgttgacaatgtttatcttcataggacaaagaatgtgaaggaaaaggtctttttggcagtgtttcatcttcttggttcatttttgggctttcttgatagctgaaaaaaaaatctaactcaccttactattttgtttgggsatgatggtttcagcctctctgcttgaacttgttctcagttttttgtctactgttagctcatattcttccaatgcacatttttgggcattattggttatagaaatggcagtctttggagatttttaaatcaagactcttgcttctggtcttattagcaagatcattggggtcacttcatctctgtctgtctttcctgattgattatcctattttcaaagaatgagactcaaaatgtcctgttctgctttgcaaaatakagtttcacataagaaattaccttgggcaaggttgtgagaggatttggaatctaaatggagaaaagtgtagaggcatatttttcaatcttctacttctatgtcattttycctgtgtgttggattgctaagattatgtatctattgctggcagaaatatcatatcctaaattcttggagaatgatattggttgcccaagattgtatagaagattaaggagctaggacyctgaagagctgggttttagaatcataaactctcaggtttggaaaggatgttaaatggtctggttcaatcaacacttctaataatttaatctcttacacaactttcytgccaagtgatcttcctgactatgggaaacataatactttatgaagaagttcattgttggatagttcagattattggttttttaaatccaacatttggaagaacattcctcttcctgaaattttcaccacagatcctaatttggcctcatggatccagaggcaaaaaagtttaatccctcttttacattatatagactttcaaaattcaaagacggctgtcatgcgttcctggagccctcactcttgctaattaggcttctgacttcagacaggtcagaagctctgtccagcaaaatttttaaatctttaatataaggagcatgaaccagatgacatttaagatccttccctctctgacattctataaacttcagtttgagtctctgaaaaaaatggaacttttttgctttttccctttcttttcaccatctatatcaaatatagatgattctcttgagtagtaaaagagtacaagcatattcaatgctatttcttaggaaccgttaattaatctttcaacaatcaattcaatcatgattacaacagctttgatgagcactagtgctacagcaactgagacagcaaccaagaggcaagaaacctgggattggttytcatggttgtttctaccatcagagtcaaagaatcatcttcacacaacaacacaaatggctggtaatgagttattattatctcatagcgtatgttttcttgacagccttgaataattttgattgacctctgggatgttattaaagcctaacgttccttctattctcacaaattttcgttatgacttcagaaggatcattaactctggtatctgtttgtttgcttgtatggcaccaataagcagatttcttctttctaatctatggattagtatagaccaggagaaggctaatacagagactatgaaacgggaataagtttttttaacgatatggcaaaattgtgactctgaaagatcattcatgtatattctaaaattaccacagtcataaaaagtcttggactttcatgaggaaatagcatagctagatatgaaaaaatatagaaaatcttcatcaatggaactattcttggggtagacactaatcatatgaaaagacaaatgctcattccctaagatagcctgaatctcatttaaaatgtagaaaacccctttttagtaaagagacatcttctacagtaaccactgagaagaagtggaagtttttcatctcctttttttattcaaaaagaaaaagaatttctcaatttctgaaccacagttcactttagttaacccctttgattgcctaataatgccaaaaatgatttctctgttaattggcttcacatttttgctctatgctgaagtagtattgggaactgcagtgtagcttccatctctgtttggaggtacactgatctgatctgatactagagaagataaaaaatgaattagcaaattgtgaacacaatgaaatgactgacgtaggtgtagattccaacatttttctgaaggtgtcttgaccaaaaaaaaaaaaaaaaaaggcacgtgtgaaacctttccattctgttcttgatggcttggctttaatggcatatggttaatgagttaataataaacatatctgaaagtgtgggggagttttcattagcctttaaaaacttatatggtgagattatgtccacacttattctttcagctttcttaaagagaatattcagttttaaagatcatagccacttgttttgagatttatgtattagcttcggagatcagaacataagaatttggggtatgcaagtcaactccctcactttcttttaaaaatcctgggaaatccattataccttctgtgcctgattttcttcctttgcaagtgggttgcttgscgtccagctcagccactaatgcaagtcaccacaacaggtacgtcttcaaataccatctcagcaggctgggagccaaatgaagaaaatgaagatgaaagagacagacacctcagtttttctggatcaggcattgatgatgatgaagattttatctccagcaccagtaagaataatcaattacagtacagccatttatgcaaggcttattgattaatctgagtgataccaaattgtatctctcttgagaagtagttaatgtgaaaaatgggtgaacctatgatcataccttagttatatcttgatgagattayrgaagaagaaatagaatgttttgagaagtggggaaaatrtctcacaaaatttctcttgtctcatgttcttcctgttttatttatctatgggatctactgctacagattgtctttgaatgatcaggctttatcagagaatgacattaaaacagtacaaaaaatgtacattgtgtacttactgtgctaggtgctggaaacacgaagatgaaaagagccagagcctttgcttttcagaagctcatggtctgttggagcaatagacttgaagaatgtgatgaggagggtattaattaaaagttgtaggccaggcgtggtggctcacacctgtaatcccagcaccctgggaggccgaggcgggcagatsacgaggtcaggagatcgagaccatcctggctaacacagtgaaaccccatctctactaaaaaatacaaaaaattaaccaggcgtagtggcgggtgcctgtagtcctagctattcgggaggctgaggcaggagaatggtgtgaacccaggaggagatcgcgccactgyactccagcactctaacctgggtgacagagccagactccatctcaaaaaaaaaaaaaaaaagttgtggaagttcctaaattgaaggccctaaaggcttaaatgatgggagctagaactcaagaattatcttagttaatcaaagcccagctgaggtcaaaggaacaaatccagagttttaacaaatgagctggacaccaatatagcagaaagaccttgaagggaagggcaaatgtcaggttagctttagcaagacattgccacttattaaaagcaaataatgaaaccactattggtacataatagtatccaaatttttgacaattataaaactttttgagaacaaagagatggaaattgagctttaaagatatccttaaaaagttaaaaacatgcaaaggttggtctaatattctgccagattactgagttttccacacatacctgtaatgacttaagattttgctgaacagagctgagaatcctgaacctgactccatcacagttctgcttttccttagaaaaaaggcttttggggtgctgtgtgagctctcccaattcactgaagttctatccattccattaaaatctgagaatttcatcctcaaatggacagagaagaaagggtccagaaaaaaaaatagcttaggccttgaaggcatctgagtatataacattgatatgacaaatactcaaaaggaactagaattttctatctaaacttttaagtgattttttttttagacccgacacccctccagagcttaatctatggaataagaaaattccttttggtaacttcagaacaaaaaccaaataatcaaaaacactggagttttacattatactgtctcctgtgttcagcatgtggcccagctttgcagatgggcccatcagtaaatacgtggtcttgatactgaagaaattaaattcccttgggtggtaacccaaacagatctacctgtaaatgaattgtatggtcaggcttcagggaaaaatttcccatggtgttggttttttttttttttttttttttttttaatttkttaaatctctatggcatatttttccaatttctgcttttctttttttttcttttctgcttagcacctatggacataattcaacatgatgccctctttcttctggaggggtgtgataactgcttgataataagcactttttcaggcctattgaraatgtggttaatgattctaaacttgatttttcataacttgtaaaatagagctgacagtattatagttctgaaaacagttttgcgttatttgggtatcaaaataaagtttgaaacaattaggatggatttgcaaataacctttcacaaaacatgttgactcagattttgtcatgatccttctgttaggtgcatctcwtattccagccctaacagattgggtgacaatatcagggtgctggtggaygtacgcctctttctttccagtgtgctgctatgatggtggctggttacctgtggtgtcttattttctttcactggctatgaatggcttgctcatgacatattttgtatttgatgagaataccatagtgtttgataaatattcagaaatgtatcgctaaaacatatggctattckaggtattctttttcagaatcatctataggaaagctctagctgctcaggcattcctttccccactgaaattactaacaacataaagtgattatcatggtataactttcagttatctgcctcttcacccggaggatctacaaacagcacacagtgactaagtccctgggctttcaagtgcagagggatactacagactgcatggatgggcaaaatggcgcctttggttatcctcggtggagggctggtgttttcaaagctgtccttcctactgctgcagcttctttgactgttttatctggaagatctcatgttctgaaccccaaggtattctatgacagaatgcaaaggacactgagatgcttaccaatatggctgaattaagctgaagtcaccctccgctttccctccatttccatgcagccatctatacaacctggtatagatgattcattgcatagcctacagaagcaagactatgtgcgggacaagtggcgaaggctcaagaaataacatttttctaattgcttcaatcatcgttatcacagtttcaaccacaccacgggcttttgaccacacaaaacagaaccaggactggacycagtggaacccaagccattcaaatccggaagtgctacttcagacaaccacaaggatgactggtaatgggttctgcatatttaatgaaagatttttttcccctcaaagcccatgatgctgcaaaggtcaatcatcgaggcacagtgggaaatttagttaatatctgatcaagaaattcttagtggacttttatgaggatacttaattccatttaggagtcatttatcaattataccatgtgggcacaggattttttatgttgcttcatgataaaaatgaatatgtttgaatggtttgtggttctgcctttgacaaactgatcatagtggaataataagggaacatgaagaaattccaagcccattgattttctcttgagaccaattaggtaaagtcactcaaaatttttgagagtggatgctcagaggtaacactttggcatagaattgttaaatagcatgcactttaatggaagaayagaatcattaaagattggttgataacaagtcacagtgtatttaaccatcatcacagcagatgtagacagaaatggcaccactgcttatgaaggaaactggaacccagaagcacaccctcccctcattcaccatgagcatcatgargaagaagagaccccacattctacaagcacaagtaagcaagatggcggtcggcagttctgggttagatgaattagtaaagacattccagcaatagggaagattttgtttagaaattggccgcatcttctatttccactcggtaatttcttttattcttagagcctgaaaagctgctaaacccgcacacaaattttaaaaattggaaggaaaatgataactcatcaggttgcccaaaggccaaaatgttttaagaagtagatctagatacaatttttgtgttaaaggttcctagaggttccatttgggtaacttgtgtgtgttcattgaaatgtgtggcaaagagtgtgttcttttggtgcttagtagtggaatctggaaagaaagtttgtcaagtgaattgatctttggaatccttattttctatgaagatctttgatgaatacagtgtcttttttgyattctgtccctgactgttctatagaaagacrtcccttgtactctttagagcaaagttggtagctcttatggtcttcatttgaattctaccactgcttctttttctgtttttaagcccatggtaacttggggaaggctttgatgctcttactgttatttctactattatgaaaactcaggttttcyaaaacaatctcaagttgcggcagtggactgtgagaatagggggccccctcactccccaaacataagaagtatrtgcttttcttcttttatctatcccgctgagatatgtctatcttatttggaataaaagtatttattttggaaaacagctttttagcatttttaaaatgatgacccaactgtcattctcacagccctagatacacctaatggggaaatgtgagccacttaaaagccacttaaaaaccaaagggctttgggaatctatggcttgaggggtgccttcagataacaaaagaaaagtttcaggtatcagttaggatagaggttagacattgtactgaatatatccagcagatcttacatcccattacaaaccccagtaggtgtgttgtatacatacggcttaggggttaagttaacaaagaagtctgataagaaaaggaaatacagaggaagcataaatctctttggaataggattttgttccactcccttagagccctaacagtataccttagaaattattttagacagtttgtacttaaagaccagaaagctactttagagacttggaaataatgagcctattgtcaaaaggtggtgcttgcggggcattaggactagagggttggtgaaaattcagacagaatgtaacttgacaaagagaagacagcaacaactgtaacaattatcttatgaatatttgcgaaactcaaagggatctgattggtgacctctgggctttatcaaattaacatcacaacttctagaagaaagtcaaccttcatcttttacaatagaaatcatatgttttgctaacccattcctatttaggctgaaaacaattaagagttatgggtacttaaaaaaatcattatgtttataaaattagtgatagaaggagcatagtgttctatacagtcacacacatacacttccttatttcttttatttaaactttgagtaacatagcagtctatgtttgggtcagttttcccttttttgtaattacattcagtggtttttgtaacttcattatttattgggaattagtgatttagtcagtgggagttttgtaaaacttaagattttggcttttttccccmtcctcctggataaccagttaacccaataatggcttggccgatggaagggtaaaatgaggacagttatattttttaaatgtcattactgtcaccaaatcacacatatcattttctaagataaggaaatacaaccatttttacaagttgcaaaaaagtactctggcttggcaagtttatagactctcattttcttgataaactaaaaaaaaaaaagaaattgctacaagctgctatagacaaaaatgttggtgtctttctgacttttcctgaagacaccttgatggaattatattctcttgattttgtcctttttaaaatgatggttgaaattttaagcctgtcacacactattatttatataatgcctcaaactggcttggatagttttcgtcaactgaattaattttgttaaaaagtgattttagcaattttaggtgccatgtggacatcaccaaatactgtgttagtggaatagcatccaagccatcccaccatctttcctgctgggcaaatccactgctggtgcatttccagtgtgtgcgattatgggttacatgaccaccatttgagaaggtctcctaatgtgctgatcttgttattagctgttatacagtgttttcctttcgtcaaaatgactggagcaaagaggttattctttgaatggttttctcagacagggtatgtgaagccattcactacagtaaaataaaaataataataactcatagaactatgagaattcatcagctatggtctgcttagtcctatgattttgaacaaatcaaaacttctttggaccacaattttcctagctgaaaaattaaacatttggatcatttgatttctcatatcccttttagaatatcagtggcctgtttccttggtgcctttcttttctaccttccctccccatgtgtatmtgcccttaaagtagaaagatatgttgacagctattggtgaggaaaatagacaattatgtctcccaactgatattcttctcacagtccaggcaactcctagtagtacaayggaagaaacagctacccagaaggaacagtggtttggcaacagatggcatgagggatatcgccaaacmcccaragaagactcccattcgacaacagggacagctggtaatggatrgtttaacaagtaaatttggatggaaacttccttttgggttaaacggtagacattgaggacattgaacaaaaggacactggaggaattgtcacgagatgttaggttacttaataaattatgctgcagttcacacagagccaaaccttaaaggctcataacaagtcacctgaacaggaatggatacaagccagttatgaataagaacaggaaacacagagaaaatgcccttgaacatgtctctttcacatcgagttttgggcatcatctagtgagattgtagcagaggccctgataaaatatcgctgtctgttgtataaaggaatctactctataatgtgggtccagactttacaatatgattctgcaaagtctggctgtgagaaagcattttgtcagaactccagtgtttgaagaaatagagccagacattatgtgaaaagtgacacctgtctgatgtcatttggccttttggccatgcctgttcagtaatttgtttttgagtataaaaaaggtatcttctctattcttgaattgtgagattgtggaaattggaatccagtcttatcatcatctctaagtgataccagataacttggctttgcaagctcccatgcaggattcttttgtctgtgtgacataagtattaaaatgtgtcctgccttataaagaatgtgaattccatattctcacttggtatcagtgagaaatattcccatatttctatttgcaacatagaagataatgcatcatgtccttctggggcatggcaagttctaaatgaattcctggcagagcaatggattctgtgattgtctatgtggtgtagttgttgctaagaggatgctattgtaatcttttctacctatacttcttcattggctcagaatgaagcaaggcatgtgctgctttcttatatgtcatttatgccataaatcccattgttagaaggtaatgcttctaacggattccattcatgcttttgagataaatggcattgactttcwtattgatcacatggaaagctgttacctgattcctttcctgagatcacttccagcctaatgtgcatttggctggaatatggttgtctcagaataacatcatgcactcgggcttttatacttctgcctttaggggactgtggcagcatggcatgggtcaagaagtacttctccttcatcttcctttgatgtcggtaactcatcctttctgcactgcgggagttgttaatgcttttgkgtcctccagttcacatgctgattgctaagaagaaaatgagcatgagtgaacccaaagctgctgaaacattctgcgtttatgcaacttccttgscctctatacaaggaagatggtttcattgtcttgtctagagaataaagtcttttttaaaaataaaatcggtgtatccctgaccaagcgtccattaacactttgacaattgctcaaactgcatggtcacagcagcctcagctcatamcagccatccaatgcaaggaaggacaacaccaagcccagaggacagttcctggactgatttcttcaacccaatctcacaccccatgggacgaggtcatcaagcaggaagaaggatgggtaatagcctctgagatttttatatattatgttttttgaaatccactgagtgactgctgactatttttctagaaatatgcccttggttttagaccaaactactttcctgaaggacctgaggttcttcaaaaattagttttcttggtaggagtgatactcatattcacctgaatatgaagttctgagctgaaagtaaggaatttagcaggagggttggcaaaagaaaaaacttattgtcaaaatatatctgtgtgaggcagtaagtaatagatatgaaatgaatgttgccaacaataaacgctaaagaaattctgagaacccctccctgcccaccacagcatcacagaaaggtgaattggacttggtttatgaaaaataaaaaaaccctggatagtcagagaaaggaagtgggtggtgggggttggdggggggggcagttttcctaagaaggagactcctgtaaggagaaacgtgaaggaagaaaagccaaggaatgaatatgtcagtgagtggatccatttttcacaagggaagatgtgtttgaatggctaggcaggggccattatgttgagtgactgaagtaccacaggcagacccagcacacatgagtttgcacatggcagctggagctctgaggacacccatgggggaaaaccaagccaggcaaagatcttcagaatcaatattaattctatgtactgatgaagagaaagagattccattaaattaatgaacatgtcaaggacaatacaattggcttcaactacacaatggtatgatgactcttgaaggactctacttataagagggaagatgaacaagagtctagagcccatcatcaagtgggactttttctgggagaatgtccatttgtggttttgattcaggttagcacttgctcttgtttgaaatctgggataacagggtcaccacatttttgtcctacaaagatctttaatattttagtgttgaatatttagtgttgaatcttgaatatttagtgttgaaaggctgcagtgcagacctgggtacccagtattctggtgcttcactgggactgattaaatctcccccagaggcagtgatgtggatagactttgactgaattgacagccagaaatatcgatggggtttatgaattgtttggcctctgtttcactcaagacttcttatttcagcagagtagatctgtgataactgttaaaaacaacatttacaagtatttcagtgaaatttctgcactactcaacattgtacatgttaaattttaaagaccgcttatacttgggtttttgggaagaataattcaatgacgtccactgcttcttatttcttgcccctgtatactttctgtaactccacctaggtggtcttggatgacgattctgtttatttgcatattcactttgtgaagaaaaaaagactaaaggggggaagagggctatttttaaaagtccctttggttggtaagggggaggggataaaatggtgcctgagccagcacactttgtcttttctccatgtgtcagattgcatgtttctataaaaaaggcaatgtttctgtctctctgcaagatttgggtgttccatcatgcactcatgtggagtccttccagactcagcaaaaacaaacacacagcatagctttcatataactcggcccttcaaggaaagccagttacttgttgtggtgctctttgatgaaacaataatctatctcagttcgggagatatagtcagtatgtgctttctttcctcttggccagatgtgaatatttaaaaaaatcagctgtagaccataagccaccttcaggtagtggtttgggaaatcaagcaataacactaatattgattccttcagatatggactccagtcatagtayaacgcttcagcctactgcaaatccaaacacaggtttggtggaasatttggacaggacaggacctctttcaatgacaacgcgtaagaataacgatgctcagccactttattgacttgtattcctgcttcatctcttactcgctattggccaagatgcagagctttggtggtggaatggtgctaygtggcttacttcagcccagagtgtgaaactgtcttcattgtctgtatttcttgtggaggtctctcaacctgattttcccttcatttctttgtgccttccagatttaatgactttgtgttttaagaaaaagtaggactctattcaactccattttcattctctaagtagttatgtcagtgaaacacatgcccacttccaggatagtgatttctctatgttttaactgaccatttcctttcaatgtccatctttcctccagccagtgcagaagaggggtaggattgcttgcatggttgtaaaaagacatttttggggccagataatcctagagatcacatcagttctcagaggagaggcaaggcatgttattgacaatcaacaaaggtggcgggatccctggaacaacaacaacaacaaaacattgctagtatctctttctatcactaagaaatgttcaaattctagtarccttaatttctactctatgwgcagggatgtcctagagatcagcctaaagtcgttcataatttctttgaggaatacaaaagaaatctagaattaagaaggtcccattttactgcttgccacacataatgggcagagtccttcatatgagccctttaggcaaaggaaaaaaatcagcaagcatgtattgatggtcagcaatgtaaatagcacagcgttaagcatcaaaggagatgcaaataagcctatgaatggtccttgccaaagaaggacttatatttccrttttatgtcactgttggcttttgttctgacattgggtttgggatttagtgactgtctttctcctggttgtaatatttattcggtggtgggcatggcttatgggtgtgctttatgaagtttttgcacctgcaactcargtcagtacctttcttaaaagaacacaaaagaaataaacttgaaacagtccaagtgattttagatatgggcaatgggtcaacctccagttgatatatgtcactgagggccctgtgtttgcccaggcaagcgtttccttggtgcagtgatgaaaatcccaatgcacaggtgaaattaaraaataacttaataatggagtaaaatggtaactttaatttaatgaccttyacaaggtagctaagtatttccttgtataaatttgatctgtgttacttgagtaggctattctagataggcttctttttcttttgtggttacaactagactacaggctatcatagtgttcattttccctgccgtcacatttcttgacacacagttaggtgcttttggttactgatargagcattgggattcaaatattcttttttccatgtctctgtgttctctggttttctggagtgactgggagcaatgctgcaattgagcctggacaatccaggataggcaaagttttggctcagtcttcaccttgccactttacctttgatgattatactgagaaataaagggtcttcagaaccaaataggggcaaaatagaattcttctgtatatttctatcaatcagaggagaattgtgtgcacaaaccttggtcttcctatgcacctatccatctgactctactctagctagattttccttgctagcagataacaggatttgtaccgtagcttcaaattaacactggattcattcctcattgaaacagagcagagtaattctcagagcttctctacatcacatgaaggcttggaagaagataaagaccatccaacaacttctactctgacatcaagcagtaaggattataaaacctagttggcytcagctattgataagaatcaatcaattatgggtacttttgcagtgtctttggtggaggtgcatccattagctgccgttacactgttacttttaatcaaaaggtgcgtctggtggtggttctctgatttttctgttttatatacctcttcgtacattaagtgcaaactacatttcttcatcttaaaagttgggtttctttcactctagagttagtgatttgttttaacaataatggattgcttatatatgatttattttatttatttatttttgttaacttgagatctttctaacttttttatgtgggcgtttaaatttagtgctataaatttccctcttactactgccttagctgtgtcccagagattctgatatgttgtatctttgttcttattagtttcaaagaacttcttgatttctgcattaatttcattatttacccagaagtcattcaggagcaggttatttaatttccatgtaattgtatggttttgagtgagtttcttagtcttgatttcaaatttgattgcgctgtggtccaatagactgtttgctatgatttcagttcttttgcagtgtgatttataattggcgtaaatgtctgattatatcactttacattcctcacaataatattgttttgccttttgtcctctggacctccatggtgctgatgactaaaaagcagtcccttctggaaaagaaaagaataattaaattagtagcctcaggcctttgaaaccatgcatttgctattttaattgcaggcagcaaaattttatctttcaatccaatgatatgtttcctccactacatcaaagatgaatccaattgagaaagaactcaagattatctagtacctcagctgacttcaagatcacagttgtagtgacatagccttacctaataacccaagcagatgttgcaacaaatgccaattctgggtattaagatcaccaaaatctcttctgttgagtgatgtccaagtagtgtctattgcaaaatatttattctgttcaatagtatgacaaacttcactctatttctccctatttatggataacaagtggaaagcttttgcagcaattgtgtgttctggagacaagcacatggtgggtggtgatcttacaaatacgrgttcatcactgattccacctccacacagataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggtaatttggcatttattatctagtttgctttctctatatagagaaacaatatatagtttcatattacagaggacattttctgtgtagtctgggattggactagtttgtgatatggaaatatctttcattattggttatcaattctagtgcaaataaacttgggtatattttagataaaagaatgcttccttttgccagtgttttttccatttgtctgtgtttgcatgtgtgtgtgtgtgtgtgtgtgtgtgtgtgttgtgtgtacaagttggctgttatgatggaattgctttctttgtcttatcttgtgatatatgaagttgaaccacatgaaactgatatttttgcaggtgaaagtagtcgaattttagcaattccgtttaattcgactaatatactctacttattttgtaaggttttatcctacaggtgaataatttctatatactagtatctttgctctgaaattattatcttgttttggtaatagattgatcagttttacttttggtgatggataaacctcttctagttctgatgcacacttaaaatgttcatgatttaatctagtattaatgaatagggaccacttctcttattgtaatagtgaagagaggaacgaagataatttattcaatgaagtttgacacggacctagaataagtctttttttttctcaaataagtagtcatctctgcttctgcttttctttgcttctccatttgtattaagaaattaacagtgaagaaaggggaaatggaaaacgcccactgtagtgaagaaataaaaaacagattctgtcttcctagtactagtttttcaattgctttgtaacacaatcactaggcatattcaagattagagactttagatacataattttggagcagagatcttctctcctccccccaaaaaagaaaaagaagaattcatatgtgtgcatatatatataatttttttttttgagacggagtttcactcttgttgcccaggctggagtccaatggtgcgatcttggctcacctcaacctccgcctcctgagttcaagcaattctcctgcctcagcctccatgagaatccaatatgtaaaacagatgacggttgtgatgcagggacagaaaattcagaatgccacatgcttggcctcatttctctgggtggcctacccaagagcttcaagaaaaacagtttaagaaaatgctaacttcagcaatattggcaagacaaagccccttacactccttagttctttattcagcattgttctgctctcatttattaaaaattccaagtaccattgtcagtattcttcagaaaatcttatagtgctgtctcatttctcttggcaaaagaaagcctgttgtgcaacccaatgaatttaattttttttttttaaagagtcttgccctgtcacccacactgtagtacagtggcgcgatctcggctcactgcaacctctgcctcccgggttcaagcgattctcttgcctcagcctcctgagtagctgggattacagatgtgtgccaccacgcccggctaatttttttatttttagtagaaatggggtttcaccatgttggccaggctggtctcgaactcctgacctcaagtgatccaccagcctcagcctcccaaagtgctaggattacagacgtgagccaccacgcccagccatgaatttaaagtttaaatggcaattttaatagtcacagkaccctagaatgcttatagcctaatgttagtaaatcaaatgctttttacaagactgatattcacagacactgattctttctgatttccacagtggtacggacagattttccataattctccatggattagacaattaagtcacccaattctcatccttggttttcttcaaaaacactcacccacataaatctcatttatgtctatacatttttctcagtctttacgcttaatgttaagaactaaagcatttgttgaagcaagcggatcacttgaggtcaggagtctgagaccagcctggccaacatggcgaaacctcgtctctactaaaaatacaaaatattagccaggcatggtggcaggtgcctgtagtctcacctactcaggagactaaggcatgaaaatcacttgaacccaggaattggaggttgcagtgagccgagatcgtgccactgcactccagcctgggcgacagaacgaggctccgtcccccaaaaaagaactgaagcatttagaatcatagtggcagtggtggtggtggtgatggtgatggtgatggtgataatgatggtgatgggatggtgacggtcatggtgattttggtagtgggagtattggtgtggcatttcagcaaatgttgttttcatttgttttaaccatcagccaaggaacaaagcaatctgtctcttcaatatagttacacaggtgactaagtgtcacccgcttccaccttctctaatcaaggaaatggtgacgatcaggttactatagattccttataaggtgccttcataatggataactgtagccattttatgtaagcattgtcctgtgattaaaaaaaaaaaaagattccagtatgcttttgaaaaatgtgggtgggggagagagttttaatatgctgcattcaagatttgacctatggatttagattctagcaattcatgaggttgtcttaatctaaagctttctggtgatagatgtttgagaagctaggattatattaactagtcatgttgaaactacagatttaactttaaaaaattattttwaacttactataatacccatattccaatacacattattaatgttagctatcatctcaccatttccttttttacttattttcaattttttttgaaaataagtagttgacctttctctttgaatctttacatcattcaatcccaagattccttattgcatactaatttcctgccgccaagaaatctctgtttcatgccctaagccagagtatgcccatttgcagtgattatgtttctcataatccaattcatattgtccttatttaaaatgtacaatgtctagtctcaacctcatacctgcaaagatatcacaatatttttgttagcatgttccttaccacagttcttggatttctaccaaaacaaagyttctacaaaacttcctgtggtcatccttcttagcctttgctgccccagtttccttaattcttattaaagttctagctcatttatcagtggattaagcratgaacggtaattaacattgtggacccattcaaggctgttttgccatcattttttggaataccttaaaaagactaaactttgtgataggctgtataagaatgcaaaggtaaagaaatgcagatgggagtgtaagtgaaaacatgcagtactgaccttcctgattgctcattacaggagaccaagacacattccaccccagtggggggtcccataccactcatggatctgaatcagatggtgagttcaaaactgctttagtcatttactgttataatcattgagcctaatgatgactaccaacgaagtatgagtcagtgtctccagagaagtggttctcaaaccttcttagcatacatcacaattgcagggagggcttattaaaccacaatgctggaccccacccttaaggttcctgattcagtaggtctggggtggagcccaagcatttgcatttctaatcagttccctggtaatactgacactgctgggacagggattgcactttgagarctactgctctggaggaaagccttgcatctgaaagcctcaggaagaattcaagcagtgtcccaatttaacmttgcactacaccagagtgattaagagcttgagctttgtagcaaaaatggcctgagttcgattccagccctccgcatattaactgagcaagatgctttaaagggtctgagacaacatttctcaactaataaacttggaataataacaattgtcacaggacattgtttcaaagactaaatgatagaatacatgtaaagcatttagcataatcctggcacatgatatcatcactggtatttgttgggaatttactgtgtgccagcagcatctttctaaacactttacatgtattaggttgggccaaatggaactgccattattgtaggtcaagaacaggtcaatatcggccaggcacggtggctcacacctgtaatcccagcactttaggaggccgaggcaggtggatcacgaggtcaggagttcgagaccagcctggccaaccctgtctctactaaaaatacaaaaattagccrggcgtggtcctgcgcacctgtaatcccagctactcaggaggctgaggcaggagaattgctcggacctggcaggcagagtttgcagtgagccaagattgcaccactgcactccagcctgggtgacagagcaagactytgtctcaaaaaaaaccaaaaaacaaaaaacaaaaaaacaggttaatatcagcaaattcatagagtttatctagtatgaactcattcagtcatcctataaactctgtgacataggtaagtactattattatccccatgttacagatgaggaaactaaggctcagagaaggtaagtaacttggcagagttgacaggaccagagagtgatggagccacctttcaagcctggagggccttgtattacttctcatagcacagtctggagaaggcattccataatgaccataattactcccaggcatgaattcttaaatagactcctgtttgttgtgattcagatcacacccctacaaaccttaccccagactgcaaaagtctgacatgaggtaggtttactaattacttctactgctgggctactgggaggttctgccagtgctgccttactgtggtctccctgaacatcataaatccaggtgaccccatgtaaatgatttaagccatatcaattattgtctcccctttttatgcccaagtttgagtgaggctcaccatcagatttaaatgtttacacattgaaaacaaatatgaagatggatatttacatggtggyttccacaataactctctatggaggagcactaggaggtagggattcattagaaatgcttctgaaatagagacagaagtcacaggttcactggggactttaggcagggcacttaacctttcccagactcagtttccttgttagtaaaaaggagatcaaatcatctgcctcagttgcttcctagagttattgtgaggaagacagggtaccagaagtgtgaaagtactctgaaaaagtagggagttattattaaggggcatgatctctaaaaccaagagaccccagccactctctaagtatgattctttaaccatcagagtggacatcacctaggaacttgttggaaatgcagaatccttggccaacccagacctactgaatcaggatctgcattttaactacactctcccacccaggtggtttatatgcacattaaartttggaagcttagactgtgctagactgcttttctcaccattgaagccaattgaacaatctctgtgcatatgtctcagattacatgtcatctcccaacaggaatatcaagtgctcctctytgtggaacttgctactgtggccagtcctaccctggctggatttgtagacatctagggcacaaggcaagacctgctatctcacatccatcttctgtggcttttgcttgaagtgagaatcaagcagacaggagccagtctcttttgtttggcttctgagcaggtgtctattgttcaaacaggaggtttcatcttgctgcacgcacacccagatcttttcttgctgggagcacttcttctttttttttttttttaaatcaaaataaagtgattatgatccgttaatggcctctttttaaatatcaaaggcttctatgagtcagaaaagaaaaaaaaaaaaaagaacagtgagagtgactgtacctcctggggagttttcacggccaaagatcttcagtttaggtggccagtgtcccatgagttgggcaggtgaaaacctgccaaccaccaaggacactggaaggcatgtagggaaagggccttggactgttttggagatttgtaaagtcaaaggccactgtcaacataggataggggatgttgaaacacccagatgtctggtaggaactkgttttgctcccttttaagttttaacaaaagcatcaaattgcataaacaagagccatcctgtccccatataaccattgtaatcaagatttcagtgtgcacagcctaaagtttggctccatgaggaaagctctcatttaagaccccaccattttcatccattgatcagccttcaggattctacagtgggcttccatttggtaggaaaaaaaaagttcattttggtggaacactttcaaattttgttttgaagcaatggaggaagaatttttaaaaattcatgaagctttcattttgatgaggctcttcacaagatgtcttagaagtttcttttttaaaaaaattgkttatttatttattatttttatttttaacagggacaggatctccctatgtttcccaggctggtctcaaagtcctggrctcaagagatcctcctgtctcagcctcccaaagtgctgggattacaggtgtgagccaccatgcccggcttcttagaagtttcttttagaaccattgtgtctccctcatttcgataggcctccagttctgacttgaggattgtctgtcttgcgatacttcctcccagtttaaggcattttgttcatctccttattttgctttttagcagtagaaaatgttgattcttctaacaaggtgtgtttcagtaatatattagcagggactctaatagggtgatttttcatagtcagaaagggccactgccgctaaactccttatttatttattgtgaggtggagtctygctctgttgccaagctgtaatgcagaggcacaatctcagctcactgcaacctctgcttcctgggttcaagcaattctcctgcctcagcctcccgagtagctgggactacaggcacatgccactatgcctggctaatttttgtatttttagtagagacggggtttcaccmtgttgactaggttgatctcaatctcttgaccttgtgatccgcctgcttcagcctcccaaagtactgggattacaggcgtgagcaaactccttattttatagtgtttatgttggctcctatgatgctattggatgagattttcaggttccctttgggctttctggagcgtgtgagtcccctgggggtcttgttaaaatgaagattctgatttggtagctttgagatgaggcataagattctgcatttctagcgatctccccaggtatgcctgtcctgatggtctgagagccacactttgagtagcaaggtcytaaattaaaaatagaaaataacaaccacacacaactaccaataccgtgtatttcttcaaatctctgcaaaattatgatgaacagcattctgttatccccatcttacgagtgtgaaaagggagacttggagaaggtagattgacccagcacacatggctagttagcaagggacagcggtgagacttaaatccagggttgtccagctctagacaccaaagtcytgaacactgtgcaacactgctgctgagaattctcatgttccttgacacaaaataacattactaagccttagccttaatcaaatgaggtgggggggaaatcttttgtgtaatgctttataaacatctgcagcttgaatccataaatggcttctcagtgattcagaatgtggagagctgcccwttatgcagctccacaaggaactcatggttacacatttcaaactttggttgagagatgttgtttttccccttaggacactcacatgggagtcaagaaggtggagcaaacacaacctctggtcctataaggacaccccaaattccaggtgagtttcaaactttgaggcagaaaaacacactgaaagcagctttctcagaatgtcccagcaaggacgaagagactcatttgaaagcacattctccacaatgcccaacatatgaatccaattgctcctctttacaagttaaaggatgaatgagaatactacaccctcttggtaggaaaagatggaatagtcttttcttcctgggttctgcamactagctgagctcatactcagatctgtccctggcctgtcccagagaagtgccatgttagttactaaagcttccttcctaaaygaatgatcaccaagaggaccccatgtcatacctaggtcctttctatcccaatccaatttccacttatttctggggtccaaggtgaagcatgtaattttccttttacgattacagacagggaggagctacaagaggcatttatgttagatggagtgaaaactttcttttggttccccaactaatttttttttggtcgagggaccgcctgctgatgtggacagaataaacttttcagaaagtatgcatgtgcagtgargaggctgggacacctggttctcctgagcatcaagacaaggcatttgttgcaaattctttatttgacttggaattaaaattgatttgtcatagagaattactaaagggaagggttctcctaaggttgtaaattacccttttaattctctcctsttcagaggtctccagactgagcctctcttggggaaagagaagaatgtggcatgcaccgttctcctttgccccagcttgcctaagcacacctgaagacagaccagacagagacaggggtgggctgtcccaagggagagcacaggggaagccttagctgtcatcaggcagcaagattcttcccagctccagtgacagtgcaggtgggatatctcagggctggaaaccagggccacagtgggcaggagtagaaaggaagaacagaaatcgggccctcctstcagtcycccccacttctgactctacctccctctccaaactcatctaaaccaggaaaaggtgaggcaaaggtagygctgagcaggaaatcagagataaaccaaaatttccaagaagaaaacagataatgagactttccatgcctcttctttctcaagccctggttcattgcacacatatacaacccactttgcaactgaatttagtggagttgtcaagtcatattttagtcctaaaagagcctgatttcaaaatgtgtagaatattaatccacaagtgatatataattattgaaaacatttgaaaaaatacaactaaataaaataatggaaatataaatcaattattatcaatctcaccatccagaaatamcatggttaccattttaatatacgkcttttttttttttttttttttgagatggagttttgctttgttgcccaggctggagtgcagtggcrcgacctcggcccactgcaacctctgcttcctgagttcaagcgattctyctgcctcagcctcctgagtagctgagattacagcatgccaccatgcccagctaatttttgtagttttagagatgggrtttcaccatgttggtcaggctggtctcaaactcctgacctcrtgattcacccacttcagcctcctaaagtgctgggattacaggcgtgagccaccgcacccggcctttcctgtcattttaaaatgtaaaatatataccaaaatgtgattacaccttacayggtgtttagcaaacattgcctactggttaaccatggcttccatgtcattgaatatttcctcctcatattgtagtgcgtaatgcaatagatgtaccctaatttatttaaccaatcctttattgcctccatttttgttttttaatacaatgtaaggtggataggtggatgctcttatacaggaaaaaaatgttcctttcaaaagaagcctacatttccttttatatgtttaataatattataccaaagrcatctacaagattcaacaagtcatcctgtccttttttagaaacatagttctcctgaagggacttgaaaatcctgactgatgataaaagattaaagcaagaaggctgttggacaaataccttcagcaaattgctcttccagaattacctgcctattggctggacctattggccagacccccctgcagcgctgactgtggtgcttgtttcaactaggtcaattataaagtgcatttttgtttttacaaagtgtgtctctgaagctcacgcatgtcatttaatttactcataccagaatggctgatcatcttggcatccctcttggccttggctttgattcttgcagtttgcattgcagtcaacagtcgaagaaggtaaggggctgtcctgggggctttcaacttggaaagggcatcatttaaacctgggctttatatccttgctgctcagagcgtagtccctggaaccagcagcctgggtaccctgggagtttgttggaaatgcacaatctcagacccaaccccagaystcctatggcagagtctgcatcttaacaagtttccagggattcatgtgcatggtgcagcttaagacatctttctctgccccggtttttagagacaggagacacctgtgattgtttggctcatcacttttaggtagtggttgaatcctttgtgattttacatgttttttagggttaaacctcatgcagactctgtctgatgaaagttatgaagtatctcaccaggaaggcacacaaaagtatatactcattcattgatttgttaaatatttattaaatacattcacaatgcacaaatatcgtataaagattcagtgattcatcatcccctgtagcctctctgaggcccagggaacctttaagaacttttaccagaaggaagtattggccttgtgcttttgtttgtcgtttgtttttttattggccttgtgcttttgtttgttgtttggtttttgtaatgatatcattttctattttctgggaactgtagttgaagagattcaggttatagcataagaagagcactgtttcatcgtcttcttgctgttaggaggtctatgaagcagagaagaactttcctttggaaaacaactaaatgaagacagtcacctcsctagaactgacacrtgggctgtttttatattcttgaaggccactctctccctacctgaaccaagacctataggtttacatgttatttacattttatatataatatatatatatatatatacacatacattatatatacacaatagtaattctagcaacagaggaaatgacctttaacaggggtataaatctaaatttataaaagtataaatctaaatttcttacccaagacactttaaagatacattatttttctccaggacgtaattcataggaatattaagccttttgtaaatgtccctttagatggtttctcataaggtaaaagaaacttatttccaagcaggaccacctttattgtgtccccagatcacctcacagggcagaaaaatgcccctcagtctgggagaagayctagagagaattatggactccttactggtttttggaaagcaaccaacagctaattccaacaccatgggcagcccatacagtctctaattatctgagaaaatcaaatgatgctgttayaataattacgctggtacaagttaataaaagtgccatgttacagtcaaacagctatgttgctatctatamcattgagggcatagttttaaaaagtagttatgctacctgattgtataaggaacaaaactgagagaaaaaatctaaaaggccgcctatgattgaatggaaagattttttttagttgaatttaaataatgtgacttgggggagcctttacaaagagtctttatacctcccttcagcttcctcattttcccttggattacttttgctcaattaaatatgaatttcctattgtgtgcaatcagccctytattgccaagccctagaatgcaccacttttgctcacatacacagtccataagctttgcacatgtcaccatagaaacgctggcatggatgctgtcgacatttagggagacctcggagaagcatctcagctgtccctaagagcagctggagtccatacattggggctgggtatctcccccatcgtctgtgtcttgtcagcagcagacagcagagaaggggcctcattgctgccctctccctcctcccaagaccagcagtcaccctggcaaccggcaaacagggacacacagggtccggcacagcgagtatctcaccaggaaagtagctgcttggatgccataaattactatgtcctgatttgataattgaaaacagatttgccacgcagctaaaaggtggtkaacagctgtacgggccccttaatgggctctgtgattctaaagctgtcaacccatttctaatccccttcaaaggctgaggcttttctgctttgagtgtcacatttaagagaaagagatacagaatcctattttcatcagagaaagtttggttgaaaatggrgcctccaataggtgttcatttattcagcaaacatcttttgagtggctcctgtgactaccagccctggcaaggagaaagagaaggtaaaaaacaaaaagastaccaccccttttctaaaagaatcttgaggtttagtggcagtattggcctcttgaatttgaattggctaatatttattgagaacattccctgtgccagacactgttatataaattatggttaaaagacaaaagtggaaaatcattagtctctgaagttgacatacaaggatgggtcatgggcttgcatgatgaagtgatctgtgagtcacgttgtcttaaagatgctgggttgggrgttctattacttctttaggtttttccacccctgccatcatccaaaacagctttctttgctgttcctcatgtcacctgactccttgagttacagctctccaagagaaatcatattttattccctyttcatgagagcacataattattttaggagtcagttgggttgatagatactgcgtgaggctccagagaagattttcctttaaagaatctatctgggccaggtgcagtggctcactccatgtgcagtggctcactttgggaggccgaggcagtggattagttgakcctaggagttcaagaccagcctgggcaacatggcgaaaccccatctctacaaaaaacacaaaaattagccgggcatagtggcgcatgcctgtggtctcagctgctcgggaggttgaggtagaagaatcgcttgagccccgggaggtggaggcagcagtgagccatgatagtgccactacagcctgggcaacagagtgagaccctgtctcaaacaaacaagcaaacaaacaaacaaacaaaaacctatcttatttgtctaaagaggagaaaaaaacatgagaactttactatgttgcttgtacataaaagctgttcatcagccttcactttaatgggaataatcgtcttttctataaaccccagcaggcagtcacccacactccaatcagtaggtcttctctacgcatcgccataatttagaaatattttccttctcttatgctacagtctagctcctgcaatctgagctcacccaacctcgtcctgctgtctagaacagtgctatgcaatagaactttctgtgatgatggaaatattctatacctccactgtccaatatataactactagccacaactgagcacttgaactatggctagttcaactgaggaagtgaatttttaatttcatttcattgtaattagtttaaattcaaatagccaaatgtggctggtggctaccatattggatggcacagctctaaaacagtgcaaaataaatccctaaatatcgttaaggattgtcaggtagaagagtcatgagatcagttgccaasttacccacctaaatcttytragataaattctgccatgccataaaagtatgttacctggcttctaaaccccagccagcctgccctctctttcctggtgaggtctcagtctgcctccttccacactgtgtgattgctgtgtgctcagctaatgcctgagatttaagggaagaggagataaaggtaagacacagatccatgaggatctctgatcttcagagtcagaagatccaagctgtggctgggcgcgggggytcacacctgtaatcccagcactttgggaggctgaggcaggcagatcatttgaggtcaggagtttgagaccagcgtggccaacatggagaaaccctacctctactaaaaacacaaaaattagccaggtgtggtggcgggtgcctgtaatcccagctacttggktggctgaggcaggagaatttcttgaacccaggaggcagaggttgcagtgagccgagatagtgccattgcaccccagcctggttgatgaagtgagactttgtaaaaaacaaaacaaaacaaacaaacaaacaaacaaacaaaaacagaaaatccaagctgtgattcttgcagtgcagtgccataacaagctgtgaaactttggacaatacttcttggacttggtgtccagtttacataatgaagaagctgggctagatgatctctgaagccccttaaggtctagtgctccttcttaaattcttataactaggaataacttaaaaattagaatttgtctcttaaaagcacttattagaygcctagagcactgaatattggaatgagttatttatgagaatcatcctaccctcctgaaactactcagacagatagaaacacataaatccaaagggaaatgcaggccaaccaaaaaccaagcacaatattcctgtgtcctataggtcaaatgttatccactgtcaagatcagcttcgtttagattaacaacattaatccccacccactcccatgcacagacatattttttatgctcataaatcactttcccacaatatttcattccatccctcaaccacccattggttagggaaatgggaattactttaactagacaactttcctccaaagaacacaggggccagggaattggaagtaacacaagcagtattctaccttgagccttttaaatcctcttcatagtaaataataacgaggtaggtggaggcagccaggagaaacaagcaaaattcatttcatatggcttttgttatattaacaattatagatagcacttgaaagcttactgtgctccagatactgttctaagtgttaacccaaaccttagtttccttaccccgcataagagcaagaataacaattatttccttacccctcataagagcaagaataataacaatagactcatttatttagtgacagtctctgtttcaagggcttttcacaatcctatgatattgctactcttagtaacctggtattattgatgcaaaactgaggctcagagaggttaagtgagttgccccaggtcacatagcagtaagttctcaaaaccaggccttccgagccccttttcttctttcttttttccttttttttttttttttttttttgagacggagtcttactgtgtcacccaggctggagtgcggtgrtgcaatctcagcttactgcaacctccacctcccaggttcaagcaattctcctgcttcagtctcctgagtagttgggattcagccacgcaccaccatgcccccatgaccggctaatttttgtatttttggtagagatggggtttcaccatgttggccagctggtctcgaactcctgacctcaagtgatccttctgcctcagcctcccaagtgttgggattacaggcatgagccattgtgcctggtctctttttcttttttgaaacagggtctcactctgtcacccaggctggaatgcagtggcacaaacacagctcactgcagcctcgacttcctgggctcaagtaattctcccacctcagcccccaaagtaactaagactacaggcacatgccaccacagccggcttatctttgtattttgaatacagactgggttttaccatgttgcccaggctggtcacaatctcctgggctcaagtgatccacccgccttggcctcccaaagtgctgggattacaggagtgaaccactgcacctggcctccaaggcccttttcttgaccatgcatcctgctggactccatctgtattcctggtccccatgaatctgtttcacagttcaagcatccttcccccaacccctcatcaagccttatgctagaggagacaggatctacctcctgttgaggaggtataatttttatttccccaaacaagagcttaaagtttatggccttggcagtcctacagggaatggtccatgatcatgaataatagaggctttgtcactattactccaaatatccagaggcaaagtgaacaattctgacttcatactgtttccaaatctccagagggctggcagcattgacagagccaggcagagcccaggctttggtcataaaggcctggatttgaatattggctctgtcattcttactttctgtgtgacctcgagcaagttattaaacctcttttggcctcagtttccattgctgtattatgggaacaatagctgctttgaaagagtgttgtaagaattacagaaaattacatgtaaaatgtctggtattcaggaggtaatctgcttccctgaatccccatcttgcttgtagttgtgaagctatgcaactttccttcctctaagcatagtctgactcgtatatgtgtagtagtgatrtgttacaggaaagaggaagcattgcattaggctgggtggggtgaagcaatggacagtaaccagggaaaagatcaaggtcgtactcttccatagcaactttcttttgcgtttgggtcttaagtaatgtttgagaaaccttaaattaacragaataatttgtcttatgttattaaacttcctatatcagggttgtatgagttagccaatgttaggaaaacatcactatggccttatacctctagaaaaatgttgttttattcttctcgatacattcagtaataatgctgacaaggccgacaaagtgttgactgggagaggaagttatgggactttctggaatatacaaatcagaatgatttacaatcatcatgttgatggtttatctaaatctgcagaaactgctaaaatgcttaaaagaggcaaacatttccattgtgaagtaagatagaaagagaatcagaacttgagagtcagacagaccagggtttgaatcctctttcttacttgctgagttacttgggggaagttactgaattttctgatccccaaggtttcttcacttggaatatagagaatataataataacaccggcttcctggagtcttagttgctggtttgcaaacttgactgtgcagagaagcccctgaggggttgcaaatttgactgtgcagagaagccacagatcctgggctccaactctagagttttctgattcagcaggtttggggtggggctgagaatttgtatttctaacaggttccaagatgatgcttttgctgctggtccagggacctcactttgaggagtgctggttgttatgagtctggttgttaagtgctggttgttwgttgttaaagtagagaaaacccctagcacagtgcttggcacacactaaagccatcataaaccatagtgatcatcaatgatggtgctcagtaaggatgatgatctgatgcctgagtcactgcaatctttctgatatggtacattttttaaattattaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactyttttygttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgytttccactgaggttgggggttggggtgtactagttacayatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctrtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttytattccttggccattgtcaacggagagctggccaagtcttcacaaacccttgcaacattgcctgaagtttatggaataagatgtattctcactcccttgatctcaagggcgtaactctggaagcacagcttgactacaygtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagactcagaagtctctaatttaaaagaaygggaggctgagagggacagaactatgcttatctggcaccgtctgggtaatttagaggaacaaagtcaaaggtatctgaggtggctgaagcctcacactcattttatttttwaaaaaagcaaaaacaaaatgggtttccatcaacttgaaagtcttcttttggagaaaatctggttttctatgagtgatgtgtggttcacatgtttcaaactaagtgagatacagtgaagtgttagttcttttaaagccaagaactactcctggacttccagttaaagagaggagagtgtacataccttcattccctcatgtaagcctctaaaaagaaaataaagagatatttccagayggaatcaaccagtggagttaaagagattggaagaagagacaagagcaacaaaaacttgaagctgaaaagtgatagctgattggtaactgaatgaacaagtctggaaaagctgactcctaagcctgcagtgtggaaaattgagaaacaaccagacttatgtgacagaaccatcaaaaggctcaatagctattctggaaatgaatgggaagatgaggctaagattagggggacaagcttaaagtctatgtaagaagcagttagaactccaggtccccttccttactctgtgtaactgaacaccgtcctttcccaatctcagcaaaagaccagaagtttattttctggagacagggaaatagagagtctctggttgaagtccaacagcacgtacacagttgacattagaaataccacactgagagccgggcatggtgatgcatgcctgtaatcctagcactttgggaggttgaggagggcggattgcttgagctcaggagcttagagaatagcctgggcaacatggcaaacccttgtctctataaaaartataaaaattagccaggtatggtggtgtgtacctgtggtcccagctactcgggaggctgagttgggaggatcatgtttgagcctgggaggtcaaagctgcagtgagttgagattgctccactgcgcagcagcctgggtgaagagtgagaccctgaaaaagaaaagaaagataagaaaagaaaagaaacaagaaaagaaaagaaacaaaaaaagaaaagaaaggycatactgaaaaagtgaaaccatgcttaaagagtgttgagattccctatcctcctctcccagcttggctctcagaatgctgggagctaggcatatgttctccaggcagaagctcagtgttgctggggaatcttatgagcctgagagaaaattctaaaaatattaacatggtagttccccaaggaaatggcccaaaaaaagcgatctgcaatgaagatggcatctcaagccccaccaggcacccagaaagctcagtcagctttctgtagcttactctcacacatgagctgttaccaaggagcaccagacatttggagaaagcatctaatattaaagtcagggactacaaaaaacaggaaaaagtaccttgacagaaaagaaactgcttagagaaggaaactttttctaataaaggtcaccaatactctcagtaagataagaggagatggtatatctataaaacaaaaacacaatgccaggataaaaaggaacatatagagaacacctaaaaaagaagctttaaaaatgtaaacttgagagcacaaatttaaaaataaacctcacagaaggtttgcaagataaagttaaagaaataccctcagaaatacagcaaaagcaaataaatggaaacagggggraatacattgggaagactggcacccagtccaggaaatttaacatgcaaatgctgtaatcaaagtcacaggaagagaaaacaaataggaagaamtcatccaagaaaaaaatcaagaaaacttcccagaactttaaaacatgaatatcttgactaaggacaaggtgagtacttagtaaaatgaataaaaacagacccacactaatgcatattatcttaaaaattcatgacacctggggcaaagaaatgatcctatgaacatctagaaaggaaaaatacatacatggaggatcaacaatcagaatagaatcagatttctcartggccacattggaagatagaagaccatgaaacagggcctcaaaatactgaaagaattatttccaagctagaattctaacttagttaagctgcaaattaagtataaggatggaataaagagattttaggtaatcatagtctccaaacctgctcacccattcacaggcaactcccaaaggatgtactccatcaaaacaagggagttaccaagagaggagaggacatgagtttcagaaaacaaagtagagggagttcttaaaatgatgataaagggagatcccaagatgacagctgtacagcaggtctagagaacacttaaagttggagtactgactaataattaaaacaatcaatgttttgcttttattgacctctaattaaaaagaaaattattttttgttgtattcattaactactgatgcattaaaaactgttccaaaattagtcgcttaaaataacaagcatgtatttatttcttatgcatccaccagttaactgagtacttctgctgatcttggcagggctcacttgagcatgacgggactcatgcatttgtgtgtgtgattaacaaacaggtcagctagaagctgtctgatttcggacagcttcatctgggatgattggggtctttttccatctgactcttmcatgcctccagctggctggtccaggcctgacagggttccaagtaagagcacatgctcacaggtcctcttgaggcctaggctcagaactggtgctctgtcattccaccatattctattgaccaatcaagttacgagagcagcccagattttaaaagaagggaaatagattctatctcctaatgggagaagctgcaaagtcacactgcaaaaaatatggttacaaaaaagccaattatcagggccaktagtgtgatcaagatctacgatagacatgttgaaagattcttgtgctcaagggcacctctcatgtttatgcttaaaatacactcaccatttgagccatattggcaatggcattaacttagaaaaccatgaacaactttataaaccccatgcttattggaaaaggaaggagcaaagtcatgtgtaaatgtgtttgggagattgcttggtatggtagaaacagyrtgagctttgggatcagacaaattttgggttttaatactgattctaccacttacttaactgtgaaactctgttcacacatcttaaatattttgagtcagtaaagagacagtaaaaccttcatagggtggctatgaggattaaatttaacaagtacrtgtcagtgctggggtatattaggtcctcaaaaatattaattcctacctgccatcacccacatatgcacagtaggtacttaacttcttccttcaccatttcctccaatgttctgaactctaaccaacttttaagtgtgaattgctattaacttacagtggctggagacagattatttcagaatctgaagctccccatgaagaaagcccttcaattttagttgaaaggtttttgctttcaaagcaaggctaacaagcagggagtccaggaagcwaataactggcattcgttgattaaatcttggccatctaggttgtggctgtaggttaaccaaagttgggcatccacccaaggctttgatcgtcacctccaggaagttgtcttgccccacccctatccaggatgagctcattttcccctctgtgggtataactcttaccttgtccatatgtcattgtagttcttactttgcaatttcattaatccgcccatgaacctgtctgttctactatatgatgaggtgtgagggtacggagaaattcattatggtcccccaaaccaggtaagtagaaagtggtagaaccagggatasagctcagctctctccaaagtctctggcttaacatgcctgaattgtctattgtcagaagtttggtaaactgaatttgctgaagttaagacatcatctccaaatgttgcaaaccaggtcagtattccagagctccctgtgcctggtggagccaaaggaggctttcagaaaccactgaaaagatttggggatgagtacactcaccatttagaccacattggcaatggaattaatttaggaaaccataaacaacttcatagatgctgtgcttattggaaagggaagaatcagtcatgtgtaaatgtgatttttgctgtgatgcccggggcaaaggctcagtggagaagaaagtctggctgggcatcctggcctcaagccccatttcttgcctgtgttgacacctggtcttgaacaccagtagtttgcytgtcagggccgcccataacccggctcctcaatcctgccccattaggcttccagactgctgatctcattacgtggtgactactgttttccagaagtcttgtctaaaccacttcctccttcctctctcccgaaagaggaataataaacctcagaagaggaggctaaggtttagcttttaaaaggtgatatttaaaacaagactctcagttcaaattcaacctctgccatttacttatgtataaccttacacgaattattgaacagttctgtgcctcggtttcctcatcggtaaagcaggaataataatctctaccggaaagaatgctggggggttaaatgagataatatctgtaaaatgatggaatatagtagacgcatataggtttccttccctcatttctgctatcttmatcacttttgtgtgaatacacagtaggggtctagaaagaatatgaaccatgatttgggagaagtcagaggtgttccaaaaatttctgaacctctcccaaacccttttaagcactggggtctgaaaagcctaccctctcccaccctaagatttccaaatagtatcaaaaagaagaagagattcccactcctgttttctggggaagggtggaatatgcaggtttattattgccaacatctataacacaaaggctctgccagagccaaccttcaaggtgacccctagatagggagagagaagaaatgagattgaaatttcaagggcctagctctggagattctgaagatccttgaccttgggaactcacccatgcagaagtggagagacaggttttcaataataaaggctaagggcttcaaatttcagcttgggttactagagttcagtgagagmtttactttttattttcgcctcttctaggattctttaaatctcattaagaaatgaagagagaaatgtgaagaaaagctgtcagaggggtaaactgtcagagggatgcaaagaagagtaagatttcaaacaattgttctgaaagaaarttagtagctatttaataaggactgtctatgcatatagcagatatttaaatcataataagtataaagtaamctcaaaagcgtctcaataaggacagcatctctcttccaaacctcaatgggttttgctggctgcacttccagggcaagttgtcttggccacactttacttctcttccactctctcaatccctttcactgggcttggaggcacagcaactcagaactacaaagtctggtctgggcagcagagtcattggctgcgctgtactctccctcagggcagtggcaagctgggacctctctcaataggcaagggacctccgactccctgttttagatcacttcccccttggacaaaatttagacctttgtgtaaaagctgactgagaaaagtgcaatgtgttcatctgtcaagccaaggatgagagtaatgaaaattttcccatcaagkttcacgtcctttgcagaaacttcgttttcaaccatcttgttggccttctctgscctgttgataatgcgccccctagtggatgctttacaacatcccctttgtcttcgtagaaactgagtccttccgcctgacttcagttctcgaatcctcaacgtaaaaccagaaag

SEQ ID NO: 13236 - DNA, 305312 bp, Homo sapiens
  misc_feature (1)...(305312): n = A,T,C or G, or insertion/deletion polymorphism (see Tables 1-2)
gcagaacaggtttggaatggccccagtcctcaccctatagtgtggagacttagatgcaatgtattttatttcctctacccagatataaagaaggaaatagaaaggctttctcatccccattattttttaacaatcttgtttataaactttatctgcataatccaaaataaaatattaaagcaccttaataggctcctagaagtaccattttggcaagcgcttctgaacatgtttactgcatcttgggtttgtagttacagtaagtcaatatgtacttttagatataatttgaagtttacactttaatattagatacataaaagaacctcagaaaatgacatattcagataatgctccatcagcatttgatattaactaccatcaattgggagtaacataagcatttaggtgttacaaaaatatcttgcattttatgagctgaggaacactgagggcaaggagcagagcaggaaggggagaaggggaccgtgggaaatgtcagctgaagcctgaggaaggagtcaggacaggaaaagacactgaggactgtgggtcgttgtaatataaggtatgcataacagatcttatggtctaaagaatagaacaggtgcaagcatctgaacacacatataaatacaaaattgagtaggtaatttgatttttgctggctctctggcaataaccatatttccctgcctcttgcctctgctctcttcccctggtataagttaggggcatctcatatacatctcatctcacatgttcttacaatgtatccttaacatgcctcaaaagagctagggtttatgctccctgtcattgagccagggagaatgtagcagaagtgactccagttgacttccaaggctaggtcataaaaggcaatatggcttccacctggctctctctcaggacaactgcccttggaaccatgttgtgaggaagctcrggccacatggtgagacttcatgtggatgttccagttgacagctccagctgggccccgccgagtcagcagcaccaatcacctgattgtgaatgaatgaccttttagaggattcctgccccctgcctttgattctttcagccaatgtctgagatattgagtagagccaagcaagccttgttrtgcctgtttgaacccctgactcataggaactgtgggaaataataaatgatttttgttgttttaaaagcctctaagttttggggtgatttactacacagccatagtaatccagagcaaattcttttcccagttatttctgagaacccctgggggcatcacaaatgcatctcatgaatgaccttctcatgctgttcagctttgtttcctatgggatggacactgctcaagaagccatgcaaagtgcaatgcatgcaagggtgactgggatgattagaactaggtcaggcttgtttggaaaacttcacatgtagctggagtattttgattagttatttgaaataagctggagagaagctgaaagaccattacctgaaagagaaataacatatggcactatatggaggtttaagtatgtgtacaaaagtatgtgtacatattgcatacatagtcagttgcctgctgggtatgaagttctgggattcagctccaggaggagagtgctggagttccatttaggggtacaaacagcaggcaaagtgaccctttcaagtggtgcccattcggtcacagactctcagccttcatacccacagtcaccatcttttcagggactctagagaatgtggtttgggatgcaggaggartcagaagatctcgtatacactttggccactgggaaatgtctgcttctgtactggactggttcaaaggaagaacacttaacattgtgtttggctgcaagtaacagaaaacctgaagaaatggtggcttaaacaaataagaactttwatttttttctcatgtaaaagaagtccagagggaggcagcagggagctggtatgtggttcggtgatgtcatcttgttgcctcatggttacaatatatcaactccctttccagacatcacatttgagctctaggcaggaggaagaaggaaaggcaaaatataaaaaggtacatgccaatttttttaaaaaagtgtattctcactgtgtccaccattgccttaaggagctttcctagaagctctacctaaacaattctatctgtaccatactggctaggatgagtcatgtacccttccctagttgcaaggcatctgggatatgtagtttagtaggtgggcacattctgtctaaaccaaacagtggatcttctgttaaaaaagaagtcatggagtttggagtggtttctgagagtggtttctgattttagcaaggggggctgatttttagcaaggatacatggtatgctattaatagaaagaacacaggctttggaatcacaaagaaaagtatcaattactgttgggtgatattgggtcaaagactcacttcctttgtgcctcatttcccccagttttaaaggttacattacattacattttaaaaaaagacacaaaatgaccagcacagcacttggacatgggacacttgcaagacaattagttcctcttttttacaaaggattttagctaggacctgcagagtcaagaccaattagactctcccaagtcccctagaccctttgcacaagcaggaggtaaactccctatccctgtcctcagccagaacaaaggccccgaggaatctaaaccccttaatgccaggagagacaaatgcaattcctgcagcaggtttgtggactttgtgggcactgacccttctgaaacccttctcctgaagaagtctaggcactgcataggagtagtggaggtgcctaataaacagctctgtatgaagaggtgattaacttagatggatggcatctctccatagtcataagatgtgggttttatgaaatacggggtaagatatttggattggtgacagtcttaaaggccttgatgacttaatatgaaaatgaaagaagttgacattatgatatgattagatgggtgcttaaggatgaggagagagagggagagaggaacaaagaccatcacagatggcatttccccaggctaggcacatgagggctcagagctgtggctgtagaattatttagttaaggtaattctaattcctagaacagatagactctccaaaatctcagtggatttgtacaacagaagtttagttctcactcttgcaaagttcaaaaaaggtccagattggggcagttctcctccaagtgatttggaaacccaagcacctttcatctcctgcatcatcaatttatctatgaatctgcctaaagccagtggcagggaaagaacatggatgatcctgcatgggtcgttttggggggccagtcctggaagtaaatgctcattcattgtattgactagaaatcagtcacatggttacatctctttctgcaagaaaggctgggaaatgcaatccagctgtgtacccaggaaggctggagaaatgggtttcatgaacatctagctggtgtctaccatggagatgagaaaaaagtccaggtcaaaattgtagcctttgaataacaaaaccttagggccaaaatagaattttaaagtcatttagttcatcctccttattttgaatttagttcaatttcaaataaaggcaacaaagtttgaagacactgtggtagggtttgtgggcaacccagagaggagcttcatcctgctgcatccctgccttccctctgaggaagacaatgccacgttggagggggcagaacaggggccagatgtgtgtgatgaaatgtgaagcgcaacagaggatttctaaatgacaggggaccttttagaggtgtttcacttaaatgttagtggaatatgtaagagtgaagatggtactataaagctggtaacaatcagtaaacattagctttaaccaagtggttcttgaagtgtgatccctggaccagccacatcaggctcatttggcaacttgttggaattgcagattctcaggcccaccccagatctactgaatgagaaactccagggtagagcctagcaatttgtgttttagtaagccctccgggtgttttaatctatgaagtttggaaaactctgcctcagagtacatcasctctgcagatatatataaatatatatatatatataattatttttttagatcttcgggcctttgagacatcctaaactgtaaaggtttccactgttcttccatgtttattccaatgttgtaagattattttaccatcaaatatcaataatatctgaaacctaaagaaactatataaagttatatagattgtattttcaacagttatccaaactattatttattattagtttaatattctttggagtcataagggcattttgatctaaaggccagttagtgcttaattgccttgttggtcattaatggtgttgtacactggaacttttataagtcatggctcatagattcctcactttactcaatagcagtgatacaggggaaacaaccaaccatccatcaccttccaatcactgaagtcagaagggcccatttcttcactggttgcatatcacaccctgacccatattcattgccacagcggtatcggagggtggtgacatgaggggcgatgaggcttcaggagccggtgctaacagtgatamaggattaggggacgtggcagctcttctgagaggcaagaaggtggtgagaagtgtgatgaccttgcttctaaatctcaattctgccaccactgactctatgagacccttttgattttcatttttgtaacatgaaagacctgggtttggcctgtgggttttaacttctttggagccatggtccccttcagaatgtctggaagctgggactactctcccygaatatgtacatgtgcatatatacccccagtccacagccctggaatagatggtctttatgagccattccagccctgacctaattgaaagttctcatgcttctgtgaaacattatggaaaggaaaagttcattacttacattctggaaataaatgttgccatcatccttcatgaccctgtgggtgcataagtctcatgctgtaaaaagcatctttaatctagtttaatctaattaatctagttaatgaagcaactctgatttgtaatgctggtcttaaggtagggaagtgggcaattcattcccggtcttcaggtaggaaaaaaggcaaagagttcacacttttttttacaaagtagaaataacagttttacattttctttaagtttgcattttttattttcaacagggttaggaagcagccaatcataactcaagctattgggtagtaattatccttcatccgctaatttctaggcaggaaaaatatgattaaaatgagtttccgcacagctgttgattaggcataatgggaaagtcatcatcataaaactaataatcagagcagagctaacatttggaaagttattgttgagtaaccggaaggctctaaaagccaaaaacaatgtccaactaactagaaaattaccaccacccccacatactttcctgtctacacttcaacatcaattaaacacagcaaactaaaaccagttaattacatcaattttaaggtcaactttcaacaactcaaacctctgtgataaacaaaccacaatatcgaaagcttttttgaaaagtcaataaataaacagccatcattctaggaaaagctgcaacacagttaacaacacatcaataaattctaaacaagctttgtgctttgattagctcaaacctcctgttgcctccccatgccccaaatatgcattcccattccaatcaggccagtgtgcctgtggcccagggatgctgcagttggacagctgttggaggtcaccgctgagcagctctttgcaattgcaaagctcccactggaaaacagagattaatgagctcacaaatggaacagcacataatttcagawcttggtgatgataacaaggagctctttaggatcctccttgcttgataacagaatcactttctttcttacgtttgtcatccagaagtctaaagtcagtagcagtaatggaaagttgggctaatgtggagatattccaaacagagcaagagcaaatgggattcttggcttgtctctcatcgtgatcctgattgaagaccactggacacatctgtcaagactctaaccgcaatccattggaaatcactggagagccaaaggtgagtgaagatgaatgtatgaatgtatactagggaggtgtggtaagatagccaatggtaaagacaattgcaactctagggtttggaatattaccatcctttgttgttttctctctacttttgccccctcttacttttttttttctttttatgcatttaaatttcttagaactctctttcattgtcctggctggaagyactggattcctcctttcaaatgaactaaaatattttccaagatgtcaagtcaatctgggcaaactttctcaacataaccatccctacattccaatatccctctttttcatttttcctttaaaaataaacgtgcatttttttctcaaaagtgactgagctccatactccacrcaaccactgtttttagaccatccagatgctttgacacatgattttatattttaatagaagaaggctgaatatgaattgcaaaatcatctgtctccttttccatcataagaatgtgacaactcattaatctcaattccttaacaaatagcagtcttctcacgtgggtaaaactccataatgttaaagtcattgctttgcaaagacattctcataagattctatttccaggaaaactccaaatttctagtgctctgagtgtcggtcactttgacagaagatggatggtcaaatatttgaaatttgcattgagaattaaggagttatctaccttttcctgggattactttgaggaaaaggaaagaaacgtagagactctaactgtgaggagttggaggacaaagactccactgggagaagcatgaacaaaagggaaaagatgatgagaatgatggcacagcactgaattagcgaggaaggagttctcttgaatgatattggtcagtgtttgtcctcaactctgcacacaaagctgtaggccttgttgcctactttctgggttacaattgaagccaacaactctagttccccaggaccagaatggtcccacaagaccctcctactcgtggttctaggaggatgatgcaaaattcctactcacgccctgtttggagagggcttggcttccctgcttgggacaggattccaggcagtgtgccaggaggtattcctcaagaatttcacgaggtctaaactagggaaacgtttcactttccatccccttgtagtttcttctcaaccccctatgctctcattctcatattttaggacatgtctattaatggcatgatatagaatggattgaggtagattaagaaaaagttgcaataatcttgaaatgttaagattggtgtttctgctataagtcttgtagaatcactggaagctttgaagtgccaaaggatgtccagagacttcagaaccggttactaaatctttgcttttcttaatctttatatttcaggatctgggtggtctcattttgacttcattaaatttctcaaattttacctgctgtagcccaaattagactctgcttctccttctcttgccatcaccaggaaaagggtggaaatgggtgatgctgaagtttaggtgtattagttcattctcacattgatataaaggactacctgcaaggcgggctgatccctcgaggtcaggagtttgagaccagtctggccaacatggtgaaatcccatctctactaaaaatacaaaaaaaaaaaaaaaaaaattagctggatgtggtggtgggcacctgtaatctcagctacttgggaggctgagacatgagaattgcttgaactgggggctcggcagaggttgcagtgagccaagatcatgctactacactccggcctaagcaacagagtaagacttcatctcaaaaaattaaaaaatttttaaaaaaaagaaagaaaaaaaggactacctgagactgggtaatttataaagaaaaaagatttaattgactcagtttcacaggctatacaggaagcatggctggggaggcctcaggaaacttataatcatggcagaaggcaaagaggaagtaggcacatcttatgtggaaggagcaagaggaagagagctaaggggggaagtgctgcacacttttaagcaagcggatctcgtgagaactcactcattatcatgagaacagcaagggggaagtactccccggatatgttttggctgtgtccccacccaaatctcatcttgaattgtagctctcataattcccatgtgttgtaggagggacctggtgggagataaytgaatcatgggggcggtttcccctatgctgctcttgtggtagtgaataactctcacaagatctgatgatcttataaggggaaattcctttcgcttggctctcattctctctctggcctgctgccatggaagatgtttctttcaccttccaccatggttgtaaggcctccccagccacatggaattgtgaatccattagaccactttttctttataatttacccagtcttgggtatgtctttatcagcagtgtgaaaatggactaatacagccaccatgattcagtcacctcctagcaggaccctcctccaacattgaggattacaatttgacacgagacttgggtgggacacagagccgaaccatatcattagcggagaaattgcaggaacttactttgattgagtgtgagaagatgactccacaccattctctgcatgagttggcatacaattaagatagtctgacagactgattggatcttataacctaggccaaggaggccattatatcattcatcacaagcctgcaggcaggccctggtcaaggctagcctagggaggagaagaggaagcaagtcatgatgggtcaataccaccttctctttctcagccttccacatcctaacctctgctgttattctcagctgatgatctcactttccacctttttaggaaaacagaatctagatgtacaagtctactgaggtagggcctctcttctctgttgtttgagcctctcctgccaccaaaggccaaccctccacttcaccttctcaaggaccttttccctttgtttctcctctcacttctgaatcttcagcatctctcccctcccttttttttttagacagagtctcactctgtcccccaggctggagtacaatggcaccatctcggctcactgcaacctccaccttctaggttcaagtgattctcttgcctcagcctcccaagtagctggaactacaggtgcgtgccaccacacccagctaatttttgtatttttagtagagatggggtttcagtatgttggccacgctggtatcaaactcctgacctcgtgatccgcctgcctcagtccccaaaagtgctgggattacaggggtgagcccccgygcccagccagcatctcccgctttattcaattactatcatgactagatagacatgtccttaaaaacacagaataacccccctcctcccatatgtctctcctgatgctttcccatttctcttttgttaaatgccagcatcaggatatgggcaggaatggcagtagggtgatccagagaaagtaacaagggaagaaaacataactctattatgagaacaggttagacttctccctgcacaggaagggggagtggtggtgggtacttgtaggtaagtgtgagcagagtgtgaggatgagtgtttattctaacaagcatttagtgagcacttactctctgacagatactctgccaagtgcagggaatgtaaggatggctagcattttgtctcttccctgtgaatacagaagtgtgagcctagaaaagagaggaagaaaggaagaaggaaagaagaaggagagaagaaggaaggaagtcaaggcagcaagagaagctaactgcccccacccccaatctcacctccatcccagtaacacagactcctgggactagctgaaagtgatggctaggatcatggcctccaatataacatctttagaaagcccctgaatggcttgaacttaggaggtcgaggctgcagtgagctgtgattgtgccactgcactccagcatgggcaacagagcaaaaccctgtctcaaaaataaaaataaaatagaaagcccctgagatttattgagcccttgttctgcacaactctgctttcagcttcctatccttgtactcttgagcacactaggccttttacccagcccaggagcagtagcagcagggctggggtcaagatggcagttgagtattagtacaattttccaagagccataaccttaacctagtagctaggctccagatgtttctgtcaatgcacaggccttttggggagcctcctgtagactcaaaaacataactcttctggtttaagtgtcagtatgctttagtcttttttgtttgtttgttttttgagacagagcctcactgtgtcgcccaggctggagtgcagtggtgtgatctcggttcactgcaacctccacttcccaggttcaagcgattctcctgtttcagcctcctgagtagctgggactacaggcacatgccaccatacccggctaatttttgtatttttagtagagacggggtttcaccatatttttcaggctggtctcgaactcctgatctcaggtgatctgcccaccttggcctcccaaagtgctgggattacaggcgtgagccatcatgcccggccaatatgcttagttataatggtcatttacaaattaagaaaattgtttctcactctgtgttcatgctgtaagattgaggtgaccttgagaaggcgaagcatttcctcttaacacctttcatgttctgtatcatttaaagatagtgctgggctgcatgcaagaggaaggggcactggcagtgactgaaataagtagggaggttatttatctcatgcatcaaagaattccaagataggcaatagggcagatattgcaggtcacggtgaccccaaagatccaggtcccttctctcttcctgctctaccatctttagacaagtgcttggcacttgtaatacagcagctgaagatccaggcatggcttctatattacagacaggaagaaaaaaagggggcacagggcaagggctaaagtgcccaccagccaagtcagtctcctctaaaaagctttcctgggatctctacccagtgaattccacttatatctcactggtcagaactggggcacataagcctcttactgtaagggaatctagggaggtattttagttttctagtctttttatgtgatgaagacaagggaaaattgagcactggatggcttttgagtagctcacagtgtgtgccacacaccccatggagctttctccctgaagcaggagttttcagcctgaatgtccatttgtatccctgtgggcttttaaaattaaagcccaggagccctcagaccaatgaaattagaatctgcaggtggaacataatgtcagtaattttatttttttagaggcagagtgttactctgttgctcagaatggagggcagtggtgtaatcatagctcactgtaatgtgagcctcctggctcaagtggtcctcctgcctcagccttacaggtacctggaactacaagtgcatgccaccatgcctggctaattttaaagttctctgtagagatggaggacttgctatattgcctaggctggtcttgaactcctggtctcacacaatcctgcctcaccctcccaaagtgctgggattacaggcgtgagccactgtgcctgagcaacatcagtaaagttttaagatcctcaggtgattccaaagtgcagtcaagatytgaagccgttattctgcaggctgccctgagtgttaattttaatgattctcattaggaacaagtgatagactataaaatgttagaggctgggcaggactttcatgatcatagaacaagatttgctcaaggttaaatttgtagtcaatgaagagtttggggtggcatagccagatcctccaccccacccctgcaaataataatagcccctgctcaagtttcctattatatccagtcaaatgcaatgtgaaatatgtggctgtttggaagaattaaaccttgatccagttagtactgaaggttgaggagagcaggtagccttggactgtagctgtctctcctacactccagtaatgatgctcagcttgaaatccaatttgggatgagtgtgtaatttacatgtttatttaattcagagccacttctcagtaaataggatgytcaggggcttgaattaccaaagctctctctacccaaggctcccttactaatctactcctgacatttattcactgtgtgtgcagctgccaaaaagcccaatgctaaatgccctcattcagctggaggttttgtcttctgaagccaaacagctggtctgtctgagtccctggtggtgttgattaacatggggttttccagactgttagcactgatgacagtctacagattacccatccaaactaaagcttggggaggttaggtggagtgacttgtccaaggtcaccgagactatttgttgcagcaccaggataataacatcagcctttaggttaactcagctggaggttgtgtgtgtgtgtctgtgatatggttaggctttgtgttcctacccaaatctcatcttgaattgtagacccaataatccctataatccccatgtgtcaagggagagagcaggtggaggtgattgaatcatggggcgatttcccccatgtcgttctcatgatagtgagtgaattctcatgagatatgatagttttataaggggttcttcccctttgctcagttcttctccttcctgccaccttgtgaaggtgccttcttcccctttgccttctcccacaattgtaagtttcctgaggcctccccagccatatggaactgtgagtcaattaaacctttcctttataaattacccagtcttgggtagttctttatagcagtatgaaaatggcctaatacagtgtgtgtgttttgtgtttttttagacagagtcttgctctgttgcctaggctggagtgcagtggcacaataatagttcacagcaacctcaaactcctgggctcaagccatccttgtgcctcagcctctggattggcgaggatgataggcatgcaccaccatgcctggctaatkttttaattttaatagagayaaaattttgctgtgttgcccaggctggtcttgaattcctggactcaagccatcctcccgcctcggcctcctaaagtgctggaattacagatatgagccactgtgcccagccttgatgggatgtttctacaaagcagaaacataacaactttgactaaagatacactggtgcatagttatygccctccaaattttcagcataaacctttaaataattcggaaccctgaacacacccatcttgcaggaataactcagctagcagagggaaaagcaaataattctatgcttttcctgaattggcttcctgcctgcactgctcaattacaccaaaaggccctgtcagcacctagcacatgcctggcctacatgggttcactctagatggttgttggtctgaattgatccctgcaagggctttgctttgctatccattatttaraacrcctctgcaggaccacattattaccagctattacatctagagcaaagcagcaagaaatcaactatctttgggatttatgtgaaaaagactcgtggtagctggaagtcatacatagaccgatgagtgttttacggtaatgtgctctcaaagttcaatttcttaagttctctaggtgatgcaaaatgattgattttgaaaatgaatgctgaagaaataaattgattcctttgaagtaagtggaccattaattcttgaccttaaaatctctaaaatgttttaaaaggagttgacttagcagttactgcattttatagaattaactctttttcttttcttttgttatattatcttgctggggcccatccactagcttcatagttcttagaaaaataggatagagcctgctattggccatatgtttcttaatgccttactttaaacacacatgtagtcaatgcttgaaggtatagtgggggaaattaaatccatggaaaagctcaaagccacattctacgctactttaggaaatggctggttattttggctgtggctctaatttgatcgcattactgaggctgactgtcttacagcaatccctggagcagtgtgatttggcccaccagggtgcaagctcctcacttggttgtgtctatccagactgagtgagaggctccactttactctgtgtggaaacttcccccaagctgccactgtggaagctctggtgaatgggcttaaacttcattcatttgttcatttcttcattcacttatacctttatttagtcaatatttagtggttatctactatatgttaacaggcctgcccctaacatttggagagcaattggaggcccacatactatatgtctaaattttaagttataaatcaaactaatgaactgttccatcatatactgtcataaagacctggagggccgggttcaaatgcataatcctagagctccctggagttctgcattggaactcaatggtgtgtggagacctcccccataccctcccttggcccccatatgggaacggccctcccttttcttctctcccccaactctccctgtctgcccagcattctgagggacctcacctgcatgtactgctccgtggccacccattgggtcttggggtctcacaatggtgtgtattctaccctagggaagataagaggcccacaattcctccctggaagtgggtttagggccatttggtcagggacttactgattcctgggtacccataatgccatctagaagaggagataatgggctctgggtgggtacttcctttggtcctgtagaccccttatcctatggggagggcacagctgcaaaggcccagagcagaccctctgggcattggttcagggcccagggcaggggcttggctgcccctcgtctgaggatggtgctgtttgccaagtgctgcaaggcgacagtgagcaagactcctgagattctaacctcactgagagagataaaaataaatggataggtgggcgcagtgcctcaggcctgtaatcccagcacgttgggaggccgaggcaggcagattgcttgagcccaggagtttgagaccaggctgggcaacacggtgaacccctgtctctaccaaacaatacaaaaaaattagcccagcatggtggtaattgcctgtagtcccagmtgctctggaggctgaggtgagaggatttcttgagcccgggaggtcaagattgcaccactgccctccagcctggatgatagagtgagactctgtctcaaaaaaaaaaaaaaaaaaaaaaaaaaagaagaataaagatgagtaggataagggtttggaggcattcaatgatgagatacagagtgattgatgaatgctactttagggtgactagggaaaggcctcttggaggtgatgatgtcttcactgagacctaactatatggaggcactgtccaagcacagggagcgcaggggctgcaatggcccagaggcagacttgaggaaccaggtggtagggagcccctggtactgggttgtggcttgagggcagtgaaaaatgggctgtgtttgtagtggccagtaggagctaagtgatacagggcccagaggaaagagaaatggcctgagacttcccaactggctgtctctgagcaaaggacatcccttggccttagcagcctcacctgtaaaattgagatgcctcatctctctcagagggctgcagaggaacagatgagatgctgctgcttctgatattggacatgaactaactaagcawtgatgtgcagcaatgagctgccttggactgtgccagggactgctgctgggaatggctcaggagcgtctttttgcagctctaagggaggattctttctagggcatactcactccccaacccccactctcagatgggctttgaagcctttctcatggcctctgtctgtccagggagatagctctctgccgacagagcagaaaatgtctgggaggctgtggagccaacacagtctggacaaagcagctcctctgcagcccttcctcgcctgtcaataaggaaagcccaacctaccccagactgtgccctggccaggagctggaacgatgactaagagtcaatcccaggggctccaaaccaagacgtcaatggcccacttggcacagaagcaacgttagctcatcaaacaccaacttgccgggaccagcagtgggacttttcacccaacctctctcggttaaggctgctgtttagtgagaggaaccagaggccacattgcgtggtgtttcttttttaggtcactgtctacactgtaccttgtgagttatctgttatcctcagtatagactgtgagctcaaacattcccaaaagatctttttgacatcgatacaaggtcccaagttaaggaatctcttcagagattgtgtaagaatcttccacaatggcggtagctaccagctgttacccactttctatttgtcaggacccacactgagcacttgaatctcacaaccaccctatgaagggagcaccattattatytcattttccagatgaggaaaacatatattaaagggattgagtagcttccttaggggcatacatttgagatttgaacctaggcttgtttgactccaaagcgacactctttttttttttcaacttttatttttggttcaagggtatatatgcagctttgttacacaggtaaactcatgtcgcaggggtttattgtacaaattatttcttcacccaggtaccaagccytgtagtatcaatagttatttttcctgatcctctctctcttcccaccctccatcctcaagtaggccccagtgtctcttgttcccctctatatgtccatgtgttcccatcttttagctctcatttataagtgagagcatgcgatatttggtcttctcttcctgagttagtttgctaaggataatggcctccagctccacccgtgttcctgcaaaggacatgatctcattattttttatggctgtgtagtattccatggtgtatatgtaccatgttttctttatccagtctgccattgatagccatttaggttaattctgtgttttcrctattgtgaatagtgctgccatgaacattcgcgtgcatgtgtctttacggcagaacaatttatattcctttgggtatatacccagtaatgggattactgggtgaaatggtagttctatttttagctcaaagtgacactcttaatcacagtgctgtaacatyatcatcakcagcagcagcagcatcstaatacatttttagcagagttttgtacacattaaatcatttaatcctcataaccttaaagagagttattattatcccattttacagatgaggaaatgggtacagggatttttaaataactgaagtctcattgctcataggtagatagttttgtaaataaacaccyatcacccagaggggtcagctgaggcttagtgagatgaagcatcttatctaagatcacatgaccagtcagtggcaaggcagggactgaacctgaagtttgcctggctctcaatgcaagmcycttagaaatctgcactgagtctccaacatgaggactccctgccccatatttcagtgcctggagcagaaaaatctgggtgggggtgcragaattattttcacaggggtccttcctgtgtgcatgtgccatgtgtgactcaagcaccctgggaaactgaaggttcaaggatcattgtgcaagtcctccttgtggtggatgttttcacaagtatcactgaaggacagatgatgaaagaagaaaggaaagcacaggagctgaataatccagaaactggataattaaaatggactctatttgagaactacctggcaaagacctcttgctggctacartatcagaattcagagttgaacccaaaagttaaatggctactttcaatacaattacagtgcttgggcaaaaccatctttctttaaaaaaaaaaaaaagttttccaaagggaagggacaaacctaccattcctttcccagcaaatttgaacaatttggatggtacaatggaagaatttagcctgttgatgataataatgatgatgataataatgtctcactttaacttaaagtaagagtcataatgaaaggcacggggttaaataaagagcatttgcttacttccttaatgccataggtttagatgaagcatatatgatatgtcaagtccttgagttaggcagtgaaaacctagaacttgtctgaatgtggtttattttccagtggggaagcagacatcaaccaagcatcacaagtgactttcagaatatcaagtgggtgcaaagatagtctttttgacaaatggtctggaacaacaatatccacatgcaaaaaaatgaatctagacacagatcttcacaaaaattaactcaaaatgtgtcatagatctaaaggtaaaatgtaaaactgtaaaactagaagataacatagargaaaacctagatgatcttgggtttggtgacgacttagataaaagaggtgattagaagtaagcaagggctgtgagaaacagggtaaaatgtttgaatttgggcctaaaagtaaagccagaagtgcagagctgtgttatcagcaggatcaatcacatgcaaaggcaaagcaggtgaggttttgtgtgactgggttgcctcctttactctttcctcaactccccctgctcccagtgtctaatattccaacattaatggcaatcactttattcctcccacaattccctactgctgtgccaaaaatagtctggtactcccggggagggctgccaatactgaagagattacagactgggggatttgagagcaggccctatggtgcatgtagaaagcagggtggcactgggtgtctaaggatgggtctggaggggaagctggaacagcagcagaggaggcggggctctgggtctgttgtattccctagggtggctcttgactgacagctgcactaattgcagattacattgctgatacattatccatatagctgaattgataatgttttgacagcgaaatgttttatgactaaagactcccaaggtgaaggaaaccaattatgaaacatgatggagaatctcacagaagcacacaccactacgctctttgtgggcacgaacgtgtgtgggtcatggtcatgtgcttggccctgctttcagcactttgtaaaaccccccaccagcccccatctcatcctggctctgacctgcctctttccaggggtctcttggccaagtttctcttcctgcctgcccctcaaaaccccatgctctgttytaaaaccactgacaatcctgtctaaatgactttatttgcaataaacccatttttaccccaaatgcatacattcctgtgttagtgtttaaaagctaatggtggcactaaagtgtcatttgttcattcactcattggttctaataaatggcattcatcaaatgcccatgatatccactaaagttaaacatgcccatatcctatgacccatcaatttcactcctaggtatttactcaagagaacttagtgcatgtgtttacagaagcacatatatgtgaaggtagacagcagctttattcataattgccaaaaattggaaacaaacccaaatgactgtcaaggtgaatggatacacaaattgtaatatatccatgcaatagaataccctgcagcaattaaaaggaacaaactatgggtccgtgcaacaacatggatgactctcaaagacgttatgttgagcaaaataagccagttagtaaagtctacatacaatataaatccatgttaagaagttcaaatcaggtgaaacaaatctatggtgttaaaagtcagaatgctggttgcctctgagggagggggctattgactgggaagggcataagcaaactgggttattgagcctggagaagccttctggagtgatgtaatttttctaagtcttgacttgggtgatttgcttacatgggtgtacccatatgtaaaaattcaycaagctgtacactaagatctgtacactttactttagataagctatacctcaattttaaaaagtgttcaccaccagggcaatgtgcatctgggctgagtccagctgttccaggccaccactgttgagaagagtcaatggcccagatgagggtctgggcagccctccctcagggccctaaggaaaatgagcagtcattgggtgacagcactaactgcggctcagggtactccagggaaagagaaaagactgttaaggcagaaaagaggtgtgtctggtggtcactgctgaggcctgcaaggaaggctgatccagtgtggaccacagcagggtctcagagaggcaggaaagaacctccctcatcagtgccagtggctcagaagctggaagaactgcacagctgtgggcasgccagtaggcagtgatccagggaatggagacccaggggtcttcttaccaggaagtgaacatgtggaggagcaaaaagagagataccctgtgaataaagcagctcctttctatttttgaatgtgtacagacattatttcatttaagtctcacaactctgtgacatagcctgtattagccccactttgcaaacaggaaactcaaatctgagttcataagataccttgaaggcctgcagccagtcagtgcctcattcaaacccagggcttggggcccagaacctgcaccccagctactacactgtctgccagataacgagtgtgaggacagcttattcaacccatgatgtccgtcacacataaactgcctgttttttcaatgtctgtccccatctatgctctgctcctgagtcaaaggcttccttaatgtcacctctgtccaactctgtaacttcataatttcagttattaaaatgggataatccagttattaaaactcagcctcatttgttttaaaactccaacttcatatactttttaaagtgttattttgattttaattggcatataattgtacwtttccatgatgtttcgatacatgtatacgttgtataatgatcaaatcagagagattagcatattcatcacctcaaacacttgtgattcaaatctttcttcctttcccaagctcaggctcacctgcagttctagggatctggagctgggaggtggtgtgggccgctccctttgctgttccccaccccttccccatccttctgtagaggacggaagctgtctccttaagcaagagcatgcattarttgacgtttggtttctgatggttgtcaccactgatccatttcccttgttggagcccctcactcccatgacgcatccgtggstttcgtgtacctgtgagacacatctgaccttcacttggggcctcttcctatgctcctcaatctagtaacgcttcagccccagtctcctcttccttccttagactctaatgctggggctcacggcttggatcagattcatcttttatatctctgaggcctgggaacttgagggatattgtcttagttctggttgctataacaaactgccataggctgggtggcttacacaacaagcatttatttctcacagttctggagcctgggaagtccaagatcaaggtgctggcagaccacatgtctggtgaaggccttctttctggtttgcagatggtcatcttcttactgtgtcctcacacggcagagagcagagagagaggaagctttcatttctatttgtaagtgtactgatctcattcatgaggactctaccttcatgacctaattacctcccaaaggtcgcacttccgaacaccatcacattgggggttaggatttcaacatatgaaacgaagcagtgggaggacacaaacattcagtccatagcaggtatccttgcccctctcccccaacaccagccacagtgctacttctccctggtacactttgcctgatttgcaagcacttggacaggcagggagtccagtggctaatcaaacaaccgggaagaagatgccagtcttcccttctggaataaaatctgaactgtataagcaagtcttcttgggacttccttcctcaacttcaatttttaacaaaggagtccctaaggaactgtgacaaaagagcaccaattccctttccctcccagagtggggagaaacatgaccgatcctcatgaacactatcttcccatcagaggcaacctcctcctcctcctcctcactcacttccttttttttgtttttgttttttttttgagacagagtcttgctctcttgcccaggctggagtgcagtggcacaatcttggctcactgcaacctctgcctcccgggttcaagcgattctcctgcctcagcctcctaagtagctgggactacaagtggctgccaccatgcatggctaatttttgtatttttagtagagaagggttttgctatgttggccaagctggtttcgcactcctaacctcaagtgatcggcctgcctcagcctcccaaagtgctgggattacaggcatgagccaccgtgcccagccctcctcctcacttccaatcttcctttggtatctccaggatgaaagccccaagccagttcatccaccagttcatccccccttctgcctagaagggggccttctttgaagtaagtgctgaagaatttagcaattttattatcagcaatgtctctacctgaggtgttatctctgaactactaggtaacctctagggcaagtaaatagttcagttcaaactctcaccaactcagttacaagtttgctcctgaaaggcctttattgggaagcccacattcctgcatgaggtagtgaggtggtttgcctccttttaatacactgttcatcatgctacattgcttaggaaaggtcagattcgtgaggtttgtcatggcagaaaaatacttccagaacccctaggaatggtggctgcacaaagtcactcatgtagggatgattgtgcttattgatggggatctgcaggatggggattgatttttctcacttgtctcttggggcttatggagtgctcatgagtactattgccacatgacaaagcacaccaaacttagtgtcacaaaacattagccatttgattatgcccacaagttctgtagcccaagaatgtgaaacagacatgatggggatggattttctcttcacatgttttgggcctcagctgggaagattaaaacacagagggcaaactgaggctccaacttccatgtctctgatgcctgggctgggtggacttgaagactgtcactgccaactggagcatctacatgtctcttcttcactggattgcacctccttacaacatggcagcctcagagaagctggacttcttacgtggcagcttagagttccaagagtgtgtcactgtattcccaaatcacaggccttccaagactccggcggggagaatatgacttgggagctattgttatgatggccgttctaggaaaacaccctgccatgggagcccatgcctcttttccagcctcgaacatctcrgattccaatagagccaggtgaaagggcaccacgcctctagacaggtgcatatcgactaaaagcaccaaggacaaaatcactatactgcggaaatattgtttattctagagagtgaacaattatttaaggtgtctaaagatatcaacagcaggrgtggttgtcctgtcctatttttcaagagtacagtgctcacagagggaagcatttctcatgggccatttgttgcagtgccactaagccgtacctcagggataaagctgtctcaggatccagggcaaaattaaaaatttgtgattcccacccaaaagggcaaaggcacctcagagcatcgtcatcatcattattttttatttttattttaaggaaatgaagtctcagacatwttgtccaggctggaatgtagcggctattcacaggcatgatcatagtgcactacagcctcaaactcctgggctcaagcaatcctcccatctcaatgtccggagtagctgggactacaggtatgtgccactgcacccagcaggacattattttgagtgtccccaagtgggacagcaaatgtttgaatctctctggcccctttgggtgtggtgaccaggatgggccatccattaaggtacatggggctggggttagagaatagagcttctccctatgaatcatggagttgccaaaactagaaagtgaagttcagccagagaagaaatgaggtccaagcaaccacatggaggttccagagaagggaggagaactagatacagaagttgtgactgagtcaggcatttgggagataaagaattagtttgagaggaaatggaggaagggtcttgtattatgctgtgctgttcaatgaggtagccagtagccatgtgcggctatttaaatttaaatagctaaaatgaaataaaattaaaaagtcagttttcagtcacactagccacatttcaagtgctaaatagctacatgtgtctagtacatgctgtattaggtggcatagattatagaacatttacatcatcacaaaaagttctactggacagtgttgactctataacaattgcctagagcaggcagcttttttcatgaaccagccttagcatgatggcggatgggaaggggaaggtggggaggtagtcaggagaatgtaagcgttcaagagtggatttgactttccaaaacaacccaragtcatctggagccaagtcataccctggatctggcatcctcatgctcaataaatttttgatgattaaataaataagtgcttgagctgtacagtatcgtttggtggggrwaggggkggggaggagacagaggcctctacaaaatagaggggctaaattttcttgtgtagcagctcattaamtaaatgaaagacattctaagaggagcttcagaaatgttttgagtagtgtcagcaacatcagaatgagtataaagcctctgaacataactaccttgaaagggaccacattcaactagctggctgtgttaccaagattaagacccctagccactctgggcttcagtttcctcagctgtaaaatgaagaattaagactgaagaccaaacccagctctttctgtgtgtctgtgatttggttatttaaactctattattatcatctttgttaaaagagcttttcttgtcataccacaaagctactatgaaagcatcagggagagcaaataggtttcatctcatgagccagttttgattaattggtagtacttgcttggaaaactctgttgggaagagttcaaggccaagttcaagcttagtgataggagtgtcctggttgattagtaatgtctgccttggggatgggagtggtggagcactgggacacctaccatcccacctttaggcactgccttacccaacacccaagcctaaatgtttactttcttagcctttcttgcaattaacagtggccatgtaacacrattcctgtctagatgtgtgttagcggctatggcagccatcttgtgaccaggaggaagcttctgagaatcacagagatgcaacctctgaagctgccaaaccactgccagcagctgcctaaccactgccagcagctgcctatctccagacatcttggtaggtgagaaaaataaccccctattcatttcagttcccagaacttgggatttctgttactttcrgctaaaggttttctggatacatcccagatcacgcatctgcctttgcatgggcacacataaatggtctttgctaaatttctactacttgtccttttcattcaacttcttagtgttcagaggtgttcccctttgtctcttctctgggattttgaatttatgctactctgcttgaggaagctctggagacatattccttaatcacaacattctgtgaatattgaaagcctgggcaatggaaagaacattggccagaatgtcaggtggggcaagttccattcctaccactgtcactcactgtgtgtactcagacaagtcacttggcctcccaggacctcagttgcactctgtaaaatgaaaggctggattataaaactttcagaatctctttttagctctaactcctatggaccctgattgaaatggatgtagacatgtttgtttttccttttgtttcatgcttttccttgggtaactgcacattttaccttcaataggtacacattatgaaaatccaccttgtcggtgaagtatagctctttcttcatgctgaagcaatagttctttggcaaggaataaccaaggagttttgggataagacaatcgggtcagacacatggctccatctcagaactatcttgacacatctgtctctctctgcctgccctttgcctgcctgaaatttgatattcaagctatcctactacctggatctgggaagctcctccatgttttggatttctgcatgccggatttgtcctttctcccctggccccaactccttccctatttattttcacctctaataacctctgatctttcctttgtgctcaacatttcttaacctgaaatctgtagggtaggccctgctctaaccacaggcccaaggaaatcaatgaaaacaatagtattgcccctatatagagactaagatctgtgcctgtaagcactccctacccttccccttgtattcagtcttagtggctccagacccctccttgttaatgagaaatcactaggatccttgtgacatggtctgcctccctacccaggttctcagaggtagctagccacatgcaatcagatgcattaagtagctgccttgtcaacatgcagcagccaagaaaagtcctttctaatcatacttcctgtggactttgagattcaagttccattaggtactccaatgatcccagcaatgtgataacatttctatagcaacctcctcaggttcatgcaagccaagcactcaggcaccttggttccacctctgaggcatgagtggactgcttatctcctgacttttaaacacctatcagctgtcccaacacttgtgtaaatttgtccatttgctactagccaaagatgagaactgagcttgggaagtcatgggggaagagccataatgcataactcaatttatcctggttgcaaaattaatttaggtgaacataagtctacatggcaattaaaagactgcacactctgagtgggagatttcccatcttagtggagagcatacatgaaattttgcctcagcatctgatctgtagtccctgctctattcacatgggcctctgctcatatgtacctgttgtctggctttcagacctgtgagtgcttgcttgactttcctttaaactgtagattagctatctggatttctgatctcctgtgttagctggcctttagtaacagcatgctcttttatgcttgcgtacttgtacctctgcactattgcatgttgtggctctaataatatatatttgcttactgtttttttttttttcattgctaacatttccatggagtagccctgttctctataacccatcacccaggataatagccacagactatgatccacatagatattttggacaattttcaataacaggctgacaaatgttaatcttagaagttggttaacatttcagaatactaggtaaactctgcattactgcaaacacaaggtaattagttttcctttagcttaggttagctgaatcaatctcaaagaatagaaaaaaaaaccacgaagaccattcacactttaaagggtccccctcagctgtcctttacctccttccctgcaaccaacagtctcctatggacatgggatctctagcattctcagagcgtctgtaggaagagatggagttatttatgaacactgtgcatgattacatgactgttacaataattcatgtggagtcatcaaatggatgcttaagccttgctaaatatatcggacggaaacttttaaaaatttgaaacacaattatgcaattggcttttgaggttcacattctgaaaaggcatgtatttaaagataaggggagtttctttctggcttggaaacttaccatctctggctctgaaaccattttagaagccagatgactctgcaagttggaaccaaacaaaagagatgagaaatattctgctgtgagcaagtatttccttttaagttatgaagaaaggcatttacttcagttcttatacaagatttcttgtgatattttcccttcccagattaggttatttcttctgctaacaagctggataatgtcccaaaacaatctaaattactgaacttcactaaattttggaaaatgctctaacaaaatctcatcaacaccttggctactgtcaaagttcccagattctagtcttgtgtatgccatttaatgtctttattagcatatgtgtataagaataatcatgatgatagttttaatctaatactattttccttgtcatgacaagaactgsttaatgtgcaaaataataaacatgacttcacacttgctgcaaaaaatagtgaaaatctgcatcaatccagaaccacacaccaaatgatagtctgagttgctcttcctaatatgatacatttttaaaccatacatcctgaatcactgaaatgtatgaaaccaatgattacatttgttggcctgggaaaattcaggacaacgatctgatataataataataataaaaaagcatttattttacaatgaacaagttttttcagaccagaattttaactagtgacatttctcaggcagcagtaatgctattgccatggattttccagagaacatttcacttcactgttatttataacttagctcagcctctttctattatttatatttaaatgtagaaagaaatcttttcctgttcctatttctttggatttttcttttcaacacccacacaaatccatgagtcataaatgagactatgaaaatgaatggttccccatcacagaagaacactctttggctactcatgtgagtttagatatagttgtcaaggtaggttcaaactgcaaatgaaacaatgtcatgtgaattctactcagaaaaaacagaaattagggagttggcatattgtccttatattttaatttaacacaatagattttttatacaaacacatccttttctgaactctcacataaatactgtaaaatatgtataagtagtagaatgggatggtaagaacccagcttctaatcttagctctccacttcctgattaggtgaacagctaactgtggccatctgcaaagcagacaatactgtctgtctagcctccccagcaatgttgctaagagggtctaatgcataaaatatgtaagagtgttttgtaaacgataacackccatcacaattttaagatatatttattaccgtttctttagctaaattaattgtatgggcagaagaatgactaggcagtggaatgaactgacaggcagattataaattcgtctactgctgcaaacaaatttaatgttaaacttagtccccaaggatctgataatgaatttggtcctgtaatacaaaaggacacaattgatcaccataagtcaagtccaattcaacctgaatgatccaatgatgagtaagtgacaaatgtccaatatagagagatgttattgctttttgcagttgaactcagtttcatttttatccaagagtgaactgcccctgcaaaactccatcttagttattttgcatatgagtatgtaccaaatgttacaaatgttattcatcaccctttataatagtgtctctgttttagagatgaagaaattgaaawaaaatttttttttgagataaggtcttgctctgttgcccaggctggagtgcagtggcctgatcatggctcactacagcctccacctcctgggctcaagggatcctcccaattaagcatccctagtagctgggaatacagtcacatgctacaacacctggcttttttttttttgtagagatgggatctcactgtgttgcccaggttggtcttgaactcctggattcaagcaaacttcctaccttggcatcccaaaatgcagagattacagacatgagccaccatgcccagccttgaaatcttagaataactttattattatataattataatagcatataattacaactctgaccaaagttttatgaattaaacaaagttgtaattatatgccattactattgtatttgaacaaaaattgttagagtatttgaattgcatttttaaactttttagctgagctaggtttaccaaacataccaaagggtgtaaaacatgaaaaaattcaaaggataataatataaatggtaaacactccaacaatattgaagaatatataatgaaaagttagtctctctagcagggcaaacactcacgtcacccatctcacttccttccaagaacatactctaaccaatccggtgtgtctatgcttttagaattttttgcatatataagcatttatatatctattcttttaaaaacaaaatacaaagggtagcataatatacttgctattccacttttttttaatttaacaatatatcttggaggtagttctacatcaacttatttcatatttggacatataacaatttgtttaaccagttccctacttatgagcaatattctgctgttaccaacaagggcaaaatccttgtacatatatctgcacatattttaaaaggaaagaataaattgatactctaagacttattgaagtacaaatkcattacaagtaaaaatagaaaaaagggattatccataatttctttaagtttgaaaaaaatcctctgaattattttttaaccagatgagaaaaacagaatggaatgccatagcttaacttaagtaaatttgaccctrtgctgataaacatttggatgttgcatatgatcacccaaaagtaaactactctgcagccaacttcaagtgacactctagtgtttagacaatagtgaacttcccataaaaaataaacaaagcaaagttaccttcagcaaatagaggagatgtatgtaagaagatgatattcagctttgctgcattaaaaaaaattggagaattttgctatttggacttggtttgaggagttgtttgtggcaagtctcaggacataatataatttcacaaaaatggtgccatgcaggtcattttctctgagacttccagggaaggaaaatatagccctccaaaatgagatggggagattgcctttcccagaggccccactctcaactctgcacgtcaggcccactttggtggtgccaaggctaacatgagctggtttggagataaaaccatcccatgtgcccatacgatggagaccttccagagcattgtcaycacacttgaatctactctgcaccactccctgagatccaggagaagatggtctggcaaatgcttcccttcacctatggctttatttgtgcctcagtttcccttgcattttctgcattgttcacctaatatcagtctttttctttaatggatatattgtttatctagcttttcaggaagagatacatttgcttaaaaatagattgtcttcattattattccagttaattccaggatgatgtcaaaagcagtcctgtttgctagtggctgtgagaaaccctgtgtctggtcctgctgtgtgacttaccaatgtcctcctcatctgaaaaactggcatcccagagtttttggaaggagcagacatgcaatgtggtttaaaatgcgtgtaagcgactaaaatttatggatcactgtaaaagtgtcagccatcctagtgattatttatcttatctctgtcgcttttatggctatgtaggtcctgaggccggatgggaagggagttctctaaagatgaattacacttaacgcctctcattttctctgcagccaaaccagtgtgattgcataatgatcctaactcctttcactggcttaatggctacatttccttccatggatagagatttgggggatgaatgttttttacggatctttccctttggccatatttccaagttgtaatcccttttagggttttgttaggattatctcaaggaagatttttaatgtccttgcttgccaacgtcctgttggcaggaggacgcatcaagagtcagccagtcctaaaactctactgccaggaaatgaggcagcagttaacaggctaggggagccgagccacattcaatctgcatcctgctccgcgtctgacaggctttgctccttctgccgacttaaacaatatattgttttcttctgatatagaagtgaataagtgcttgtaaataattcaaacaatccagagatgtataatttaggaattcaaagtcacctattattcctttctcataactactgttaacagtttgtggattatttctctggatttctttctatacatatactaagatatgcattcattttctaaagtgggaattagagtagacacaaagtttggcatcttacttttacacttaatactacatatgagactttttcctcatctttaaatgtatctcattcttgttaaaagctgcacagtattgtatggaagtaacacacattaattggaatcttactaaagaatatttgggttgtttccaatatttcaatatcataaaaaggagtaaaataaatatttttgttcatatttatttgcaggcttgaccaagtgttttggttggataagttcctagacattgctgtatactcttaaacaatgttaaaattttaattgcaaaatatgacaaaataagctgtattctattactggagtaagaactgttgcgtgaagaaaatttggtcaaaccaaagtggaaatttaattgccgctgtaacagtgggatatttgagaagtggttaggccatgaggtgctctgccatcatcaatgtattaatgcctttaccttgggagtgtgtcctttataaaaggatgtgttcggcccccttttgtctctctctcccctctccctctttctgcccttccaccatgttatgaggctgcaagattttcgaggtgccagaattttgatattggatttcccagcctcctgaactgcggttcaataaatttctgtttattataaattaccctgtcttatgaattctgttatagcttcacaaaacaaactaagacatgtatacaggtgctcaccactctcttctgttcacttgtctttttttttgtgtgtgtgtgtttttwtttatttatttatttatttatttatttatttattttattgatcattcttgggtgtttctcacagagggggatttggcagggtcataggacaatagtggagggaaggtcagcagataaacaagtgaacaaaggtctctggttttcctaggcagaggaccctgcggccttccgcagtgtttgtgtccctgggtatttgagattagggagtggtgatgactcttaaccagcatgctgccttcaagcatctgtttaacaaagcacatcttgcaccgcccttaatccatttaaccctgagtggacacagcacatgtttcagagagcacagggttgggggtaaggtcacagatcaacaggataagaatttttcttagtacagaacaaagtgaaaagactcccatgtctacctctttctacacagacacggcaaccatccgatttctcaatgttttccccacctttcccccctttctattccacaaaaccgccatggtcatcatggcccgttctcaatgagctgctgggcacacctcccagacggggtggtggccgggcagaggggctccccacctcccagtaggggcggccgggcagaggcgcccctcacctcccgggcggggcagctggctgggcggggggctgacccccccacctccctcccggacggggcggctggccgggcgggggtctgatcccccacctccctcccggacggggcggctggccgggcggggggctgacccccccacctccttcccggacggggcggctgccgggcggagacgctcctcacttcccagacggggtggctgccgggcggaggggctcctcacttctcagatggggcggttgccaggcggagggtctcctcacttctcagacggggcggccgggtagaggcgctcctcacatcccagacggggcggcggggcagaggtgctccccacatctcagacgatgggcggctgggcagagacgctcctcacttcctagatgggatggcggccgggaagaggcgcttctcacttcctagatgggatggaggcsgggcagagaygctcctcactttccagactgggcagccaggcagaggggctcctcacgtcccagacggggtggcggccgggcagaggctgcaatctcggcactttgggaggccaaggcaggcggctgggtggtggaggttgtagcgagccgagatcacgccactgcactccagcctgggcaccattgagcactgagtgagccagactccgtctgcaatcctggcacctcgggaggccgaggctggcggatcactcgcggttaggagctggagaccagcccggccaacacaacgaaacctcacttttctataaatgtgaaaactatccaattaaaaagctgaaaaaaaaagaaccaagataattacccaaaaccatatagtaagtcctcacttaatgtcatggataggttctaggaaactatgaccttaagcaaaatgatgtataataaaacaattttttccctcatcagttttataacaaatcacattgagggaaacaatgttattctaggactgccgtatgtcactttgcttaaagtcacagtttccaaggacctataaggacattgagaatttactgcatcttgctttaatttgcatttctttcgtgaacgaggttgaatattctttctcattttcatttactaattcccattttaattatgtgactgagctgatatgaccctttactcatcagtgggggtcttaattgtttcatatataagctctttgtagatattgatactaaaatcctgaaactcattattgcaaatatctttttctcaaactattttcctgtaatattggaaagcctggctctaggctggcccacttttctctgatctcctccctgagtgatcttacccggtcccatagcttaatggatcatctacatgctaatgatttccaattttagatctgtaacagtgacttctctcgtgtcttccagcaacatcccaaaggtaatgacaaccttgtgccctgacattggtttccaaatatccttcccaagtaaaatgaactaggrctccatggagaaatggctgatttcatggcagaagcaggaaaagtaaaagataaacctagaacgtcttgttgtatcagaaagtaaggatgagttcaaagaatgatgaaaatttgtcaaagggacacagaaaccagcttgaaggggctttcggtggccaaatctagaacaatttgagcatcaaaacaaataataaatgatagtaatggggcaaaataagaatccacaagtccacatgatacaaatcaggacttggcttttcctacaaagggttggataataaatattttagtcttgataagccatacagcctctgtcacaactattcaactctgccattgtaacacaaaagcagccacagacaataggtgagtgtgtggctgtgttccaataaaactttatttgcaaaaacaggcagaagtccagatttggcccatgcatcatagtttgcctatccttgcatcaaataaacaaatgaataaataaacagagaggacagaaagctcttaatcatagcagaatgccaactaataaacccagaggagtgttggggtttaaaaagtcacaatgtggcagccatcatagtaattattaattcaggtagacatatcaacagatgctaaaaaatagtgtgtaaaagaaggatgagccaaggtggtgccattgcactccagcctggcaacagagactttgcgagaagcagyggttccaaatcagcgtccagtgaagggtatacatggaattgaggtggaggctgcagtcttagcagctatggaaggggggtctttggtctgcagtgtggcttgggtattgcaaggctggcttcatgggcagtagtctctacagtcccaactgccctgcacttagaagggctccacacttggtttaatgctctgctattcctgtcttaaaattcttaataaatttgaacaatagacctgcaaattatgttaactggtcctggggtattgatctgactgtagtttggtcctgactgaggaatctaaacccagtccttcagcccttctagagacttggggagctacccaataccactggtgtgccagggcaaatgtttaacagccagtagcttctttgaggataaaaacaaatacaaaccatttgacttgaagtgtctgctgattcctgcggtataaatatgctcaccactgctgagctcaagctaccagtgtaacgtcagtcaacatgaagctggaaagaaaaatacaacagcacattgctatatggtatttccaccacacagacacaatacatgtcatagcctcgacagtatagatgccaataaaatctagaaagatatttaagaagtgatgagtttcgagcatttattatctttgattttgatataatttatttaattgtaagtttactttttatttatttattttttgagatagagtctcactctgtcacccaggctggagtgcagtggcacaatcttggctcacaacaaccttcacctccaaggttcaagtgattatcctgcctcagcctcccaagtagctgggattacaggtgctcaccaccatgcatggctactttttttgcacttttagtagagacgtgttttcaccatgttggccaggctggtttcaaactcctgacctcaagtgatccactcacctcggcctcccaaagtgctagkattacaggtgtgagccaccacatctggcctaattgtaagtttataaatttaatttttttttctttttttttcttgagacagagtcttgctctgtcacccaggctggaatgcagtggtgcaatctcggctcactgcaagctccgcctcccgggttcaggccattatcctgcttcagcctcccgagtacctggaactacaggcacccgccaccatgcccggctaattttttgtatttttagtagagacrgggtttcaccgtgttagccaggatggtctcgatctcctgacctcgtgattcacccgccttggcctcccaaagtgctgggattacaggtgtgagccaccgtgccaggccaaatttaatttttgataatggccatgtttarcaactagctcacagaattcttaaaaatttcacaattgactcttgtgagccagtaacaagccagccccagcacatgactcctttctccttttaatgaattacttttcagtttaagtcagccagcgttagtttctgctgcttgccatgaaaaaccctgagtgacaggagcaagaattatcaaggtgtgtgcaaggtgtaaccaattatcctatgttgcctcctgtttcctgttttaattctctcactagaaacaggaaataggaggcaacacaggagactgacatgaactacgaaatcccataattcctggcctgctgatgatcccatggagatagggtctgctgaggaagagagagtgggagttatcacagagtaaaggtggtcccaatgctgggtatagcctggttatgtgttaaattctggggttcacactctaactgcttcagaaccttgaagacaggagaggccagttagttctgagtggggcagtctagaaaagcctaagaaaagagattagatttgagctggctttgaaagagtgataggatttgataaaaatttggcttccatttataaacgtgggaacatcttggaacctagctgccctaaaaaagcatacccttgttaactaataagcatttttttggtcatagaaacctcaagaatataaaaatgtgggcgaggaaacttggaaaactccaaatttgttctttctcatgaagtccctgttacatcagccaaataatctcagctaaaatttcttgatacccaataataacttctctttgtgtagcagtcctaagagacagagtctgttatcattcccattttacagatgagaaagttgaagcacagaacttaataatgcattgcaagtcgcatagwtagaaagtagtggcgctgagatttagcagaatggctccatagcttatgcccttatcccgcatgttccaccacttctccaaatgttggctttctcatctataaaactggaataataatacctgcctactccatctcacagttgtgtgaggatcagatgagataagacatatgaaagtgcctcaagaaggccatgaacagactaaagacatggtcacagtcatmcatgtttaaatgcaaatggaaggaaacgcagcaatttcttgttaatccgtttacagctttcattctgcctcctgacatctggatgatgggcttcttgcaagcccatatttcttcccaactgtggcatggaaaattttttcacacaccacatcccaactcaaactttaacttgccaacatcatgatgtctcccatttgaaacaacctcctttggaaacattatctcctttggataagtgtttagcctttctgatgatctcccactttaaaatgtacctgggataaggccgggcatggtggctgacgcctgtaatcccagaacttcgggasgctgaggtgggcagatcacgaggtcaggagatggagaccatcctgaccaacatggtgaaaccccgtctctactaaaaatataaaaattagctgggcatggtggcgggtgcctgtaatcccagctactcgggaggctgaggcgggaaaatcccttgaaccagggagtcagaggttgcagtgagccaagatcaagccattgcactccagcctggtgacagagcaagactccgtctcaaaaaaaaaaaaaaaaaaaaaaaatgtacctgggatttgtttgatcaggtatggtaaggtgactggcatggagacaattgccttgagagaatagtgtattacttacacttccccagaggaggagggatgccatgccactcagggccacgtggggaagcaccagggttggtaaaggggcagaaggagtgagataaaagcgtgggccagagtctttattgcggtttttgcacacaataaatatatatgctgggaggataggctgagcacatttaggagtggatggtaggctgaggcgggcagatcatctgaggtcaggagtttgagaccagcctggccaacatggtgaaaccccctctctactaaaaatacaaagaaattagccaggtgtggtggcaggcacctgtgatcccagctacttgggaagctgaggcaggagaattgcttgaacccgggaggtgaaggttacagtgagctgagaccgcaccattgcactccagcctgggcagcaagaatgaaactctgtctcaaaaaataataataatagtaaataaataaaataaaaacaagtaatatactttccttccccaaatcctctccaaggtaatatctgggaatatagatgattctagattcatgagtgtcctctacattcttagtggtctgttgctgattgtctgctctggacaggcccctaagcaaatgcatacacagatccctgagtggatgcatggacaagctcctaagctgatacatggtcagattccagagaggagatgcatggatagaccccctaagctgatacatggtcagatccctgggcagatgcagggacaggcccctaagcagatgaatagacagatcccaaggcagatgcatggatagacctctaagcagacgcctagacagatccctgagcagatgcatggatagacctctaagcagacgcctagacagatccctgagcagatgcatggacaggcccctaagctgatgcagggtcagattccagagcagatgcatggacaggccactaagctgatgcagggtcagattccagagcagatgcatggacaggcccctaagatgatgcagggtcagattccagagcagatgcatggacaggcccctaagctgatacagggtcagatccctgagcagatgcatatacagatccttgagcatatgcatggacaggcctctaagctgatgccctgtcagatccctgagcagatgcacggacaggcccctaagctgacgcatgcagaggggcagctggccccattgggtcttctagagcatctgatggcatgtatttgaagcctccagctcagccatttgcctctggctgtgaaggccccaaatgtggtggcttttgtccgaattccagcatctatcagagactatggaaaatctctatgctctacgtcaacaaagtgtgctacacagagataatggagaaagaatatattggtttgatatttcagaatattatttgcctttgggtcccccattcaggtgtgggtgtgctcaaaggcaggcatatgcagtcaaaaagggtgagctggggtttacttcatgaggatcaaatgacttgttgcctcgatttgcaaaaggaaggtataacatggatattaattgtgaaaagacatcatctaaagtctctggagagatgactgccaaaaagaacgagaagatacatgacctgagatggtttttaatggagcgaggtattaatttggtccaactgaagttcttaaagtcaaaatgaaattatagccaggccacattgattggcccctagccaaatccacacctcggaaggaaccttgctgttccagaagatgccaatttgctaaggtcacctgtttcagtagaaagcaggaaaaggatgtggtagcagcatatcagaacctcatcttatgagcttcaggtttaaatccctgatagggaagaaagtatatttattgttcttgcagctgtaacagattttaaaaagaaataaatggaaagggaatgatttatcttctgtttacagcttgtgaaatggacgtctgtttttactgacctcmtcagctttcattccctctccatttcttcctggaccctcactctccattgagcacatcctcagacagactggaaatggaggtgtccaattctccctggccaaggtaggggcaggaggggcagtgtaggcagactctcctttatctgtgctgtagataaaaatattgcagggaaagggatgcagagagctggggtgggagtataatttaaaagatggtggtcaagaatggcctcactgagatttagaatttacctgaggctctcccccaaaataaaccctgctctacccacagtcttcctcatctcagtagatggtttcaccaccctttcatttatgttagtgaaaaagtaaacaaacaaaaatgaacaacgtggaataatcactcccattctctcacatcccacatccaatcagtcatcctcacatcctgtttaccttctaaatagatccagaatcagactgtcccttccctgcacagctatcagactgatcgaaacccccacatctaaatggtctctctgctcctgcccttacatcctgtcatctattttcagcaccacagccagaggaacctctacaggtagaagtcagttgatgtcactcttttcaaaaccttckaaaagctccccatctcactcagagagaaagcagtctttatcatggcctgcaaaaccctaactgatctggcttcctattcacttctatgaccacatttttggttatgttcccctttcctcattcttctcagctgcctggccttctgttaatcctcaatgtctctgtgcaatcttatgccccagggcctttgcacatgctgttcatagtttcagatattggatggctcacccattcaattccttgaagccttgtgtgttttctctggacttcttcagctgtgtgggcacaggcacagtaggcagagagctgaggttgaccgtgggatttaaactggataaagagagcagtgaggagaagaggggctgagagacagttaaaaggcagtagggtagatgaattatcagctcagtgaggtactggaaagaatgagatgtgttggggcwcagattgtgatactgctaagtatggcaccttagcatgctgagtattttgaactgaaagagactgtagagtttcagaggcaaggtccctctgaccttctcctgccctcctgtgtctcacccctctctccctaattgagtcrtagaaaccagaactcctgttctccaaagctgaccatagcaactagaacccctctctccaaaatcaagccatacaayctaaaaggtgtatacttgaagcctgcagctcagccatttgcctctggctgcaaaggccccaagtggggtggcttttgttctaattccagcctctgccagagactatggaaaatctctatgctctgtgtcaaccaagcgtgttatgcagaggtgatgaagaataagaatatattggtcactctctcccttctcccttgaagaccttcatgtaagagatgttctgtcctattccatagaggagggaatgctacacagagagaccaagcatctgaaaacacaggccttgctgggtttccccctcagtctattaccattagatcatacctttttgtctaatcacacttttacatggctatcsgttcttcacagactctaagcttaaacacagaaggtttttcctaggtctttgggtcttcatttctgaagcctcctctgtcacagaaaaatgtgattaagtaagtttgttatgcttttctcttgataacctgtcctttgttatagcagtgttgaccatgtcccttatcatgagtgaggaaaggtatcaccccttactgcccctacagatagaaagataggaggtggtgttggaggacagaatgcttgggattaagattagggaggggttgttgttgaaaatgcaaaatggggatatgactctgaaagggagtagccgaggttgggttgggaacaggatccctggatgrgaagacaggaactgagaagctaagactttgagaggatcatctttgtggatgttgaaatccccaagaattaaggcaagagtagggttggagagagtgacagcgagctagcagctagaatcatctcgtggggtgtgttccaagagctggggaaaactgcaatgagtagaggtgtggaagggcctgccagaagacctgagattcaaagatgctggaggatgcagcaagtcagaaaggagagaggcaagaggatctcccattcccggcctcagggccagtggcatgaggcctggtgggggctgcaggggagcggtgtcctcaggacagctggttactgttagagcaagaaggcaaggactgcatttagagaagaggctggggatagacagagttttgctgatgactgtgagtttccaggggatggctttggtagtgtgggaatggggaggaataggtcaggaaggtttgaggttcagagtgtgggaaagggaggtggtctgagtcctaggataaaaggcaaaatgagatgagtaacagtggtaaaacccaaattcctactgcagctgcagtgactcagcgaatcaactagttgcctgtcattacgagcaaaaataacatttaaaagtataaaagaaatacatgctcctggaaaaaaaatccaaataatttagaaaagcataaactggaaaataaaaatctgcctctccctcccagtcctacccccagaagtaaccactgttaacagtttcttgggtatccttgcatccattttttatgcatgtgcaagcaaaagcagtaggttttttatgggataattttatacagcttggtcttatccattaaaaatacacttgctatacgttgtcatacatatatacattcctccattctgctgcatagtattttattatatgcaatctatttcaccagtcttctgttgtcggccatgtatgtgatttccagttttttgccttacaaacagtgcttcagggaacattgttgagaataaatctttgttttatttcccattttatttatttgtgcttatttgttaatattcacattgttacaggtgttaaccaatgagcacatatatacatatacagtgttacatattgttcatattgttgcattgtaacatattcatactgacaaaataatgaaacatttctaacattaaaagtacagatgtaatacataactacatacacactactgggattgaatacctgttaatgttttaccataattgctttaagtcttcaactttactacgtgtggctaccttgcttttcaaggcagttgtactaatttatggtcccaccagcaattataagcattcacatttccccacatctctgacagcacatgatgttgttaaacttttgttttgcccgtctgttgggtagagaaaatcatattgcattaccttagtttcattttcctgtttcaaaaactattyaaatgtttcttggccatttgagtttccatcttyatgaataacctgtccttcacattctcctagttcttcctggcaatatgctcttccaaaaggatgtaggattactttgaaaaagttctatgaaaaaccatcgttttagctatagctctttgcatatttttccatttgttttagttatgtcagcagtagccaccatttttttttttgagatggagttttgctcttgttgcccaggctggagtgcaatggcacaatctcagcccaccgcaacctccacctcctgggttcaagtgattctcctgcctcagtctcccaagtagctgggattacaggcatgtgccaccaygcctggctagttttgtatttttagtagagatggggtttctccatgttggtcaggctggtctcgaactcccgatttcaggtgatctgcctgcctcggcctcccagagtgctgggattattacaggtgtgagccgtcacgcctggccggtacccaactttttggcaccagggactggtatggttctaggataaaactgttccacctcagatcatcaggcattagttagattctcataaggagcgcacaacctggatcccttacatatgtagttcacagtaaggtttatgctcctatgagaatctaatgccattgctgatctgatgggaggcagagctcaggcagtaacgctccctcgctactcacctcctgctgtgcagcccagttcctaacaggccacggaccagtaccagtccatggcctgggggccgaagacccctgctctatatmctttactttgcacagtctttttagagttgactttgtatcattttgtgtgtaaatattgtcaaaaataaatataaaaattttacaatcatggaagtctatttactcccmtacatgcttttgcacaagttgctacatgtaacacatataaacccatataattataataaatgttacaatttttgctttaagtattacgtgtattttaaaggaactaagaggaaaaaatatacatttctatatatccacatatagttactatttcattgctttttttttggcagagtcttactttcttgcccaggctaaagtgcagtggtgtgatcatagctcactgtaacctggaactattgggcacgagtgatcctcctacckcagcttcctgagtagttgggactacaaacacatgctaccacaactagctaattttttacttacttccttacttatttatttttgagagagagtcttgctctattgtccaggttggagtgcaatggcatgatctcagctcactgcaatctctacctcctaggttcaagagattttcatatttttagyagaggtggggttttgccatgttgcccagactggttttgaactcctggcttcaagtgatccacctgccttggcctcctaaagtgttgagattacaggcatgagccacctcgcccagcctaacttttttttctttagatatggagtcttgctgtgctgcccagactggtcttgaactcttggcctcaagttgtcctcccacctcaacctcccaaagtgctgggattgcaggcattaggtaccatgcccggcctttatttcattgctctttattccttcctagagagtctcatttccatctggtaccattttcctttagttagaagaaatttctttagcctttcttgtagtgcacgtctactggcgacaaattatcctgtgcattttgttttttgaccctggaactatattttgccttcattcttggaggatatttttcttggatatagaattctaggttgataggttttattttttcagcactctaaaagtatattccactgccttctggacctcgtaatttacaattcaaatcatcaggaacttcactcattgttctcctgtaatgtgctgcttttatatttggtttccagcagtttcaccatgatgtgcctaggtgtagttttcttcatatttatcttgtatgggattcactgaaataattgaatctgttaattcatgtttttcaccaaatcaggaaatttttcatccattatatcttcaaatatttttctgcctcagtctcacctttccttttgggactcccagggcatgtttctttaaccatttgatattgtcctttagagccctaagagtttgttaattttctgcatttttttctgtacttaagattggatgatttctattgatttatatccaagtttattgactttttattgtcatcagtattctgctgtggaattttaattttaatttttatttttatttctgcttgtgatttttaaatgtcagaatattattgtttttgaattttcagtgattccttttgaagtttttattaccctagtgggaatttttttttcatttattgggaagatatattcttctattttgttgagcataattaatatagatgctttaaaatccttgtctgttaatgccaaactttggataacactggggttggtctccattgactgccttttctcctgacaccagatcacatttttttcttttctgctcttcatatgtcaaatcttgaattgtgtcttgtacgttgttatatgttgtgtaaactctcacatttgttatatccttccaaaacttttgatgtttttgtgtttggaggcaagtaacttgactggactcaagctgcaaaccatcttttgcttggcagctcaagtttcagttcaattctgtctttatgtgagttgccctgagtctgccccatgaatgcagagagtcggatataatataggctcaggatctgggggttcccctactcagattctttcatttctgggattctcccctcattttctagtatatgcagctgctctaaactttttcctctggttttccagcccacaaaagctatgcttttttctatcagacttttagtactctgtgtaacactgacctcagactaaaagcattaaaaacaggtaaatcactttttattatttccttctttcaagttttaatttgctttcagaatagattaactcttttgttcactgttcagtgtcttcagatcattctgtgtgggtgtgtacaaacgtatgtgtgatattttctccagaggttatagttgcctgtggaagtcatatcaaggaaaagcttacttgtttacttgggcatactggaagcagaagccttcaatcttttttttattttgcatctttaaaattagaatatggtggaacatctttttatgtgtttgtttatatttgcattcctttttaaaatcaattatctgttcatatcctttggctattttttcttttcttttttttttttttttgctcttttgatgtgtagaagctcttgttgtgttaagaatactagctctgtctgtcacactcgtcacaattattttttccagattgttattttcttttgactgttcacttttaactactaggaagcttaaattttttatgtagtcaaatttatcaatcttgcctttaatgatttctggatttttgggtcatgcttagaaaacttttctccaccaaatactaaaataactacttttaaatattttaacactcacctatttaatctatttataatttgtcttagtataagtgtttagaaactgaaccagcttatttttccaaatatgtaactaattataccaatttgatttattagataatttatcttttcctcactgattttataatgccaactattttacttttatatctttattatcttcctgcattttctcttaaaatttatatttctgactcttttcatcagtgtatattctacttcttgcctttttttttttttttttttttttttttgagatggagtttcactctttttgcccaggctggagtgcagttgtgtgatcttggctcactgcaacctccgcctcccgggttcaagcaattctcctgcctcagcctcctgaggagctgggattacaggtgcacaccaccacgcctgaataatttttgtacttttagtagagacggggttttgacatgttgtccaggctggtctcgaattcccgacctcrggtgatctgcccgcctcagcctcytaaagtgctgggattacaggcttgagccaccacgcctggccctcttgcttcttttaggatggctttcatttttgtaatgtttatatctttattttctttttattgkcccaagactctgccatctcactcttcaacgattttgtcatcttatctgatcttatttgatctcttgaatttattctttgagttttatttcttccagagttcatatctattccaatttctttgagagcataaagaagtatttgtctgatattttcttctgtttctgaagtgattcttcttctgctgtgaacccttaatctgtattttgcttattctattctttccccccggcttctgccaggtttgaaccacattaatttatctgacatcaaatcccaagttgcactgatgcaggatataatacaagggatgagagtgcagcctttggagctgtaaaggctgggataaaatcccagctccaccacttaccagttctgtgaccttggacaactgagttggtatcacattatctgtcttacagggctgttgttaggattagagtgtttaatacagtgtgtggtacatagtactcaataaatactagggaaagataattctggttattattttagcaagagagctataatacttatataattttggtgttatctaattaatatatggacacaagaatgctaatttagtttttctttttggttcatccaaaaaaattacaaaatagattatttgtgatatttgttattatccaccaataaagaactatccccatctgctggccacactcaagaattaaagatcaaaagctgttcaaatatggttgttggaatatttcattgtgtagccactgtgacttgtagctgtctttgtagcaaacagcctctctctctctctctcacctacacagtcaaacagattagcatcttgtcacacagtgctgggtaattgttgatacacttatttagttggaggcaaacattcattttcatttgggaatttagatttgtctgagatgcaggctatatgtttcccttcttgcttagcttggctatttcataggtttacctttccaaatcttgaatctttgtcccaaaaaaggaatttcccctaatgtctttttttttccttcttaagactcactgcagtcaacacacagaatattcctaactaccatcaatgtttcacagaaaaaaaaaatctcttaactagtcattctctctcgtctctctctcttttatgaagatgttgtaagaattgctgataaatgaactgttggggagagttctattttagttctacctggagtcatttcagactgaataataaaggccaataggtcttgacctttgagttttggcctttctgagatccatgcatttcatcagagctttctttggggtacagaaaagtggcaatccagacctgactctttggggaacttccattgctgtgggtcgcagggattggctcagggcagtgactcaggtcagtgcagcaggaggagaagctgaagcagcaccagctgcggatgctgagaaagaccccagacctgcctgtggcattyctgcataattggtgacagcctgtctgcccttctggccttcttgttaccagggcaacagtgggcctattcctagctggctgagaggttgctaccctcctctgccttccaccctcacattcatcgtggcctcgctgtgtgcctgctcctaacggcctccagctctttctctatctggattcccagggattctttcctgagcccagccagaggacaaagggactctctcactctttattccaaaggatatagctcttactactttactttcactctgtaccccatacacagccttctgatgctactgcaaactttctccaccatcttctctccaacttctcccaatccgtctgctgttccctcaccaactctctgcatctcttcccactcttccccagcctctatgccttcccagccgctctcctggtccctcactctaccttcacagggcctttcttttctgtgcttttgtaatgtcttaggctgctttgtgcatactgatgacacaccctagtttttcattacttcttttccctttgtgttcctgtgacacttcgtttgcttctcagatagcccgcatcacagcatcctatcacttttgtgtctggatccttctagtccagactcaggcctcacagatatcagggaccgtcttcttcctggttgtatctccagttctaagaacagcccctggcatacagtagaccctttttgttgagcaaatgaatatttccgtcattccaaatcttcatttgttgatcaagtttctctgatgtttattttcttctgattttattgtccaaagttttaaaataactttcattttgaagtacttttagactttttaaaaacttgcaaaaatactacaagaaattcccatacacttttcagccagattccccacgttaacatctaacatatctacagtatgatgatcaaaacaaggaaattaacactgatgcaatactattaacatctccagattttattcaaattttctcaattttcccactaatgtcctttttctgacccaggatgcaaatccagggtcacacatagtattcagtttccacacctccttaatcccctttaatctgggacagtcccttcatctttctttgtctttcatggtcttctaactgttgaaggatacttgccaatcattttgtagactgtccctcaaattcagtttgtgtaatgttttcttattataataatcaagttttacatttttcccgagaatctccttctcagtgcatcacatcagagggtatatgatgtctatttgtcttattactgatgatattaatgttgatctcttgggtaaggtggttctagcagttttcttcaatctaaaattattatttttcctttgtaattaataagtatcatgcaggaatatataactatactggttctcatcataccactgattttagtatcctttgatgattctgcattgcatgattattattgtggtgttttccaaatggtggttttctatttccaagattttaaatggggcgggggaaatgattttcccgtggtgaactgttagggtccaatgccaggcatgaccctaaagcattctctaaatgagacttgagcatttcaagtagcactctgggtcacagatctctctaaacaacttcagtgtatggactgctccctttctcttttctcccccaacccccaaatctcctatttgtggacacaaataggctctcctgatgggatggtagtgttcctggtgagacaccaagaagggctatcacaagtaaattgatcatgacttaattattaattcatgcccttaaagtacatactgtggagattaatgctgcaagccaaaagatcctcggctcacatttttagaaccactgtcttaaaggacagctgcataggctaagatcaaggtagcatataataaaccaagacctaatgtctttagggaaaacacttcacaatccattatgagctacgtcatgaaatcaatgaccttgggatcttttctaaaacattcaagcacagagttaatgagtttagggaaggagttggaggttgcatgacattttaaaatgctaagacactggatccttgacagaatgcttgttagattctgttattccctgaagtatagggtgtttatgatccacaaaaagtttcaaatccatagacagtgtcagaaaagaaaatcttttcttttatcatgtttgcagtagctagtttttagtgtgaccaagtttgggttaattattccctgattaggaggtcaacttggtagaattctgaactgtgtttaggggactgcaaagcaggccaccagaattcctagctgtaggaggactccttgggaaaatcaggtaagtgtacactgggattcatagtcaagactgaaatgaagaaaacgtagcctgcctttgaccctgtgctggggtcagtaggctgctgaggcaattggagtcaccaaagcaagagagaatccaagtcatgggtctggttctagattgagtttcagtgctggaggagtctcaacaattgcccttcaccgcattccctacccagaaacctgggaattacagaggtgaatgaagaagaacaaaaggcctcagtttggctgagaaacaagtgacacttgagggaccaatcactgccctggctttctcctgtgtgagaacactgtaggcagaagctgaggatggtgtgtgctatggggatgtggcgggggctggcagcagccccagagtgacagttatgaaggcagagacagttcctgccatcattagaatccctgtcygtgattcctctgacccatggctgtccaaaacacaacggttaccttcatgaaaaaattaaaagcaaacgttatttcctctttttgtgaaattccttaatactgattattgtatcttctgaaatctgtaagaaaaagtaatcttccttgagttggaacagagaaatctttatgttcaagtgacagtgctgagtgaattgttcaaaatcttttaagaaytgaacagcctaactcctctctgcattagcacaaaagctgtttgtcatgataaccatattctcaacaaaggccttctttgcagccgtagactttcgactgagtttagcctttggtaactcataaattctggtcagccattgaagagrccctctctgagggtagctctgcccaaagggatagcactrtctagggaggacttctctctcttgtttctcaatagcatcacagggacaaagatctcacttcacagctctgaacttcaagatgacaggctccctttaaggcttggctccatccagctgggttgtctgaaataatgaccacagaaaacactcgaacatatacatcactgctgtgcacaataacttgaaataaccagtgtgcaaatgggacaccaggctgggtactcatcatgggagaggaggamgaagttaggtccttgtccatcrctgagcagtgagctaggtgatgccgagaaatgttttgcttgggacctgtgtgaattctatcagtcagatctgtcagttgacctggcctcgctttgggacagcttgatttggaaagaccttgaagaggcctgagagacctgggctggagggaggggtagtgactgatccctggccaaggccatttttattgagagtattaatattgtttccagcatagaaaccgttagatacacaataagagtccttcctctcctagaataccctgggaacataccaaaaagagaagatctggtaarataacctttcgctgaatgttattcattcatttaactaatcacactgctgttccatgaatatttattgagtgtctagtaagtggcaggcactgtaccaggtgtcaggaatgatagtagtgaacaagacaggcacagtccctgcccttggggaatttgctttctagttgagggagacatcagcaatacattaatcagatayaytgtggataacagtgttataaaggaaataaggcaggttaatgcaatggaaatggtttggggtctagagggccccctgatctgaatggcaggacagatcctgttatgcgaagacctgaggcacgtgaattccagggagtgggagcatcccaggcacaaccttgtggtaggactgtgataaaactgtgtttgaagagcagagagaaggccagtggaacagagctcagagagcaaatgtggggtgggctggaaggtgagggtgacacggtgaatctagacaagaccagagagacagggagagactggatcatgcagggccttgtaggccactgcaaagtctcctcaaagaaaactaagaggttattcaggtcagtctttaaaaactgtcttctctagggacctctgttttatctaaagtccaagggagcagcagaaggagcaaagctctgtcccttccccagggcccccacgtccccctaatatgcctccctaccctttgtcagttttgcacaaattctgtgtaagattagcctctcaaagatttcaaagttgtgataggttaaagatagacagaaattctttcactcacccattaagagatagagtttttatttaccctgactttgaaactgggctggttctctgactgctttaaccaaagactggtggaagtgatgctgcacagccttgaagaggactggcaccttccacgccctccttgactgatgggctccttcactgccatagaagaagttctattctactgaagaggccatgtggcagatagccaagcaaccagcagacaaggagacctgcagcactgacccacaccctccactggaccgttccggccagcccccagccatctgcaccctctcggcagatgtgaagaagcgtgggcattctgtctccagcaggcatcacctggggcagagacgagcagatcctggttgccttgccacggacctcggaactgtgttcaacataaaatggttgctgctttaatccactttgcttaggggcagtttattacacagcaatagataactgaaggaaaagtttacacaaagagtttgaaaaccacttctctgagcaaaatcaatggttttacaaagaactcagagaactctgctctcacagctgggaaggcagtggagtgtgatggagtgggcaaggacttgagagaaagatggtcctgaggctgagtcatggcataaccttgattctttgccactttgtttctgagacacaaagaacaatatgtactgtggagggttaatgtgagacttaaaatcagacatagtgtgtgaagaccttggaacatactaagaacttgacatgttgtaactatcttgtggtcatcagggcccttccagggctcccggccacctgggttaggagcccacttggtgggccaggccctgtcactgccagaacccaggtgaaatcacaggtgtgggcagtggcaggaggaaatctgctacccagacttactgttgagtttccctatgtgttaatgtgtttcatgaacacagtatttcataatgttgaattagtattgagaatgtttttccctattcaatcctctttcaatcctgataaaatcaaagcaaaattgctactacagctttaacatctctgtagcccttggtgatctcttttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagtgagccaatttaaagaagactattagataagaaatatacaggtacgatgtgacaaagaattgtgatgaaggtatgcggttgaccgatgcaaatgctgctccactgaatatcccccaagtttgtctatgggcctactttgggttgtcacagtggggaaaagctgacaaagccactgtgtgtgtgaagtttccctctgccacctctgaggcccatgcaccctacagtcccccacaacccagagtggtctagcaggggtgacagaagtgggcagtaggagggaacaacagcttcatggttaagatcccaacatgcagttgttaagactcagccagcccctggcatttggcctcttggtttcttagtccttttcagagctgggctggcccatgagccatgcacctggcccaggactcctgcctgggcagttctgtaggctcatctctccctgaccttctctttgtctgcagctcttccctccctaatgtgctcagcacttttagctgttctgtgatagtctcaaagggcgtggagatgagagctttgctgaaaatgtgcatcttctgcagaaaagggccagggaacacttagagaggaaaaggacaaaaagatcaaagtggttttgaaacagaagagggaatgaggagctataaaatttgaatgaagaggctggaaaaaagaagcaggagaaaggaaatggctttgtttggtagttagagctaagaagggagaaatgataagagcaaggatggaagccctttaaattaagggactgctttaaaactaaaaatatcaatgtgatagtgatcaagctatcacaacctaccacggcatggatctcaagcactgaatgcaagtatagcatttctatctatctataacacagtgtgtctatggtcctttatcctcccaggtatctgctcttatgtcacctcctccatgaagtcttcctggaccacatcatctgaaatagcaatctcctttttctctatccctgatcccactgtggttttcttcatcacatcactacatggaattttgtttggtcatgtattttttattctatccccattagatagtaactccatgaaggcagggactttgccrgtcacttctatctccagttcctctggcacagagaaggcattcaattaaaaaaaaaaaggtacaggaatgaattcaaatagttaatgtaggctgggcacagtggctcacacctgtaatctcagtactttgggaagctgaggtgggaggattacttgaggccagaagtttgagaccagcctggccaacatggcaaaaccctgtctctactaaaaatacaaaaattagctgggcatggtggcatgcacctgtagtcccagctacttgagaggctgaggcaggagaattgcttgaacctgggaggcagaggttgcagtgagccaagatcgtgccattgcactccagcctgggcgacagagaaagactccatctcagaaaacaacaacagcgacaacaaaaaaaatagtttatgtatataaagtccctaatattctatagaatattctaagaacaaaagatgagtcagatatgaattttgccctcgatacatggtctaataattatgataatcactatccattttagagggctactatgtgctaggcactttatacacattatggtatctttaataactaggagcaatgttcaatgtaaacatatttaacaggtattatagaaactgatctatcagtaccatgaactggcactccaacatattaaatagtactgccaagatctgagaaccagaaaatggcagagtcaaaatctgaatgaaggtgagcctgaatccaacgcgcattcttctgggcatattactgccattcttggaaatacatgtgagcacacgtactgagacttacatttctttgatgctggagaccattcttttatgtgtctcataaatagttgtcaaaagacaacttttatgtgtgcacagaaatagaatgtttccagcatcagagaactgtaagtctcattgaagagttaaggactttggatsggttaggagctggggagccagccagcttcttctctcacagccatcttagcttcaagaggtgctagatccaatgtctatacaaagagaaataggagagaagagcaaggggagtgggggagagctgagcaaggtagctttggggaagtttacagaaactgggagaataggcagagaaagcccagatccttggatagtttgctggttcccacagggctgtgttcctcctcacctcttctaagtgacctctgtcataagggagtccagcccaagggagcggcagcaggctgagctctctagaacaggcttttctcaggcctggcagtgcaatttgaattttcatcccagatgatacctaatagaaacagtatcaccacaatcaaagagaattgggacctggccttctcactgtctgcagagcctgtgcctttggtagtaatagttagtgcacaccaaatgtccatgtgctccctctgtttcccagcctttcttgcagttcacgggtggcagaagagatgtgccactttcaatcttaatgcctctcttctgctgctgtggcattagagtcacattttccacattcatagttacaaggtggaggtcagcctcctgactcatgatcagcaaccacaacaaacttgtattgggttaaaccactgagcattcaggtttgtctgttgcagaagctagagttaattacctcggactagtacgtctccctaaatgctctctgcgcttcctaatgaatctgtaatgatcactgctaataatagatgtatcatatactttcatattaacagtgtttgacttaaacttacatgggcttggcatatggmacaattttatcctggtcatatgccagagaaagtaacaatgatggaattaaatctgtgcttttgcctctacagtggtgtggcactatacaatagcttcctaagacatacctatagattctatacatcatctgggtaggcagagatttttgtatttaccctgctaggtagatactgttctctccacgttacagaaggcgaatgaagctcagaaaggccagttaacctgttcacagttgcgaggctaatgagcagtggaactgggcttctaaaccagggagcactgattccagagcccattccacagtgccctgctcccttgactgacaagttgcctctatttaattcacaaataagacttggatattaacctcgaaaagaatagaggccggatgaggcaactagctgaacccaggtaagatagttagaaggcaatattaaaaagcaccagtgtgaatgaaacagatttgaaatactacaggtacccagataaggggagagagaaaggcatgcatgartgggaacacaaggcttcccaaaacttagagagctgagggaggccaagaaggatggagaaggtaggggcaagaggagggaggaaggtgtcctacatgagggagagcatcctttcagggcctggggacagggagggggaagcagccaggggcatcaggtgacagggagaaaactgatatggcaaaatgaaggctttgtgtggagataagtgggatggaggctccagaacaggaaagcctgtggaaggcctggctggggagtttggagttgaccctgaggcagggcagagccaagaaagtgaaaataaaggaatcagttgtttggaggagataggctaagaaagattttgagtatgtacttcctttaaaaatggaattgatttgcaggcagttaaaggtaaagagatttgactcaggaaaaatgaagatccagaatgtcaatttagaagatattccgtggttgcagttggcaccaaggtgaaccctgttttccttcctgcggagcaggccacccctccaatggctcgccctctcctaacattgaatgagaaatgaccgaggatcaacagctgtccttggcctttacttcaaatcactttatctccctggccttagttgcttcacttgtgagttggcagcattggacctggcagtctccgggtggtggctggccatggtgacagcaagttcttcacttatgtctgccccgctccacttcttttcatcaaagcccttgctcccctctttttttcccctttggaggatgtcttgggacatatgatcagattccctctttggggtctttggttaggtgggaacataagccatctaatctgctttgtatgggtcctgatggcccattcttgtgtttgggccaaaggttagagtctcagggaatatagttctcttcagctgcagcgtgtgaggaattgctcccatgctgagatttgggggaccctaggagaggtaaatgttcaaaaactacctctgtgagtacacactgaactatttatggataaaatgatacaatatctggggcagtgggtcatgtatgaacgaaaccagattggccatgacctggtaattgctgaagctgggtgatgctacatggggtttaattaaactgtcctgatgacttttgtgtatatttaacatttttccataatgaaaagttgaaaaagccacacacacacacttttttttttttcatgttgcggcgttcagaaaactgaactgttgagtctccagagagcacaagttgaatacccacaaggcagtatccataaagcatccctgagatgtgggacaacagtaaatttgatacagctaaataattgactgtacatggtagggtctctatgagcacactggccttggatgccttgttgatggccttggatgccttgttgaccagaatatctccctttattgtgcgctattttcctgtctgacgactccaccttccacatctttctcttcccatttcttcgttggcaagttaactttctcccataggcagagggagcttctctttcaggaaccatagaggaaggatgagagagccctccaaagctgcagcgttcaatttttttgaccacaacccagtgtaaaagatatatatttttatcatcatagacaatcataactaaaatgtaagtttcacaaaataacaccctttaccaaatgggatacattctgatattttctcttctgttctattctagamtattctattccatattttaaaaggctgtcatgatccactaaatgtaaattactaataaattcaggattgctaatgggttgcagcctgcattttraaacaaaattggttagtggaaaagagatgttgggcaggaaacttaccatttaacacatctggcccggggttgaagtcacaggcagctggatttcatttgcctctgcccgtggagaagccctccatactttgtgcgggtgtcaaggtcagatctacagtgccagccaaggactgactagagtattaaatttccccagatgtgttaattgacgtgctcgtcaatagggagagatcacaagtcatagacttaagatgggaattttgttgaactgggctgtcacatgccatcttgtagttttaagatagaaaaaacaaaacaaaacaaaacagaaaaaaaagaaatagccacgttattcacaccatcactatgactgttgctcagagaagacgccaggcaacaggataagacagtgcatgtccttcagaaccaggtagatctgaatttggaccccataaactactaaccatgtgactttagaaagattacttaacctctctgaatctcagtttttctcatcagaatagaagaatgataatactccattaaatgagagagtatatagcatctagcccagaacctgacctgagggcagaccctcaaatgttaaccccttctagcacagaggccctgtgaggtttccttcaaaggctgtcaatctagtaccccgtatgacaaatctatcactctactttgctcagtggtttactggagggggaagagagccaggagaaaacccaaatagaaacaagcaaagtgccaagagaggagccatgttttcaggctaagtgacctaggcagcgccattcaccagctttagctctccagttctcagtcatgaaatgaagatggggaaaatgctatgttctccaagaactcttgactcatatttcctaaagatagtgggcttcctgggcaccaactcagacccagtgaatcataatcattctaagccaatgtccagtaatttaccaaatcctttccagcctgcttcctaaccatctcccaagacagctcattctctcctccccaccgcccctacctctgtacctttcccactcctgtttgcccttttctcctgttgactgcattccaggctttcagtcttgcttgttcttcacccagttttcactctgcaaccagagagacagttttatcatgcaaacatgacaccaagactgctgtccaaagcttctagtgatttctctttgtccttaaaataaagtctaaactcttaacctgtctgtccccagggctcatcttgatcttccccgcaccaacccttgctctttcttttttgatcatccatccccacccctggactgtcaagtctgggatagtggcagcagtgtctctcctgctattgatgtaggcccaatgcccagcacatggcctgatgcaagtcaggcactgaatgaaaaagcagttgcggagctccaactaatctttttccataaaacgatagcatgtgacctattttctggataaaataaattccatgtgctgtggcaaattgtctcttaaagtccttattgtgttctctgctagctgtgtagagactaaatcaactgtactataatgtctattattttatattttggtacaaggatgctttcaaggatttttttgggttttgaagaacaaatatgatttgggtgccatttccatactcctcaaaatactctaagtagatagtgaagctgctctttatttctaaaccctcatctcgcacagacataatagccagagattccccttagcaggaggaatgtcacgcattatggttttcacttccatttaactggattaagtatttgttgaagagctttgtgctgattagagatgtctgaatatgaagtgctccttgaacaaaagttatggatagtcacatcaatttaattgaaaaatgttccataattaaggcaaaactacttcacttaaataattagcttgaagtggtcatagtaacagagttaatagattttcttttatttcctctgtgtcactggtgcctgcctgacaaaagaacactggtgacatggtgttctatagaaagttttgggcttagcaatttaggattctgtgccatataagtactgtccaactctcttcctaagaaggcacctaaagaggtgtcaaagtgcaataatcaccagatcgtgatttattcataaagttgaataagcattcagaacagaatgttttggagataatatgggcagttccaccaagcttagtagtgcacactggaggaattatttccagagttttctagagtagtgatcctcacatcactactgattcaggatgctgcaaaatctttggggtgtcaattgcaggtgattcagtgtaggcaaaagattagtaaattatctgttagatatgtgttcagaagctcatagcagaaaacccaatttacaatagcttaaacaatttccctttgacatcatcaaatatccagaagtagatggttctttgtcttggttcaggcccaagatgtcacatgggcacgcaggtgctttctctttccatctgccatcttgtgatgttgccttcacccttaggctcctcccaccatggtcacaagctgcatgccagccatacatcagcagtccaggtgacaagaggggaaaaggcaggtaagccacatatggcatgctttatcaagagaaaacaaggctttctcagatccctctaccttgcttagatctcactgcatggccacccaggtcaggaagtacaggacagtggaggacaggagtttcatatttgctttagacctcgtcttattgtaggataaatacatcagacagcaataatttaagcatacccttagaatgaccctgtatggcagatgcacctgaatccgggagtggccaactcagagactcgctccttgtctatgaggaacatctgagtccctgacacatcctgtagaacatgggccatacagggcattgaggctctgagttttggattaaatgagggctatcaggcagaggtcattaggggagagcgttaagtggaaaggtgatatcaactgcatgatgtctgtaggtggttgcagttttcctgcccagtccatcaccactgggccatgaggttattttgtccagcccatggcccttggactgtaggaaggtggatatcttgcctaacccaccgccactggactctctgctttgtatgtaagcccctagtattaataaaaccctatgtcttgtttgctggatctgggtctcttcattggcctctagaatctgttgccttctctattaaggttaataggggttcagcacaacaactatcaagataggtcttccgttttattccctcttttttaaaaaaaatgcattcaatgaaggactaatatccagaacctataaggaacttaaacaaatcaacaaggaaaaaataacctcattaaaaagtaggcaaaggacatgaacagatacttctcaagagaagacatacaagtggccaataagcatgaaaaaatgctccactaacatcagaaaaatgccaattaaaaaacacaatgagatatcatctcacatcagtcagaatggctattatgaaaaggtaaaaaaatwacagatgttggtgagaatatggtgaaaagggaacacttatacactgttggtgggaatgtaagttcgtttagcccctgtggaaaacagtatggagatttctcaaagaactaaaaatagaactaccacacgatccagcaatctcactactgggtatctacccaaaggaaagtaaatcattttatcagtaagacatctgtacttgaatgtttattgcagcactattcgcaatagcattcagggaatcaacttaagtgtccatcaatggtagcttggataaagaaaatatctgaggcaggagaagggcttgaggtcaggagttcaggaccagcctgggcaacatagtgagaccccctgtctgtataaaaaaattaaaaattagctgggcatgatgttgtattcctgtagttccagctacttggcagactggggtgggaggatgacttgagcccaagatgtcaaggctgtagtgacctatgatcacatcaggctggatgacagtgggagagacaagaaagaaagaaagagagagagaaagaaagaaagagagaaagaaagagagagaaagaaagaaaggaaggaagaaaagagagaaggaagaaaggaagaaagcaagaaagcataaaatatggtatatatacactctggaatactatgcaaccgtaaaaaagaatgaaatcatgtcctttgcagcaatatggaagcaacctgagaccattatcctaagtgaattaatacagaaacagaaaatcaaatactgtatattctcacttataagtgggagctaaacaatgagtacacttggacataaagatgggagcaatggacaccgggaactccaaaaggggagacagagggagggaggaagggagggagaaaagggttgaaaaactacctattgggtacgatgttcactatttgagtgatgggttcaatggaagctcaaactccagcattattcagtacactagtgtaacaaacctgcacatgtaccccctgaatttataattwaaaaaaatttaaaaatagaaaacaaatattttgtaatattcttttatccttaaaggcaatgaataaatcatataacccatttaaattcataatttcgaagtaatgccctaactgtaacttaagaattagaggaaagtagcccaagcaggccccacccccacaagacctcttatcttggaggaagagaaggtggagggatgagcatccatggggaagtcaaagtgagtgacaggaggactcaaggcaaggtgttaaatctcagtcccatcagtgtcagagcctggcacagggagaagccctccgtgacactcactcccagctcccagcaggagcagaaagcatctccaaataagaagcaggttcctaaccagggcggtcatggctgaggaagggtaagacgccccatgaaccttgggctacaaaggaaactcaaaaaagaaacatcttgaaagcttcctccagttgccaggcctctacttccstcttgaaacaagaactctaatctggaaaagcaggattagagaaaatctaaaaccgtttatgtcaacaggcctgtgggatttgatcagggatactcacagttgttgctagaatctatctcaccttccagcgttggacacatagagactgatcctttatatggagaaaaaccactggacacattaatagatatttttatttttaaatttttatttatttatttatttatttatttatttttgagacggagcctcgaactttcgcccaggctggagtgcagtggcgcaatcttggctcactgcaagctccacctcccaggttcacgccattctcctgcctcagcctcccgagtagctgggactacagacacccagcacyacccacgcccagctaattttttgtatttttagtagagatggggtttcaccacgttagccaggatggtttcaatctcctgacctcgtgatccacccgcctcggcctcccaaaagggctgggattacaggcgtgagccaccgcgcctggccattaatagatattttttaagacacaagaggggcctaacctgaaaaatcagaacaacaatgttcccctctgaaagtattacttcaagaccattaggaagccttaagccagctctaattcgtatcctctaggaagtcaggggcacattgcacccaagacacaggagcaggcagacaggacacggggaatgattggggcaggaaaattgtttacctgttgcaatggattgaatgtgtctcccaaaatccttatgttgaaatcctaatcccctcaatgtgacagaagtaggaagtggggcctttgggaggtgaccaggtcatgagattggagcttgcatgaatgggattagtgtctgtatatgaaggacctcagagagctctctcaccctctttctgcaatgtgaggacataatgagaagatggcagtctgcaacccagaagaggaccctcatcagaacctgaccctgctggcaccctgatctctgctgtactccagaactgtgagcaataaattcctattacttaagtgctattcagtctatggtatcctgttatagcagcctgaactaactaaggtacatgtgaaagacacaatatcatggctggaaatgcagtggagatagtcagtggagacacagctgatgctaaattagggcaagaagacaaatcagacattttcccagagttgaatagaggcaaaaatgacacagagaagagagaagccaygatgcacaagtccaggaaatccaaatctgtaaaacagggtcttccaaaatgagaaaacagggcagatgctgtgattacatccaagtggaaagttactgttattttcttcytcatactttttgctttgctttcttctccttcaaattatcatggaatgtgctacttataaactcagaaaactacaaactacaaaaagcacacaactcagacaagaaaatctgtgtagaggccctatatgctctgcctttgaaagagaaaatattctttttaaatttttacttttagagacagggtcttgctctgtcacccaggctggaatgcagtggcgtgaccatacctcactgcagcctcaaactgctaggctaaagtcatcctcccacttcagcctcccgagtagctgggactacaggtgtacaccaccatgcctggctaattttttattttttgtagagaggtggtctcgctatgttgccaaggctgttcttgaactcctggccttgagtgatcctcccacctcagcctcccaaagtgctggaattacaggaatgaaccaggaatgaacccccctgaaagagaaaatcttacagaactaagggaggatcccaggctgaaggccagaaatgaacatgtgtgactaatttgcagccaaaggtgagcatcatctgcaagaaaaatgccttgataggtttactcatttgcttctaggtcactttcacatctggggaaggctgaagcagttccactgactgtggtcctcttcttgagcaggccacatacaacctccctcatctcattgaccagggcacccaccattgattggggctccctcctctagaaccctctggcataaccacagttattgcctgcagtctgggtctagcatgctgctagtgaggaaatagtgagaggttaaatgccaggatgaatctgtgagttttatgcaatggaagctccagaacttctgtcccagagaagccctggctttggtggctcaggtcacactcagagtcaagggcatcagatgaggactcattgcaactcttacaacaggaaaaatagctcatatcacagctctgttaatggtgtgtaaatgaaaggaagggtctctcactgcatggactttctagtggcccatagttttcttttaagtagagttaggtagacattcaattttttcatggccatcaatgaaaacagcactccactcttaagtagttcattgcacttcccaagtgagtatttgctctgtggcacattgcccctttgaggaagaagaggcattgctcttttaaagtgaataacatgggctgttttttcatactcaaatgtgaaatgaatgaaacgtggctaacaagcaattacaatttattacaatttcagtctttctcttcagcataagccttaggcatatcttaacaggactgaaaataccagcatgcggtaaataaaagaattcatcgtgtcctcactctttttttttcctagtttttttttattttattattattatactttaagttttagggtacatgtgtacaacatgcaggtttgttacacatgtgtgtcctcactcttaatgataattcagctgggtgtaaaattctgttcaccaactgatgagtgggtaaacaaaatgtggtatgtccatgaaatggaatattattcactaataaaaagaaatgaagtactgatatgtgctgcaacattggatgaaccttgaaaacattatgttaagtgaaagaagaaaaataaaaaaggccacatagcatatgattcaattatatgaaatagctaagattggcaaatctatagacatagaaagtaggctaatggttgcctagggttgacagtggggtggagagattgaggaatggtagccatggggtgtgggttatcttcttgggctaatgaaatattctaaaatgggtcgtgctgatggatgcctaactgcgactayaataaaagccattgaattgaattgtacacttcaaatggttgcattgtatgtgaattatatctccgtaagcctctttgtttgtttttaagtattcatgggcagtcattcttttctgggcatgtgcatatatttaggacactgtttttggtctcctctttatggctctaatattccgggcttgtttttaatgccttcctttcattgccctgtttgaaatgtccttttcgttttattgtactgagcttttcatttgcctttcagctctgcttgctgtcctaattttggtgagtctgccaacctttgatgaccatccctcttccttctccagcccctggcagtcccattgataggcttcccccatgatcttgcataacagatgagacagacccacattctcctccatagtggcttttccgtggaccggcagaggagcttggttatttatccttactgcaactaccttttttgagtacagttctttcacagggcagctttcccactcactattattcttgcctttcactgtaatcctgtgaagtgaatacaataaggattatcctccttgttttacacgtgaggaaactgagctcaaagaggttagctgggctccaagtcacacacaggatcatacaactcagatcttctattattctttccattgattcaggatttcccaacataaaattctaggattaatcctttactctaaataaattgttttctttaatctctgttcttctctcatgtttattgagtaactactgtgtgtcagacacttctaggtgctggagatatctttgagaaaaaagatagggtcccagccctacaaactatcagagaaagtaggtatgcatctgtccttacctttgcccaaatagtatctccattgccaccccaagacccccacctagcatcccctactaccacctaccatctggcatgacttctatctcatctctacaaggttaatgtctatctaactttgaaggctctcccacctggaataacccaccttcctgagaatacacaatccccaggggtttttctctactttcccttgttgttacgtataggttttaagtgaaggcaaccatgagctaagtgctgctcccctgccactttcagaaaaaaagaaaataaatgatcctctgaacctgaaagggctcagagcagagatatgcaaagtcatcttaaagagatagagtggctcccaggtagcccaactgctggtaacttgattgaatgtactaaagtatctaaagaaggaaaccatcatgaagagggggttggtcagccagggaaattagaaaagggacagtccctgaagcaaatgttgctggtgccattcaaatgtcatttagggaagggggtgcccagccagcgtgcagggtaggaatgactattgtagaaatggtccagtggctaccaaaatcttctgggaccaagcccccaattcatataactctcatctgtcgccctgaaatcatgctaaccagataatcaccagttaaactggcttcccctgcttgcctttggggaagaaggggctgttcaagctggcatattatctgaattacccaacagttcctttctctctggaagttaataaatgagccatggctttgtacgtcagcatgggagtctttgggaggtggttaggtcatgagagcagattcctcatgaatgggattagtacccttattaaagaggccccagaaagctgccttgcccctttgatcatgtaaggacacagaaagacgatgccatgtgtattagtcagggttctctagagggaaataactgtatatttataaaggggagtttattaagtattaacttacatgatcacaaagtcccacagtaggctctctgcaggccgaggagcaaggagagccagtccgagtctcaaaactgaagaacttggagtccaatgttcgagggcaggaagcatccagcacaggagaaagatgtaggctgggaagctaggccggtctctcttttcacacttttctgcctgcttatattctagctgtgctggcagctgattagattgtgccttcccagattaagggtgggtctgcctttcccagtccactgactcaaatgttaatctcctttggcaacaccctcacagacacacccaggatcaatactttgtatccttcaatccaatcaatttgacactcattattaaccattgcaccatgtgtggatccgaaagcagtccctcagcagataccaaatgtgaaggtgccctgagcttgtactgcccagcctccagaactgtgagaaataaatttctgttgtttataagtcaatcagtctatggactgagacacatgagtcagccttcagtcaaatctagaacagatgaagtgacttatctcaccaaaacctcacaaaagctggtgtttatctcatcaaggccaatggcagaaccctgcaccaccctacatcaccaatgaaaatggcactttatgtggctgagtgggcgatacacccacttccttcaaacccctaaacctaacaaaaaatgctaattggttgatgcattatcctagagggaagacttgaagaaaactcaggcctgactcttgcttgcctgaggcttaagcacttctataattttggttgctgttattgatgttgctttgtagtaaagccagattatcaaggctatgacatttgtcaagggaaacctgggaagaatgatcatttgaacaaaaaggcatttttatttttatttttctttgagacgaagtctgtcattctgtcacccaggctggagtgcagtggtgcaatcttggctcactgctacctacacctgggttcaagtgattctcgtgcctcagcctcctgagtagctgggactacaggtgcacaccaccacaccacacctgttaaatttttgtatttttaggagaggctgggtttcaccatgctggccaggttgatcttacactcctgacctcaggtgatcgcctgccttggcctcccaaagtgttgggattacaggcgtgagccaacatgccctgccaaaatgcatttttaaatatatttagttgtgaacatatttggtaggcgatgtctttactcagtatttaatgtaattttcaaaaactgaatccattttaaagctctacaatttggaacttcagcaagagtgcctctgtgggggtggaacatccacataagtccatgtcattgcatatggctccactgtacagaggaagggtaaatggcttgtttaaacaaattttttttgtgtagtggtttatctaaattttattatttgaccttgtatgttttatagaagttcatttaaaccctgaaacatcatttattggaaaaagtaactattttagtccatagagactgtcgtgagtcaccttgaccaacaaattggccttgatgaccgagctctgcacagatgcagaaaggtatactctggtggctaggggttaatggtaaatagcgagtttcttccattaaggtctcttctaatttaagaaagtaaaataacatttggtaacacaataattcgggggtatctgtgttttcaggcacagacaaaattggaaagaactgtgaagattaaaggaaattttagaattttctataatgtacactgtgttctaggaggaaaaaatagtatcaagttgaggtaaattagcttaattctgttacctgaatgtgttcactggtagattctttcttccatttgttgacttattgaatataaattccattaaagggcattggattcatttttcatttgaatgaaaggagctcaatatcctacaagaattggcttgctgagaattcttaacacactgctaaaagtgctctaaatttgcaattcaaaccccaagggatgccaagtctcgtgatgaacacacacacacatacacacacatgcacgcacacacacacacgataagttaaatttaagaatatttacatcatgaaataaattagttgtcagattattgtgaattacagatccccaacaagaaaggtaattcagagcttccttttccctcctaacaagtaggttaggtttgtgaagaacatgctaagaaaataaacaatctaaggagtaatcattacatttcaaatggctggaagcttttggcaaaatgagggggaaattttaaaaatacatcataatgtaggagaaaatttgtaattttaattgggaatatacttgaacaaataaattctagtttaaacattggtaaacttgaattttaatctgaaattaaatccttacggaattacactatcacacccatatttwtttttttgttgtttttgagacagagtcttgctctgtcrccaaggctggagtgcagtggmgtgatcttggctcactgcagcctccacctcctgggttcaagcgattctcctgcctcactgtcccaagtagctgggattacaggtgcctgccaccatgcctggctctaactttgaaaatatttttagtagagacaagatttcgccatgctggccaggctggtctcaaactcctggcctcaagtgatccgcctgccttggcctcccaaagtgttggcattttcaggcgttagccacggcacccagtctctcccatgtcatttaatcatctgtttttatgtagggtttatgttacggcaaaagaaaaaaaaaatatggctccttcattctcccatgatagctaatagctaaatgaatgtctttttttttttttttaattttactttaagttccgggatacatgtgcagaatgtgcaggtttgttacataggtatacatgtgccacggtggtttgctgtacctatcaacccatcatctaggtttaagccccacatgcattaggtatttgtcctaatgctctcccttcccttgtcccccaccccccgacaggccccactgtgtgatgttcccctccctgtgtccatgtgctgtcattgttcaactcccatttatgagtaagaatatgcagtgtttggttttctgttcctgtgttagtttgctgagaagtctcagttggacatacaataatctaaggccttctcccatgtaaaagcctcccagttaccctccattcaaacagacgagtgtcaactctacactgcttgctgggacctcatgtcattccacagtcctgttcttgcttctgggtgagtcatacaagtcagtatacttggggtaaagaatctctggatatcatatacagcaactcagcagagtcacagaatttagcttggcaggataatgcattagtctaaactctttcacccattgtcttagccctaacctgtggggaagctgggtcttttaaccggagccttggttggcaacttgagctgcaaatcctaaaygctcctctgaaacctcctgacatccatgccatttgttccatgcctaatctatcttgaactcctgggtcttcagcgtttccccagcctgaaccttcacctccatcagttcttggacttcttattctagttcttttgaaatttttgctcttcttgctcccctttttcttaatcttcacaaataaggtcttgggacccatactatctgttaagatggggaaaagaaaggctggttgcctttgggctcagaagtgctagcagctggatccttccttcctggtttctccccagaagagggggaggagagggtttgatagctgggtgggattttacctgaaaaagtaaagatactatgaaagctagtgaggcttttttggtgaacttttaaagtcaaagagtttatcaaaggattatgggaggtttttgattggggaactccggggtggtgtctttgatttgtggctcaggtaggaagaatccaagagcaggctttttatgtcttaggccccagaaataaagagagccttctggtttccttctcaatggtctcacccactwcctaagcctggaggaggggcagggactctggtaaaagcctggccctaaatcttcccgtgggtttttgttttcagaatcctgacctattatatgtagtgctggagagcaagaaattctaagcagcaatgacttccactgcccaatggtctggggggatattacttctggtcctaaatcccattgtgttttccatcttgtaatggggcgatcgtctaaataaagctccaccaggcattatgacctggcattgtcccattgtcccaaaccactgtcacaacccaaatgtttgtgtcttgcctacaaatgtcaaccaagtctgttggtcacccatcctagcatgccacctatactgtgagtccagcagaattccataagagccatttatgttttttttttttttttgccacaggcagagggatagctggcccctgatgttcctaaagccagcccctgctatccacaagctccctctaaccccctgaccttcccagaagaccttatcttggacttgtaacttccattcactaagggcaatataaacctcagggctgttgggaaaggctattttagcaggccccaagttctctgtgaccatggctacacaaggctgcagggtagggcctgtcacttcattccagttgttctcactgagccttggccattagagactcctctaggaggaaacccttcttcttctatgtagatgcttcatctacaaaaagcttgatctcatgtttgtggggccccctttttaccctcgaagctgtcaggacacacatgtgagtcatctggaggcattctgtcatgacaactcttcacgcagtcctcacctcactgagcaggcaaattagttttatgttaaggttgatagcatttatgcttcagtccctttagatatatgtataactgctgagccaccagagatataacaggtaccacattccaacacgcaagcttccagaagacttagcaaaaaagtgcttacagactcccgaactcttcacctatgtcaagggcacataaaacattgatgagagtagggacagagagttggtgaaggggatttttggaaagcgttgttggtgcattaagagtctgatccccaacaaagagcaaggactcctcccatctcaaacccaaygaaaggggcttcaagaaaaccttgggggagcgagatgggggcagaggggtctcctacagctggtcatggcagtctggggttaactttggtctgagaagtgaaactaaatgttgaagggtgggctggccaacagctttggttgtgggcaaaggagtggggcccggataggaccagatggcactcacagactttgtgaacacatgttttgtgttctccaaatgtaggtcacagcatgagagagagctgggggcaaacagagctgagaggatgtgaaggtctggctggattcctagaggctagtatccgaagtcaggtgccagcagaatagagatgaattcacctgcagcatggtagctgccagctggataacctatgttcttgttttggggagtaggatgggggtgggcagagctctccaaagaatccacaaaatacctacaggaggaagcctgcactttaaacacctaccagacctagaaagcttggagccagaagatgacagaacaagtcaattcagaacttttctgtgaccctctgaccctggagagatcagaagctactgcagcaaaagggcagggccagaaatcagcaaggcaggggccagagagaccagcacaggctttccccaaattgaggtttcctgtcagcagtgagtctgggtgggcacagacccaagagggacagtttcaactttaagtcacagttggagtgtttaatttgatcctgaccagatatattaagaacagtattgatgtgagaggggatttgtgacttaagaagtgaacaaagaagttgtgagacccacctgaccttttatgcagggcatggggagaaggagtaccagtgaaattttaaaggaacagtggcaggcaaaattaagttgctatgcgccaacattccagaagacccacttcttcaatgtgcctgtaacatatctttatagtttgcttcatatagtcagcatacatttattgagttatacccaacactgggaacacaaaagtgaaacacagtcagggttcctgtccttgaggaattcatggtcttgtcagggaagtggacattttctctacaatgagtctgagtctgagtcgtttacaactgtttctgctgtagtggtcttgcgtaaggttgaattgaattgcataatgccaaacccacagagcttctctctctccaaagttctttattttttatttatttatttttttagagatggaggtctcactctgttgtccaggctggagtgcaggggccagtcacagctcactggaatcttgacttcctgggctcaagtgggcctcctgcctcagccttccaagtagctgggactataacatgtgccaccatgcctggctaattttttatttttattttttgtagagacagggtctcagtatagtgtccaggctggtctaaaactcatgggctcaaatgagcctcccaccttggcctcccaaagtgctggggttacaggtatgagcttctgtgtgcctggccactgtccccaaagttctaatctaaggcaccctaactcaggaaaggtcaggcacctcccagctagtcatcccttaacgctgtgactcatcgtaagtggcccttgctatttgcaggtgacacactcgcccagtaggaggacactgcctatgtgattcctcccaggtaagatgcagggacgttggtcaccacccactgagagttattcttatgaattgcaggtgtgaaagctgagcagyagcaatatctggacactgagagagccacacttactgtcytgagagtcacagagatgataaagaaagaggttcatgtagagctttcttatgtagcagagaggagaggaaagagcactagctgtgggtaagaagactgaccagaggaaagggatggcacaggccaatgtstttggggcagtctgtcctctttacagactggagttgtcaggggctccgttgagctgccaggagttagagtagccaatgaaagaaacaagccaaaaatgagagtcacagtcaagcccttagtcacttactgcgattgtataagcaagagctaagaccggagaaagtgccgactcccctgtgttccatcttccccgtggaacagtatatcagtggaggctcaggtagatcagcatggatgtaaaggaatggaggatcatctcacccccactcattcataaaaagctctggcagttttatggatgagttgggagtggtgtgggataaggggcatggcaggtaagggctcagaatggagaagtgctgagtcacagtagagaaaagtggtttggaagttccttgataaggagctgtccaaatggaggcacctgggctaggaatcagtgatgcataacagcgcgggcagccagggggcagcctccccatgaggcctgccaggctaagccttgtcattgctcatagacaggcctgaaaaatcacccataggattttggcctggagctggacttcacaagagtcacttgatgatgccgctaacacagatctttatgacaaaaagcctgtagcttctacaaagagtgagaaacagacatgctcctaaggactgagacctttccccacccttttttttaaattaaaaaaaaaattagagacgggatttcaccatgatgcctaggctggtcttgaactcgaagctcaggtaatccacctgccttggcctcccaaagtgctaggattacaggtttgagccaccacaccaggccaggactgagatcttaaatctgaaacactttcttcctgcagtgtcactaggaaaacaaatcccctctgggatctggctttatccaggagggtttgggccatcccctctatggggactcagatagccaggaaagcctttgtggaaayatgtgccttccttcccttgaccagctcccctccctcccgaggggctgaagttccctgcccagtgctccagagttcacgccaccctgttggggttacaggggggacgctgaatccaaggtaatgcctgtgttatattaagtgaagatgagggtcattttaaccaaggaattgccaactccagggatttctgtgttatggagtagggttcagatctggagtcagagtgccaggttcagaatccgagctctgcatcttactggccatgtatgttgagttaattacataaattcactaagcctcagttttctcatctgtagaataagcatctcacccatacctgccttatgtagttgttagagagaattaaatgagttaatgcatatgaagtgcctagcttgtgcccggcacaccaatggcagtcattgatatggccttatttggctgtctgggggagaggagcagccgagatggaagaaaagttgagggtgccggtgatgggcattttgctgcttcatagctccatggacattactcctgaatctagaagctcaattcccagagacagaagagcttttcctctatcaarggtaatasagtaatttcagctccctgcttgagtcttctttttcaaggtgaagagtcatgccatagggtgctgtatggtaaacacacatggtagcagtaacttaagcatatcgtgataatgaccctgtagggcaggtgcaccggagtgtatgttcccagctaggcaatcctggagtggccaacctggagatttgttccttgtccatgaggagcatctgggcctgcagcccatcccatggaacatgggccctacaggggatcaaggccctgagctttggcttgaatgaaggttgccagatggagattgttagggaaggaatgctaagtgaaaacgctatataaactgcatgccttttgcaagcagttgggttcttctgcccagctcaccgtcaccggactctctgccctgtatgtaagctcccagtaaaagtccatgcctcatttgctggctctgggcctctttggcctcttgaaactggtgcctttcccagtggagctgatagagatttgccacaacaggsacatgggcagaagaactagtttaaacctagaagggatttcccacttgcctacgagtaaagtccatctaagagtggctgatactagatggcttcaaggaagaaaaccagcctggttttgacagtccttatttgctactattcatagtagtgaaagcgtaaatgatttaagattaactatggagacatcttctaagaaaaaaaagattttctgctctctatgatagtgattgttctttaaattggcccataatactttattaataaattaaaattatgttctgaatgtttaatcaaataatgcaaattgaacaatattgtcaaaatatccatgacgacatgaagcagcaactgagaagtcccttctccaaatcgccagtgtgccttacctgttcatgctgctttgccgacttgatggctactaacactgtcatttcaagttctgcatatatcacgagttactcgtcaccattcttgccacatatatacgttaaattggcttgcctattaatgaaattaaatgctattttattgatttcacacatgggttgcacacatattctcttcaagctgggaatttacacaaaatggaagctttacaaacttgtgttactaggaatctgctttttttttttttttttgagacagtcttactctgttgtccaggctggagtgcagtggcacaatctcagctcactgcagcctccaccccaccacccccatcctgggttcaggcaattctcatgtctcggcctccagagtagctggaattacaggtgcctgcaaccatgcctggctaatttttgtattttcagtagagctggggtttcactatcttggccagtctggtttcgaactcctgacctcaagtgatttgcccgccttggccttccaaagtactgggattacaggcgtgagccactgcccccggctcagaatctgctttaagttcaagaattctataatcagattttattgtatttttttaggatgaatgattacaaatgacatggagggagttgggaaaggtaggacatgattagaaacatttctttagtttgaaattgtaatcttatgctcaaggggccttctattagttcttggcactgcttttgctagagtcttgagtgtgattactcaccaccacgctcaagaggaaaactaaatagccaagggatcaagagtagtcaagaaatcagacaaggatactcagccaggctgcactcagggaacaaaagccccgctaagtccctgaagggtccagggaaggaagcaggaaaattgaggcactcctagggaaacagaaaccagaaacctgaaagaaattgaggggcttcctaagaaaaattattaagggagaaaggtatgagttatatgaatagtagaaacttgataaataggactgaaatggagcttaattattttgataattataatgtattgtcaaccaagtgttggcgagattctgcattccgggccagctgcagtggctcacgcctgtaatcccagcactttgggaagccgaggcgggcagatcacgaggtcaggagtttgagaccagcctggtcactatggtgaaacccccatctctactaaaattataaaaaattagccgggtgtggtggcacgcgcctgtagtcccagctactcggggagctgaggcaggagaattgcttgaaccccaggaggtggaggttgcagtgatccgagatcacaccactgcactctagcctggaagatagagtgagactctgacaaaaaaaaaaaaaaaagattatgcattccaaatagtgacagattaacattatggaggggaaaaggagtgtttatcataattgtatgtgaatagatagagggctgagaaaagtaagcataagaaaatgtaaggggaatatcagggtaggaagaaaaacacttccaaacttggttggatgtgaactagccttgcaagatagcagtggtgatgactctggaattcaacagttatgtatcttctccttgggccactggtgactaaagacatgacatatgacaatcaccctgagctgtccctggtgatctcagagaacttttggacctctaggttttggcccacccagcatccagagtgtcctacagggaactagccctcctccaaaatatgcagtctgagggaatgtcaaccatggctcctcacttccaccacaagagttgcgcacgtgtgcaacccgacttctacatctgttagactcctggtcacaattactgtggacttgctgtgtgccaggaactgttcttagagctctacatatactaactcatctaatcctcagaacaactctatgaggcagttacattttacagatgagaaaactgaggtaaagagaggttaaatgacttgctcaaggtcacacagctcgtaagagaaaaagccagatttgaatctgagcaatctagttcctgctggctgcagggaagacagggaaagaggctatttcaacttttccagcctttaaagcagagtaaggcaagcaaagttgggagatactgaatgagtcaactgtgatgtctgccaaatctgtctggtcagtttcctcttcccctgttgctaattatttcttcctgtctgttgcggctttgtatgtgattcaaataattctccaatgtcacactcattgcttcatgaaccacatcttttatgagacttgcaatttcactttgcaattgattgcatagtagtctttgtagtcgtgaatatcatctgaaagtggcaggtacatttacagtatctgacagccgatgagagactgaccccagatctttgattgatagctggcatgggtactagtgtgtttgggcagggatgtttcatgggggatgatttaaataaatggacagctcaggagggcattttaataacgtatttactttcctacataacctggtaacccaaattcttatataatgattactaggatcatgatgtgaaatttgcagatagcaagatgaaatcacgtttgtcagacccagacaaaatagggccagaaaaacctgaaagagaggaggtccatgcttacatgtttgagataagaaagtccaaggactttcggccagcacagtggctcatgcctgtaatcctagtactttgggaggtcgaggtgggtagatcacctgaggtcaggagttcgagactaacctggccaacatggtgaaactccgtccctacgagaaatacaaaaattagctgggtgtgatggcatgtgcctgtaatcacagctactcaggaggctgaggcaggagaatcgcttgaaccygggaggtggaggttgcagtgagctragattgcgccattgcactccagcctgggggacaagagcaaaactccatcaaaaaaaaaaaaaaaagtccaaggactttctagaagcccttttacacctgctttgataaagcttatcattagacatgctttagaattggcagtaattcagacaagatgttctcagaagaacgcttgcccagtagtggaatctccaccaataactgacaactactctggctttgaaactctggaatcaatgaactctgttctaagcagcttatgtcaatctctttttgctagtaaaatctccccttatccttctctcaccaaacaggctggtggcttgccattctgtgcattccagattataatcctgagtaaacgcaacatattcagacataattttctctgtctttatttaagttgacaataagaacttcttgaatatagtacacagtaacctaattcttaattcccctcagccccacatctgccttaaggaggatattcaaagaatgtggatgccattaataatgacaagaaagatctgtaggcttgaggcccccttggctcagactcatgcattcctcagttcttcaggttacccctctgtccatagctaggtctgatgtccatcagaatycttcagcttcagctgtagatgcagctctccttgagccactgctgctgccttaggtccctctgtggctgaccacagaacctgactgcagttgcagtcttgcttgtgacttgcctggagagcctctatcttgttcmccaaggggtgtctgttgagcagctgatgctgctgtctttatgtggaggaaggtctcttcaaggaatgtttcacaattattttttaaatcctgaaatggtgtcattattccctcagtcttctgtgattacataaagatacttggaccatgaagaaatttggaaggaaacaggcagggtcttacttaccctctgtgaaaattaaaattatcactgtcattcatatatatatagatagatagatagatagataaatacatgttaaatattttattcattgatcagtgaaggattgaatcaggcatacattataacctgaagaacagacatttatagatcaagaacagtgaaatgggccaggtatggtagctcacacctatatcccagcattttgggaggctgaggcagtaggattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgatggattgaggaccttcatgtaacaggtgtcctaacctctactggacaggaaaggaatgctatgcagagagaccaagaagaacctgaacagacaggtcttgcggggtttccccttcagtctattaccattagatcataacctgtccaatcacagttctacatggctatccgttttttatccaacctaaacataaaaacagtttcccctggatctttagaccttcacttctgaaggctcttgtgtcacacacaactttgattaaatagatttgttatgcttttcttttgttaacctgtcttgtgctttaagagtgttagctgtccgccttctatgggaaggaaagatatcacaattttctacccttatrccaccaagttcaacctcccatcatgatgttttccagatacaaactcatttgatcttacttaacttttttcagcatcccgtaagggggcacagcagcaattgttacattttgcagggggagagacagctgcagaggggttgaaggaattgctagggttacacagctgatacactgcctcgcctgagttgraaaccagctctgcatgtctgcagctgctcttgctcggtaccacacagcggaggctggtcccaagtctcctcttctgttaatagaaaaatgggataatcatcatttcatttttcaattctgagattctgggcagcttctctagttttatttgcaattcaacagaggaatctagcaggtttgtaagttacatcctcacttactcattttagaaaatgggtgattatattcactctcaagctggttggctgactcttcaaaagccgtagtctcccacagtgaagaatctaaaatgacaatcaggatcttaagagacatgaaggtgaagaaaagacaaaataataattctaattgttctatcgatctcttggccaaggagcaagacaaaaatcaattataaataacaatagcttttaactcattgagctatcttttctcttaaaatcaagataaaagccaaattgtagatggctagagatagaataaatgttaatttccagaaaggccccttcagcagtcatatgagtaacagatagattctatcagggctcagaacacagtgcctcaaaatatggcaccttggcatgctgagtwctttgaactgaaggagattgcaaagactaagaagcaaggtttctctgaccttcgcctactctcctgtctcccacgcctcattcttccctgaattaagtcatagactctagagttcctcttcccgagggctgatcatagaaactagaattcctctccccacacacaagccataaaacctagaaaggtcactctcctccttctcccttgaagattcttattccagagggatcctgccccatacccaggagggaagaaaygctacacagacaggccaagaagaatctgaacagacaagccttgcttggtttcctcctcagtctactaccattagatcataaccttctgggtttccccctcagtctattgccattagattataaccttctgtccaatcacatttctacatggctatccattcttcattgaatctaagcttaaaaatgcagttttccctgggtctttgggtatttgtatttctcaaggctcctgtgtcacatacaatattgattaaataaattagttttgcatctctctcattaacctgtctttatagaatgttggcgtaccccttactatggggaggaaaggcacacttctctatttacctgggctctagttatcttatttacctgggctcttaaaaataccagctacaatcagaggttctaagagagcctcaaaaaagatggcctttccmaaagtatatttcatcaagtgggagcttcttatattttcttggcttctgttgaaacttttatagttaaatgatgtgacaaaataatgacactagcttccgttttgatgatgagacaagttaattatactaacttctgtttttcctttctccttgccttactaagagaattttatttttctatagtttaggaataaaagcctagaagtttcagaatctgggaaggcagccaataaatgtcaccctctgaaaaacaaatatcatcagaataaaaaaaggatgacattaactgacttctgaggaaataacacattgacgtgatgattggtaagtgggaggcagtttagatcagaacatttatcaaagtgaattgtcactagaaaccttcctgaaagaaagagttccatggtcaaatattttctcaaatgctgggttaaatattgctcaaacacatttgtttattgcagtacttctcaaaacctttaatatgctcatgtacactgtgaggttctaacaagacctatggtatacagtattttccaaatatatgttaccagataattaatttttgtagacaaacctactttggcaaactccttactagagtattttcttaatttcacattaagggattcacattatctaccggttwatatttctataaataaatttatttatacaaatacatttctgtttatacaattaagtttatatgaaaagattatttatacagatgaattgtcacatgtctcagtatgcactgtaattctaatctgagaagcaggattgayaaggagagtgagagagtaggaagaatttgagccaggctccctaggtgtttctctatagcagatgtattagtctgctcaggctatcagtctaagtggcttaaacaacagaaattgttttaagttctggaggctggaaggccaggatgaagatattggcagggctggtttcttctgaggcctccatctttggcttgcagrtggctgccttctccttgtatcttcatgtggtctttcttctgcamacatctgtgttctagtctcttccttttaaaaggacaccagtcatattggattaagtcctactctaatacttcatttaaacttaactgatctgcaaatacaattccattctgaggcactgaggaatcaggacttcagcatatgaattttgggttgactcaattcagttcacaacagtgaaaccacctctgcaaaattatgactgagattatgaaagagatctaaccaactccatcttggttctaactttaagctgtccttgttccttcctgggtgtaggctgaactaactttgggaggaacttagtttatagtttaaacagagatgataacagcccttttccaaaacaaacctccttcttgcctggggactagactgcctttgtaggactaacaaattagccacaagattagaaattatggtttaggagtcaggcagctggaggctacaggattctgaccctccttaaactgctcctatcagtgtttcagatattttgcagaccttgcacttgatggatcagctggcaccacccagattgataaagtggctcatctgatcttgtggcccatacccaggaackgactcagtgcaagaggacagcttcaacttcccatgatttcatctcctacctaaccaattagcactcctggctcactggcttctctctacccaccaagttgtccataaaaactctctgaatgctcggggatactaatttgaataaaagtaaaactcttgtctcccacacagcgggctctgagtgaattactctttctctatagcaatttctctgtcttgataaaccggctctgtctaggtagtgggcaaggtgaacccattgggtggttacaacagtgggccagggacataaaataccaaaagtagctacacattccatggagacccgaacattcctgcactccatcttggtccttcttgagcaggctctgagcctgagttggtttttcatgaggatrtttcaactaggaggaaccagcctcacagccagacacaatctcttgaactgttatattccccgcaaaaatataacagttaatgcctcagcccgctttgtgagagaatctcttgaatatttggctaagttgattcagtttccctggccctgatcacattaactgccattacctgggagtccaggggaacgactttaaggatcagtggtgtggcagggactattaacaataatggctcctgtgtcctgaattgtggtgggcattctacatcagtgttgtctcatctgctgcttgtaacatctctgagataaagatgatattattgcctctagattacagatgaggaaactgaatactaaaaaatgtaactgtcatagtataacaaataggaaaaaatttgaagtttcctatgctctgagctacaatgttaaatacagtttaaattatctcagttggttttgtaggggaggaaaaactctccttctacccttttgggatgtgtggctgggaactatgaattgaactgacaaaagacagattaacaggagcaaaggcatacaacttttattaacagttttacackcacaagatgttcaaagacacaggggcttgtatatcatcctaacaaataayaatttgtgaaggaactagataaaggaaaagaggattaagactcctaggcacagtgaattttcgggaggcgatgaggaaatgtatggcatataaggattgcttagtagggcttgttatgcagattcattttggtgccaagagtcaggctcctctccctggtatggtaygggggggataccttaacaaatggaaatctatgctttgcttttaggcaaaaagggggagggaagagaggtcttcccacatctgctgttttgcaactgccttcagctaaaagtaatttttatgccaaagtggcatattttgggggtaacattcatattcccttcagtttctacarcactttgaggcaggtctgattagccccattttttccttctgcaatttaatgttaatttttcatttttgtgaggacatagtaggtatatatatttatggggtacatgagatgataaggcatgcaatatgaaataatcaaatcatagagaatgggacatccatcccctcaagcatttatccttggtgttacaaacaattcaattacastcttttagttatttaaaagtatatagttactattgactatagtcactctgttgtgctatgaaatattaggtcttattcattctttctaagtgtgtttttgtacccattaaccacccccacctctagcacagccccctaccaccctcaccagcctctggtaacaatccttctactctctatccccatgagttcaattgttttaatttttagctttcacaartaagtgagaacatgagaagtttttctttctctgcctggcctatttcacttaacataatgacctccagttccattcatgttgttgcaaatgaaaggatctcattcatttttatggctgaatggtactccattgtgtatatataccacattttcttttattattattatactttaagttctgaagtacatgtgcagaacatgcagttttgttacataggtatacacgtgccatggtggtttgctgcacccatcaacccgtcacctacattaggtatttctcctagtgctgtcccttccctagccccccaccccccaataggccccrgtgtgtgatgtttccctctctgtgtccatgtgttctcattgttcagctcccacttatgagtgagaacatgtagtgtttggttttctgttcttgtgttagtttgctgagagtgatggtttccagcttcatccatgtccctgcaaaggccatgaactcatccttttttatggctgcatagccttccatggtgtatatgtgccacattttctttatccagtctatcattgatggacatttgagttggttccaagtctttgctattgtaaatagtgccacaataaacatacatgtgcatgtgtctttataatagaatgatatatgtgtgcatgtgtctttatagtagaatgatttataatcctttgggtatacacccagtaatgggattgctgggtcaaatggtatttctagttctagatccttgaggaatcgccacactgtcttccacaacggttgaactaattgacactcccaataacagtgtaaaagcgttcctatttctccacaccctctccagcatctgttgtttcctgactttttaatgatcgccattctaactggcatgagatggtatctcattgtggttttgattttcatttctctaatgacaagtgatgatgagcttttttcatatgcttgttggctgcataaatgtcttctttttagaagtgtctgttcatatccttcacccactttttgatggggttgtttgtttttttcttgtaaatttgtttaagttctttgtagattctggatattagccctttgtcagatggatagattacaaaaatttttttcccattctgtaggttgcctgttcactctgatgatagtttcttttgctgtgcagaagctctttattttaattagatcccatttgtcaattttggctttcgttgccattgcttttggtgttttagacatgaagtcttcgcccatgcctatgccctgaatggtattgcctaggttttcttctagggtttttatggttttaggtcttacgtttaagtgtttaatgcatcttgagttaatttttgtataaggtgtaaggaaagggtccagtttcagttttctgcatatggctagccagttttcccaacaccatttattaaatagggaatcgtttccccatttcttgtttttgccaggtttgtcaaagatcagatggttgtagatgtgtggtgttctttctgaggtckctgttctgttctatttgtgtatatatctgttttggtaccagtaccatgctgttttggttactgtcgccttgtagtatagtttgaagtcaggtagcctgatgccttcagctttgttctttttgcttagaattgccttggctatgtgggctcttttttggttccatatgaagtttaaagtagtttttttcaattctgtgaagaaagtcaatggtagcttgagggggatagyattsaatctataaattactttgggcagtatggccattttcacgatattgattcttcctgtccatgagcatgaaatgtttttccattyatatgtgtcctctcttatttccttgagcagtggtttgtgtagttctccttgaagaggtccttcacatcccttgtaagttgaattcctaggtattttattctctttgtagtaattgtgaatgggagttcactcatgatttggctctctgtctgttattggtgtataggaatgcttgtgatttttacacattgattttgtaccctgagactttgctgagatttttaccctgagactttgctgaagttgtttattagcttaagaacattttgggctgacttggtggggttttctaaatatacaatcatgtcatcagcaaagagagacaatttgacttcctctcttcctatttgaatacatgttatttctttctcttgcctgactgccctggccagaactttcaatactatgttgaataggagtggtragagagggcatccttgtcttgtgctggttttcaaagggaacgcttccagtttttgcccattcagtatgatattggcagtgggtttgtcataaatagctcttattattttgatacattccatcgatacttggttaattgaaagtttttagcataaaagggtgttgactttggtgaaagccttctctgcatctattgagataatcatgtggtttttgttgttggctccgtttatgtgatggattacgtttattgatttgcacatgttgaaccagccttgcatcccagggatgaagctaacttaatatggcggataagctttttatgtgctgctggattccgtttgccagtatgtcattgaggattttcacatcaatgtttatcagagatattggcctgaaattttctttttttgttgtgtctctgccaggttttggtatcaggatgatgctggcctcataaaatgagttagggaggattccctctttttctatactttggaatagtttcagaaggaatggtaccagctcctctttgaacctctagtagaattcagctgtgaatccatctggtcctgaactttttttggttggtaggctattaattactgttattggcctattcagggattcgacttcttcctggtttagacttgggagggtgtatgtgtccaggaatttatccatttcttctagattttcgagtttatttgcatagagatgtttatagtattctctgataggagtttgtatttctgtgggatcagtggtgataacccctttatcattttttattgtttctatttgattcttctctcttttcttctttattagtctggccygcggtctattttgttgatcttctcaaaaagcaagctcctggattcgttgattttttttgaagggtttttcgtgtctctatctccttcagttctgctctgatcttagttatttcttgtcttctgctagcttttgaatttgtttgctctttcttctctagttcttttaattgtaatgttagggtatcgattttagatytttcgtgctttctcttgtgggcatttagtgctatgaatttccgtctacatactgctttaaatgtgtcccagagattctggtacattgtgtctttgttcccaytggtttcaaagaacacctttatttctgccttcatttcgttatttacccagtagttattcaggagcaagttgttcagtttccacgtagttgtgtggttttgagtgagtttcttaatcctgagttctaatttgattgcactgtggtctgagagacagtttgttgtgatttctgttcttttgcatttgctgaggagtgttttacttccaattatgttacaccacattgtctttatccattcatctgttaatggactctgaggttgcttccaaatcttagctattgtgaacaatgctgtaacaaacatgggagtgcagatagcttttcaaaatatgcatttcctttcttttggttatataaccagcagtggaattgctggatcaaatgatagctctatttttacttctttgaggaggctgtaaactgttttccacagtggttgtactaatttacattcccaccaacagtgtacaagggttcccttttctccacatccttgacagcatttgttatggccttttggacgtaagccattttaacattttaattggggtgaggtgatatctcactgtagctttgatttgcatttctctgatgatcagtgatgttgagccccttttcatatgcaagtttactatttgtatgtcttcttttgagaaatgtctattcaaatcttttgcccattttttgatcagattattagatttcttcctatacagttgtctgagctccttatatagtctggttattaattccttgtcagatggatagtttgcagatattttctcccattctgtgggttgtctcttcactttgttgattctttcctttgctgagcagaagctttttaacttgatgtgatcccatttgtccatttttgctttggttgcctgtgcttgtggggtattactcaagaaatttttgcacagaccgatatcctggagattttcccccaatgttttcttgtagtagtttcataggttaaggtcttatatttaagtcttcagtacattttgatttgatttttgtatatggcaagagataaagggctagtttcattcttctccatgtggatcttcagttttcctagcaccatttattaatgtcttttcttcagtatatgttcttggcatcgttgtaaaaaatgagttcactgtgggaaatgagttcaccgtgggattatttctgggctctctattctgttgcactggtctatgtgtctgtttttatgccagtaccatgctgtttgggttactatagctctgtagtataatgtgaagtcagataatgtgattatttcagttttgttctttttgcttaggaccgctttggctattccaggtcttcttaggttcaatataaattttagaattgttttctttatttctgtgaagaatgtcattggttttttggtagagattgcattgaatctacagattgctttgggtagtacttaccattgccagtgagttttctaccttcaggtgattacttattgcagattaacatccttttctttctgattgaagtactccccacttaagcatttcttgtaggacaggtctggtgttgatgaagtccttcagcttttgtttgtctaggaaagtctttatttctacttcatgtttgaaggacatttttgccagatatactattctagggtaaactttcttctccttcagcactttaaatatgccatgctactctctcctggcccataagctttccactgaaargtctgctgccagacatattggagctacattgtgtgttattcatttctcttctcttaggtttgagaagttctctgttattattcctttgaataaattttctacacctatctcttcccttacctcctctataaggccagtaagtcatagattttcacgaggtgggcagatcacttgaggtcaggagttcgagaccagcctgaccaacatggtgaaacaccgtctctactgaaaatacaaaaattagctgggcgggtggtgcacacctgtaatcccagctacttgggaggctgaggcaggaaacttaaacctgggaggtggaggttgcagtgagctgagatcatgccactgcactccagactaggtgacagagccagactccatctcaaaaaaaaaaaaaaaaaaaaaagcccggtgtggtggctcacacctgtaatcccagcactttgggaggccgaggtgagaggatcacaaggtcaggagatcaagaccatccaggctaacatggtgaaaccccatctttactaaaaatacaaaaaattagccaggcatggtggcaggcgcctgtagtcccagctactcggatggctgaggcaggagaatggcgtgaaccagggaggcagagcttgcagtgagccaagatcatgccactgcactccagcctgggtgacagagcaagactccatctccaaaaaaaaaaaaaaaaaaaaagtctcagattttccctcttgaggctattttttcttttgtctcctctactttcaaatagcctgtcctcaagcttgctaattctttcttctgcttgatgaattctgctataaaaagactcttatgcattctaaagtgtgccatytgcatttctcaactccagaatttctgcttgattccctttaattatttcaatctgtttcttatatttgtctgatagaattctggattccttctctgtgttatcttgaatttcyttgaggttcttcaacacagatattttgaattctgtgtctgaaaggtcacatatctctgtttctccaggattggtccatggcagcttatttagttcgtttggtgargtcatgttttactggatgttgttgatgytaatagttgttctttggtgtctaggcattgaataattagatatttattgtagttsgcactgtctaggcttgtttgtactcatttttcttgggaagactttccaggtatttgaaaggacttaggtgttgtgatctaagctgtatctgctttagaggggtccccaaacctagtaatactgtggttcttgaagacttgtggaagtactgccttgacagtcttggactggatccaagagaattttctggattaccaggcagagactctttttctcttcccttactttctcccaaacaaatgaagcctctctgttctgagccacctaaagcttggggaaaagtgacacaagcactcctgttgccaccaccactagtctgaccctgaagtcgtcagacctagtgccagcacagcactgggtcttgcccaaagcctactgtaaccactccctagcaactgcctatgtttgcttaaggtccagtggctctataatcagcaggtggcaacccagccaggactgtgtccttcccttcagagcagtgggttcccccagaacctgggtgggtccagaggtgccaaccaggactccgggactagaatcaaaaaccttaggagtctagctgctattctattgtactgcagctaagctgcactcaaatcgcaatacatagtccttcccattcttccctcctttttttaaaggcagaggggcctcatcccaagtacaccaccataggccatgagtagtagtacggccagactatcactgatagtcccttaaggcctaagggctcttatgtcagcttgtggtgaatgctgcctggcctgggactcacccttcagggcaacgggcttccttctggcccagggtaggtgcagagatgccatccaagttaagccctggaatcgaggtccccaggagcctccttggtgctctccctcactgtggctgtgctggtacctaaggtgcaagataaactcccctttacttttctctctgcttttctcaagcagaaggagtttcaccctgtagccaccaaagctgataaaccgctgagtctcacctgaagccagcaagtctcagaggctcactcaagacacttgacgtagaacttgggtatcactgcttgttatttagcccccaagggctcttcagttagcagktgataaatgctgccaagactgggtccttcccttcagggctgcagatcctcttctgggcgggctgcagattctcttctgggctagggtgtgtctagaaatgttatctaggaactaggatctgaaatgggggcctcacaactccgactsgttccctatcctgttgctgagctgatatccaagatgcaagacaaagtcctcactcctctttctcctctcctcaagcagaaggaaggagtctcttttggagccacaagccgtgcagcccggggtaggggaggggtgacgccactcccttagccaccccagctggtgtctcagtatgtcatgtgccttccacaccccaggtccactgtctctgggcccagttcagcactaggacttgcctaagagttgcagtcctcatggccaagactgccttttcagtttacttagagacccagagcagtttagtccttgggagtgaggtttgtgggaattcaagttcagactgcgggaatcagcgattcccctctggctagggctggtttaaatactcccttcatgggtaggcagctgagtttggtccagttaaacagggaagcactgagttcaatgcctcagaattactatgttcttgttctccctgcagagagaaatgctgtctgaaccatgctgctgctgtggagtggggaggggtagcactggctgttcaagatgtttttctatctcttcggtgccactttcagagatatgaagataaaacctgttactatgagggctaacctgagagttggttcttacacaagtgatttccctgtgtagacagttgttaaattggtgtctttgtcggggagacgatcggtggtgccttctattccaccatcttgctccacctctctgcttcagcctcattttagagatgagaaaaataaagccaagcgttattaagggttacaaggtttataaacagaaattaaattataagccggtgtctatgacttcaaaaccactaacatgtgtactgtgtaaataaaattttctttaaaattaccattttatttcataacagttttagatttatagaaaaactgtagagagagctcagaaaattcctatatactctgcacctaagttcccctattattaacatctcacattactatggcatgtttgttacaaataatgaaccgatattgatacattagtattaactaaagtccatactttatttcnatttccttagttttttatctaatattctttttctgttcaatgatcccatccaagacgccacattgcatttccctgctgtgtctctttagcttcctcttggttgtaacagtttatcagacttcctcagttctgatggcagttttgaggagtactgtcaagtagtttataaaatgctcctcagttggaatttacctaatgttttctcatgataggactgggattacatgttttgaaaggaagaccatggagtaaagtgccattttcatcacattataccaaggatacacactatcaccatgagttaccactgttgatgctggcttttgatcatctggctgagatagtgtttgcaggtttcttcactgtgaatacaaataattattttgtctgcctattttctcctcrgtcttacttcattttcacatttctagatagtagcaatctctgaacttgtccttttgcaataattccacatcatcccgttgtcaatgtatsatgtgtactaactgcttgtcattctgcwatttcagtgagagatttgttcttgcctttgtcctgtgtgtgtttttttttgtgtgtgggcatgtgtaaaagggagtaggtagcttgtcggtaaccttttattctaaggattctgcggaccaaaaatatagagtctaagagggctccagcactgtgtccaaacagtagcaatcagagggcatttgggaggtacctagactgaggcattgaggggagatgaagtttggaaaaaacttcctgagtttcagttttctcaatggtaaaatattaagattgtgaatgctaaggtcccttcccactctggaactaggaatctggggtctgtaggtaggaaaataagcctggttctcttcctgtaccaactttatttctttagcagttcattacaagctaaagcatcagcaagaatcctggctcatagtccctgggggtatttccttggctagagtctctgatttaatgaagatataaacattacttgtggaaacagatctcagctgattgctttgcccacgcttgcttccttgaagcagctctgccctgtttcctcttatccctgttgtgtttcctactatcttccttgtgccttaccatcagtgagacagacttgtaagacttcttgtttatcctctgggagcatttttgtaaactcaggtgggagctcactcggattaggcatgaatggtttttaatttggccattttggctcaaagctgttcccatttctacaattatttagggtaagagtcagagtacaaaaattttcatttttgctttgtgaacttgagaaaattgcagttaaatttttctctatccttggccatttgccacaaaatgaaacttccttgtgaaatttatgcctgctgataactttttgtttaattaaatcttacatgttaactaagtaccagtaaacatttactgtagcctgttgcaatctttctgtttttgacaaagtacccttgcactctgctatgtaacaattaactttttgcaagctagcaacttgtccatttacaatgggcactgaatattctaattattgcttctggatagagaatgaaaagtctaggaaggtgtcgtcttgtcccacttttgtcttgcactcatttctcctctttggcaactgaaaattgaagttcttcttccatcagtttttttttttctcattttctcatagccccatttaagacaaaagctttcattttgtgtgttgtcaattcctctgggttcacttacatcagctttggctggattcatgtttaaaacattttcagagggctaaataatttatttgaaagctagtggcaaaagacacttaaaaaattaaaccaagagaatgggtttgaaagaaaaaatgttgctgggaaccaagctatgttgcctaaaggaggagagatccccatttcaaaagcaaaagtaaatgtcatctaagtgtgaccttcgtacatatgatttcatgaatcttgtttgaatgtataaaatatgggtcaaaatatgcctgaataaatatttctttaaaatattggcttaaaaatcctctaagttttgatactatcttgttacttatgttcatatcatattgcagttgtgaacagagtcactagctctttgaataataattaaatacacttcgtgcccaatgtcaacaaattctctcagattttgtaaaactgtattggattttttctacttcattttttattacagattcatcgtatcttactctaccttgatgttatctagaattgattctccttatacttaacaaagttttcctttttctagcaaatgtcatttagagggactagactcaaagttttgcccccaaaattcgtgttggtttgccagaaaacaactgaggccctgaatgaatgggctctagcttttcaggaaagctagaaataaaaaaccaggaggtggctgggcgcagtgactcacccctgtaatcccagcatttcaggaggctgaggtgggcagatcacctaaggtcaggagttcaagaccagcctggccaatatggtgagaccctgtctctactaaaaatacctggcgtggtggtgcacgcctgtagtcccagttactggggagggaggcaggagaatcgcttgaacctgggaggcagaggttgcagtgagccaagatcatgccattgcactccagcctgggcaacagagcaagactctgtctcaaaaaaaaaaaaaaaaaaaaaaaaagcaaaacaaacaacaaaacaccacacaaaaacccagggggctcattgtacttttcatgggcaactgacctccactgggcacgtgccaggccctcagtaggaacaactgaaactgggaaattaaagcactaaccgtttgcccttagaaacttacaatttagtatgctctgcctctcattataatgtcatgagatttacatatattattcatttgaaaaaagtcccaaagtccaaaatggttgaagggcaactgagtttactgtattttataatttgagagtctgtgaaaggagaaaagatgtggtacataggatctatgtatatacacaatttgcaatcatatattcatgtcacttgcaaattaaactgtttttatgataatttttcctttttkcgagacagggtctctgtcacccagatggaagtacagtggcacaatcacagctcactgcagcctcaacctcctgggctagagggatcctcccacctcagcctcttgagtagctgagactacatgtgtgtaccactatacctggctaattttttaattttttttatagaaatgaggtctccctatgttgtccaggctggtcttgaactcctaggctcaagtgatcctcttgccttggcctcaaygsaaagagctgggattacaggtgtgagccgtggtgccyggcctatgataataataatacatccacatgtttaaaaaaaaatcaaaacgtaagtttggatataaaatgaagattacttccccattctggctcaggctgttaggaacttgtctattctatacaagacagaggttctcattcctgactgcagtctatgaaggtatgaaatatagatacctggttctttacccagaactactgaattacagtacctaagaatgtaagcacctgttttaaaaactgtagaggtgattttgatgtgggcctagattcgagatccaatggttcatatgctactgtgactttttacttatttaagaagttatcaagtgtttgggttttgctgggagtccttaactttaccttaggatcccttaaaattctgggctcttattttggtctctagagggaatacacacaaatcagagcgaggacatacttgcccccaagaggaattccccttggccctagaggaagcactgtgcaggaaacatttgtgaaaaggtggtagtaaaaccacgataataggctgggcgtggtggttcacgcttgtaacaatcccagcactttgggagcctgaggcgggcggatcacgaggtcaggagatccagaccatcttggctaactcccccggtgaaaccctgtctctactaaaaatacaaaaaaattagccgggcgtggtggcgggtgctggtagtcccagctactaaaggctgaggcaggagaacggcgtgaaccctggaggcggagcttgccgtgagccaagatcgcgccacagcactctagcctgggccacagagggagactctgtccaaaaaaaaaaaaaaaaaaaaacaaaccacgataatagtagcaacattaacatcaatcagaaaaaacaaaacaaaacaaaaaaaaacctgtccataaaccctttattcatcccagtaaatcaaactactttctttggctgtcgaagtttggagacataaacaaaggaaacattgatgaaacattccagcrtatgtttgcttctctctcagatcagatcaaaatacacaaagagttggtattaccagacgcttaatcaattacccamaactattgggctttgaactttctaaagaaataagaatagttttcaaataccctctaccagaaactaaatgtgacaatgctttatcctcaactcagctacttaaaaatcaccaaggaatgcattttaaatttctttcaagatactatgttctccaaaagatctcaaatccttttctttttcttttatcagaagcttcttttatcctttttcttttcccagaaacttataggcttcaaaacaataatgatacattggaggctatgtgttgtggtgtgcagttctgagtttggatttttttaggtacttattttcaaatctaaatatttttaaaatttatctgcctatagctcctaacaggtcaaagtggcaacattttaaaataaaggatttaatttttttattgtttgaaagacttagcatctctcataattggagtttgtgtagtttatttgtgttttattactcttagacatatggctaagcaattttataagatccacagggctattgagaaatgtcagccctctgcgattccctcaggttctttttggcgccatcaatattttattgtttaccatttacttcatggtttggaactcttcctgtcttcctcccaacccaataaaactctgtaatttaagcagcagctcaggaagtgagggggatgaggttggtttgggtcttctgaaacagacggactgcataagagtctaacgcctaatataagatgaacctttctgactcccaagcccatgatgaagatatttggggctggagttgaaatacaggagactgtaccttttatgaaagaaatcttctytggtttgtgtagaactttagtgttttggacataaaaacagaaatcaaattgcacacaaatatgttcaagaatttataaggaatgttctggactcagactctaaaaacagtgagtttaattggggacccgttttataaatttacagggtgcctttccttgactgcttgcccaataaaaagtgggattttaattttgaagttgccttcagcgtctaataaaaatatgtctttaattaacagtgacttggataacttttgtcactgcactacacaataaacctttgtagtgctaccttgcatgctagtgctaagaaaactatcctacatctgcccgtatgtacttcacttcagacttgtgactggaagcattctttaggtaaaatagtattatcttataaagttatgtgtcagtctctttgagattaacattcacaaactaagtaagactgaagcatatttttgtaaagcattcatactataaacatttccagtatctactatatcccaagcgctgccccagaaactacagaagcagagataagagacgatctctattctcaaggaccccagtgtttctgaagaagccactgggtggagagaaaaccactgatgacactgctgtgtcatccatggcctggggcactccaagggtctgtgggagcaagcaagggaggccgtcctacctgcttcctcatatgtccgttaaagttaaaartccttktattgatgtgactttgacttggactcatgggactcagaaaagctgttatactcatggttgtagtttactaaatatatatagtttgtgaaacatgttttagtacagtgaaaggatatacattaaaatcagcaaagggaaaaggcacatggagcaaagtccaggtgacaccaggcacaagcttccagctgtcccctcccactggagttgcacaagagtgtgcttaactcttccagcaacaatatgtggcaacgtgtgagaggtgttgtcaaccagggaagcacatccagacattggactggggtttttgttgcggatcagccatgtagcccctgtgtgactggcctcagacacaagacaccagcccttttcccagagcaaaaataggcattccctacatataacattattagcataaacctatgtggttaaatgagtctagcatggcccaagacctcagccatacaaaagcactctcatccggcagaatattctaagggcttagaggttgtctcctgggagctggccaatggccagttctgaaggtaggctaactatactaacagtccttgctaagtattccacatgatatgtcttattctgatctattcctggtgtgaaggtagtaatactgtatctgtttaagctacaaaacaaatctccccagtggcccagcaggatgcagttcctgaaaattcctaacttaataatctctgttgtaggatatgaaaaataaaagtaaaaaatactggaacattactagagttccactcagtcgctaacaattcattcagtttatctaatggctaaagtgtctcccagagcaatgccattcaggtatgcagatttccatttgaccttgtagggttccaaaaggagggataatcttggcaaatatatagctgtactttctggtatctagtttaattgttctaagagacaggatctttctattacgctaagcctctctagaggcacaattgtaatattgaatttcccttgctgcataacccacttttttattctcttccttccaacaatactattgctccttctctccacttgtcattgatttttacccagacttttccacctgtggaagagatattaagttcaaccactgtgctggtccagactgcaggcagcaacaccactctagcaagtacctacctcttagaccactagtattcatatagagtaggaataaagggtatagaccagtgggctttctcaaccaccatgcaatatagctgcattcactgtcaaccccaattatgccagttagggtgaaggcaccatccaacccattaggcccttcagaattctggcatagatatttaaaggcttagttacactttttgcttagagatcatccctacttcattcctgtttctggcactagagttgtagccctgctggcaggaacactgtatcagttaggaaaagaggaagttaaagtgatgtgggaataattgtacagtcatactagcattctagtcatcccctttaccccaaatccaccagaaaagcagaagaatctactgactggagacctgcccctggcccccatcatgttgaatctgagcacccaagcatgaatgtgtgtaagccagccccgcataccttatctccttatgtttgggacaataaatgttaccagtgcccctaccaattctctatcaagctattcctctgagggtggtaagaaacatgatgtatccatttggtgtgatacctctttttccactgttggacattatgggccatagagtatattctttggtttaaagaaatgtaactcagtggttttacatggtgtagtatttttgctccattccttttatggtgttttgagcatttgcgtccaccactgggtatgcaaagtgtggtccggagtgtctattcctgtcaggacccattccaaggcaactggcactgatggcataataaagtttctctgtcagctctgcaccagggacctaccctgaggaaatctgccccattactgtctgcagtgttcatgtttcctgctggcggacaggacagttcctggcactttgtgcttctgagggtgcagaggaatatgtgtctatgattacccctctctgcattgctgccacttccccatgtccactcacttcatggacccagttggccacctcaagtaagtgcaacaagattttgacttaaagttgcaatcactttcaggctggaaaagaggttcttctcatgagcattkatgtgtcttatttaatgcatcccttaaattcttttttttttttttgagacaaagtctcrctctgtcacccaggctggagtgcagtggtgcaatctcagctcaccacaacctccgcctcctggcttcaagcgattctcctgcctcagtctcccgagtagctgggattacaggcgcccaccaccacacgtggctaatttttatatttttagtagagacggggtttcacaatgttggctaggctggtctcaaactcctgacctcaggcaatccgcgtgcctcggcctcccaaagtgctgggattacatgcatgagccaccatgcctggttgcattctttaaattcttactgatgttcatagggccatgatccatatggacattcctttaagaatccagttttccattgcccattttcctgaccatgtagccagccatccactggccaatgcccatgagttggaatgcacccagactttggggaattgttcaattcttccatcackgtgagaaaaccagtaggcaatcaagccactgagcttatttgttctcaacttcttcaattagaatttttgcattatttggtcatagtgcagagccttccaaacaggatgctgaccatccactgtgaaactgttatctgtaaaccaagcagctttttgttgatcaatcaagggctgtttataaggacccccccaaccaccaggtggttatacagtctggtagtttctcagagggttccaaagtgtgtcctagaggaaatgaggctacccattcatgcatacgatgagaacctccttgcattcttccagtagtatattcctgtataaaccatttccattttattacaaagtcagctcttctggtcaatggcttccttatcagaatttttctctgacatcacccaagacatcataggtatatcagattttaagattatcatatgtctttcagttattggggcagtttcaattaatgcccaaaaaatagcagcacaacagcaacacaataatgacatgtactatactgccacatctggaaattttctggttcccagttccagtggtcaccatcaggcaccacttacgcactttttttttttttttgagacggactctcactctgtcacccaggctggagtgcagtggtaccatyttggctcactgcaacctccacctcctgggttcaagcgattyttatgcctcaacctcccaagtagctgggattacaggcacatgccaccatgcawggctaatttttttttttttttttttttttttttttttttttttttttttagtagagacagggtttcaccatgttggccaggctggtctcaaactcctgacctcaggtgatctgccctcctcaacctcccaaagtgttgggattaaaagcatgagccactgcatccggcccacttatgcacattttaacttcagtctgtagaaatgtaagttgcagatacttccaaagtcagaatatggatttttaagggcctaatattgattcagccatcacttcttgcaattcagacagttggctgttgcgaagagtcccattcaaacatagccttccttcagagactcttttttctttttattttttgagacagggtcttgctctgtcacccaggctggagtgcagtggtgagatcacagcttactgtagcctcaacctcttaggcataaatgatcctcccgcctcagcgtctggagtatctgggacaacagacacatgacatcttgcctggttaatttttggattttttgtagagacaggatttcaccatggtgtccaggctggtttccaactcccaggctcaggcaatctgcctacatgggccttctaaggtgctgggattacaggcatgatactattttgcacaggtcaaaactgaagctcagacaagatcagaaacttgtccaaggtcacagagtaccaaaactcagggaggaaaagactcctggttgcctggttatccaacatctattcttccctttacttattagtaaaatctgtaaattttsgctgagcacataactgcctagtttgaaatcagcattcccaagcctccccaggataatctgtaaaactcagttctgatgaatgggatgggaacagatcattcacgctcttataaaaaaggggcaygtgctttcgttcttttctcctcttcccactggctacaaagatgacttgcttatgggaacaggagaaaccctgttgatggtaattgccaaacagatccactaggatttggagccaggttggtcaggtgctagagcctatgctgtattaggctttcaaaggtaagagtgtttgaagaatttaccaaaacttagaggtaacctgttctygggatgccagcaggctttggcaatgaacctacatgaggttggacataggctccaacattkactaattaaggaactatgggcaagtttcttaatctgtcttttttcttttttttttcactgttccaaagtttaattaaaaacacaatttacaaatatttaatatcttctgaaaagcatttctaagttaagaatgaaaaagtatgtacataatatataatcaaataccaggcagcctcaacttccaccaggtccacactcagcaacatccgtctttttaggtttttcagtgtcttctgtcaaatccacaaagttgttttccatgacgggggaaggaatggaaatacccattgcttttcgaactccatacatgcttacgatatcacctggagttacttgctgtgcaagttctttaaggttattggtcacttgttcagcaagatgcatttctctgtatgagggacccaagagacagatcatgttgggagggggtctggtgctcaaacgttcattctgggcttcctggagttccctgagcaatctggtggtctcaccaaatttcttctggaatatttcagcttcttcagagtcaaaaacttcaactggaacgccaaaatttgttactgctttcagcgctatgagcctgtcttgagtattggactccaaacgccctgggggctctacttctgtaatctccatttttttttgctgtgtcaagtgtcttagtatggccttcatcttcaggcaatgacatctccatctcttgtagggtcctggaatgccctccttttgttaaaacatccagtaaactatctgccatgacatatggataatcttggcacgtggccaaaaactcatggatgctgaaaacgcttggaagatcagagtcttccccataggttgaatagattaaatcagaatcatccttgctgatattcgcaaatgtggagtcataatgcggtgcataagaaccgtagggcccataattcaaatataacactggagtgactttgttccttttatcctctttgaacccctgcaaagtattcactccagactgaagtcttccagttgtcattcccagtctcacagggcagtagcctggctctcctacaatgggatccacaggatggagaagtcccaacgtcgttgttccatctggttttcttctttcaaattcgcactgactgttcacaagccgcctggtcagttttcctccagattccttcacaatgcggtcaagatgctyctgctctctctctaaattattgcttttaaacttatcttcaagcgtatctttttctttttctttgctgggactcttgaaggcgtgtgcttcggcatctccagagtcctctctctctgccagcagcctccgtcctccccactctgtgaggtgtctgttccatctttctgctttcgagttttctgcaagtcagccatgaagtctatgctctgcttcaggctctgaattctttcctggctaagaattttcatccctgagtgcaacagcttctttgcagctttataataaatggtctctggtttattgtaaatcatggcattagtacacattagtttgaagttatcctttagttcttctatggactgatagtcattgttcttgatcttttctttcatggtactaaaatccattgggtgtttaatgatcatggagtagccaggagcaataaaatcagtcacaggaaatgaaaagaaagcacttggatcttttctctacaattgtctcatcagttgattcaaagcttcttgaaggggtgtctgttctacttcttgtttggctaaagagcttgtgagaggcttctcagggggcaagtctaatctcacaggggcgtgacactggaggtctttttctgcctcattctccacccggtctcgatctcgcttctttttatcctccttaactcttctccgttttctccccttttcttcccctggaatctgcttctctcctttctttctctttttccgctttctgtccttgtgtttgtcatgatcgtttttgtcttcgaagaggctggagtcgtgcctcgagctgcccatggagagttcggtgacttcgttccctcctactttgaggaccagcttcaatggcttctctacatactcctcgtggaggtgtttgtccgacttgtgcttcttgtgcttcttgcccatgtccgaccgggccccggtgcccgtcccccgcgccaggccgaggccgtgcggcgccgcttccggtccgggccaggcgagcggagggcgggagcggggcccgcgagactccgcgccgcgaggcaggcgtgcggcgcacgccgggcggcgcgatgcccgtctccaatccgtcttttttcttatttggaaaatgagaatgtcaatagtagctacctcataaggaagatgttagggcaaacaagatagcatatgtgaatcggcttagctagcattattgctggctaccttgtacaaagtagcaagtattattattattatagctattcattcactataaaatgttcataacaccaaagaggatttgagatactatatttaaaatgcttaccacagtacttcttgtatggtagagactccataaatggttaaataggtaccaacacttatatatttaaacagaaaggattcttctccctgcaaaaaagtcaaataaaatgaacatgaataaaataattccagtttagatttcattgtagtaatatttaccatcatttacttacagagcagggatgtcataacagttaaaaaaaaaaaaaagcactcattcttttgtcactgcttcagctgacaacttatttcattgggcaggatttgccaaccatatttgatctgagacccgaatttaaaactgtgttgaggctttcactttatgtcataacaataacagaaaactagagaccgaggattcatgacagatgatttaaaaaaaaaaatgcaacccatagggtgtgacctattattagaagagagagaagaggaaacaaaatttgtatatctttctagagaaaaaagcagaagagactcattatttaagaaactcaagggcagttgcagtggctcgtgcctgtaataccagcactttgggaggctggagtccaggagtccagaagttcgagaccagccttggcaacatggcaaaaccctgtctctacaaaaaatacaaaaattagccaggcgtggtggcgtgcaatgtagtcctagctacttgggaggctgaggtgggaggatcacttgagcccaggaggcacaggttgcactgagacgagattacgccactgcactacagcctgggttaaagagccagacgctatctcaaacaacaacaacaacaacaaatcctcaaaataaacactgatcttgagaacagaagacctgaattctggtcttgtcattgtccttgtcctttagctaccgtttacctcctggaactggatgaaggattttgtagaacttaagaagttcattgaaatgatagccattttatttcctccaaagagctcaaaagaaacacgtgagattctctcaattactttctacagaagactcttaagaaggaaactattttaatcagctccttccatctgggtttctgtggcattaatatgtacctcaccactgacattaattattaactgttcctagtaacagttttaggatgccactaaaagggaaaggggattactttactgattctggggtcaacatcttggtggctgaatcaattaagttagatatgtatttataaagcattactagggcaataagcaacaccttttcagggaaataacacattatagtgtttaacttactttcacacacattaactacttgactgtggttacagggttgcattgtgaagagcctgaagacttggaatttcagcactcttaggctggtcactcccagcctctttctcttcccatctgtaaaatggagatcacactacattccttctttatctatcacaaagaatcgtactgtggctcaaatgaaaacacatgcaagggaatgctttgcaaattgtaaagccttgtgtatacagcaagcatcatatttaaatactgtaatattaaagcagaggaaacagagggtataagatattcctgtccttggtaaaggtaactgggcaggtagtggcacagctgtactccacaactcttctgcccccacatatgcagggagtggagtctgctaaatctttggccacacagcagctgaactcccttgcttgtgttttgaagcctccccttcctccctaggcacacctctgcttacttaaacttacctcattacttaaactgaaaatgccactccctctcctggtctcccctaagctgagggatgggctgtggcctcggcccagtaaccttctctatctgccttgggttgaaagctagagaatgagaagggacaggcccacatgggctccagggtgagggaggaggagatggcggctttgctgtgaaagcagctccccactgttagcggtgcagccttcagttcttgcccggggcctggtgatccaggcactgggttcctcccctctatggagtgatgtgggtgttgtacctggtggcaacagtcccaaatctggctctctggctttctggagagtctgtgagctacccagtagctttaaaattacttcttctcaaacatgaatcatacaaatccctggagggttgtgtcgaaatgtagattcagattcagtaggtctgggtgggcataaaattctgcatttctttttttaaaattaagtttttctttaggctctagtccagtatgagagattctgcatttcttttttttttttgagacggggtcttgctctgtcacccaggctggagtgcagtgggacaatcttgactcactgcaacctccacctcccaagttcaagcaattctccctcctcagccttycaagtagctgggactacaggcatgcaccaccacaccccagctaattttttttttttgtatttttaaagatatggggttttgccatatcagtcagagtgttagtttaagccaaaaacaaattgagtgaaaccttgctgtgcaaagtgagggccctcaggccagcagtggcatcaaataggagcttgttagaaatgcagagtctcagctgggagcggtggctcatttctgaggttgcagtgactcaagatagtgccactgcactccagctgggacacaggcacacacacactcatttctgtaatcccagcactttgggaggccaagttgggcagatcagttgacgtcaggagcttgagaccagcctggtcaacatggtgaaagcctgtctctcctaaaaatacaaaaactagccgggcacggtggcgcatgcctgtaatccagctacgcgggaggctaacgcaggagaattgcttgaacccgggaggtggaggttgcagtgactcaagatcgcgccactgcactccagytgggacacaggcacacacacactccatgtatgtagtagacagctccaggctgggatctgatgccacgtgtgtgtgccacacccactgtcttccaaagaaccattccagtgcctgcgcacacaaacatacacacaggcacacacactctcttcataatttggtttgtgactggagactgggcggaagaaaacatgtgagttagaatgaaaggctaaggccaggtgggaatgccaggtaggtaatgtaagttggtaatctaggttggtaaaggccatgaggttaaggccaaatgggtgaatctagatgggtaatacaaggtgtwtgagtctagggggaagtgggtgggaggaggtggtaaatccagggaataagggcagaagcataagtccagggaagtaaacctatggaggtaattttagcggggtaaggccaggagagtatggcctggtagataaaactagaaagttaagaaccaagtgtgaaggccatgtgggtaacatatggtgggtaaaactaatgttaaaactaggtaggtaatacaggttgttaagcccattaggttatggmccataaggtttgcccaggtggatgaggctgatggggtctggccagggcagtaaaaagaggtggtaaggccagtgaataagggaaggagagtatggttccatgggtaagatcaggtgggtcctgatggcagattgaagccagcaaattaaatccaggtggataagarcaggtgaataatcatgggaagttatggccaggtgggtaaggccaggacatttaagccaggaaatgaagcctgggtcrgtaaggccaagagtttcgtagggccacatggatgaagcttgtttaagaataccatcaggataaggtgattaacacaatgaggttaatcatgtctgttgagtaaggccatgttgttaaaacgagctgcgtgtatccacctgaataaaagactatccgggtaacaacagacctgtcaatcaaagggaaacaaccaagagcgttaaatccaagtcgataagccagccaataataacaggaggctaatacccggtggtaaggggaaggctaggaggtgaaggccagttgaacaaagctaggtgattaacttcacctagccagcaaattaagtcatgctggctgaagccaggtaaatgaatacaaccggtaagtatggccctaagtttactaaggccaggtggataaggcaatagaagaagctcagaaaagtaaggcaggggaggatgatcagaggataatgacactaggttaaggccagcagggctgggagagctgrgtaagaccagaagttaggactaattatgaagaccaactggttaatgttgggtagctaagatcagttgggtaattcctgttggtragaacatgaggttaatgccagtagggtaaggtcagaagcgtaggcaggtgcataaagcctggggcgtaatactggatgagcaaggccaggaggctaataaggcaggtgagtaaattgacgttggtaaaaccatgaggttaagaccaggccaggaagccaagcaatttaaaaggccaggtggataaggccagtaagttcaggcctcctgaatagagctaggaggccaactcttactgggtaatgctaagaggttaaagctatgcagattagaccaagaggttaaagccatgtgagtaagaacaaaaggttaaggccaggtggaaaggccagggtgacaagctatattggcattccaggttggtaaggccatgaggttaaggacacatggataagtctagttcgttaatgggaggtgtttaaatcgaaaagcaatggggaagagggcatgtacatataggaagtaaggcaggggagtaaacctagggctatacatccagggttactgtctgatagataaaaccagaaggttaaggacagttgtgtcaaccaagtgtgaaggccatgtaggtaactatgttctttaagactaggtagcaaaactaggtggctaatacaagttgttaaggccatgtggttaaggcccttagggttaggacaggtggggaaagctaatagggtctggccagggccctaagaggtgagtaaggccaggtgtgagggataggggagtaaggccccgtgggcaagatcaggtgggtcatgaccagagattgaggccagcaaattaaagccaggtggataagtacaggtggataatggcaggaagttttgaccaggtggttaaggccaggacttttaggccaggaaattaakactgggtgagtaaggtcaggagtttaataaggccagatagataatgccaggttcataataccatgaggacaagataaggtgatgaaggcaatgagcttataagttctgctgagtgcagccaggttgttaaaaccaggtgtttaaatccagctgaagaaaagactgagcaaccccaggccaggatatcaacrggggaactgcccagtaggattaagggcaagttgtaaaaccagccaaatgatgacctgaggctaatgtaggtgggtaagacagtgcagggaaggcaaggaggtgaagaccagctggataaaaccaggtggtcaacaccagaagggtttgaggccagcagattaagtcatgctagctgatgccaggcagttgaatacagcaggtgagtttggctgtaggattaacgaagtcaggtgggggagacatagtgggtaaggccagaaggtgagcaagaccaagtgggtaagcccaggtaaataaggccatgtggtaacatcaaaaggtgaatgctgtgaaagtaaagccaagggtcaggacagaggataatgacattaggtcaaggccagtagggctgggagaggtgagcaagaccagaagtttaagagtaattgtgggcagggcgctgtggcttgcgcctgtaatcccagcactttgggaggccaaggygggtggatcacttgaggtcaggagttcaagaccagcttggccaatatggtgaaatcctgtctctactaaaaacacaaaaattagccataaatggtggtacacgcctgtaatcccagctacttgggaggctgaggcatgagaattgcttcaacataggaggaggaggttgcaatgagctgagattgtgccactgcacttcagtctaggtgacagagcaaggctccatctcaaaaaaaaaaaaaaaaagactaactgaaggacactgggtaaggctaggttggtaagatcagtttggcaagtctggttgttacgaacatgagggtaaggccaggtgggtaagccaggtgcataagttcaggggatttatattgaataagtccagcaggttcataaggcatttgagtgaatctaagttggctaaacactgaggttaagaccaggtcaggaagccahgtgaatgaaaaggctgggtgggtaatgccagtaagttaaggcctcctgaatagagctaggtggctactccacgtgggtaatgctaagaggttaaagctaggtagattaggaaagaaggctatgtgagttagaatgaaaggttaaggccaggtgggaatgccaggttggtagctatattggtcatctaggttggtaaggccatgaggttaaggccaggtatgtaagtccagctggctaatgcaaggattctaaatccaggggctggggagcagtggtaaatccagggaataagggcaggggtataagcccagggaagtaaacctagggaggtaaatccagtggtttaagtcctggtagataaaaccagaaggctaaggacaattgtgtaaaccaagtgtgaaggccatgtgggtcatgtacagttgggaagactaggtgggaaagctgggtggctaatccaagttgttagggccacaaggttaaggcccatagggatagaccaggtggagaaggctaatggggtatggccaaggccctaaaatgaagttggtaagaccagggagtaatggcagccgagtyaggcctcatgggcaagatcatgtgggtcttgaccagagatcaaggccagcaaattaaagccaggtaggtaagaacaagtggattatggcgggcrggaagttatgtccaggtaggtgaagccaggacttttaatctaggaaattaagactcggagagaatggccaggaggttaataaagccagatagataatgccaggttcataatgccaagaggataagataaggtgatgaagccaatgagcttaataagttctgctgagtgtggcttggttattaaaaccaggtgtttaagctaaatagaagactattcccaggctggggaaacacccagttggattaagggtaattctccaaaccagccaaatgatgacctaaggctaatattaggtgggcgagacagtgtggggaaggtgacaaggtgaaggccagaggaataaaactaggtggtaaacaccagaaaagtatgaggccagcagattaagtcacactgactaaggccaagcaggtgaagagagcaggtgagtatgtccctaaggttaatgaggtcaggtggggaaggcctagcgggtaaggccaggtaaatacagccaccaggaatgccatcaggtgaaggccaggaaaggaaagccaaaggccgggacaggggataatgacacgaggttaatgccagtagtggggacaggtgaggaagtctaaaaggttgagactaattgggaaggccaactgggtaaggctggggaggtaagatcagctgagtgatttgggttggtaaaaatgggatgttaatggcactagggtgaggtcaggtgggtacgctaggtgtgtaagaccagaagattcatactggatgagtaaggccaggaggttcataaggcaggtgggtaaatctaagttgtcaaaaccatgaggttaagaccaggtcaggaagccaagcaattgaaaagtccagttggcttaatccagtaagttaaggccttcctgaatagggctaggtggctgactccacctcggtaatgccaagccgttactactaggcagactaggtcaggaggttaacaccttgtgagttagacaggttaaggccaggtgggaatgccaggctggtaagctatgttggtcatccagattgggaagttcatgagtttaaggccaggtgggtaatacaagatgtctaaatatggggctggggctggggcatggaattgagggtgaagctaggggaaaagggcagggggtgataaaaccaggggagaaaacctagggaggtaaatccagggggctattccctgttagataaaaccagaaggctaaggacagttgtgtaaaccaaatgtggaggccatgtgggtcacgtgtaatcattaagactagttaggaaaactaggtggctaatccagattgttaaggccatgaggttaaggcccatagggataggccaggtgtggaaggctaatgggatatggccagggccgtaacatgaagtggaaaaggtcagacagcaagggcaggggagtaatggcaggagcttcataaggcaggtgggtaaatcttagtgggtaaaatcaggtagattttgatgggagactgaggcaagcgaattacaaccaggtagtaagaacacgtggacatggcaggaagttatggccagttgggtaaggccagcatttttaggcaaagtcatgaagactgggcgacaagggccaggaggttaataaggycagatggataatgtcaagtttgtcataccatgaggataaaataaggtgaggaaggcaatcagattaataaggttggctgagtttggccaggttgttaaaaccaggtgtctaaatccagctcaataaaggactatttcagtaaccccacgctgtgaaatcaacagagtaaacacccagtaggattcacggcaagttgacaagccagtcaaatgatgactsgaggcaaatactaggtacgtaagacagtgcagctaaggtgaggaggtgaaggccagctgaataaaccaggtggtaaacaccagtagggtatgaagccagcagattaaatcatgctggctgaggccaggcagctaaagagggtgggtgagtatggccttaaggttgatgacatagttaaccaaaggttaaggacagttgtatataacaagtgtgaaggccacgtttggtaagactaggtggcaaaccctggcagctaatccaatttgttaaggctatgagattaaagtcaataaggttaagtcaggtaagtgagtctaatggggtctcaccagagagggagtaagaccagggtgtaaggataggggagtaaggcctcatggctaacatcagatgggtcttgacagcagattgaggccagcaaattaaagggctacatggatgaatcttgtttaataatgccatgaggataaggacgattaargcaataaggttaataaggtctgctgaataaggcaaggttgctaaaaccaggtgtataaatccgggtgaataaaagacatttgggtaacaccaggccagtcaatcaaggggaaacagccaagagcactaaagcaaagtcagtaagccagctaaataataacaagagggtagtactggatggggatgacagtgagaggaacactgggaggtgaaggccagctgaatgaagcaaggtaatcaacaccagatgggtgtgagaccagcagattaaatcatgctggctgaggcctggcaggtgaatacagtaggtgagtaagcccaggctgcttgagacctgcctggccaacatggtaaaaccacgtctctactacaaatacaaaaactagacaggactgatagcacatgcctgtaattccagctacttgagaggctgaagcaagagaatctcttgaacctaggagttcgaggttgcaacgagccaagatggcaccaccacattccagcctgagtaacagagcaagattccgcctaaaaacaacaacaaaaagactcattgtgaataccactgggtaaggcttgaatggtaaaatcaatctggggctgagcgcagtgactcatatctataatcccagcacattgggaggctgagacaggcagatcacctgaggtcaggagtttgagactagcctggycagcacggtcaatctccatctctactaaaactacaataattagccaggtatggtgtcaggctactgtaatcccagctactaaggaagcataggcaggagaattgcttgaacccgtgaggtggaggcacagtgagctgaaatcgtgccattgtactccagcctgggcgacaaaactctatatcaaaaaaacaaaccaaccaaccaacaaaaaaacaaaaaagaattgggcaattgtgtttggtaaggacatgaggttaatgatagtagggtaaggctaggtgggcaagccaagagaataagtccaggggattcatactgaatgaataaggcccagaggttcataaggcagatgggtaaatttaagttggctaaactatgaggttaagattgggtcaggaaacgaagcaatttaaaagtccaggtggctaaagccagtaagttatggcctccctgaatagagctaggtggctaacttcaaacgggtaatgccatgaggttaagcttaggcagattaatccagaagaatgaggccatgagagtaagaatgaaaggtaaaagccaggtgggaaggccaggttggtaagctatgttggtcatctcggttggtgaagccatgaggttaaggccaggtgggtaagtccaggtggctaatgcaaggtttctaagtccaagggtggggggtaaatctagggaataagggcaggttatcattctaggggagtaaacatagggaggtaaatccaggagttaaggcctggcagataaaaccagaagatgaaagatggttgtgtaaaccaacgtgaaggtcatttgagtcatgtatggtcagtaagaccaggtgggaaaacatggtagctaatccaggttgttgaggccatgaggttaaggyccatagggttaggtctaytgaggaagactaatgggttccagctagggtggtaaaatacgggaggcaaggacacggagtcaaggcaggggactaatcacgggcaagatcaggtgggtcatgaccagagattaaggccagcaaattaaacctaggtgggtaagaacagatggataatgatgggcaggaacttatgaccaggtgtgtaagatcaggatttttaggccatgaaattaagtctgggtgagtaaggccaagaggttaataaggacagaaggatgatgccagctcctaataccacgtggacaagataaggtgatgaaggcaagaaggttagtaagtttggctcagggtggccaggttgtaaaaccaggtttataaattcagctgaatgaaagaccatttgggtaacaccaggctggtaaattaataggaggaatatgcaggagaactaaggccaagtcagcaagacagccaaataatgacaggaggctaatgctaggtgggtaagtcaggtgaagggaaggcgaggaggttaaggcaagctgaataaaactagggggtagacactggatgggcatgaggccagcagattacgtcatgctgtctgagaccaggcaggtgaatatggctggttagtatggctttaaggttagtaaggttggctggggaagccctagtgggtaaggctatataaataagggaaggtcaataggtgaggtctgggaaagtaaggccaagggtcaggattaaggataatgccactaggtttaagcccagtagggctgggaccagaagttgggactaattgtgaaggtaaaatggagaatgctgggtagataaaatcagttaggtgattcgggttggtaaagacatgaggttaaggccagtagtgtaaggccaggtgggtaagccaggttcataaggccaacagattaatgctgaatgagtaaggtcaggaagttaataagtccagtgggtaaatttattttggcaaaaccataaggttaacactgggtcaggaagccaagccattgaaaaagccagatggctaaagctagtaaagttaaggccactgagtacagctaggtggataactccaactgggtaatgctgagaggttaacgctaggcagactaggctgggtggttgaggttatatgactaagaataaaacgctgaggccaggtgagaaggccagtttggtaagctattgaggacatgaggataaggtgggatgggcaagtccaaatgggaaatgtaaggtgtgttaaatttgggtgttgggggacatttaggtaataagggcagggaagtaagtccaggggaggaaagctagggaggtaagtttaggaaaattagaccagtcgctaagtcctgataaataaaactagaaggttaaagaaagctgtgtaaactaagcatgaaacccatgatgggtaagtctaggcaggaaaacaaggtacataatgcaggttgttgagacttaagtgaaggtccataggtttaggccaggtttggaaagctaatgggttctggcaagggtgagaaaatgaggtgggttggccaagcgtggtggctcatgcctgtaatcccagcactttggaggccgacacaggtgaatcacgaggtcaggagatagagaccatcctggccaacatggtgaaacctcaagtctactaaaaatataaaaattaggtgggcgtgttggcacgtgcctgtaatcccagctactcgtgaggctgagacagcagaatcgcttgaaccagggagtcagaggttgcagtgagccgagatcacaccactgaactccaacctggcaacatagcgagactccgtcttaaaataataataataataataawaaaataaataaataaaatgaagtgggtaaggccaggcagtaaagaaagggcaggaaggcaccatgggcaagagcgggtaggttttgacagcagattgaaaccagcaaattaaagctaggtgggtaagaacaggaggataatggtgagaagttatggccagatagatgaggccaagaccgttagtaaggccagaaaattaaggctaggtcagtaaagccacaagtttcatagggccacatggatgaagcttgtttaataatgccacgagggtaaggtgattaaggaaatgaggttaataatgtctggtgaggaaggccagactgttaaaaccaagtgtttaaatctagctgaagaaaagactatttgggtaaccccaggccagtaaatcaatggagacattcccagtaggataaatgccaagttgccaagccagctaactaatgacaggaaactaacactaggtgggcaagacagtgtggggaaggtgartaggtgaaggccagatgaattaaaccaggtactcaacatcagatgggtatgaggccagcagatgatgtcatgctatgcttaccgaggccaggcaggtgaatatggcaggtgagtatggctgtcaggttaataatgttggytacagaaggcctactgtttgaggccagtagttgaacaaggccaagtgggtaaggccaagaaaatacagtcatgtgaaaaggccaataggtgaaggccaggaaagtagagccagggsctgggacagcagataatgacactaggttagggccagtagggctgggacagctaagtaagaccaaaaggttgaggctgattgtgaaggtgaactgggtaaggccaggtaggtaaaatcagctgtgtcattctggttggtaaggacgtatgttaaggccagtagggtaaggccaggtaagtaagctaggtgcataagaccaggggattaatactaaatgagtgaggccaggatgttaataaggtaggtgggtaaatttaarttggcaaaaccatgaggttaagggtaggtcaggtagccaagctatttaaaaagccagatggttaagaccagtaagttaaggcctccttgaatacaactaggtggctgagtttaagtgggtaaagctaagaggttaaacctaggcacattatgccagaaggttaaggccatgagartgacagtagaacattaaggccaggtaagaaggtcagggagttaagttggtaatcctggatggtcaggccatgaggttgaggccaggtgggcaaatccagatgggtaatgcaaggtgtctacatccagggaggggatatctaaggaataagtaaagggggataagtctaggtgaatgaacctagggaggtaaatccagggggttaaggcctggtagaaacaactagaaggttaaagccaggagattcgtactggatgaataaggccagtaggttcatgagacagttgggtaaatctcagctggcaaaaatgtgaggttaagaccggttaggaagccaagtgattgaatagtccgggtggcttaggccagtaagttaaggccttcctgaatacagctaggtggctaactccacctggataatgccaagaggttactactaggcagactatgtcaggagggtaaggccatgtgagttagaatcaaaggttaaggccaggtgggaatgccaggttggtaagctatgttggtcawccaggttgggaaggtcatgaggttaaggccaggtgggtaatgcaagatgtctaaatatgggcttggggctggggctggggttggggcattcagcttgggataaagctagggaaaaagggcaggggkatgataaaagcaagggaaaaaaacctagggaggtaactccagggacttaagacctgttagataaaaccagaaggctaaggacagttgcataaaccaagtgtggaggccatgtgatcacatatgatcacctatgatcagtaagactaggtgggaaaactaggtggctaatccaggctgttaaggccatgaggttaagaccacagggttaggccaggtgtggatggctaatggggtctggccagggccttaacatgaagaggataaggccagagagcaagggcaggggagcatggcaggagcttcataaagctgatgggtaaatcttagctgataaaatcagctgggtcttgatgggagmttgaggacagcaaattacaaccaggtgagtaagaacaagtggacaatggcaggaagttaaggccagtcaggtaaggtcaggattgttaggcaaagtcatgaagactgggtgagaagggccaggtggttaataaggccagatggataacgtcaagtttgtaataccatgaagataaaataaaatgatgaaggcaatcaggttaataaggtttactgagtttggccaggttgttaaaaccaggtgtctaaacctagctctataaaggactatttcagtaaccccacactgtgaaaccaacaggggaaacacccagtaggattaacagcaagttgctaagccagtcgagtgatgactagaggcaaatactaggtgagtaagacagtgcaggtaaggtgaggagaaggccagctgaataaaccaggtggcaaacaccagtagggtatgaagccagcagattaagtcatgctggctgaggccaggcagctgaagagggcaggtgagtatggccataaggttaatgacatggttaaccaaaggttatggacagttgtatacaccaagtgtgaaggccatgtttggtaagactaggtggcaaaccctggcagctaattcaatttgttaaggctgtgagtttaaagcccacaagggtaagccaggtgagcaaggytaatggggtctcaccagagaggggagtaagacctgggtgtaaggacaggggagtaaggcctcatgggtaagatcaggtgggtcgtggyggcagattgaggccagcaaattaaagccagctgggtgagaataggtggatgatggtaagaagttacggtcaggtgggtaaggccaggacttttagtctaggaaattaagcctggatcttatgggcaggagtttcaaagggctacatggaagaagcttgtataataatgccatgagaataaggatgattaagacaaygaggttaataaggtctgctgagtaaggcaaggttgctaaaacaggtgtataaataggctgaataagactatttgggtaacaccaggccagtcaatcaaggggaaacacccaagggcattagagcagtcactaagccagttaaataataacaggagggtagtactggatagggatgacagtgagagggacactgggaagtgaaggccagctgaacaaagtaaggtggtcaacaccagatgggtgtgagacaagcagattaaatcatgctggctgaggcctggcaggtgaatatggtaggtgagtaagcccaggctgcttgagtcctgcctgtccaatatggtgaaaccatgtctctactacaaatacaaaaactagaagggcgtggtggtgcacacttataatcccagctacttgagaggctgaaggaggagaattactggaacccgggagtccaaggttgcagtgagccaagatggaccactgcactccagcttgggtgcctgagcaagactctgcctcaaaacaacaacaacaaaagactaattgtgaataccagtgggttaggatcggtaggtaaaatcaactgggggccaggcacagtggctcacacatataattccagcactttgggaggccgaggcaggcagattacctgaggtcaggagtttgagactagcctggccaacatggtgaaacttcatctctactaaaaatacaaaaattagccgggtgtggtggcaggcacctgtaatcccagctactctggaggcttaggcagagaatcacttgaaccagggaggcgaaggttgcagtgagctgagatcgtgtccaacctgggtgacaagagggaaattccatctaaaaaaaaaaaaaatcaactgggcaattctggtttgtaaggatatgaggttaatgccagtagggttaggccaggtgggtaagccaggtgaataagtccaggggattcatactgaatgagtaaggcccagaggttcataaggcagatgggtaaatctaagttggctaaaccatgaggttaagactgggtcaggaaaccaagcaatttaaaaggccaagtggccaacatcagtaagttaaggcctccctgagtagagctaggtggctaactccaagtgggtaatgccgtgaggttaaggctaggccaattaatccaagagaataaggccatgagagtaagaatgaaaggtaaaggccgggtgggaaggccaggttggtaagctatgttggtcatcttggcttgtgaagccatgaggttaagrccaggtgggtaagtccaggtggctaatgcaagttttctaagttcaagggtgaagggtaaacctagagaataatggcaggggtattagtctaggggagtaaacctagggaggtaaatccaggggttaagacctggcagataaaaccagaagattaaggacagttgtgtaaaccaacgttaaggccatttgggtcatgtaaggtcagtaagaccaggtgrgaaaacatggtggctaatccaggttgttgaggccatgaggttaaggcccatagggttacgtctggtgaggaagactaattgggtcttgccagggttgtaaaatgaggggggagaggccagggagtaaaggcaggggactaaggcctcatgggcaacatcaggtgggtcaagaccagagattgagaccagcaaattaaacgtaggtgggtaagaacaggtagatattggtgggttggaacttatggccaggtgtgtaaatccagaacttttaggccatgaaattaagtctgggtgagtaaggccaagaggttaataaggaaagaaggataatgccaggctcctaataccatgtggacaagataaagtgatgaaggcaagaaggatagtaagtttgactgagtgcagccaggctgttaaaaccaggtttataaatctggctgaataaaagactatttgagtaacaccaggctgctaaattaataggagaaacgtgcaggagaattaaggccaagtcagcaagccagccaaataatgacaggaggctaatgctaggtaggtaagacaggtgaggagaargcaaggaggttaaggcaagctgaacaaaactaggggktagacaccagatgggcatgaggcsagcagattaagtcatgctgtctgagaccaggcatgtgaataaggttggtgagtatggccctaaggttaagcaggtcaggtggggaaagcctactgggtaaggccagataaataaggccacatggggaggttaataggtgagggctgggaaagtaaggccaagggtcaggactaagcataatgcccctaggttaaggtgagtagggctgggagatgtgagtaagaccagaagtttggactaattgtgaaagccaaatgggtaagkctgggtagataaaatcagttcagtgattcaggttggtaaggacatgaggttaaggccagtagggtaaagccaggtgggtaagccaggttcgtaaggtcagcagattaatgctcaatgagtaaggtcaggaggttaataaggctgctgggtaaatttattttggcaaaaccataaggttaacaccaggccaggaagccaagcgactgaaaaaaccaggtgggtaaagctagtaaagttatggccagcaagtacagccaggttcrtaactccaactgtgtaaggcttgtgtgggaagtcagtgacccccaaatggagggaccacctgaagccatggcagaagaatgtggattgtgaagatttcatggacatttattagttccccaaattaatacttttataatttcttatgcctgtctttactgcaatctctaaacataaattgtaaagatttcatggacacttatcacttccccaatcaatacccttgtgatttcctatgcctgtctttactttaatctcttaatcctgtcagcygaggaggatgtacattgcctcaggaccctgtaataattgcattaactgcacaaattgtacagcatgtgtgtttgagcaatatgaaatgtgggcaccttgaaaaaagaacaggataacgcaattgttcagagaataagagagataaccctaaactctgaccgccggtgagccgggcggaacagagccatatttctcttctttcaaaagcaaatgggagaaatattgctgaattctttttctcagcacagaacatccctaagaaagaaaatgcgcacctgggggtgggtctctgaactggcccccctgggcgtggtcgtctcttatggtcsagactgcagaggtgaaatagactccagtctcccatagtgctcccaggcttattaggaagaggaaattcccrcctaataaattttggtcagaccaggtgatctcaaaaccctgtctcctgataagatgttatcaatgacaatggtgcccgaaacttcattagcaattttaatttcacctggtcctgtggtcctgtgatctcgccttgcctccacttgccttgtgatattctattaccttgtaaagtacttgatgtctgtgacccacacctattcgcacactccctccccttttgaaactccctaataaaaacttgctgttttttgcggcttgtggggcatcacggaacctaccaacatgtgatgtctccyccggatgccyggctttaaaatttctctcttttgtactctgtccctttatttctcaagctggccgacacttagggaaaatagaaaagaacctacgtgaatatcagggcaggttccccgataaaggctgagaacttaatgctaggcatattatgctaggaggttgaggccatgtgactaagaatgaaaggctaaggccagtgagaaggccaggttggtaagctatggagtccatgaggttcaggccagatgggggaagtccaaatgggaaatgtaaggtatgttatgttcgggcgtgggagaaaatctaggtaagaaaggcagggaaataagcccaagggaggaaacctagggaggtaagttttgaaaaataagactgggggctaagtcctggtaaataaaaccagaaggttaaggacagctgtgtaaactaagcatgaaactcacaatggggaagactaggtggaaaaactaggtaggtaatccaggttgttgagaccacatggttaaggcccacaggtttcggccaggtgtggaaaactaaagggttctggcaagggtgataaattgaggtgggtaaggccaagcaataaagaaagggcagtaaggcaccatgggcaagaccaggtaggtcttgacagtagattgaggccagcaaattaaagccaggtaggtaagaataggtggataacggcgagaagttatggccaggtagataagaccaagatcattagttaggctaggaaattaaacctgggtcagtaaggccaggagtttcatagggccacatggatgaaacttgtttaataatgccrtgagggtaaggtgattaaggaagtgaggttaataatgtctggtgagtaaggccagattgttaaaaccaggcatttaaatttagccaaagaaaagactatttgtgtaaccccaggacagtagatccatggagaaattccctgtaggattaaggccaagttgccaagccagctaaataatgataggaaactaatactaggtgggcaagatagtgaggggaaggtgaggaggtgaaggccagatgaattaaaccaggtagtcaacatcagatgggtatgaagccagcagattaagtcatgttatgctggctgaggccaggcaagtgaatatggcaggtgagtatggctgtcaggttgataatgtcggttgcagaatgcctactggttgaggccagtagttgaacaaggccaagtgggtaaggccaagaaaatacagccatgtgggaaggccaataggtgaagtccaagaaagtaaagcaaggggctgggacagygaataatgacactaggttaaggtcagtagggctgggacagctaagtaaagccagaaggttgagactaattgtgaaggccaactgggtaagcctgggtaggtaagatcagttgggtaactctagttggtaaagatatgatgttaaagccagtagggtaaagccaggtgggtaagccaggtrcacaaggccaggggattaatactgcatgagtgaggccagtagcttaacaaggtaggtgggtaaatctaagttggcaaaaccawgaagttaaggccaggtcaggaagccaagctatttaaaaggccagataggtaaggccagtaagttaaggcctccctgcatacaactaggtggctgagtttaagtgggtaaagaggatgtccatgtgagtaagaatggaaagataaggccaggttggtaagctcagttggtaatccaggttggtaaagccatgagtttaaygccagttgggtaactccagatgggtttagaagggtatctaagtctggggaggggaaatatagagaataatggaaggtggataagtccagaggagtcaacctaggcagataaatccagtggagtaaggcccggggattaaggcctgtagataaaaccagaaggttaaggacatttgggtaaggcccatagggttaagccaggtggggaagtctaatggggtgtgcccagtgtggtaaaatgaggcgggtaaggccagggtgtaagacctcatggataagatcagttggatactgaccagataatgaagccagcaaattaaatagctggttataaacaggtggataatggcaggatgttatggccaggctggtaagcccagttcttctaggccagaaaattaagactgggtaaataaggccaggaatttaataaggccaggtggataaagccagattatgaggctaagataaggtgattaaggccatcaagttaataacatctggtgagtaaatccagattgttaaaaccaggtgtttaaatccagctgaataaaaaactatttggttaacacaccaggccggtaaatcaatggggaaacttcccagaggatcaaggccaagtcggtaagccagctaaatgacaggaggctaattatacgtgaatgggacacagagggaactgtttagagatgaagtctcactgagtcaaggtaggtggttaacaccagatggatataagaccagaagattaagtcatgctgggtgaggtcaggcwggcaagtatggtcgtatctttaagaaggccacgtgggtaaggcctagtgggtcgggctggaaggtgaataaagccaagtggttaaggccaggtagtgaaggccagctctgtaaagctatgtggttaacatcaggtgtgtaagttgaagaggttaaggtaggtgggtaaaattcagtttgtaaggacaggagattaaggccaaaagattaaggtcacatgggtaaggccagaggttaaggccaggaatctatagctgtgtgggtctgactggaatgttaaaggacagctgtgaagactctgtgaacgaggctgggaggttcaaacccaaaggttaaaatcaggtgaataacatcagctgtttgaggtcgagtggggatgtctgagaagttaaggccagccaggcaatgccaggaagttaatgtcaggtaggcatgtcctggaagttgagtttttggccaggtctgagccataccttggttccacgttcaacaactgtagtattcctcgcttatctgcagtttcactttttatggtttcagttctgctctgtcctgttagggacatcaattatccatttgtccagcataattggacaacgattgatgtgtttgagtaatctttattttgtttaataacggtccctggccaggcatgatggctctagcctgtattcccagcactttaggaggtcaaaatgagcctaggatcacttggaacatgcgagtttcagatcagcctgggcaacatagtgtgaggccacctctacaaaaaattattttaaaaactagccaggctgggcatggtggctcacgcccgtaatcccagcactttgggaggctgaagtgggaagatcacaaggtcaggggttcaagaccagcctggccaacatggtgaaaccccatctctactaaaaaacacaaaaattagccagtgtggtggcgcatgcctgtagtcccagctactcaggaggctgaggcaggagaatcgcttgaacccaggaggcaggggcagaggttgcagtgagccaagatcatgccactgcactctagcctggcacaggctgagactctcacagagtgagactctgccttaaaaaaaaaaaaaaaattacccaggcatggtggtgcatgcctgtggccccagctaccttggaggctcaggtgggagtactgcttgagcttggagatcaaggctgcattgagccatgagtatgccactgcattgcagcctgagagacagaatgagatcctgcctcataaataaataaataatgttccaaagcaaatgagtagtgatagacatattgtcctaattgttctactttactcttgttgatctgtcactgtgcttaatttcataattaacctttaacataggtatgtatgtacagaaaaagagcagtatatctagaggtcagcattagctgtggtttcaggcatgctccggggtcttggaacacatctcagaggatgagaggggactacttactgtacagtgtgaggggatcagctcctcatcttcagcttcccctacttctcatgggtatgctccctgtctctgaacattggtctgggtgggtatctgtgaagctcttagtgcagcacatgtaaggccactatttcaagttagcgcctctcttgcactatcaccgtcatggtctactggagtcactgggactaacctgcacactggacaaacagtacctgtcaaaggatggctgccttctcacttgatcagtgtcaaggccacgctggcccccaggtcccctgcagatcactgttctccatgacaaccccatttcataactccataagagggtcattttgctactgacttctttcttcaccatgacaacttaggaatgaagggacactgtgtaaactgcacagggtcagggactgcaagtaggaggtggtggcgttccctgcctttggtaggaaattgggtttacacactggtggatatgggtggagctgagcctgctcctcatcccggtggcagcagaaatacctcagaaacgggatctgttcactgcctagtgctgggtcttgccccagtggaactccagcaagttgggccccatcacagagagacaatgcccgaggatgcagcaccctcacacactgttgttgctcaaagaaatcagtttctagtagagtaggtcctctgcaacctgggattcaaacaaccttggatcaaatatattcggaaaaataaacacaataaaaataacaacaacaaaaaaaatacaagcaaaaaaactataatacctatttacacagcaaaaaattgcctctaccacactcctgacaatcttgtgtgagtctcacrgaatccgaggccctggtttgtaacctcccatgtcctatcctatgtgagtctggttctctamtgtcactttagacattaaaatggtccaaggtcatccaacagcttaatcgatgaacaccattatcaatacaagaatatacatccaattataggctcattatgatttaatattaagttagtcttacaggttaatgtttagtcaatcatacaaccacaaagatggacttgaaaaagttatttgttacaccacctgaaacatgccattcacaggagtctttcttcctaacattttgtagcacataggccatcacctacaagaacttgataatagcatcaaaacacaaattgttatattttttaaatatgttgctgaaattactattattttaaagataagtgctctggacttattttcctatgaagaatttatactcaagatgcaaacctaccaagaagtcaagctgtcaaaaaaatcagtgtataaactgatggcaaatgtagtcagctataactatccttaatttagcttagaaaaaccatgctcaaccatttgtgtttgtagttactggaaataaaagttaagtattctcttctatcttttattaaactatatcattagtagcggcaataaaagtaaaacacgtgttcccaaaaaacatcactgctggaaaaagccaaagcaattaaatatgagaactaaacatttgtttttttttcttttctctttttgaggtggagtttcactcttgttgcccaggctggagtacaatggtgtgacctcggctcactgcaacctccgcttcctgggttcaagcgattctcctgcctcagcctcccaagtagctgggattacaggcatctgccaccacaccyggctaatttttttgtatttttatagagatggggttttgtcatgttgaccaggctggtctcgaacttctgacctcaggtgatccacccacctcagcctccaaagtgctgggattacaggcataagccaccgcgcctggccgaaaactacaaatttgaatatgatgactttgcttcatttagcacatctttctagtgctcactgagtgccaggctttacaaatgccactgacttaaactcagtcgcaaccctggaagggggtcctattactgccatctttttaaaaaaatgcacaagtgaccacaattctcataaccctgaagttgcactcattgtccacacaacaggtgcaaactcctaagcaagaaagagactgtgcagaaaggagatggtgccccgcccaccctgcctcccactactgcccccacagcttcccctcccagacactcaacaccctggccacagggccctgtggtgactgcacccgtgtgctcagcccaggagactcttcctctggagatccataggaccccaaggaaggcactgatgaaaggaggtgtgaagacagtccagttactctggaaggtccctgtgtggaaggaatgtggggtcagcacacaggtggaagagcagccacactgggcacaaacccacaacctcagtgtggcctgtgcaagcctcccacttctgttcacccctcccggcttgactcttctcgcactttstaatttactgtacactttccttattctttattgcctattattccccaaytgaagtataaactctgtaagggcaggaattttgccaggtaagaaaagtgcagaagcaagtgccttgcagtctggatggaamaggcctgggaggggtcacggagatacaagcagtgagtcgaaaacttcttaaagggctgtctcataaataattcaggcttgaggaccctcgggtcctcatcacaagttcttatctatgccactgtgacaagaaagcatccaaagatgatcgtaaacaaatcatcatggttgagttctaataagacaatgttccaataaaaaactactgataacaacaggtggtgggcgggatctggccccaggcagtggcttcctaactgaaatgcagatgatgttccagcacagaagtaagaaaacaccaagatgagggccaaataacagtatggaagagaagaggttttagtaagtataattaatgacagaaaaatctgaaaatgaggccacagaacaagaacattacaaccaatctaatttgtagatatttattaccaggcacactgaaaacatctactaatgaggaactggagacaaagccatacatggacacattagcaatctgcacatattactggccacactgcctcagaaacgcayatgataaggttagggcccactctgaccaagtttttacccacacatacatctcagctccataaccagcatcatgattaactagtcaaaggtcaaaagcatgagacaggcaggaatgctgaagccacctgatgacagctgcaccagttccacaagataacagaaagacacatacaaattcatcactctttgcctccatgaacatcaatagaaaaaatattatatcaatggctttcctgtacatgaccaataacatggtagaaaaaataaaaaattaaatccttttcacaatagccatccaaacacaaattacccaggaataattgtaatattaaaaaagtatgcagagccaagaagaaagctacctgacttcactgagggatacatttaatgactggaagaaacatatcccatgttataaagcaggaaacactaatactgcaaattaaaatgcataatacctgcacttttaatcaataccacaaatgatgggtgtgattttaaggagctgagaaacagatttagggccgggtgcagtggctcacacctgtaatcccagcactttgggaggccaaggcaggcagataatttgaagtcaggagtttgagactagcctggccaacatggcgaaaccccgtctctactaaaaatacaaaaattagccagtgtggtggcaggcacctctaatcccagctactcgggagtctgaggcagaagaatcgcttgaacccaggaggcggaggttgcagtgagccaagatcgtgccactgcactcccgcctgggcgacagagcgagactctgtctcaaaaaaatgaaataaaataaaatatccaacacacaatgaaaagatacccaagcagacaggaaggaaaagtcatgaccaaaaagcacagccacaaaaacagacacacagggatcaggataatgaaatcgccaggagtaaaccctaaaaaatctrtaatatgtccaagctattaaagctcaaggttgagaatttcagcaaaggaactaaaagccataaaagacatcaaaaggaagttccagagcaaaaaaaaagtacattaactgtacagtaaatcctcacttaatagaaactgtgtctttaagcaaacctacaaataaaaggaatcttaccataggttaattaatataaaccagagctaaattcctccagcatatttctggtcacaaaaacgtcaccaaacttctaaagaaagattaaaaaccttcctaacattatacattagaataaatatgagctatatatccactgaaggttaataaaaacaaggcaattaccaaatttttggtgaatgagtgcatgatggtgattrtagtggtgataggttaaatcaagaataggctgggtgtggtggctcacacctgtagtcccagcactttgggaggccgagctgggtggaycacctgaggtcaggagtttgagaccagcctggcgaatatgatgaaattccatctgtactgaaaatacaaaaattagccaggtgtggtggaacgtgcctgtagtcacagctacttgggaggctgagacagaagaattgcttgaacccgggaggcagaggctgcagtgagccgagattgcgccactgcagtccagcctgggcaacaaagagagactccatctcaaaaataaaataaataacataacataacataacataacataacataacataacatataaaataaaataaaatataaaataaaataaaataaaataaaataaaaataaaataaaatataaaataaaataaaataaaataaaataaataaaataaaataaaataaaatataaaataaaataaaataaaataaaataaaaataaaataaaataaaataaaataaaatataaaataaaataaataaaataaaataaaataaaataaaataaaataaaaaaataaataaaataaatgtttgcaaagccacaattggagggagcacctcctaccacaccacgcagttacgatcacaaatatggtgactggatgctttcagatgacattgtttattgtcatgcatttgtgtaattatcttatgttttaggaatttttatttgatgataatttgtatttattcgttttccaacctgcttattgcacttcagggtctcaggtagccggagcctatcccagtggctcatggcacaaggcgcaaaccgaccccggccaagacgccatcccatagcagggagctctcacatatgcccaccctcactcactgagactgcgactagagacccaccaattcacctcaggggtgcagcttaggatgtgggaggaaacctgagtaccaaaagaaaactcgcagacaagaggagaacatgcaaacaagacctagacagcggccgtggccctggttgacagctgaggtgttttctcatcagtgttataacaaaatgaagtgatttgaggacctgctgtacataagacaaagctagagaaaatatccaggtttcaggagttcaagatcagcctaggcaacagaatgagatgcagtctctgtaaaaataattttttaggccaggcacagtggctcacacctgtaattccagcactttaggaggcgaaggtgggcagatcacatgcgataaggagttcaagaccagcctggccaacatggtgaaaccctgtctctactataaagtaccaaaattagtcaggcgtggtggcaggcacctgttatccagctactcgggaggctgaggcaggagaattgcttgaacccgggaggcagaggttgtagtgagctgacatcattcagctgcattccagcttcggcagcagagcaagactctgtctccagaaaaaaacaaacaaacaaacagggaaacaaacaaaaaaaactaaggcacataaaatgatgtaaaaagccctaacaaatgtgtaatttgagtggaagaaggaaaaagagactagcgcagaagcaatattccaatagaaataggcagaacaatcaatcaataacctcttcatcaaaagaaacccttacaaattttwaaaaagcaagtcaaagacagggacgacatacttgcaatacatagacatgagctaggtgtatgtccaaaatagacaaagaagccctacaaatcaccacacaaagacaaatagcccctygcttttttaagagatgggatcttttgcccaggctggtcatgaactcttggcctcaagctgtcatcccatctcggcttcccaaagtgctgggattacgggcgtgagccaccgcgcccagccaaacaacccactcttttcagtggacaagagattctaacaggcgtctgatgataaaggtcatttgaaagccagcaagcacaagaaaaagtgctcaacatgcttaatcaccatgcaacacaaattgaaaccccaatgctaaccaacacacaccaaacaaaayggctaaaggctgttgtacagtgacatcacatgctggtaaccaaggaagaggagaaggctcccacgggctgtgtgctctggaaaactgctgggcatgagagggagaccccaaggggctcaccaactgccctaccacccagctctgsmaccctgtttaaatactcaacaggagcacacacagatgtacaccaaagcctgtggcaagatgctcaaaactagtttgtcatcactgccaaaaacgggaagtaatcaaactcctttaacagtggaagaacagatcaaggaggtacattcaggaaacaaagtattgctgttggaagcatagttgacttttcataggctkgacattgagcatgagaaacgaaccccccagagggagggcattgcccaggaggatcttgtatggcttgtagtgtctcctgggtggtagtgacacaagtgtgcaaggtttttaaaaatcactgagctctatacttaatagctgtgcattctatagtatgtgatcattcacattcaggttttttcagtcataagaatccttgggaaaaataggcaaatacctataaaagcagtaataacaaatgcaaaaatacagtggggaaaaactcactgataacagcacttcaaatatatatataataacctataaacttatatgcaaggtcaacatttataaaatgttaaaactttcctgaatatcattatttttaaaacaaaagaaaaactttacccaaatgggcagtcagaccatgctttggataagaactgttaagtcaattaaagcacaaacacctcctgagaaaatacacaaaagacccaaagctgtaaaaacataagccactgcattctatcccattcatacygagagaaatgcaaaggaaaacctctaccgctggactggcagagatgtgagcagacaaaaacctggctctggtggccggctcctgcccacaccccctagtccttcctctgtgacttcaccaccaagaacccggcaagaggagctgtgacgacccccagttctcccactttctctcccgtcctgaccaagaaacaccaggtgctttgactgctctgtgagctgggcagctgcatttctctcgcaggcttgaacccaagctggggccgtgaatattcccaggcactaagcaagatgtttggattgttacccaaaatgcggaaagaaactggcaccagccctgagccaaattcctgaacctttcctataaactccataccgtgacacccttgacagggacatgcttaagcagaacatccttttctctgggtgtctatccaggcatatgctacagcacccagtaagttcccctaatgaacactttggaccaattgccctggagcttggtgcttccttctttggagtcccaacaagtcccatttccacatggactggggcactcccatgtgggaattcctttgccaacaattttagggcaactccagctggaggttcagcctgaggaaatgagagccaaatccaattctagtatattcatcacagatatgattaaataaagacaaactattgcaaactacctagatgtctcttctggctgctataccaaaacacctgccttacaaacaacagattatttctcacggttctggagggtagaagtcagtgatcagggcccactttctggttgctgagtccaactcctcgctgagtcctcacaaggtggaacgagaacaagctcatgctgaggcctcctttaagagaatgtatcttattgcgaaggctctgccctcaggaccttatccatccctaatcrcctcccaagggccccacctcctaacaccatccctttagaagggtagggcttcattatgtaaatgacattcagttcacagtccatcaacaggatggattaaatgagggtacatccaaatagcatacccacacagccactgaaaaataatctagaccctgatacaaacaagctgttccaattttgagacaacctggggactccaaacactgcctatgtgacaataataatgaattattgttaactgtttgggttattttttaaaagttctctgaggccggatgtggtggctcatgcctgtaatcctagcactttagaaggctgagttgggtggatcacctgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttcctctgaacggtcccacaaaagctcctccaccccctcccccacccatccagatggagtcttgctctgtcccccaggctggagtgcagtggcacgatctcagctcactgcaacctccgcctcctgagttcaagtgattctcctgcctcagcctcccaagtagctgggattacaggcatgtgccgccatgcccagctaattttgtatttttaggagatgtggtttctccatgtttggtcaggctggtctcgaactcctcacctcaagtgatcctcctgtctcagcctcccaaagtgttgggattataggcatgagccaccacacctggcctagcttggaaaaatttgcacatgatctaggaggttgcattaagggtctttaaaggtcttttatgttctaagccaggcgtggtggctcgtgcctgtaatcacagcactttaggaggctgaggcaggcagatctcctaaggtcaggagttcgagaccagcctggccaacatggtgaaaccctgtctctactaaaaatacaaaaaatggtgaggcatggtggtggggggctggaatcccagctactcaggaagctgaggcaggagaatcacttgaatccaagagacagaggttgtgcagtgagccgagatctctcgccattgcactgcagcctggtcaacaagagcaaaactctgtcttaaaaaaaaagaaaaaggtattttacgttctgtatccattcatccattcgacagaaatcaaaattggacatttcagctatggtttaracaagaaactggaagaagtggatcgactctccaagaatgagttttatgtctatagacaaaagattgcaaactaaggctgggtgcggtggctcatgcctatcattccagcactttyrgaggctgaggcgggcagatcacttcagtccaggaattcgagaccagcctgggcaacatgacaaaaccccgtctctacaaaatatacaaaaaaatggacctgtagtcccatctacttgggaggctgaggtgggaggattgttccagcccaggaagttgaggatgcattcacctgagactgcgaccctgcactccacgcactccagcctgagtgacagagctagactctatctcaaaaaaaaagattgcaaagtgaatatgctgttgtttaaatttaaaatgaagtgtttagatatgtatcatattttattattttccacattaactcatttcttcaataactaaacatctatgattccctaacatataaaataaatatatacagcttctaaaaacatggtggaaggccaggcacagtggctcacacctgtaatcccagcacttggggaggccaaggtggaaggattacttgagcccaagaaattgagaccaaactgggccacacaggaggaccctgactctacaaaacaattttaaaataattagctgagcatggtggcatgcacctgtagtcccagctacttgggaggctgaagtgaaaggatcacttgtgcccaggagttcgaggctgcactgagctatgattatgccactgcaccctagcctgggtgacaaagtgagatcctgtctcaaaaaaaaaaaaaaaaagaataaaaammaaaaaataaaacatggtagaaaaaatgactgatagggtaaaatactgataatacatttaagtgaaaaggaagattagaacaaaatgtccagtacattcacatcttagtaaagtatgcctttgttacatatgactaaatagaaatccaacaggagtatactacaaaatcctaacagttcctcccagacatgaactaaagataattttattttcttccttttgctttcctaggattttccaaatcttctaaaactaagattacttttatttcttcctcttttttttttttctgaaacagagtctcactcactgtcacgcaggcttaagtgcagtggtgtgatcttggctcactgaaacctttgcctcccaggatcaagtgattcttctgtctcaatctccaaagtagctgggattgcaggcatgcgccaccacacccaactaatttttgtatttttagtagagacgaagtttcaccatgttggctaggctggtcttgaactcctggcctcaagtgatctgcctgcctcggcctcccaaagtgctgggattacaggcatgagccaccacatctggcctaagaccatttttataatcaaaagaaatattacttgtttttgttagtctttcaaattcttcttgtggaaatgccactaaatggataatcaaaaaatgattgtgacacaaaaggcctttggcgctacatgagcccatggaggtcactcagtgagatgaaaactcagtttctgtggcgaatagactgcagtgacacagaataaacctgggcatgactgaatttcctctgcagggtaaaccacaggggagcacacagcacccttgtcacccgggagtgggaggacaccgaggaggaagggaggcagggcagagctggggaaaagctctagaaaggtcagagcctgggttgatcctgttcagatttctgacttctttctgctcatcctctatsagagctgctcacactgtctccttttctcagaccctagggcctaggtgacaaaatgttatttaacgagagatcagggtgcacaggacaagcacctgtgttaaaaggtgctgtatcctagaaccacaggggacccacagtggtttcattccatcaaataaattctttttggatggtgtaaataataggatttgatgaaaagggccctaagttccaatgatagaatttgataggaaaacatagatacaacagttaatttagtttttgagatagggtctccctctgttgccyagactggagtgcaatggcacaatcacggctcactgcaacctccacctcccaggttcaagtgatcctcccacctcagcttcctgagtagctgggactacaggcgctgtcaccacacctggctgtgtgtgtgtgtctcgatggggggggtctctctatgttgyccaggctggtctcgaactcctggactcaaatgatcttcctgcttgggtctcccacaatgctggaattgcaggtatgagccatcacgcccagctttgaattcttaaaattacctgtaccacatgtgaatagaatttgtgaactatgcaggractttaagtcataatcggcatccacctgagaacctcatagcagagtaaggcttttgcaggaatctcagccagcctagtaaatattcactgaactctgactcttttccaggccctgtgctgtgtacaaagatgcagattccatagtagttgtcaatatcccactaactatgatcgtttgagtagaaggtgcctgggggtaagtggtcaactccaatatctaactcagacaatgtggaccgccagcccatctggcaccaaccccctaggtactcttaagacacttgccaattctctgagcaacacttgagaaacctagtccctgataaacaacagcagaaagctacactgcaagccaatctaaatatcaattccaactgtaaattttctaattgtttgayaatgaaaaaatatacaatttaaataataccaggaacaggctgggcggtggctcatgcctgcaacctgcagcaccttgggaggccaaggtgggcggataacttgaggtcaggaggtcgagaccagcctgactaacatsgtgaaacctggtctctactaaaaaaaataacaaaaattagctgagggtggtggcatgcgcctgtaatcccggttactcaggaggctgaggcccgagaatcacttgaacccaggaagtggaggttccagtaagccaagattgtgctgctgcactccagcctgggcaacagagtgagaccctgtctccaaaacataaataaataaataaataataccaagagtgaagagctttaaaaacaagatgtatgtaaggctgggcgcagtggctcacgcctgtagtttcagcaatctgggaggctgaggcgggcgratcacctgagctcacragtttgagatgagcctgctcaacattgtgaaaccccatctctactaaaaatagaaaaattagctgggcgtggtggggggtgcctgtaatcccagctattcaggaagctgaggcaggagaatcgcttgagcccgagagttggaggttgcagtgagccgagatcgtgccattgtggcccaggctggaatgcatgagtgagactccatctcaaagaaaaagaaaaagaaagaaaaaaaggccaggaacggtggctcacgcctgaactcccaccactttgggaggccgaggtgggcggatcatgaggtcaggagtttgagatcagcctgaccaacatggtgaaaccccatctctactaaaaatacaaaaattagccaggcgtggtggtgggcacctgtaatcccagctactcaggaggctgaggcaggagaatcacttcaaaatccaggaggcagaggttgtgcactgagccgaaatctcttgccactgcactattgcactccagcctgggcgacaagagcgagactccatctcaaaaaaaaaaaaaaaaaagccaggtgcgccaggtgtggtggctcacgcctgtaatctcagcactttgggagagcaaggcgggcggatcatgaggtcaggagttcaagacctgcccgaccaacatggcaaaaccccatctctactgaaaatacaaaaattagccaggcatggttgtgcgtgcctgtaatcccagctactcaggaggctgaggcagaagaatcgcttgaatctgggaggcagagcttgcagtgagctgagatcgagccactgcactccagcctgggcaacagagcaagactcaaaacaaaaaacaaaacagatacatgtggaaaaattcaccaaaagagcattgaatttaaaatgaaatgtttagatatggattgctttttcttatttcccgtattacctcaatttgtcagtaagtatcaggctgggggtgatgtctcatgcctgtaattccagcaccttgggaagcccaggcagraggagtgcttaagctcaggagtttgaggtcagcctgggcaacacggcaagacttcatctctacaaaacataaaaataaaaaaaaaattagccaggtgtggtggcatgcacctgtagtctcagctacttgggaggcgagataggacgacacttgagccggggaggtcgaggstgcagcgagctgtgatcgtatcactgcctgggccacaaagtgaaactctgtttcagaaaacaacaaacaaaaaccagttctccaccatgccaaataaaacaytgggaaccagaaataaagaagtggaagtctcacctcaggggtggctattcctagcatcttgctagatttttaaaggtactcagtaatacattacagctgaagagtgaagcatgtttttttkttgttgttgttttccaagacagagtcttgctctgtcacccaggctgcagtgtaatggcaccatctcagctcaccgcaacctgcgcctcccaggttcaagtgatcctcctgcctcagcctcccgagtagctgggactacaggcttgcacaaccatgcccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccactttgggaggccgaggtgggcaaatcataacgtctggagctcgagaccagcctggccaatatggtgaaaccccatttctactaaaagaaaaacaaagaaaagaaaaaaaaaaaagaattagccaggctggatggcaggcgcctgtagtcccagctacttgggaagttgaggcaggaggattgcttgaacctaggaggcagaggttgcagcgagctgagatcatgctgtgttcagaattggtgcgttcttggtctcattgacttcaagaatgaagctgcggacccacgtggtgagtgttacagttcttaaaggcggcatgtggcgagtttgttccttctgatgttcggagtttcttccttctggtgggtttgtggtctcgcggactcaggagtgaagtttcagatcttcgtggtgagtgttaacagcacataaaggcagtgaggacccaaaraaaaagcagcagcaagatttagcgcaaagagtgaaagaacaacgctcccacaacaagcaaggggasgagttgccactcttgcttytggcagcctgcttttattcttatctggccccacccacatcctgctgattggtccattttacagagagccaattggtctgttttacagagagctgattggtccgttttgacagggtgctgattggtgcgtttacaatccctgagctagacacaaaagttctccaagttcccactagattagctagatacagagtgctgattggtgtatttacaaacccagagctagacacagagattctccaagtccccaccagattagctagatacagagtgccgattggtgcaaccacaaaccttgagctagacacagagtgctgattggtgcatttacaaaccttgagctagatacagagtgctgattggtgtattcacaatccctcagctagacataaagattctccaagtccccaccacattagctagatacagagtgctgattggtgtatccacaaaccctgagctagacacagggtgctgattggtgtgtttacaaaccttgagctagatacagagtgcccattggtgtattcacaatcccttagctagacataaaggttctccaagtccccgctagactcaggagcccagctggcttcacccagtggaccctgcacaggggctacaggtggagctgcctgccagtccctcacctgcgcctgcacttctcagcccttgggcrgtctatgggactccgtgctgtggagcagggggcggcactcgtggcgggggctcaggccacgcaggagcccaaggtagggggcggggcggagactcaggcatggtgtgctgcgggtctggagccctgccccgcggggaggcagctaaggcccagcgagaaatcgagcacagcgccagtgggccagcactgctgggggacccagcgcaccctccacagctgctggtccgggtgctaagcccctcactgcctggggccggcagggccggccagctgctccgaatgtgggacccgccaagcccacgcccaccyggaactctagctggcccgcaagtgccgcctgcagccccggttcccacccgtgcctctctctccacacctccccgcagggtgagggagccggctccagcctcggccatcccaggaaggggctcctacagtgcagcggcaggctgaagagctcctcaagtgtggccagagtgggcgccgaggccgaggaggtgccaagagtgagcgagggatgcgagggctttgagggctgccagcacgctgtcacctctcaacaccactgcactccaatctgggtgacagagtgagactccctctcaaaaaaaaaattttttttttcttagagacaagatctcactatgttgcccaggctggtcttgaactcctggcctcaaggcatccctctgccttggcctcccacagtgttgggagtacaggcatgagccaccatgcccagccaagagaagcatttttaaaatgaaatgttacctattagtcaccaaggagttagaattatattcatgtatggctggaaaatatggtgtgtatttaaaaaaaaattagtgttttctctagatatcttttattaaaatattcaaaggtttatgtgtgttttagaaacagaatagtggaaataagatttacagttgatgccagagcccacacatgccagctgacatccacctgactttctctgaaactgacccaatagtcccattggcagtttttttaaaattagaaacttacctttctgatctaaaagctagaaacctatacttgttttatctgagctccttcctcagcaaaagacctccaggcctctcaaaaactgtcaaagacctgaggcttagcagctcatcggctccagacaatgagacatctagtccctccttcttcatgactgcttctttaatccacctgagttctcattttcccacacatggttgcattactcccctgctacataaacccctaattttagttggttaggggtgcaaatttgagcgtgatcttttacttccatggctgcagcacccaactaaacccttcttctctggcaatgctcacctctcagcgattggctttctgtgctgtgagcagcaggacccaggccgaagccctggtgtcgtggtaacagctgcacatctgcatacatgtctctgctgctcttcttcagccttcctgctgcacttcacacctccctattctggcatctcctaatgccctgctcttcctggcctggcccctcatgcctyatagcgacttccctgagcaggtcagaccatggcagtggtcaccacctggtcctgcctggcacacaggcaccccgtaaaagttaagtaaatggatgtgggaaagaatgcagtgagactatcgttatatcaagtgtttctactttgttcacacagtcaggaatctgctcacaggcccatatactattataaaccaaaatacatctatcagccgggcgtggtggctcatgcctgtaatcccagcactttgggaggccaaggtgggtggattacctgaggtcaggagtttgagaccaatctggccaacatggtgaaacccaatctctactaaaaatacaaaaatttgctgggtgtggtggtgcgcacctgtaatcctagctacttgggatgctgaggtgggagaatcgcttgaacctgggaggtggagattgcagtgagttgaaattgcgccattgcactctagcctgggtggcaaaaccgaaactctgtctcaaaaaacaaaaacaaaaacagaatacatctaccacaggatgcatgaaaagtttcaagttcttttagaaggcatcttagcaaaaagaatccctgaagcacactagtgaggtccagcattttaagtagaacctccgtactgctcaatccccttcccactccccaccaaccccactcacaaccctactcactccccaccatgccagctcactgtcccatttggtgtcccttttgtgtgatatcttttcccactgttggacactacgggctgtgaagtgygttgcttggtttaaaaaaaygtaagccagtggttctacatggtacactatttttgttccattccttttatggtgttttaagcattgtgcgtctattactgggtatggaaagtgcaattgggagcaagtgtctattcgtgtcaggaccattttatagtcttccaaggtgaccagcactgaatggcatcatatarcttatctctaagctctgcatcagggactttccctgcaggaaacctgccctataatcatccgcagtctctgtctttcctgctggcagacaggacagctcttgttggcattttatgcttctgagggtgcagaagaatatgtgtctgtgatcacccctctctgcatggcggctgctccccaatgtccactcatttcatgggcccagttggccacctcgggtgtaccatgatatccacttggggttccaatcactttccagtctgggaaaaaggtttttctgatgggcattaacatatcctatttaatgcatcccttaaattcccatatgatttccataaggccatgttccatacggacgcccctttaacaatccagttttccattgttcctcttcctgaccacatggccagctattggccaatgcccatgagttggaatgcacctagacttcagggctgtaagtgttgaagtcttccatcactgcaaggaaaatagcatgcagttcagctcactgagctttacttgttttcaacctcttcaattcgttttaccatcagttggttacattggcgagctttccaaacaggatgctgaccatctactttagaagtgttaatgtaaaccaaggagatttttgttggtcagtggagaggtgttcatgaggcatcatcagccacatgtcaataggatctggtagctcctcagatggttccaaagttggtcctagaggtaatgagcctacctgcttgtgaatatgatgcaaacctctttgcattcctccagtatcatgttcctgtataaaccatttccattttattacagagtcagctcttctgggcagtaacttcctcattagtgtttctctgacatcacccaagacatcgtgggtatttcagatcttaagaatattttattcttcagtcatagactgcttcagtcataggagcagtttcaattaatgccccccaaaatagcaacccaataattgtctctgaaatgagacataccgtattgtcccatctggaaattttctggtccaaaattcaagtgctcaccattaggcagcactcatgggcttttaccatagaatctagtctgtggaaatgcaatttcagatacaggtgtccctgggtatctgtggggaattagttccaggacccctccctaagaggatgctaaaatcacaagggactgaagtatctttttaaaatgacatagcatttgcatataacccatgtacatccttccctatactttaaaaaatcactggattacttaacaataactaacacagagaaaatgctatggaaatagttgttctattattttaaaatttgtatttttttattgttgtttttaaaacattttccaaatatttcatgtgtrtatatatatrtgtgtgtgtgtgtgtgtgtgtgtgtgtgtrtrtatatatatatatwtatgtattaagacagggtcttgctctgttgctcaggctggagtgcagtggcatgatcatgactcactgtagcctccatctctcaggttcaagtaatcctcccacctcagcctcctaagtagctggggctacagatgcacaccaccacaccatgcttatttttgaatcttgtttctttttgaatcttgtttctttttgaaacagggtctcattatgtttcccaggctggkcttgaactcctgggcttaagtaatccacccgacttggcctcctaaagtgctgggattacaggtgtgagctatcacatgcagcagcaaatatttagacctgaggttccttcagtttccagatatgaagcctgcagawaagagtgctgaatgaggccaggtgaggtggctcacgcctgtaatcccagcactttgggacgcccaggcaggtggatcacctgaggtcaggagttcaagaccagcctggccaagatggtgaaaccccatctccactaaaaatacaaaaattagccgggcatgatggtgggcgcccrcaatcccagctacttgggaggctgaggcagcagaatcactggaacccaggagacagaggttgcagtgagccaagaccgcaccattgcactccagcctggacaacaaaagcgaaactgtctcaaaaaaaaaaaaaaaaaaaaagagtgctgactaaacttaaacttccaaagtcatatcagagtggaccataagggcctaatatatatctagacatcacttcttgaaattcagtcatagagtgctattatgatggctcccattcaactataggcttccttcagacagtcttaatggataggagctcgcactctttccagatgcagaacatgtcttccaaatccaaacaacccacccgacactgtgcttctcactgagttccagtggtaggtaacaaaagcagtctattttagctgcctgtgggatgtgatagctcctgcccaggttattcctgagaatttcattgttgatatggactctgggatctttgctggattggtcaactagcctgtgttagtcatgactgtcactactgcactaaagtcaatcctggcttgtttttcagtttgtgatgtgattgtagcattagcgatgtagcgtattgacacagcagtaaactggtgaattcaaataaccatrtggcaatacaatgtagtaggctggaatccttcccacataaaggcaaatcgtgtttgactcttttctaagattgtgatacagaaaaaacttttgcaagacattgtattttttgcactattgaaaccatatcaggaactgctagtgctgtaggcaggactactttatttttatttatttattttttatttttttgagacagaatctcaatctgtcgcccaggctatagtgcaatggtgtgatctcagctcaccgcaagctctgcctgtcaggttcaagtgaagctcctgcccccagcctccatagagtagctgggactactgacatgcmccmccatgcccagcttatttttttttgtttgtttttgaaatggagttttgctctgttgcccaggctggagtgcagttggtgcaatctcggctcactgcaatttctgcctcccgggttcaaacgattctactgcctcagcctcctgagtagctgggactacaggcacaatccaccatgcccagctaattttgtatttttagtagcggcagggtttcaccatgttggccaggctggtcttgaactcctgacctcaggtgatccacccgccttggcctcccaaagtgctggaattgcaactgtgagccactgcacccggccaggactactttattcaagtctggaaaatctactgtagtcttgatgagccacttcccttttcatgggccacacaggacatttgtacagaaaatttattagtaccagcaytccaacttctaacatgtcagcaattaaagtggtattctctttttgtctactaggattcatccgacactgtgtcaaattaacaagctatgtgggctcaggcaattctataggttcccatttagtatgcccagttaatgattgcagaagggcaaacttacatacctttgattttataatactaggaatgggaagtgctcccagtcagatgtgattccacctaataatacacttaggtagaggagacacaagcacttcacatgaagtccgtcctaacgttccaattttcatccaaactttcaccttcatctcatcagtctttatatccccagatgctccctagaaaactatcacccaattaggacttcaccgataggttttgataacataatgcattgggatcctgtgggaaggactctcagaagtttttctctaccccatgtccactatcctcacacatatgcacaagccccgggtctgctgttgaggatcaggccgagggaccctgacccctgcatcagtctttgttctgattaatgtgtctgatcactagccccatgatttgaggtcagatttctctctctctttttttttttagacggagtctcactctatcgcccaggctggagtgcagtggtgtgatctcggctcactgcaacctctgccgaccggtttcaagcaattctcctgcctcagcctcctgactagctgggattacaggtgcctgccactgcacccagctaatttttgtatttttagtagagacagggtttcaccatcttggccaggctggtcttgaactcctgacctcgtgatccagccaccccagcctcccagagtgctgggattacaggcgtgagccaccgcacccagctggatttctcattttcatctttgtgttcagtcttttcaaattcctgcaaactcaggtaaatagggtagatctgtttagagcccttcaatgttggaacaccagcagggkcacctgtgagtccactgaaccttccatagtgctgcaataagatatttcttttgaatcatcaatattcagctttttcatcccagttttttttttttkggggggatagagtcctgctctgtcaccaggctggagtgcaatggtgagatctcggctcactgcaacctccacctcctgggttcaagtgattctcctgcttcagcctcctgaatagctaggactacaggcacgcgccaccacacccagctaatttttgcatttttagtagagacagggtttcaccatgttggccaggctggtcttgaactcctgacctcaagtgatccacccgcctcagcctcccaaagtgctgggattacaggcgtgagccaccgtgccyggcccatcccagttgttaatatttgaaaatttccaccctgctgggataagtcccttgactatttcctttgactttgcccattccttttgtgactgggcatcattttcttggcatctgtaagacccatgaggggaagctgagataacaaatctggtatgatgtcttgaactgcgcttgattttgcagcagtaagtttccatgggattcgtgtgcaaaaggagctcgcgtaatcacactgaggcaggagatcagcaggacttgttttctgaacactggtcacaacccagctgattgaaacaggatctggtcaaaaaggatgcagtaaagaaactggccaacaccacctaaaaccaagatggcaacaaaagcaacctctagttgccttcactgctcattacacgctaactgtaatgcatttgcatgctaaaagacactcccaccagcaagtgacagtttacaaatatcatggcgatgccctgggaagttactgtacgtgatctaaaaggggaggaacttcagtctcaggaactcccaacctcttttgtagaaaattcgtgaataacctgccccttatttagcttatgatgaaggagtagctataaacacagctccccagcaatacccgactacttctctgcctatggggaagcctgtgctgtctgcggaacagccattttcttgtactctcttgttctaataaacttgctttgctttcactttactctgtcagtttgctcaggaattcttttctgtgtgaagccaagaacttttctgggctgagctccaatttgggcattcatctgcatcactatctaggtgctgtgacctggttaagggacatatgagggggatgaacaacctgatcattataaagccagtacagccgggattggatatgtggcaaatcagctgcctcattttgggaggccacttagcatgtaaaggagggaaatgtygatttaccttctcagggtaaacaaactacagcggcatttctccattccagcaggctggctgacccctcagrgacaacctgtcatgtgttgggatcatacacaggyatcttttatcgttccataataagctgtgggtcctgcagcaatccagacatgctcttctagtccgcagcattcaaagtctagaaggctgctcctcagccagtctcacaatccattttggtaaaacttcctcaggaagctgcagatgtcgatcaataaatgagacattccttcacattttatcctctgctttagtagtttcttgggtttgcacaggcttgccatcttgactttgcaacagtgttatctgttgttcaggcacmatttttctattagagagtggtcctgagactaataaccatagctctgaccagctgaagtccaagcatggcacagcaccagaatctgccccagcactctcctttactttcattttagctattacagataaaaatcactgaaggaggccaggcgyggtggctcacgcatttaatcccagcacgttaggaggccaaccaaggtgggtggatcatttgaggtcagragtttgagaccagcctggacaacatggggaaatctcgtctctactaaaaatacaaaaaaaattagcccagtgtggtggtgcatgcctgtagtcccagctactcrggaggctgaggcaggagaacgcttgaacctgggaggtggaggttgcagtgagccaggattgcaccactgcactctagcctgggtgacacagcgagactttgtctcaaaaaaaaaaaaaaatcgctgaaggatttacactttactttctttctcattgttttccatttatttatgtatctgaagagtcaacaccttgggagttggggtcgtcatttctcaatcccattgataactacatcttcagtaacagacatcagggcagctgctgtcttgtccctgttttgagagacaaggcaactaaaatgtggagaggttatgtagcttgctcgaggtcacacagcaagaaaatgacaagaggtggtatttgaaaccaggtttatctgacttcaagaccttctctttamgctttagcaacactctttcctatgaacagattctaaaccttaaaaactagaagctgctcatgcctgtaatcccagcactttgggaggctgaggtgggaggatctattgagcccacgagcttgacaccagcttgggcaacatcatgagacccccagttcttaaaagatacctagctgggtgtggtggcacgctcctccagtctgaactactcaggaggctaaggtgggaggattgcttgagcccgggtgtttgaggctgcagtgagccatgatcatgccactgcacctcagcctaggtgggaggagaccttcacccctcaaaaaccacaaagaaacaaacaaaaaccctagaagcttctcccatcctactgggcattccttacattattccatggggatttccacttttgaagcatagccctcaaagacagatcaagcagtccacttgatctctctcagtttttcatgtgtttgggggccagaaacatcctttggtctctcttttgggcttcctgtctgtttgtacccaggacctctgctgggcacaacatggcaattcaagtggatcaatgattctcaaccttggctgaaccttggaatcacccaaggacctttaaaaaatacaaatcctgctctgggcgggcgtggtggctcacgcctgtaatctcagcactttgggaggccgaggcgggtggatcacgaggtcaggagttcaaggccagcctgaccaatatggtgaaaccctgtctctactgaaaatataaaaattagctgggcgtggtggcatgcgcctgtaatcccagctacttgggaggctgaggcaggagaattgcttgaatcccgggggcgaaggttgcagtaagccgagatcgtgccactgcactccagcctgggcgacagagcgagactctgtgtcaaaaaaaaaaaaaaaaaaaaagaatgctggtggggcgtggtggcttatacctgtaatcccagcattttggcaggctgaggcaggaggatcacttgaacccaggaggtcaaggctgcagtgagctgtgtttgcattccagcctggacaacagagggagaccctgtatatatatatatgtaaaagcaaatgcccaggtttcaccctaaacactctgatttacttggttatatgtagtgggttaagtggtcattcccataaaggtatgttcatatcctataagctgtgaatttaacttgtttggaaaaaggatatttgcagatataattaaagacctcagatgagattattacggtttagtcagtgagcactaaatccaactacacgygtccttgtaagggatacccagagaagagtcccatgaagaagaggaagaggtcatgtgaagatggaggcagaattgcaactatgtagtcacaaggcaaggaacatcagaacaatcagaagctggaagagacaaggcagaattcttccttacagcctgtgaggaactcggccttgctgacaccttgattttagacttctaggctccagaattgcgacagaagaagtgagtgtggtttctgccaagttttttttttgttgttgttgtttttgtgtgtgtgatttggtcatttgttgtgacagacacaggaaattaatacagttggtgggcgggggcggggcctgggcctttgtacatttttttattttttayttttttgagacagggtcatccatgttgtcacgtggatgagtactttctatctatttgtctgaagaagcagggtatggtagagaagcctcaggcttcagagactatcagacttggattgcatccagccacctggaaactctcagaatgtcagttcagttactccagactcccatagaagaggaacagaatccctttacctgtaatacagatgcctcctcattactctctggcatctcctcccccagggctagattgaaaggcaagtagacctcagaaacagcatctcactgtccagggacacagatacaggacaaaacatcagaacctcactgcggccctctgctcctctcctactcaacacttcatcagccctgatgacaaagcagccacaggaactgttctttgtccttcctcagcccagtgtttctggaggtgctaatgagccctgggataaactcccctgacatagacagctggaaggagatgggaaggcaggagaggaaagcggcaggataatttataaattaaacagagaagcagaagcaacaccgcagttatagcccaaacagccttagagacacaaactacttaagatatagatacctatatgcaggttcacaaagctttttattttcttaccatcaagtttatttaccctggctgttctcatagtgtatcaaatatttactctgctaaaaatgataaaaatagaattaagaaaacattatgatagccaggcacactggtgtgtgcttgtaatcccagctactcaggaggctgagacaggagggtcatttgaggccaggagatccagtctagcttgggcaacatagcgataccctgtattaaaaaaagataaaattaaaaattaaaaagaagacattttgatattgcaaaagcatttagaccctaagctgaggaaaactgccagagggagatgcttctgacatgccctattccagtggtccccaatcctggatgcatattagaagcacctaggaagctgttaaaaaggtacaaatgtgggccgggaactgtggctcacacctgtaatcccagcactttgggaggccgaggcaggcagattgcctgaggtaaggagttcaagaccagcctgggaaacatggtgaaaccccatctctactaaaaatagaaaaaattagccaggcggcgtggygtgcacctgtaatcccagctactcaggaggcggaggcaggagaatcacttgaacccaggaggcagaggttgcagtgagctgagatrgtgccactgcacttcagcctgggtgacagagygagactctgtctttacaaaaaaaaaaaaaaagggtacaaatgtggccaggcatgatggctcagtctgtaattcaacactatgggaggccgaggcaggagaatcacttaaacctgggagtttgagaccagtctggacaacacagtgagaaccccatctctgaaaaaaacttttgtaattagctgggtgtggtggtgtgtgcctgtagtttcagctcctccagctttagagtctgaggtgggaagatcacttgaaccccgaaggtcaaggccgtagtgagctgtgatcatgctactgcactccagctttggtgacagtaagmccctgtctctaaaaaataaaaaawgtacaaaggcccaggcccaccccctgcccccaccaactgtattagtttcctgtgtctgtcacaacaaatgaccaaattacaaaaaaagaaaaaacaacttgttggctgaaaccacactcacttcttctgtcacaattctggagcctagaagtctaaaatcaaggtgtcggcagggctgagttcgtcacaggctgtaaagaagaattctgccttgtctcttccagcttctgattgttccactgtttcttgccttgtgactgcatagttgcaatttctgcctccatcttcatgtgatctcttcctcttcytcgtgggactcttctctggcggctctgctgtgaagtcagctgcccactgttagcagtgcaggtgtctgttcttgcctggtgcctggtaacccaggcactgggctcgtcccctctctggagtgatgtgggtgttgtacctgatggcaacatcaccaaatctggctctctagcctctggagagtctgtgagttatccaatrgatttttttttaattgtttaaaaacaagagcaagactctgtcccccccmccmcccaaaaaaaggtaaagaaatgtagactcagattcagtaggtctggttgggcatgaggctctgcatttcttttttttttctttttctttttttgtgtgtgtgtgacattgtcttgctcttacacccaggctgatgtgcagtggcgcartctcagctcactgcaacctccacctcccaggttcaagcrattctcctgcctcagcctcctgagtagctgggactacaggcatgcagcaccatgcccagctaattctgtatttttagtagagatggggtttcactatgttggccaggctgatctcaaactcctgacttcaagtgatctgcccgccttggcatcccaaatggcctttagggagaaaaccaagatttgcttaaatacaccataaagatttctattagctaatatcagcatccaaaaagaacttcttagtgttgatttcttggctgcacctgccttttcaggcatgataacagaagacaggagtctatgatacagagaaagcagatgtagagagaaaactgagtagactttgtcatatcaaatttcaacaatggggctgggtgccggtggctcacacctgtaatcccagcagtttgggaggctgagacgggtgaatcacttgaggtcaaaagtttgagaccagcttgaccaacatggtgaaaccctatctttactaaaaatacaaaattagcctggcgtggtggtgcatgcctgtaatcacagctacttgggaggctgaggcaggagaatcacttgaacccgggaggtggaggttgcagtaagctgagatcgtgtcattgcactccagcctgggcaataagatcgaaactccatctcaaaaaaaaaaaaaagaaaagaaaattcaagcatgggcttcgctgacagggatccccaagaactacccctacttggccaggcatggtggctcacgcctgtaatcccagcactttgggaggccaaggcgggcagatcacctgaggttaggagtttgagaccagcctcgccaacatggtgaaaycccatttctacttaaaatacaaaaattagccaggtgtggtggcaggcacctgtaatcccagctactcgggaggctgaggcaggagaattgcttgaacccagaaggtggaggttgcagtgagctgagatggtgccattgcactccagcctgggggacaagagcaagatttcatctgaaaaaacaacaacaacaacaacaacaacaacaacaacaacaacaaaaagaactacccctacttggatctcagctaaaggaaacacaccacctatataattttatacctttatgggtttaaccaaacatgttgggaaaaatagtaaacaaatatatttttaagccacatttctaccaaaaatacaaaaattagctggacatggtggcttacacctgtagtcccagctacttgggaagctgaggcaggagaatcacttgaattatttttatttatctatttttttgcacacagtctcactccattgcccaggcttgagtgcagtggtgtgaccttggctcactgcaacctctgcctcctgagttcaaatgattcttctgcctcagccacccatgtagctgggattacaggcaagagytaccacgcccagctaatttttgtattttttgtagagatggggtttcaccatgttggccaggctagtcttgaactcctgacctcaagtgatccacccacctcggcctcccaaagtgttgggattacaggcgtgagccaccaagcctggccattttttttgtatttttcatagagacagggtttcctcatgttggccaggctggtctctaactcctgacctcaagtgatccaaccaccttggcctcccaaagtgctgggattacaggcgtgagccacaacacacagccaaaattttaaccattttgaatggaaacattttatttcagaaaacaatggacrtaatttaacataaatatcagctttgaatgctgaggtaacacaggttggtgtctaatttgcacttgtttctgtatgtttctggttctcaactgagctggcaggttcctgctgttgtcattcaggctttcaatagctcagggcctcacactctttacstctgccctctgctggggtcaggaagacaaaataacccagctatattaggtttctccagagaaagagaacccactggatggatagatagatagatagataggkaggcaggcagatagatagataggtgggdagatagatagatagatagatagatagatagatagatagataggcaggctggcaggcaggcagatagatagatagatagatagatagatagatagatagatagatagatacacagtcatacatcgcttaacaaacatacattttgagaatgcatctttaggcgattttattattgtggaaacatcacagtgttcttatacaaacctagatggtatagcctactatacacctaggctatatgatagagcctattgcttcaaggctacaaagctgtatgacatgttactgtgctgaatactgtaggaaactgtaatacaatggyaagtatttgtgtatttaaacacatccaracctggagaagatagagtaaaaaaatggcttaaaacataaaaaatggtacacctgtagagagcacttaccatgaatgaaacttgcaggactggaggttgctctgggagagtcagcgagtgagtggtgagtgaatgtgaaggcctaggacattactgtacactactgtagactttataaacactgtgtacataggctacgctaaattaattaatttttgttttttgaaacagtgtcttgctctgtcgcccacgctggagtgcagtggcacaatctccactcactgcagtctccacctcctgggttcaagcaattcttctgcctcagcctcctgagtagctgggattacaggcatgcgccaccaaacttggctaatttttgtatttttagtagagacagggctttgccaygttgggcaggctggtctcgaactcctgacctcaggtgatccacccgccttggcctcccaaagtgctgggattacaggcatgagccactgcacccagcctattaaaaattttttaaatctgcaataattaaccttactttactgtaactgtactttataaatgttcaaatttttttaccttttgacttttctaataacacttagtttaaaacacacgttaagtagttgtataaaaatattttcttttttatatctttattctataagcttttttattttttaaattttttacatttaaacttttttttttttgttaaaaatgaagacacaaacacacacattagcctaggtctacacagggtcaagatcatcaatattgctgtcttcctcctccacatcttgacacactggaaggtctccagggacaatgacacgcatggagctgtcatttcctacaataacaatgccttcttctgaatacctcctgaagggcctgcctgaggctagttacagttaacttctttttttataatttgaagaagtacactctaaaataagaaaaagtatagcacagtgtattagttcattctgaaattgctataaagaaatacctaagactggataatttgtaaagaaaagaggtttaattggctcacagttttgcaggctatacaggaagcatggcggcatccacttctggggagaccttagggaactagcaatcatggtggaaggtgaaaggggagaagccacgtcacgtggttagagtagcaagaatgggytggggaggtgctacacacttttwttttwtttttttttgagacggagtctcaccctgttgcccaggctggagtgcaatggtgcgatctcagctcactacaacctctgtctcctgggttcaaacgattctcctacctcagcctcctgagtagctgggattacaggcactcacgaccacgcccagctaatttttgtatttttagtagagatgggttttcaccatgttggccaggctggggtgctacactcttttaaatgaccagatctcatgaggattctatcatgagaccagcaccaaagagatggtgctaagccattcatgaaggaaccacccccatgatccaatcacctccccccaggccccttttccagcagtggggattacaatttgacatgagatttagtggggacacagatccaaaccatatcacacagaaaatacataaggcagtaacatagtcatttattatcaagtattatgcactgtgcataattgtatgtgacttttatatgactggccatgcaataggtttgtttacaccagcatcaccacagacacatgagtaatgcattgtgctacaatgttatgacacctacaacatcactagatgataggagattttcagctcctttataatcttgtgggaccaccattgtatatgcagtccattgttgacaaaaatgtcattatatagtgcatgagtctacgtctatcagagatttattatggaggttggctccctcaattatggtggctgagaagacctaaaatatactgtccacaagagaaccagggaagctggttgtgtggctcagtctgagtatgaaggcctgagaacctggagttctgatgtccaagggcagaagaggaagggtgttgtccccgctgcaatagagagagcaaattctctcttcctctgcctttgtgttctatccaggccctcagccctttggatggtgccygcccacattggtgaggtcagatcttccttattcagttcactgattcaaatgccaatctcttccggaaataccttcacagacatacccagaaataatgtgccaccagttatctgggtatcccttaacccagtcaggtttacatctacaatgacccaccacaccagtcaaatacaaatcagcaagactcagctggagtgaagtagtgcagatgggctgggcactgcttggtggstccactgcttacctttcccacctcacattttacatttctacagggggcagatgcctgagcatagctctgtgatcaacaggctttgtgggtttttattatttccacactaagattcttgagattggaatgttatcccctttccttttgaaatcagctcacttgtcctagagaactgatgtttatggtttcttctgaataaacatagaaattgatcctcccactcttaaaactttagaaagttacatttgtcttatctgagttcctttctcgggtttccaactgtcagccctcccagatagtaatgaggcaggagaacagggtctggaaacaggggatgtaaggccgattcaggctgacttcctagaactgaatcaaaaggaaaaccccacctctccatgtccaagtaacaaaaagatcagaggctactccctttacactcckcccctccccactcccattccactgcattgcagatgaaaaattgaaagtacctctgattggttgcctccctctaccaattagactggttgtgggccaagtcttcatttacatagggtgtaaccaagtaaccagtgggaaacctctagagggtatttaaccccagaaaattctgtaactggtcctcttgagacacttgctcaaatctgctcccactctgtggagtgtactttcatttcaataaatctgtgtttttgttgcttcattcttttgtcgctttgtatgtgtgatccgttcaattcttcgttcaaaatgccaagaacctggatgactcacagtcaagaccctccagtgcggtaacagtatcaaggaactgacacttaccagatcatcacatctggacaataagaagccagacccctcacctgtcatgattgcctaactgatcacctgcttcttcttgaccaactcctcttccttacccctccctaattcctattttcctatatgtagttacatttcttccctgttatataaacccctgatttcagttggccagatcacagctgcagcatgtgattaagccttcttccctggcaataatcattgtctcagtgattggcttcctgtgcggtgagcaattgtacctagatcaaactcctggcattttggtagcacttttttttttaggtaargaagttgagaaatgttacaggacttcctcaagttcctacarccagaaaagggcagtgctgggttggaactccacttagcagctaaagttcatgtaagtaagcaacatgctagcttgtcttccaacaaaactatgtgaaaatgaaccctagctcttcacttaaagcccagcagccctgtgtgagctatgtaatctaaaagaacctcagttagctcatgtgggaagggggtgtaatatttttcttgcactgttattgggatgtgtaaataacataatttgtcaatgctctccagccagaaaccactaggaacacacctatagttaagaaagttgggtttaattctcattgcaaagagggaaaatgcaaacaatgggaaaccctgggggtgtctcagtgagatgatgttagaaaatgttattaaaggatttgggctttggtttgctgctttgggagaagttgaagaaagcatagtttttctctgggttggatagggtcaggaaactggggtaattctatgaatgtgtatcctcataaatcttacccatagggaaagcagactacaccaagtctgaagctgtaattgggctgagtgtagtggcccatacctgtaatctcagtgctttggcaggctgaggcgggagaattgcttgagcccaggagtttgagaccagcctgggcaatgtagcgagactctgtctccacaaaaaattttttaaaaattagctaggtgttgtagcatgtgctgtgatcccagctactcagaaggctggggtaggaggattgcttgagcccaggaagctgaggttgcagtaagtcattgtgccactgcactccagcctgggtgaccgaacgagactctgtcagaaaataaaagctgtaactggcaatgaagcagcagccagttctattagccaagacaactgctatatttgtgtgttttcttttgtggcttgaacaatgtttatgctttgtctgttttcagatatgatgttgaagtggtcttattctggtctagatccatcctggtcacagaggagtcttgtctaatggtgttgtgggaaatcgtttatgttcatgttcaacaggaggacatggcccagggtagtgccaggccagatctatttcagaatataaggtatccatcccagtgctggactcaccggtgttggaaccacaggggttatgactctaatggtgcttacccaaatgccatcccagacctctgagccacagtgacacaggcaggtgcattctggagaggctaaaagacagatgtcccatcagggagtaatgactcattttcctcctgagcttcaaacattacacgaagccatttccatgaagtcagtggtatttcagcccagggagaattttggacacagcaacgaggggcctgcaagttagatgacctatcctgtgatctgcctttgcctccttcatgcagcaaatatgcagtgtgtctcagagctgggctagatactgtgacacccaccacctcatgaaaaaggcagagaagcaaacaatctagctgaaaaaatgtaaaagcatgtagtgttcagtgagggcagtggtgcccacactttcctatgcaatggaatcacctgtgaatctttcaaaacactaatggttggggtcccatcccactgagttaagtgatctgggcttccactcgggcttccagcttttaaaaactccctaggtgatcaatgtgcagccaagtttgggtactattggtttaatccatcatttttacaagcttggcgggggttgggggggtgggggtgraggtggggagtgggcmrtggagggtgtcacagatgttgaattggataaaagcttttgtctctcattccaggcacttgcatttagatgtaaaacctggcatagtatttcaggggatttacagatcccaagaagtgaatcagggaacgcctgtgggccttgtggtccccaagtgagaaaagtccagctgcaggagtgtccacctccaattggggtgacaggagctctctgtcctgtccagaatggtgctggccctttgtctcagtctttttgtctgtaatarcaaaatacccaagactgggtaatttgtaaaaaacaaaacaacaagaacaacaaaaccaggaatttatttctcacagcctctgaagtctgggaagtccaagctcaaggtgaagcctcctcaggtggcaaagagcagaagcacaaaagagaccaaactccctccctcaagctcttttacaagaacactgagacattcacaagtgctgagtcctcaaacctactaacctcctgaaggctacacctcaaatacggattgaattttcgcatgagttttgagggacacccattcaaagcatagcacccttcggcttcagagaagctccagccctgttgtcaccaagcaggttccccctaggcagagcgccaagaagcagcccaggcgatcccaaggcgcacaagtgctctcaccaggctgcgcgctggcgggtcggtgcacagggacggggtcgccgcccacgcgcgcttggttcagggagcccaggctgtccctacccgcggctacaaaagctcgccgagtcttcctgtccacccaatcgccccacatgtcagcggttggtcgcctcgcggtgcagtgctgggcacgcgagcccctcccgcagtcattctcagcacaagcaccagcctggagccccgcagcgacagagctgagagcccccaagccgcagaggtcgtgcggagcaggtaagcgcagcctcctggctggggagccacggaggagaaagggcggccgggtcccacggccccgccaacaggacaggctatgccctttcagtaccccctcttccctggctctgtttctaatctaggaataaacaagaaagtccttagtctttgaaaagaaaatgattccaaaatmcaaaaaaaaaaaaaaaaaaaaaaaagttaaaaagttaaacatcacgtttgtttggcttaaaataattatayatggcttgtaatgagggaaatccaaaattcacaagcctcttgatgtaaaataatttaaatatctttggtttgggattatgtggttactacaaaacataccacagctgatgggaaagtggtttacttcccattaggttgcaaatgtcttagaaacacactcctggaccacagcttcaagagacgcaagcagtcacctcatctgctggtttccaagctgccctgccagaagcaggtcaggggtcccacaggggtcctcagtaactcctcaaaatcctctcccatcaatggccccaccagatcatccctacttttgaatgcttgtccaatgcaggttccaggtaagatttcctttcacaagtgacttccatggctaaggaaaaattcagcactctagaactagtccaagcccctctctgcggcagtatttataagcagcggaaccatcttgtagatttctaagcttgctggaaaataaaacactgctataaatgcatagagccttctcccttgtgaaaaggaaactcctgccagagatgaaagcaacagcaaggatagcactgtgcagagtaagggtggctaacgccaggcttcctcctggggatttacatcaggattgtaacatattagatgtaaatccacctgtgggctccagggtggatctggaggtccaggcaccagggagctggggtcaaaaccaactgttgttaaaagtcaagggaattataactaaggaataggacgctttaaaatacgacttgtggctgggcgcggtggttcacacctgtaatcccaacattttgggaggccaaggcaggcagatcacctgaggtcaggagctcgagaccagcctggccaacatggcgaaacsccatctctactaaaaatacaaaaattagccaggcgtggtggcaggcgcctgtaatcctagctactaggaaggttgaggcaggagaatctcttgaacccggcaggcrgaggttgcagtgagccgagatcacaccactgtacttcagacagagcaagactgtctcaaaaaaaaaaaaaaaaaggcttgtaagtaaataatgatacaaagaagatacatgagcagtgtcaaaaggcaggtttatttttcttccctttatccataacttagggattcttcaaatagcttaagcaaaatatatccaagttgttaatcaccacatgcatgatgctaggtggttaatttaattggtgaaatggttttgttgctccgtagagtagcagtatctatatggaccaacaaaatcatttcaccaagtaacaaaagccagtgtggcccattattctctgtggcaagtctcctttaagaagtgacatgcacttgtgctcctagctgcttgggaggcttgaggactccttgagcccaggagttccagggtacagtgagcataacttgccactgtgctgcaayctggaggacaaaaccctgtctctactaaaagaaaaaagaagaataaggagaagaagaagaagataaggaagtttttccttcgttctttgaaatctctttctgagtagcattcctcccccaccacaaaagtaaatgattccatggtgaaagacaagaaaataacttctccagtaggatgaggtggtctcataccaaccaaagcaaccaaagcttgcataccaacattgtyaggtgggtgagaattgcattcattcctaacctcttgaggcttcagcatcccaagactagatagtggaaaatctyagtagctctccaggcaaagctggccgggtggcggctggggggcattgggggcggggttgggattcagaacgctcmcccaccatgtctgaaaagcatccararagatcataatgctttgacttctgatataaccttttggggtgtttatgtacttttgatgcttcaaggaataaaaagtctaaatagaattctaaatgcaaaacctytctctgtactactgaggattctcagatggaagaatacattkgttaaccatggtaacaacatatataatcaaagttttgcattattttgagcttggttataacaatgtgctacatccatccacacacacacagaaagagaagttgttgaaaaccaagacaaggaaccctgtggttttctggatcaacaccaggaacgatcccctccagccctccctgggctctgctttctcccttcccctctttgctggttgagcatctgtggcgccaaccagtggtccccgtgatccatgcttcagggccccggaaggcccagaaggcttatgttaccagtccggtctcggtctcaagtaccagagtgacatgacctctcccttactgagcctgaccacctgcctggatcttgacgtgcatggcctcctttctttcactacagctcagatcatggggggtttgtacccatttcacagatgggaacagagagccttcaaattaggttgagactttgcttacactcccaaagctagccagcactggggctaggcttccaacccttcctctgactcagctgcacacaccatccttactaagaggacagcagccccttgcttgcttttgcatttgcattaactctctgaacccaagcttataaataaccaagcaacacattctgtactatgcatttgttattcccaaagatacagcttgattcaaaataaaatgactaagtttatttcctgctcaccttccagcacatcttggacttcaagaaagatgacatcattcaagcacttacataaattctatgttgtggcaaggctctgatccttttcttgtcacttcttcagcatcctaaatttgcacatgataacatctgttgtcctccatcagatataatcagtattgctaatctacagtgccacattggcagtagtgatttttttttttttttgagacggagtcttgctctgtcgcccagcctggagtgcagtggcaagatcttggctcactgcaagctctgcctcctgggttcacgccattctcctgcctcagcctcccaagtagctgggactacaggcacccgccaccacgcccagctaattttttgtatttttagtagagacagggtttcaccgtgttagcaaggatggtcttgatctcctgacctcatgatctgcccgcctcggcctcccaaagtgctgggattacaggcgtgagccactacgcccagcctggaagtagtgatttttatccactttttctccaggttcccagaaagaatattcaacttagtatctatttggctgggagggcaggatgttagtctttgcttcatctaaaagtaaatgaggaattcagtagctcctctgaccacttcaatcacttatagacaagtataatgaaaatatattcttcatacttaaaaaagatcacctgaggtcaggagtttgagaccaacctgatcaacatggcgaaactccatctctactgaaaataggaaaattagctaggcctgatggtgcatgcctgtaatccctgctacttgggaggctgaggcaggagaatcacttgaacctgggaggcggagtttgcagtgagccaagatcgcgccactgcactccagcctggctaacagagcgagactctatctcaaaaaataaataagtaggctgggggtgatggctcatgcctgtaatcccagcactttgggaggctgagatgggcagatcacctgaggtcaggagatcaagatcagcctggccacatgatgaaaccccatctctactaaaatatataaaaactagctgggtgtggtggcaggtgcctgtaatcctagctactcaggaggctgaggcacaagaatcgcttaaacctgggaggtgaaggttgcagtgagccgattatgtcagtgcactctagcctagatgamaagagtgagactctgtctcaaaaaaaaaaataataataataaattaaaaaagtacaccatgattggttacattaaccacatttatttatttaatatttttttagacagagtctcgctctgtcacccaggctggagtgcagtggcatgatcatggctcactgtaacttccacctcccaggttcaagtgattctcttgcctcagcctctcaagtagctgggattacaggcgtgcaccaccacacccagctaatttttgcatttttagtagagatggcgtttgaccatgttgggcaggctggtcttgaactcctgacgtcaggtgatccacttgccttggcctcccaaagtgctgggattacwggcatgagccacagcgcccggcctaaccactttaaaaatatatttaagtgcccccagtatcactgctttctaaactatttcaaaaactgaagggtactatttctataataataaattgttagagtataatattcacagtggtaattcaggtaatgagagtattttacaaggcagaactaattaggttggaataaaacaaaatcagacaccaacaataattcatatgtctcaaatagtgcccttgcctacctgtctttatctaaatattagctctacacattgacaccacgttagtagccactaaaaagaagagcaagcactctgaattttagtctctgttatgccatttcctggcatttggaggaaaagcacattctacagaaaaatcacgggatggyactatctgttttgtatctgattttaacatgtgttatctcttaggtacagggtcatacacttggaaggtgtgatattgtgaaatatgtatttggtcttcctcatcttttcctgacatacggttccttcaatccttggaatcttctgtgctaatgaggtgactggaggctgagggcctctagatagcctcagggtgggaactttttgtgggamaaatcaagttctgattacagggttaagatattcagccccaggccccaacctccaaggagggaaggggggctgaaaattgagttgatcgttaatggctaatgatataatcaatcatgcctacaaatggaagcttccataaaaattcaaaaggaggccaggcgtggtggctcacgcctgtaatcccagcactttgggaggcctgagtgggcggatcacgagatcaagagatggagaccatcctggccaacatggtaaaaccctgtctctactaaaaatataaaaattagctgagcrtggtggtgtggtaaaaccccgtctctactaaaaatataaaaattagctaggcctgtagtcccrgctacttgggaggctgaggcaggagaatcacttgaacccgggaggtggaggttgcagtgagtcgagatcgcgccactgcactccagcctggtgacagagcaagactctgtaaaaaaaaaaaaaaaaaagttcaaaaggactgggtttggagacctcctgggttggtgaacacatccacatgctgggagggtggtgtaccccaacttcatgaggacagaagctcctaggatcagaacccttgctgacttcaccccatggatctcttcatctgtatcctttatcatattcttttttttaggctagttaggtgagcccttattatattctttgttaataaattggtaaatgtgtttccctgagttcttgtgaactgctctaacaaattaattgaacctggggaggggcatgtggcaaccttaatttgtagctggtgggtcagaagttctagaggctcagatctgcaactggtatctgaagttggggacagttttgtgagactaacccctgaacctatgagatctaacactgtctttaggtagggagtgtcaaaattgagttgaattagaggacacccagctagtgtccactggagaacctgctggaaaacggattgtttggtgtctggggaaaaccttgcccacatttggtcacagaagtattctgtgttgattgagagcagaaaaaaaataaaaaaaaaagctttggtttgggtttttcctatctcctatattgcacaaaaggccatatatgtctgccagtaaaagccattgaccccatataaatactagccctatcattgagctagttttttccttagctggtcgtgctacagggtagcacagctccctggttgcagttttatttaaggatccttgaagcatttcaaatacttgaggggacactagaggggggcaagagatgagataaactcttcctgccctttcatctgcaccagctatttattaaagtgcatttaacatgtgtgcttggattcttccccacttgacaggtttcctctctgaccactttttggactgaagaatgggctccaagggatggctcctgccatctagtggcttcctgatgtatggcagattgttcctggctttcaaatttccacaccttgaaagatgcccagggagcctatgaaaagcccaagacctggctgggcgcggyggctcaggcctgtaatcccagcactttggaagaccgagacgggtggatcacctgaagtcaggagttcaagacgagcctggccaacatggcaaaaccccgtctctactaaaaaatmcaaaaaaaaaaaaaaaaaaattgggcgtggtggcaggtgcctgtaatcccagctactcgggagtctgaggcaggagaatcgcttgaagctgggaggcagaggttgcagtgagctgagattgcaccatcgcattccagcctggcgacagagcaagactccatctcaaaaaaaaaaaaaaaaaaaaagagagagagaaaagaaaagcccaagacctcggggccatccccaaacctactgttatcarattttgaatctatctttttttctcttaagagacaggctctcactctgttgcccaggctggagtgcagtggcatggtcatggctcactgcagccttgagctcctgggctgaagttcccgagtggctgggaccacaagtgtgtgccactatgcccggctaatcaatacttatttatttttgtatagacagaggtctccctgtgttgcccaggctggtcttgaacccctgggctcaagcgatcctcctgcctcagctttccaaaatgctgggattgcaagcatgagccactgcacatggctgagtttgggattttaacttgctttccaacacatcctctcagccaaatgtttcccaaacttaagtcatttgccttccattgtcatgatttttcccatactcatatgccaggtgaaatgtgatttcctcaatatttctttaaattcataactaatataaatggaacattggtatcatttgccatatgaaaaggaagtcaaaaagaaacatttaaaaatttatttccaggaattccacctaaaacaatcttctatatcattctatattttggaaaacagtactttgggagttccttctggacactttgctgtgattcaacaccacattcccggtttgaaatttagttccttttctaacaggtgtctatgtttcatgcagaacttccatagttccttttgctgaagatgccttaatagtgatgcatggtctcaattagccattggtgtaggcctgaaaaaagagtggagaccagaaacatcttacagtgctgataattattaaagaagattctaaggccgggcgcagtgtcttacgcctgtaatcccagcactttgggaggctgaggtgggtggatcatgaggtcaagagatcgagaccatcctggccaacatggtgaagccccgtctctactaaaaatacaacaattagctgggtatggtggcgggtgcctgtagtcccagctactcaggagaatgaggcaggagaatcacttgaaccccaaagggggaggttgcagcgagctaaaatcacgccactgcactccagcctggcgacagagcgagactccatctcaaaaataagtaaataaataaaaataacacaatgtcccaactaggactctttatggatcagaaattttagcttgactaaacaggcctgttgtggttttttggtttttgtttgtttgttttgtttttgagacggagtttcactcttgttgcccaggctggagtgcagtggcaccatcttggctcactgcaacctccacccgccaggttcaagctatttccctgccttagcctcccaaatagctgggattacaggcatgtgccaccatgcccggctaattttgtatttttattagagacggggtttctccatgttggtcagactggtctckaactcccgacctcaggtgatctgcctgcctcagcctcccaaagtgctgggattacaggcgtgagccaccacatgcggcccaacaggcctgttttaaagttgctaattgaagggtaaaatatagagagcaaaaatcagtcacatccataggaaaggctgaattccaaaacaactgaaaatcaaaaaccatttccttttgaaagataaacacatgatgggaaataatgatccgtaatgatcgtaattctgtgtcttggaaaacagacatcaatggatgactggtgcagagcacttcttctgcatcattaccagtacttaccagatcatctgtccacatataacctgatggataccatagaaacaagttaagaaatgattcaaaagttattcagataagtagatgtatggaatacctaacagatccctaatatcattacatttatgcagcaaaataaaaattctggaggacagaggccgggcayggtggctcatgcctgtaatcccagaactttaggaggctgaggcaggtggatcacttgaggccaggagttcaagcccagcctggccaacatggtgaaaccgcatctctactacaaatacaaaaattagcygggcttggggacgcgggccagtaatcccagctacttgagaagctgaggcataagaatcgcttgaacccgggaggcagaggttgcagtgaactaagattgcgccactgtactccagcctgggtgacagagttagactctgtctcaaaagaaaaaaagaaaagggctgggtgcggtcactgattacaggtgtaatcctagcactttgggaggccgaggtgggcagattgcctgaactcaggatttcaagaccagcctgggcaacatggtgaaactctgtctctactaaaatacaaaaaattagccgggagtggttttgcatgcctgtagtcccagctactcaggaggttgaggcaggagaattgcttgaacccgggagacggaggttacagtgagtcaagatagcaccactgcactgggtgacagagcgagactccatctccaaaaaacaaacaagcaaacaaacaaattctggaggacagaagaaagagaagagtgggttaaaactcctttgatgtccagctacttagccccttgtgatgcttttcagaatgatatgataaccaatactgggttgtgtgtgttacttattgggaaagatgtgaaatataatccaaaatgtaaaggatgaagaaatcaaatcaatcaagcttctgcactgctaaaacagaccaaagcaaaccaattccactcctggctgagcacaccgactatttgaagtgttcccacactagctgtgcaccccactgacctccagggatttgtgctgtgggtgcctgtggaaccagtgccagcacctctgctccagaagctggggcttttgttttgcttagtcaaatctttaaatgctatagtgatgggacaattatgttttttactcctccgtccccagctccacccaccccaccccaaaaccagtttatttatttaaaaatttttttagacatgagggtctccctatgttgcccaggctggtcttgaacccctgggctcaagtgatcctcctgcctcagcctcccaaagctctgagattacaggtgtaagtgaccatgcccagccaaaatcagagtttttattcaagatacaacttacattatctcagttttctgtccgtataatttcctcagaatccatttcaaccaaaagtaatttaaattcccactggtttctctggatacacttcaatataactattttatgtattattttttgagacagggtcttactctgttgctcaggctggagtgcagtggtgcaatcatagctcactgcagccttaaactcctgggcccaagagatcctgcctcagccttccaagtagctggctacaggtacacaccaccacaccaggctaatgtttattttttgtagagatggaggtcttgctagggggcccaggctgttcttgaatcttggtctgaagccatcytgctgcctctgtctcccaaagtgctaaagtgctaggattacaggtgtgagccactgtacctggcaaactttataattttaaaagtgaatccttaatatcagtttcctttaagaaaactttttaaattaaaaagttgtattagttgataatatacaatatcaagatacaaaatgatgacagttagaagggttagattgcttgagtggcaactgaaactttgaccttgggaatccgcatctggaatcacacaccttcttttcttttgctaccagccccgccttccagaccctgttttactacttcattgaggcttctagaccctcacctccatttttccgaagtcttatttttctgccctctcatagtttcacagtgtttcatgtttcaaactgggacrtgagtttaccgttgacaaccgtttcctaagagctttctaacctcctcaccatctttgcttaaatcattctccaatctggaaatgactcagcatttacagaactaagctagtggtttaactgcctctcctcactgaataacatatttccctaacaaaccctcttatcactatgagtttgttgttgttgttgttagagatggggttttgccatgttgcgcaggctggtctcaaacttctgggctcaaatgatctgctcaccttggcctcccaaagcactgagattacaggtatgggccactgcacctggccttatcactatgtgatggacaaagaacctctgagaagctactccacttgctccagtcttcatctaggaaagggtgaaactgaaatctgagcccaaccttctggctctaaagtgtgtgctctgactcacactacacagatcgggctttccctgctggctttattctcatggctttaccaacttgcattatcctcctagtttacttacctggtcttcatcgtactttacacacctgacctttacatctggccttcagatttagctttccacttctggttgtacccactgttccttacccaactagtggccttaaccttctggttttaccaatctggccatagcttcctgaccttgtcccccggtcttaccccctagtcttacctacctgttcttacttacctggccttaacctccttgccttaccagcctgtttctattaaccttctggtgttactcacctggtcttaacctcatggtcttacccattgtgcttacccayctggtattatccacctggttttgatctcctggccttagcaattaggccttactcacctggcactagcttttggccataccactttgccttacttacctagagtttctacttggccttatcagccccctagtcctactcacccagtcttattctcctggccttgcccactttgctttaaccaccctgccttaactgggtgctctgtccttctagcctcacacaccaggcctcagtcacctggtcttactacctgctcttaaccttgtggcctttccctccagcctttccccctgcccttatccagcaggccacatccacctttggtcagtgactggcttacaggtccccagcactgttatctttgcaccagagcccactctcacctaatctccgtgtgctggtgctacgtcaagtgtggtggtggttaggagtcaccttccgtgtgagrycaagcgttctggctcccgttgtccttgaagttgcatctcaggcttctgggcatggcagagcctgcgttcctgtgactcggctgaggccggtgtgatggagacttcccggcagcctcccggacctggtctctccaaggtcagatcttgaaacttctgggcacccatgcrartgcctgtcctggtgtgccgacttgctcttggtctgcgaagcctgtggacacatggtcaacatgaaaccaccttaacccgcttcccrtcaggtctcgtgggagggatggggcagtgcctggagcacagagaggctcaggaaagggcagttcaactggtttcrctgtggtggatccctyatgggggtctttctagcccaaactgggtgtgatcctgggatagtcaagagctcatgggaagctcttgtttttctcgtattttataggmaygtggagttttcaggaagtccaaaaaagtgcccagtggtcttggcaggctttgagtcttggccacctgacttgttgccagttcccttcacccctggtgacccctaacgtttatctggggtctcatcatggggtcagaatttgttacttcmgtttcttttatgaaagagtgcatttgggtgtatttgaattgtttattttatactctatgaagtcaataaacccattcctatcacccatcccactgcctgagctaaggggccttccacagttgacctggagagttcaagygcactgcactcgagtgcgcttctgggttgaagctgccacctggtactcccagagcctgtgcctctgaggcttcctcttaggttgtggatccgtggaagagccctgcccctgggaactgacatttcccttagaatagggacagaatggaaggtcttgcatttctggagaagccagataaggctgacaattcctgtaagattccttcttaggatgcttgactatgtgttcatattctgtattataaacatatgctacttttcatttaacattctatttttttgaaaatgttcctctgttatgaaaactttcttgatttttaatggattctccaagtcataaccattttctaggagagtgtggcattttggtaactggaagtaaccacagtttcagcattgctccaaagacttaggcgttcttctggttgttggtggagtttgcatgtcagtcatgtatctgcttctgatattttatagaaacatttgacaaggatgattttgctaacatttgccttgcagttcttctagatattgtacttattattattattattttctgcaggttggtctaattgaaggcaatggagaagtaagtctttatggatcaaaatcttagctctagaaaaggtgagggggcctgttttggaaatacrtctattcataaatatattgtttgatgtaattatgaatttgatgatattgaagcctctcagtactctcaattacccttatgggtaatcttagggcttataacatttaggagacacctgcagatgcacaacaatagctttgtttattgtgatttctaagttatttatatgatttgcaaaagttcagaaaatgtagagtaatgtaagaagaaagaagaaaataaagatcacatgtattccttctgcccaaagataatgaacacctcacaatgctgtagactcttctaggaggctcctgtgtggccagccacagtaatgctktttatttattattttattattattattattattatttgagatggagttttgctcttcttgaccaggctggagtccaatgttgcgatctccrctttctgcaacctctgcctcccagattcaagcaattctcctgcctcagcctcccgagtagctgggattacaggcatgcaccacaaygcccggctaacttttttkttgttgttgttttgttttttttgagacagagtcttgctctgtcccccaggctggagtgcagtggcgggatcttggctcactgcaggctctgcttyccggrttcatgccattctcctgcctcagcctcccgagtagctgggactacaggcgcccaccaccacacccgctaattttttgtattttagtaaatacggggtttcaccatgttagccaggatggtctcaatctcctgacctcgtgatccgctgcctcggcctcccaatgtgctgggattacaggtgtgagccgccgcgccccgccaactttttatatttttagtagagacagggtttcaccatgttggtcaggctggtcttgaactcctgacctcaggtgatttacctgccttggcctcccaaagttctgggattacaggcatgagccaccgtgccyggccagtaatgctgtttaaaatgaaagaaggctctacaatggggccatgacgcacaccgcatatgaagtgggcatcttccgtgtcagtaagttttatgtatgtattctaatagttcttgaggaatctgtatttttctgttcctagaggaatctagggaggaagtaaggtggagaggttaaagtcacagctcttcaatgatcttataactcacagagtttctgtttaagtyctcaaagtgacactgtgatgagcatctgtaaatgtgtgtgtttgtgctctcctggccacttcctcagatgaccttctaggcagaattgccagatcaaaagggtacacaccttggaagcattgatgtgggatgcctgtctcttttttttttttgagacagagttttactcttgttgcccaggctggagtgcaatggcttgatcttggctcaccgcaacctccgcttcyrgggctcaagcgattctcctgcctcagcctcctgagtagctgggattacaggcatgcaccaccatgccyrgctaattttgtatttttagtagagatggggtttctccattttggtcaggctggtctcgaactcccaacctcaggtgatccacccacctcggcctcgcaaagtgctgagatgacaggtgtgagccactggccagtctcatttttaagactgcattggtgtggagctgtgagtttgttcaagacagttgaagtgcagtttattataatattgctaaaggcaaacttgtggaaaagtccactttgtcctgagaagaactgacttgcaggaggtcaagtgaggtccttgacagtgctctgagccatcctgtccacttcctatgwgtcaggcagactatgagcccaaaggtcttgaagtattacggtgttaggttttgtttaaacattagttatttctgatttttctaattgtttgcatacacaatctctttttactcttaacagtgagactctagtaagtggtctcttgatgcttactataactttggggatgtttgaaagtgktgaccgagtcmcccacctggtcttctgccatgtcacttggccctgctggtccatttgtttttggccagtgccygtttgggagccaaaccttgtcacctacctccagcccaccttgcccctggggagtcaggtgcagatgcttctccgggcccttcccactgtcctgttctgatcttttacctggtgcagggcagaggggcttagaggacttgacctcattatctgagcaagctcgtgttctccctgaagcctcctggtgcctggcagggttcaggtgctgcaggccagtcaagccgacacataatattaaccatcacagggccacttgtgcctctctttttcttcctcctgctgccgcagataatccattttcagatttcccctgtatgtatcagggttctctagagaaacatatgcatttgtatgtaagatatagaaaagattcatttcaaggaattggcctgtgtgattgtggggactggcaagtctgaaatgtrcaggacaggcaggaaatgtgcaagaattgatgctaaagtcgcggcagaattccttccctctaaaacctcaatttttgctcttaaagccttcaactggttagctgagccccacccccattattgagatatatgcgaagtgtttgtgcttatgtagacacacacaagtatatgcatattagtcatatgtgtatatgagaatatatagacagtgcctaccacatagtgggcactcacaaaaatctgctattagccatgtgcggtggtgcccacctgcagttccagctacttctgaggctaagtcaggaggatctcttgagcccaggagttctttgagttcagcctgggcaacatagtgagatcttgtctcaaaaaagaaaaaaaatatgcygctattagctgctattattattgttcttttcattagttcaaatctttttccttcctccatgtaacaaytgccgatccttggttctggttgtctatagttatatggagggagggaaagatttgagaatagtgttcatatctttccctatatttcctcatttaatcctgagcctgagtggagggtgaggctgtgtcagggaaataaggagaygtgggagtgaggccatgtgcttgtgctgggcaggactgtgcatggggcgcacctgtgaggtcgagtaggagagacgtygggtgcttctgggggtggagattagatttgcagattggggagtaggttagatgccctccctgggctctcaacgtggaaaggaggctgggagtgggcagtgrggcctggggcgttagcagytggaggtgggatgacagagaagaacgagaaggccaatggagaaatggcattcccactccagctttctgcaaggttgtatcattgaagtcgtgcatgtsagccttctagatgtgtgggtagaggggtaagactggaggagcagggccgagtcaaggctgggtaggacttgggtgacaccaaatgaaattagtattaaagccagacttgtgatttgagctcaaattcaaacaattaaattctcttttatccattttcaaagaygaacaggctcctttgatgtgaaacagactggttgtggactcagggagaatttagaaaagaaattaattgagtttggatctsttttacaaaatgtatgatttttaaaataaatcatttctactctttattcagtgtgtgcatttcctgacctttgttttcatttaagacaggacaacagttctgagagcagttctggatgtaagtctgttaagtaagatattaatctccttaattacggaaattacatagaaacctttatttttattttaaagtaatacacacatcatttattaattgttgtttccagatatattaattacaagcatggttttagacagcattggaaaagtatttatatggtaaataaaataacttctagttgtcaaggaaagtgaaaaacaggataagttcaagcaagacaagactcatgtctgtgtttcagaaccttcagatcagcctagaaccttctgagacaaggattctgaaaacttttagtctttatttgccattttatcttcaatgctgtttttaaaagctggttctcttgcaayccctggtcccccaacactgccctgataggccaattgtctaggcagcagttgtggcaacagctggaactgcctgcactttctgggcactagtgctggcataaggaccttgccaatcatgctgagcaggagtgcctagcttcccttcacgcgaccctcccaaaggtggctcagatctggaaggtccaaagcccatctcgtggcacattaggtatgaaccccaagtgtttatacctacttttgaagtaggttgttgtctacttttgaagyaggttgttgtctacttttgaagccttgcatttttacatggtccacacccatatccatagcaaaataatagttaatatcagatagctaacacttaccgagtgcttgctgcctgccaggcacaatccccacctgtgatttaatttccataactttgtggaggtgataatattgtaactcccatttaacagayaaggaaagtgaggcacagagagactcaattacacacataraggcacatgctcaggcaacacgtggccagtgcagataacaggaaaattyactgctcttccctctcataatacattttaatattatggaaatgtggtccttgaaaaagtggtcattgagcacttaccaggtgctayggatacaattcctctgcagcwtgcattctagtggggagagacaggaaacaaatgctaaaatgtgcaggrtgccaggagtggcccattccctgaaagaaaaggaaaggggagagtggttgtgtcaggagattctctctgatagggcagcatctgagcagagaccagasgatatgaggggagtgagcaacagggctatttgtgggggaagacagtaagtgcaaaggccctgaggyaggrgcgtgcctttgaaaagaaatggcaaggaatggctggaggacagcaagtgcagggaggctgggaggagacggaggaaagggcartgagatcctagagggccctggccacactgaaagaagctcctgtgaaacggagtctctcagaataggtyccttttaaagtcacctgaaaccaggtgtcagtgcctgcctgcctgccttccctccttctttcctttctttctttctttctttccttcttctttctttctytctctctctccttccttccttccatccttccttcctttctctctttcttctctttctcactttcttctctttctttctttcttctttgtttctttgtttgtttctttctttctctctctctcgcttgcttgcttgctttccttccttccttccttccttccttccttccttccttccttccttctttccttctttctttctttctttctttctttcyttctttcyttctttctttctttctttctttctttctttctttctttctttctttctttctttctttctttctttctttctttctttctttctttctttctttcttttctttctttcgaagtcttgccctgttgcccagactggagggcagtggcacgatcttggtttactgcaacctctgcctcctgggttcaggtgattctcctgcctcagtctcttgagtagctgggactacaagtgcccggcaccacacccggctaatttttgcatttttagtacagacagggtttcaccacattggccaggctggtcttgaactcctgacctcgtgatccacctgcctcagcctcccaaagtgttgggattacaagtgtgagccaccacgccyggccctagtgcctttcttacttccaaacacatgtttctgaactgcataaggagcctggaaggctgatggcagccaaggctaagtgccattgtgagcactgtgagactctagcagagttctggggtcctggtcgccccaggtgactctcgaatgggagcagctgccctccagttgcaatgctggtctctgagatgagtgactgtaatgaagagattgatgataaccccatgtcctcagaccttcattgtttctgcrgaagggaactgggaaagtcttccaccaaggaatcttttgtgaggcagtgagcttgccttcctgttttctgtaattcctcccattctcccatgtgcttgyggcgagaggaggacgtgaggattgtgttaaagggtgatgagagagcaggagtggttgcagttctggaaaaagatctaataaaacacttacctgcctgaaggcagtgtgctgaaatgaagaggcacattcaacagcattgtcatacattggacctgtgaggggtgtcattgaattgaccacttrggatgtttaaatgtttatttaaagttgcccttggctataaagcctgaagtgggtgttggagtagtcaacgactaacccaggatggatttgtgccaatacacaagtgacaacatctttcacagctgaagagtcggaggataaagccatgcccacagatcgttgtcacacaggtataaccttacattttccaaaatagtcttttaagtgccagcattgttgagtggcatgcactttttgaattatgtaatctgggcatattgtatacctttattttaaaaattttgtttaaaaatgccaatcacgtttattttactttatacmtataagtaacattttttctatcatatataatttaataaaatccaatctcactgtgaacactgtactgctgaaaattcatttttactrtaaaatagaattctgtaaattgctttaagaaagcatttattggctgggtgtggtggctcacacttgtaatcccagcactttgggaggccaaggygggtggatcatgaggtcaggagatggagaccatcctggctaacacggtgaaaccccgtctctactaaaaatacaaaaaattagctgggcgtggtggcaggcacttgtagtcccagctactcaggaggctgaggcaggagaatggcatgaaccagggaggcagaacttgcagtgagccaagatcgcgccactgcactccagcctgggtgacagagcgatattccatctcaaaaaaaaaaaaaaawttatttatatagtacttatatattatctatgtactttttcccagacacacacagtgaacaagtgatcactgggctcctttcccaggcacagtttttgtaagtaattgtgaatgcaggatacctaatatctttgatcatttaagtttttacataaaactaactctagtaggagaaaaacaaaggtgcgtaagtcacgttcacatatcttatgtagtcactttgattgtttccttggataatgatgctctgacagagtgctattgagttctcttagttccttccttccttccttccttccttccttccttccttccttccttccttcctttctctttctctctctctctctctctctctctctcacccaggctggagtgcagtggcatgatcttggctcactgcaacctccgcctcctgggttcaagagatcctcctgccttagcctcctaagtaactgggattacaggtgtgcaccaccacgcctggctaatttttgtatttttagtagagacggggttttgccatgttggctgggctggtctcaaactcctggcctcaagtgaccygcccgcctcagcctccaaaagttctggaattataggcgtgagccaccgctcctggcctcttagtgcttttgaatgaaataaaaacccgtaattattttaagaagtcttcttctatgtaaaaattagaactaggctgggtgtggtgactcacgcctgtaatcccagcactttgggaggccgaggtgggtggatcatctgaggtcaggagtttgagaccagactggtcaacatggcgaaaccccatctctactaaaaatacaaaaattaggcgggcatggtggtggcgtgtgcctgtagtcccagctactcgggaggctgagtcaggagaattgtttgtacctggaaggtggaggttgcagtgagccaagatcgccattgcactccagcctgggcaacaagagtgaaacttcrtctcaaaaaaaaaaaaaaaaraaagaaagaaagaaagaaaaaattagaactaaacaggtgttcttgtctgtccaacatagactggtagactcagagggagtattccaatgttcggaaactgaaaactttatttgaggtcaacagaaaagaagttgagatcaagtatcatgttttgtcctggagccaaatatgtagactttgctgttgagcctggcttgacactggacctttgattgatgttaactgtgactcaccctctcttgcctcctttcagtttccaaattctctctgcttgggtcaaaagtcattgyttgccagaagtttaatagtgtgtgcattgtgtgtatgtgtgtgcatgccaatatgtatgcaacccatacaatgcctggaacaccaatttagcttcatattttaacagaccatgattccaacatcatgtcaaagtcttatatgttaaaagttctgcatccacattagaaggtactatggatcactgtgtakcccatgccaaatggtacatgagctctctttctcctctgggtcctgatattttaaacaaagaaacagtgtgccattatgggcccttgattctgtgcaaagtcattgatcgttacccatccttgaggtttttttcttgaggcagagtcttgctctgttgcccaggctggagtgcaatggcgcgatctcagctcactgcaacctctgcctcccgtgttcaagcgattctcctccctcagcctcccragtagctgggattacaggcacctgccaccatgcctggctaatttttgtatttttagtagtgacagggtttcaccaygttggccaggctggtctcgaactcctgactttgtgatcyacctgccttggcttcccaaagtgytgggattacaggcgtgagccaccatacctggccccatccttgacttttaacatgtacagagcaaccaataacgagtccttcctcaaagtaaagtgaaatgaataataaatgtctaagactttgtggttaaacctaactccacactgaggtgggtcctgtccctgttgatctaaattttcctccactaggggtctaatttggagcttccctacagaggattgtgtgctgcatcctcagatccatggcgcaaggttttttccacgtgtgaaaagaagataacagatgggaaagagctatccagaattggtgtgggcgctggtaccaggcctggccatggagaggactcccccatatttaacctagggcatctrttttctgcagccttgctgcttaaaatggggtctgggaaccaaggtaccatgaggatcagcatcaactgagagcagcttgttaagacgcgaagtctcagccccactccagacctgcagcactgtaatctgcagtaggcaggattccaaggcaactcttgttcacatcagaatttgagaagcaactgttctagaatacactagggagccatatgagatctcaggrtcaagtgtagagtgacttgaggtttctccttggttgagagctcctcaaataagataggcctcccaggttaactaatttcagagcaatttttyagatttagaaaattggagtcaggcgcagtggctcacgcctgtaatcccagcactttgggaggccgaggcgggmagatcacctgaggtcaggagttcaagaccagcctggccaaaatggtgaagcgttttctctacyaaaaatacaaaaattagycaggagtggtggtgtgcrcctgtagtcccagctgaggcataagaattgtttgaaccagggaggaggaggctgcagtgagctgagatcttgccactgtattccagcctgggtgacagagtgagactctgtctcaaaaaaaaaaaaaaaaaaaraaraaaaraaaaagaaaaagaaaaaacaaaaattgggttcattttgggttttgttgcacaaatatacatatttaagcacctgttaggtgcaaggcattatggcctgaggggaggtggtttggatattcataatggaacgagattcctagaatatagaacaaagctgcaatgtttaaaccatttttctaaacttttgtgtaattcagcattgaatctcctttctcatctttacctattgtaagtccagttaaaatgagggtagacgtggatggtgaactgaaagtagcaaagtagacagatgcaatggtgrctacaaatcccactttctgatttgaaatgtgggattgacagcagttgaaaaataaggattaggtctataataaactgtctttattaatgarctatagtttragtaattaacacaaattcagaataagtagtaccatttaatgrgtttatgtttttaacaagtacadtaattagaaaggcctcatgcacacttcctgggaagctagaatagctgatcatattctgctaatgcggagggaggttcccccaagaacaacagggacaatggcatgggaaaggctggacgtccttcctggctgatgttttacacctttcttcttgggttgattgtttttttcctatgtagaagatttccttggacttggccttcagaaaacctaaatttaaagttcagctttatcaggggagcctgggmgaatggttacattaacctctttgtggcctttgaaacatacatagaaaatatcaagggatagwtgtaaaaatgaggataaaaacatctaaagtgctaagtagaaagtaactgagtagaatggaagcctgtagagcaaaaaattagattgtggtttgagtgagtggtttatgcctgtaatccgagaaatttgggaggccaagatgggaggattgcttgagyccagaagttcaagaccagcctgggcaattagcaagaccctgtctstataaaaaattaaaaattagctggatgtggtggtgtgcacctgtagtcccaacratttggtaagctgaagagagaggatagcttgagcccaggaagctgaggctgcagtgagccacatcactccagccaaggtgacagatggagatgctgcctcaaaaaaataaagttagattgtatttgcatgaagggcatgtagttagcctacaggtatgatgctagtgcttatttaattttctgaaatcttttagaagaaggctgcttgtgccacrtggggtacctgtgttcttttggctgtggagtttgcrcaggaagaggtttggagatccaggagcctgaagtcagatgacaggtgccttgacctctgtggcatgtctctttggactctgtgaaagttatttaattgctgtggttttcyagaagaatatgaagataattgtaaggtgccacatgcactgcttggactcttacagttctgacagttattcctgacaaatttcaaaaccaaagtctgtttctacttgtaggatatttctaagatatcccctgagaaattaatgacaatggagaagcctcttgtttgccagaatttattgtagaatggaaataaatacagagtgatgagtgaaccagaaactgtaattaccctagaaatacatattctttttcttttcttttcttttcttttctttttttttttttgagacagagtgttgctctgtggcctaggctggagtgcagtggcacgatcttggcttactgcaacctcygcctcctgggttcaagtgattctcctgcctcagcatcccaagtagctgggattacaggtgtgtaccaccatgcctggcttatttttgtatgtttagtagagatggggtttcactgtgttggccaggctggtctcgacctcctgacctcaagtgatctgcgagctttagcctcccaaaatgttgggattacagacgtaagccaccacgcctggcccagaaacacatattctawaaaccaacttgaattagcagcagagatgtatatcccttagatatggtattttctttctttctttmtctttctttctttmtcttttctttctttctttctttctttctttctttctttctttctttctttctytctytctytctctttctctttctttctttctctctctctttctttctcttttctctctctctcctttttttttttttgacagcattttgctgtaatgcccakgctggagtgcaatggsatgatcwtcactcactgcaacctctgcctcctgggttcaagcaattctcctgtctcagcctcccgagtagttgggactacaagtgcgtgccaccacgccyggctaatttttgtatttttagtagagacggggtttcaccatattggccaggctgttctcgaactcctgacctcaagtgatccacctgcctcagcctcccaaagtgctgggattacaagagtgagccaccgtgccrggccagatatggtattttcaatgtttcaaaatagtgcattgtgttctcacattttataatcctatttctgaaaaaacaatwgtttgttaaccttgtagcttattccaaagaagcagctttggaggatttgcagaagyggwgtcatgggagggcattttctgagctctatgggccctggtgattgtcagacactcagaggatcctttaaaagtttctaggactaggaatggaaagagagaggagccaggttaaggcaatcaggtggygatggcaatgcccagtgcagttaagtgctttgttcctgtatttcctccagacttgctgtcaaacctggacaggagccgaggaggtgggaggcaagggccagtgcatgtagtggggttcaaattccagttctacccyttcctagaggaggacttgggcaaatggagtagctcctctgaggttctctgtccataatatagtgataagagggctttctggggggaaggtggtattcagtgaggggagacaactaaactattagcttatttctgtaaatgttctccagttccaggttggagaatgattcaagttagcaaaaatgatgaggaggttggaaagctccaatgaaaccatggtcagtgggtgataagtgtgtgttgcagtttgataacatgaaagactgaaamtgagagagagttgaaaaataagtctttagaaaaatagagtttagggactggaagcctcaatgaggtagaaaaccagggtggagtaaggaggaactgaaagcaaaagaaaagcacgtgtgtgacttgagagtgagatttccaaagtcagtttcagttaccacccaagcaatcactaacccttctaaaktgtcattatttcgtatattgatatggtattttattaattaatacactttttttttcaagatagagtttttctctgtcacctagrttgaagtgcaatactgtgatcatggcttactacagcctcagcttcccaaacgatccttctaatctcagcctsctgagtagctgggaccacaggaatgtgccatcttgcttgtctaactaaaaaaaaattttttattttagacatggagtctcactattttgcccaggctggtgtcaaactcctgggcccaaggaatttacttgttttggcctcctaaatccycttggattataggtatgagccactgtgcccagwctaagtagaattttaaaaatctccttttctaaagaaaattgmatttgttgatagtaaagttttaaaattgggamgttatattgaaatgtrtctggtgcaaccagtggagtttaaattatttttgaccaaaatggattctgaagaaatggtatggatagaaaacaaagaatgtaagttttatcttgaataaaaactagttttcagggtggggtgagtggaactgagggtagaaaagggtgagaaagcaaatataataattgtctcatctctataacatttaaagatttgattaagtgaaacaaagccccagctgctggagcagaggttccactygggttccacagacacccacagcccaaatccctggaggtcagtggggctcacagtgagtgtggggatgcttctaatagtgggtgtgctcagctgggagtgggtttggtttggtttggtttggttcaaaggcagcagaagtctgcatcttagctgtcttaatgtgaatgtgggrtcttgtgacagggtctcttctgtatcctgggggtggatctgcactctgcctgatggcytagctactttgccagaccctgcctgcttggtcttcaccaggttgctcctgctgtgtatgattacagccttgrcatgggactgcatttcccttgtttaatgttggtgctgggaagccctcttgcaaccactcctttaatatcctcctttctcctgggagaagctggagagagctacaggtcmtgaggtcctcctctgggagaagggagatggagagaaacaccagatacacctccatctcctgcagctgttttgagtttgatttcttattctatttgaaggaaattttttagaataacagatacatgtataataaacacattttcgaacgtaaagagggaaagtagsaatgggatggaagtgagaccactgaaattcactggctccatgtgggagctcagggccatagtgtcatcatctacaaatggcactgaagtttctcctgccattgatacaagtttgcagcagatgttatttctgcatcatttgcattttcagttatgatacttcacctctttctcagtatcacacacaattcagtgttgactatgatattctgaaaagcacacaggccgggcatggtggctcatgtctgtaatcccaatgcttttggaaggagaagcaggtggaycctcggtgccaggagtttgacaccagcctgggcaacaaagggagacctcagttcttttttttttgaggtggagtcttgctctgtcacccaggctggagtgcaatggtgcaatctcatctcactgcaacctccgcctcccgggttcaagccattctcctgcctcagcctcctaagtagctgggattacaggcacgcaccaccaccccctgctaatttttttaatttttttgtatttttagtagagacggggtttcaccatgttggttaggctggtctggaactcctgacctcgtgatgcgcctgcctcggcctcccaaagtgctgggattataggcrtgagccactgcgcctggccgagaccccatttctataaaaatttttaaaaattagccaggcatggtggtgcgttcctgtggtytcagctacttgggaggctgagrtgggaggatagcttgagcctgggaggttaaggctgctgtgagccatgatggctgcagtgagtcatgatggtgccagtgcactccagcctgaatgacagagtgagactctgtctcaaaaaaaaaaaaaaaaaaagcaagcaagcaagcacacagatgagtttagtagatggacattaaaggagttttaaccaactcttttatttcttctctctcttaaaaaactatatgttgctgacaagaaattatatttcttctgtcatgtagaatttttattttgctccataaatgtaatgacattgggatatcatggatctgttttctgtacacctacttatcacttaaataacttttgaatcatttttcaacttgtttctattatatccatcaagttatatgtggacagatgatttggtaacaaccaatgctggcacagaatgagtgctgtgcacaggtcatccattgaagtctgtctcctgtcatgtctttgtctctcaaaaggaaactgttttggaactcagtcatgtttagaattctcagtctcagtttaagcataagcctctcctatggatgtggctgaattttactctagatactatcccattcaattagccagtttaaaacaggccagtttattcaaagctaaaattacagctgcataaagaggtagtttggactctctatgtcaggaattgggttgttttttgtggtattcattgctatgttcaaataaatgaacctgaaaggtgtgactttttcatcactgcagatgcctcagtaatagggatatttaactggtagcacccagaataacagatgttcttctacactgagtttcttggctgtttaaaaagctactttataatacctctggtttacttgtttagaatctattttaataatattttgcattgtaagatgcttctggtctctgctctttttttcaggcctaaggcaatagctaattgagactatgcatcactattaaggcatcttcactaaagggcgctgtggaaacgctgcctgagatgcagacacctgtcagaagggggctaaatttcaaacaaggaacgtggtgttgcatcacaataaagtaagtgtccagagggaacttctgcagtactgtgttttccaacgtgctgagtgatattgtaggagactattattttgctggaatttctatgaatacatctatgaatacatttaaaataaaaagtgttttttgtttttttttttgagatggagtttcactcttattgcccaggctggagtgcaatggcgctcccttggctcacacaacctctgcctcctcggttcatgctattctcctacctcagcctcccgagtagctgggattacaggcatgagccaccacgcccagaaaattttttgtacttttagtagagacggggtttctccatgttggtcaggctggtctcgaactcctgacttcaggtgatctgcccaccttggcctcccaaagtgctgggattacaggtgtgagctactgtgcccagccaaaatgtgtttttttaatatttaattttgtggccaggagtctcwcgcctgttatcccagcactttgggaggccgaggcgagtggatcacgaggtcaagagatcgagaccatcctggccaacatggtgaaaacctgtctctactaataatagaaaaattagctgggcatggtggcatgtgcctgtagtctcagctacttgggaggctgaggcaggagaatcrcttgaacctgagaggcggaggtggcagtgagctgagattgcgccactgcactccagcctgaagacagagcaagactacgcctccaaaaaaataaaaaaaagaaagaaaaaattgttttggtacatagtaggtgtatatatttatgggatatgtgagatattatgatacagaaatgcaatgtgaaataagcacttcatggagaatggggtatccatcccctcaagcgtttatccattgagttacaaacaatcaaattacactctttaagttattttaacatataccattaagttattactgactatagttaccctgttgtgctatcaaatagttggtcttattcattctttctaattattttcttggtagtcaaaataaaatgtttatttttatgacttctttttttttttttttttttttttgagatggagtctcgctctgttgcccaggctggaatgcagtggcgtgatctcggctcactgcaacctctgcctcccgggttcacaccattctcctgcctcagcctcccgagtagctggggctacaggcgccaccgctaccacgcccggctaattttttgtatttttagtagatacggggtttcacygtgttagccaggatggtctcsatctcctgacttcatgattcacatgcctcggcctcccaaagtgctgggattacaggtgagagtcactgcacccggcctccatataccagtgatagcagtgtttyatttacagtaattataggttttttttttttttgagacagagtttcactcttgttgcccaggctggagtgcaatggtgtgatctcagctcactgcaacctcygcctcctgggtttaagcgattctcctgcctcagcctcccaagtagctgggattacagaggtgcctgccaccatgcctggctaattttttgtatttttagtagggacggggtttcgcgatgttggccagcctggtctcgaactcctgacctcaagtawtctgcccgcctctgcctcccaaagtgctgggattacaggcgtgaaccaccacgcgcggcctcaaactcatatttgaaatttagagagattgccaagaccctagagttttgcatgttctcacaaattgatttcgttagttcaaatttcataccactttttctaactgatgattcttacaccttgacaggtgactgagttcaatatgattagagctgaaccatttcaaaaagcagcacaagtggcgactgccagtaaccgataataaccgagtttaatccccctcttctgctccttccctctgatggaattctcattttccctggcctcccccattgacattcatccaatgcccatgctgctggatcagtcttcctggagccatatctaacttagaaagatgaaggacttccaaccttttgggagatgacaatgtgttatcaaaatcaacaaactaatagattgacttcctttgcatatttttgcaatgttctgtgagatatcaagtcacttccctggtagtttcttattcagtatttcactgtactgctttaaaaaaaaaaaaaagtcaggcctcaaccctaacagagtcacttggagatcttgttaaaaagttgagtttagagtctgatacaggttttgagatggccctgagaacttaggttttttcataggctctctgggcaacttttatggggcagaggtttagaaagctaggagtaagctgccaggtatcaggaaaccactagatggcagggccatcccttggagccygttcttcaatcaagaaagtggtcagagaggaaagtggagtggggaagagtccaagtacacatgttaaatgcacgttaataagtggatggtgaagatgagcttaggtgttgggtcctagcgggagagtgggaaggattcctgtcacttctcacctctttctagctttatctccagtatttgaaatgcctggaggatccttaactgaaactctccactagtcaactgtgctgyactatagcacaaccactttaaaaaggtgaaagtaggaaaactagctcaatgagagggctaatatttttatggggccaatgatttgaattggtagacatatatgccytcctacatgatataggagatagagtgcaaaaatcaaaccaaagtgttttttcctaccctcactcaccacacactactcctcacatgccvagcaagcaagcaagcaatttttctgcagattctgcagtgcacaccagctgggtgtcctctaattcaactcaaytcttacactagctatctagagatactgtcagatcccacaggttaagggctcagtcccacaakactgtcccccacttcagaggccwgttataagactgaattgccagaacttctgatccactggctacaaattggggctcccaagaccctgcccaggggttcaattaatttgttacagtggctcacagagctcagggcaakactttacttacatttactggtttattagttagagatataataaaggatgcagatgaacagccagatggaaagatactcagggagctatctggaatggtcccagcactggagctcctgtccctgtggagttagggtgcacacactcccagcatgtggatgtatttgcaaacctggaacctctctgaaccctgtccttttggttttatagaagctttaatttgtaggcatgattgattacatcactggccgttagtgatcractccattttcagccctcctccctatctgctggttatggggtggagctgaaaatcctaactttccaatccagccttggtttttactgtgacccactcctaacctgaagctatccaggggccctcagctaccagtcacctcattaacatataaaggattatatgctaattatatagtatatattattatgttatataataatataatatatatatctataattacatgctatattatatatgctatctagtaatatagttagcatacactcctttatatgctaatatataattatgctatataattagcgtatacactctaaacactccttagattccaaggattttaggagctttatgccaggaaaagataaggaagaccaaatgtatatttcacaaaaatcacaccttctaagtgtatgacactttctaagaaattagcagacattacaaatcagatataaaacagatattaccatcccatgaggcttttttttgaaatgtgcatttccccctaaaaccaggaagtggcataatggagatgagagctcagatctcttgcttttctccttagtggtcactgaggtcactaagtgtcttggtgtgccactaacatttagataaagacaggtgtgtaagaccaaaactgtatctttctctttttaagccacttgaattatttttgatgtctgaatttttcaaaattccaacctaatttgtgctgtcttcaaaacagtcttattattggaactatcactgtgaatgaacattacactctaacagtggtatgttatatgaaatggtaccatttagtccttaaaattgattggaaaacagtgattggggarcatttaaatatattttaaaagtgagagaagtaacaattaatgctatactttttttaataaggagagtatattttcattgtaagtatctattaatgattgaaatgttcagaggaactactgaattcatcatctgtgtttagatgaagcaaagacgaaacccccttaacagttactcagttttttgattacccttgctggcgacttgaggaaagagtggataaaaactgccactgccagctgggtgcggtggctcactcctgtaatcccagcattttgggaggccaaggcgggcggatcatgaggtcaggagttcgaggccagcctggccaatatggcaaaaccctgtctcyactaaaaatacaaaaattagctgggcatggtggcaggcgcctgtaatcctagctatttgggaggttgagttaggagaatcgcttgaacccgggaggcggaggttgtagtgagctgagattgtgccattgcaaacaaaacaaaacaaaacaaaacctgccactgccaatctggagttggagttatcaaaactgatgatatctggaagagggcagaagatgttaccatctgcaagtttaggatgctgaagaagtggcaagaaaaggatcagagccttgccacagcccagaatttatgtaagtgcttgaaagacatcatctctcttgaagtccaagatgtgttggaaggtgagcagaaaattatatcttagttatttgtctggaatcaagctgtgtctttgggaatagytatagaacatgtggcttggttatttataagcttgggttcagagagttatgcaaatgcaaaagcargcaaggggctgctgtcctcttagtaaggatggtgtgtgcagctgagtcagaggaagggttggaagcccagccccagtgctgccctagctttgggactgtaagtaaaatctcaacctaacttgaagcctctctgttcccatctgtgaaatgggttcagaccctcctatgtcctgggctgtggtgagaatgaaaggagaccatgcatgtcaagatccaggcaggtggtctggctcagtaagggagcagtcatgtcaccctggtacttaaggcagggctggtagcattgagccttctgggccttctgtggcactgaagcaggggtcatgggggccactgggtggcgccagcaatattcaaccagcaaagagggcaagggagaaagcagagcccagggagggctggaggggatcgttcctggtgttgatccagaaaaccacagggttccttgtcttggttttcaagcacttctaattttgtatgtgtgtggatggatgtagcacattgtcataactgagctcaaatcaattcaagactttgattattatatgttgttactacaacgaatatagtgttttttttttctaagaatcctcagtaattcagagagaggttttatttaaaattctatttagatttttttattcctggccgggcgcggtggctcatgcctgtaatcccagcactttggaaggccgaggcaggcagaccacgaggtcaggagatcaagaccatcctggccaacatggtgaaaccccgtctctactaaaagtacaaaaattarctgggcatggtggcatgtgcctgtmaccccagctactcaggaggctgaggcaggagaatcgcttgamccagggagtcagaagttgcagtgagccgatatcacgccaccacactccagcctgatgacagagcgaggctccgtctcaaaaaaaataagtacataaacaccccagaaggttatatcagaagtcaaagtactatgatctctctgcatgcttttcagacatggtgagcgagcgttctgaacccycgggcccactttgcctggaggaccactgaggttttctactctctagtcttggggtgctgaagcctcaagagattagaaacaaatgcaattctctcccacctagcaatttgggatgcaagctcaaaggtgagctcctcatcccctggagaagtacaactggccamacactacttttcttggactttcacrgtggaattatttacttttcatggggaagaatgctactcagagatagctttcacagaaccaagggaaagmtgtcttcttttcttgaaaaagacttgcctcaggaaataatgggcctcattggctsctgctaattggtgaaatgtttttkttttttttttttggtctgtgtagatattgtcactacttcagcatcatgagtgtggtgggtgattaatattctggatatattttacattatttgatccataaattcataaatcatggatgatgagaagaaaaggaagtctgctttttgacactgctcttctttgtattatttacttacaggtcctgttttaaagcatcctattccttggytgtctttcctttggctctttggcaatagttggttttgatcccagctctttggctcctgggccaaggctgagtgagtgccagacagggtaaactagttcaccaggtgttcacacaggttcaggacaacctgcattgtccccacagcccttttgccacaggaataattatggttttctcccttccaaggatgggaaggtgtgtttttatttaaaaccaggcagattcctaatacttcctcatttgtgcatttctcttgacaagggatttttctgcacataatgactctcatttggtccttttgctgtattcctttcggggaaaagtttcctcccgctgctttttcatgagaaagcacgcttcactccattctctaaagagaacacagcagttgctgaatttttaatttgttcccatgagaatcgtggtttccagcagtcagcctaggccactacccgttttctggaagtccttcttagggtgaaccagcacactgcttgctgaagagcttgatcccagggattcactgctggaatcatgtgtttttggttgacaggtgttctcagcctccctgtctatatgtcaggatttgagaagtcctgatcctggctctgcagccgctgatgctaacacggaggccctggggttaaattctaggckctgagttttgagatttctcctgcttcttaagtgagacctccatttccaccctggagcccactgtagatttagacctaatttgttctggtcctgatgtaagtcctcagttaggaagtctagagttagtcagccacctttattctttgcaatcccattcttgctgttttctgtaacctctagcacaagtttccttttcagaagggaagacgctctatgcatttatagcagtgttttcttttcgagcaagcctggaaatcaacaggtggttccattataaaaacaactggagagaggggcttagagtaattcagcaagttttcatttttccttacccacgaaaaccttttgtgaaaggaaatcttacctggaacacgcactggtaaaatattcaaaagtggagctgctgtggtggggtcattgaggggagagggatttcgagggcttaccgaggagccctgcagggcctctgacttgctcctggyagggtagcttggaaaccagcagatcaggtcattatttggatttcttgaagctgtggtgcaggaatgtgtttctaagacatctgcaacctaatgggaagtaaaacactttcccacccctaggtgtggaatatttattggcacgttgtttctgaagcatagacatatactcagaccacaggtatttaaattatgttaactaaatcaaaacgtttatgaatttggatttttccccattatgaacatgtataattattttgaactaagtaagcatatgcattttcaattttttaactctttatttttataattgtgaataagtttctttcaaagactagagacttattttttaaattttatttttatttatgtattttttgagacggagtcttgctctgtcacccaggctggagtgcagtggcacgatctcagctcactgcaacctctgcctcctgggttcaagcaattccctgcctcagcctgctgagtagctgggactacaggcgcacaccaccacacctggctaatttttgtagttttagtagagacagggtttcaccatgttggccaggctggtctcgaactcctgacctcaggtggtccgcccacctcggccccccaaagtgctgggattacaggcatgagccaccacacctggctgagacttctttatttctatctagattaggaaaagacatgagaattgtgggggctcatgaagattccctttgtttctgtatcatttttaagttcctggggctgggaacacaaatacgtgggtaatactacattgcctatatctgaggttcccacagtttagcaagagagagaagggagatacataaataattgggatgatatttatatggttatagggaaagcattcccttgacttagacagtgacttcaacatgagcatagctgctggcacaggctgagaccaggccacttaaaatgttaattatgtgagcttacataatcttattatttattatttttattttttgtagagatggggattttgccatgttgcccaggctggtcttgaactcctgggctcaagcaatccttcatctcggccttccaaaatgctgggattacaggcatgagtcaccgcacctggtcaacttcaataattttcttcactttccacatccataaaaagggttattaggatggttatgtttatttgtggtaaactcttaggaacatgcctggcatttaggaagcacaaytgagcagttgctactactttttttttgtctaaaacagattccattaatatactgtttttgatattacatagatctaattcatactcatatttttaatgtaaaattgaaagatacataaatataactaaagtttttgtgcctgttctcaccacatatatttcaaaacatttatacgcatcctatttcacttttttaaataaaatatttcaagtacatagaattcaatttttggacaatgcggccatatttttttcttacttatcatattgtaatgcagtttgctttaaactaggaagccaaattatgctagccagaaccaaaagtattttttaatttttaatttttttttttagatggaatctcgctctgttgccaggctggagtgcagtggtgcgatatcggctcactgcaacctccgcctcctgggttcaagcaattctcctgcctcrgcctcctgagtagctgggactacaggcacacaccaccatgcccaactaatttttgtatttttagtagagacagggtttcactatgttggccaggatagtcttgatctcttgaccttgtgatccgcccgctttggcctcccaaagtgctaggattacaggtgtgagccaccgcrcccggcccaaaatgtttagtcctcaaataaggataataactgaatggcccagtgtgacacagagaagaggacttatgatggctgtgggtgctggcccccaacaaagctggtgttcttttctttttgtctgtagtttcttatcctcctttgggtgtctaagggtcttttacayctcttgagtttttcaatactyacctttggatgtctggccagaccatgtcctagaactgttctgtcttcccaaagtcctggacctttaatggggcagckgacaactaaatatttttcatgttaattctctgatttagtcattcttaggtgtgagatacactttcaaggtttagtttcttttgaataaagtagtttgttaatcaaacgaatctccaattgactggggggtatttttagggggatggtccttggttttgataagttactttgctcctggcctggctcagtggctcatgcctgcaatcccagcactttgagaggccgaggtgggtggatcacctgaggctaggagtttgagaccagcttagccagcatggtgaaaccctgtctctaaaaatacaaaaattatctaggtatggtggtggacacgtgtaatcccagctactcaggaggcggaggcaggagaatcgcttgaacctggagggtggaggttgcagtgagccgaatcgcgccactgcactctagcttgggtgacaagtgaaactccgtctcaaaaaaaaaaaaaagttactttgctctccaccctttgttcttggaaggcagagaccctgccttttgccctcatacttcacaccaggcagccgcttgtgccgaccacacttaatatgctgagtgccatgggggacagcacatcagcgggtgttckgatgtcttgtgagaactgtgacaaatttatgttgagtaataactaggtgytggcastgtattgtgtcatttaatcttcacaataacacagttaattaggtcccaccgttttctgaatttcatcaatgaggaaatagcagcaaagaggaggtaamaaattyggtgcaggtgcttagcccaaagactaataatacatttcaaaatgtgcttacatttattgtgcacttactatgtgccaggtgcaacgctagccctttgcacgagttgttccattttaccctttctctgatcctttkaggtagattctagtattaccttcctttttcagaagaggagaccaatggggagcattggaatgatttggttgcaagcatactacacwacttgtaaactgcagrcacaggcttaaaaaaagtgaaaaactaaccatgcaataaagaatggaatgaaccatgaagctgtttctgtggccagtcatgtttttgaagcatatcccatgctaatttctagaacagaagaaacacacgtgttcttgtgtgtaaacccagtccatggaagagaccgtctgcttgtccctcctgatctctgggcccagacaaccagtagtcaccattccaagtgaggggtggctgcaactctacagccccgttcgtctctcctcactgtcaaagctgctgagaccccagactcracacttgaaagaaacccatgtctgtgaagcacttgtggaccattcaagattgtggaagaatcactcaagagaaggagataggtgatgggatctagcttctgatggtttctattttattgaatgtctaatagggcaagaatttgaaaaacgagaatgtttgycatgcaggaggacctgggaaggagataacacatttacagggagaaagattgggattcagttgggaggagtaactgaggaaaggggtcactcaaaatattttgtattttaggtcctttttctattaaggaggaatggattrtcaaagccttaacattaaattgtaytgtgtcaggtgaattgctatggtttgaatgtggtgtgtccccctcccaaactcacattgaatttttttttttttttttgagacggagtctcgctctgttgcccaggctggagtgcagtggtgcgatctyggctcactacaagctctgcctcccgggttcaagagattctcctgcctcagcctcccgagtagctgggattacagatgttcgtcaccacacctggctaatttttgtatttttaatagagatggggtttcactatgttggctaggctggtctcaaactcccgacatcaggtgatccacccacctcggcctcccaaagtgctgggattagaggagtgagccactgcacccmgcctcacgttgaggtttaattgccattgtaacagtataaagatgtgggacctttacgaggtgattaggcaatgaggactctgccctcatgaatggattaatgctgttatcatgggagtggattccttataaagggacacgttcagcacccccttgctctctctctcaccttccgccatatgatgatggggcacaaaggccatcatcagatgttggccccttgttctygaacttcccaacctccagagcagtaaaaaaataaatcactgttctttacaaatggcccagtctcagatattctgttacagcagtacaaaatgaactaagtcatgaaacctaagatttacatgatttacagcagtggtccgcaaccttttgggcagcaggggctggttttgtggaagacaatttttccacagacccggggggcrgggggcaaagatagtttcgggatgaaactgttccacctcrtattatcaggcrttacttagattcttataaggagcatgcagcctagatcccttgcatgtgtagttcacaatagggttcacactcctatgagaatctaatgctgccactgatctgacaggaggcggagctcaggtggtaatacttgctcacckgccactcacctactgctgtggggcccactgcccaacaggccacagaccagtaccacwccatggcctggggatcggggactcctggtttagagaattaaaaagatggaatttaacatttagctcattaagagcacatctcttaagccaaagtaaggcaattatccatgtggttcaggcaaaagttctatacagttttaaacaaatggagagattttctggttgcaaattagagacaacttttctctcagagcccaaagggtcacaaaaattagaataattaggctagaaggcctcttagtgacattttttttctggttgaagaatactatgaagtatttttctaatgcacagcatacttttagtcttatgttgaacaaaaataataaaccctcaaaaaccatgactcacttggctgccttagtagtaaagcatatcttgtcttactagggtccctttaaaatgagatgaaagggactaggaaaggaataagaatattgtggcattctttccagagtaattttgttgaagtctcatcagagttttcaattttcccacaatgtrtattttaacacttaaaagtacattagaaaaattgcagaatcactttaattcaatacttttatttttagaacacttaaaaatatttttcaaatacacttgataaataatttaataaatataacataaataaatataagttagctcagatgctttcatgattaccaagttatataaataaatattttaaaataagttatgcttacatgtttgtttccacaaacactttggtacagaaatagcttataaatatttgcccttctattaaagtgaatgaaaaacaccttcaggatggatattttcccttcttagcaattcattcatgaaaacttaaaaacaatttatccacagtaaatgtcaaaaatacttgatcagaggtatyatgtggatgtaatrgtcccatccttctttycccctccctagttcttaatccacatcctatcaaagtttcctcatttcaaagttttataaaaatgacaacggtttggagggacctcgctttttaggaagcattcagatagctcrtcactctrtcaatagtcactgcccgaattctgaaagcatgaagaagtatgcagagcttgattttagttttataaaaatccggttcttcaagggaggatttttgtggcayagtctcactgttgaaattcagggcctaggagaatgaacagtaagcatgacttacatggtattccaaaattcaaatattcattcataaaaatgagtgaagccagtacatgtctcagagcctgcaactcrgtcccttatgccactcctaaacccaatccaaatctactctcagccagatcaccaggcagaatgagaaaagaaatactcattttccaagcacatscatcttcaatgagctctgaaaagacccttaaaactatttagaaaaaatcatcagtgggagttgtgtcttagaaagaaacagttcctttaaaatgacatctgctgcaatatctaattaattttatatatgttacattaaaaagcccacttctgtttagcacagggaggtgatggattgctattgatcagaactcactatcagtaacaggcctgtttactgaagacatgccatttgtgtcagataaacctggcaatgaatttcccaagtttagcactttgatttgataacagaatataaaaccttacatttgcacccytgatgaataaatactttcatatcttcctcacaaaaagtctaaaagaaagctagaataaagtcaccccattttatactggaggaaactgaggcacagagggkttaagtgacttgggaatagttgtctggttactggtagaattgattctagcacccaaatcacccaactcttggtcctaaaaatgaaatagcaactacagctctctagatgctaacattctttgatacttggatgaagctcattgcctttcaaacaagaaatctggcacatgcacacacacacacacacacacacacacacacamacamacacacgaaaagaataaaagtaaaacaattacttttcagacaatgatttctgccaccatatttttatcccatgtcctcgtcaccaaagcagtcaccctcrcttatataaatatttgttttatattagcatctgtgttatggtrattcagaacataacaaagcaagytcttgcctatgaataacattatagatgccccagatgataggtcattcttttatttggttcacattttggttcacaatgggtcataatcaggcaccaatcttgcttgtttcccagcaatatttgcagatatgcaaactggccccttgcakgcamatcctggagcacgtcctggagcctttagaggtgagtgagaaggtaagtgtagtgaaatcctcttgaaggattttaagaggcagagcctcagacaagtggtttaactctcctaaggtttggttccctcctttgtgcagatcccatatggttgytttgaggctgacataagaaaatgcacaaaaacatttgccgagtgtgggggataccacagagtgaatactttggagtctgcttttcataatgtgatctgctcacatttgtgctccctatagacggcaccctcaaggctgtcttcttgaaaatgtaggtctgtcaggcctttaaaaggcctccagacctctttttrtatctctttatcaaagaccctggctggttatctttagcatgaaaaaggtgctctcactgatagaatgaagtcttacctgcatcagctcatcaataactgccagcatgttttgatcyagaaagatctgcctcttaggatccatcagaagctttgcattcatggtcttgaactccacctggtacatcttcaagtcttcataaatactactaaggcacagggcctgggtgacatgacaagatggggaagtatccattgagatgggctaaaaacatttcccccattgcatttgaggaaagagctgtgtgtcttaccatcataaaagaggtctttctggaggccaggcaactcccattctagaggaaaaaataatcagacatcastgatatgaattcatcatacaggctgaaacttttcattttttgacttacagttatgaaagaggtctctctggaatttaggcaactctcattctagagggaaaaaatcatatatcaaagtattaattcttagtataaatctttctgactcttcaggtctcaaattttttttattatggtaaaaacacatatcataatatttagcatctgaactatttttaagtgttaagtgtattcacattgttgcaaawaaaaccattttttaaaaataatttttctcccaaatctaacttctgaagtaggaccagttaaaatcccataatgatggataccagaaaygtgaatttytagaagcaggtgagatttgatgcacagtttttaaccacactgcatgctctgggaggaaaatcctttataccttggttaattccaatggtaaacaggcctccactgtgctggttttatcttttgtgatatcttcatgatcaatctcttcagaagtgcaagggtaaaattctagagtttgtctggcctataaaaaatgaaggagaaactcagtttataacattgataatgcacctggcaccccacaaggctggtaagccagggtgccaggaaggctccggctggctgcccttgacctctgtcactttgacttgcaggaaattctggttcttcataatacaaaagaaaatagattccttacattctgtctctcaccctcctctccctaagcttggggcatgtttctctggattacatattttttcattatgtaaacacaataaatcatgtcaacagcctgtgctaaccagcctcyacacctcactgtgacacttgcttctggtgaaaattgtttcttcttttgctaaagtgactgtattctatgaatacctatttcaagtataacttctaaagggggaactgttaaggtcacagtytgatggatataacaaacatgcaaacccttaagacaagctgagatttaatttgcagtgcacasacrcacacacatacacagagatgtcatcttagtgtgttggaaagcaccgttgggtaaaattatgaaatgtatcttaggaagtaaaggactgtatgattgaagattacgatcatttttccattcaacagcctaatgggtggcaggcactccattaggtactaagaacatgacagagaagaggaccatgtataccctcctggattgcaagtttagctgctgagacagacaaktgcccaaatgaccaggaggcatcagtaggtgagacatggtgagaagggcatgaagcttctgaggaggggcaggaagggaagcaaagcttcctagagwtgggacacccacattaagaggagtaaagtgtcgacaatggaggagggaaatttcagacagaggtaacagcatgagccaagaagcaaggcctgaaaattcagaatacgtttgggcacaagtagtaaaatccctttctgtggtagctagaccaattctccacctccaaagacatccayctcccaatccctggaacccggtaatgagctatgtgacctgccaaagaggaatgaaggtgcagatgacattcaatttgctaatcagctgatctaagagtagagagatgatcctggattatctgggtgaatccagtgtaagcagtgwcctcaaaagtagaagcrggtagaaggtcrgtccagagggagcagcatgagaaagactcaaccagacattgctggtatggacaatggaaggggccacaagtcaaggaatgtgggcagcctctagacctgacaaagcaaggcaacagattctccccaagagcctccagaaagggctacagctctgctgacacattgactttagcccagtaggacccattttggacttctgatgcccagagctgtaagataataaatttgtgtcatttaaacccactacatttgtgacagcagcagtaggaaatgaatacactattcccggaggtgtttaaacagacctgggcaaccccactattctgagcaggttataaagagttagatttggaggtgtgagtccagtgttgttcttcagatcttttcaagagaagctagaattttgaaatcttaattgaaatgtttggtttttgaatggcatcaaactaaaaaataaacatatagcccaaattctacaaacctgtgccctggatatggccggtgaatcacttgcatctacctcatttgttttctactacagcaaatttgacaaatgatgtacaaaacattaaattgatttctataatcttttgacccttaggactatatctgggagtaggggtgtcagcttttgcacaaaaaaatctatatgaattggrgcacctaaaagttacccattttgaacctttcttcgggaaacaaagcagttttcacttgagccccctgtccaattaagattaattgaattgtgaggagcaatgcacagcacattatgaaagattgaaaggggaaaggagccctttaagaaggcttggtggcattgagyttattttaagatattcctaaggcaacaagctagaaaatactcaagaaaaaattcctagagagcagaaaggcagaggacatcttttaaaacattagcctttagcctttgcagcagtagctactggagcagtttttaacggcaatgttttttacattaaaatatgaaacctaaaagaacgaagctgtaaataaaattaggtaactcttccctagaaaatgaaggctgcatgtgcactgtcatagtcctccctgagatgtgttgctccaagaaggaactgtgtcaccaagtagaagctggtgggcagcaggagggacaaggctatttcatctttgtacccctgccccccaacacagagtatgcacccaagtaactatttccgggattgatcagtggtgtggtgccagagaaaccatgtggacctgacacaattctatctctgttggcaggctacaggaacactgcaaatatccactttactcagtgtagacatagccaaaaccaacatcattataatttattactactcttgctttctctggagacacaatttcactaggactctttaacacttgggccatttgtaaagttccctctcctgctgttgacagctgctaatgaacttccacaatttctctgcagttccatcaggtaccagaggggaggatcagaggccccttcctcagggagggtgcaggtccacagtggagasgacaggaaaggctcaccttctggagcatgttgctgacggccctcagcaggttttgggagtggtgaaggcatgggaacattcctgggtctggagtggccacggggaggtttctggccaaactgaggtggtccaggaggaccagggtagccacaaggaggaggcctggaaggaagaggagcaggtggaggagcttcagcctggatggcctgcctgcaccaccttccctccattctggccaccttcacccatccattcatgcttggcacccacctccctcaacccatttccaacacttttccttcaacacctgagagatgactcgagttattacaaagcrccactctattctagggctagaagccagctccctgtgagggtctagagatgagcttggacaagggtgttgaacccaacactcacccagagaaagcctacatgtttttgatcagggaaacccagaccaggtggtgaagtggctgagtcagacttgggacccagtgttttaaaaacagtggagtgagaaagcctgactttttttgtttttttaagacggagtctcactctgtggcccagactggagtgcagtggcacgatttyggctcactgcaacctccacctccgagttcaagcaattttccctgccttagactccsgagtagatgggattacaggcacccaccaccacactcggctaatttgtgtatttgttastagagacggggtttcaccatgttggtcaggctggtcttgaactcctgacctcaggagatctgtccgccttggcctcccaaagtgctgggattacaggcgtgagccattgcacccggccaagcctgactttagaactggctaggatctgccttctgtttgtagctgagggaccctaggcaggaaagcaggaaatctcccacgctgggcctcagtttctcctctacgaagtgggcataatgatagctcatcaggctgtttcgagatgaaaagagacatgccctatttagcacacggtgagacccctattcttattcctctttgcaggagacggctgctgctgttccagtctctccttaggcagacttgagtttctacccactcttcccaagcagccgcccctccgcacccgagcgagccaaagacctggcgggctgagtactcactgcgcgctggacacatgctgagccggcactgcagggacacagggcgagccgctggatgcagacctgtggccgcggcaggtgagggcggtggctgggaggctgacccaggggrccacatttttataattgtcccgaggcgcggcaggactttcccgggactctggtctcttgctttctgtctccttctgtgtctctctctacatcagcttctcggtgacacgtgcggtgcggccggcccgcggggcttgcggcgctttcggattaactcccsgggtgcccggccgcagccgttccgggacggccccgccgcctccagctcggcccaaaatgaaagcgaaatgttcgcagttactgcgcggggtccacaggcgggcgggacaccccgcccaccaccctgggtccccggccttagccggacgccccgtgtctaagctaccccgccccgcagctgtgcagcgccccctgccgacgtagagagaggagtgcctcccactttgcatgtcctgcgtagggatgggccctaaccacgacctccagcctagtactggaaggggtaggcaaatcattcactcatcatcgttcctttagatggctcactagatgccaggccgacgttgcaccaggtgcaggacacccagggagaacaggacccttggggcattgccacactaaatcagactcmaggcgttttgttcacaggtcttttctgaaacctgaaaagggatgagagctggctgactctgcaattattactcttgtagagaatccagtttaacgataggatgaatacacagagtcctgggaggaaagacctagagaaagagcccacgctcagccggagcaacggggtccaggagtcagcaaaggctcccgggagcaggcaggggccccaacctgagtgttaaaaacaagcaggcattagaccgcttccagcgggagggcacgcagggtctagcmaggggaaacagggatcagaagcgcagtcatgaagggttgagggaggtgggggtctaggtgtccttgcagggtgtgaggctggagggctggatggggccatgccatgagggcaggggatgccatactaaggagtgtactttcygtgctgagagtagtggggagtcttcctgggttttaggcgggagatgtggcagaatttgcatgatggggggatcccttcagccacagcatgaaggatggatccaggggtcaggagtagagcagagggaagagttgacaaggtgtggccaagtccttattcagtatggagaacacagggtgggcaggagggactctsagagggcttgtgggccaaggcttggtagctcctcaggtgagcgggagaggaaggccctgagaatggggaatggagattgttctagctttacagggattactgtataagaggactgagtttggaggagatggtgagaagttccattttggatgtgctgggtttgaggttcctgtgggactttttagttcagttgtttttcccacaggcattagtcaccctaggcgtgggtagtggggaggatgtgtttgatctctgacttggagcttccaaagggcctgactacacccaggccctaggacctaataactggagctgccttctgggtggctcatctgctcgaagctgatgaagcacggctgtagggagttttaggtgtgtgtaaaataagagaaatggttgatctctaaggccccttctaatgctgctgtctgagaattcccccacgggatacagagtaatccattgtcagaaacaattgcgtttagcagtttgtctagagcaaatgacaggtgcagagctgtgttgtggccacaagggtttagtgtggagttaaatgtacttaaagtcaggatgaagacaagtgtatcacaactgagctgtttctcccctggaagggccatctcctatacaaaagtaatttctgttgcttagatgagcacagggccactgttaaaaatggattattggctaccagacacagtttctaatttacatttttgtgaaatagtttcctgaagtgctccatgtcctctagctaagatgaaatgaaaaccttcttctaggaatacatgatttttctataagtgacagtcttagctcacaatcactacttcacagtgtgtagcattgtcgtggaggtctcggccaatgctataaggaaagaaaaagaaatgagagctttaaacattggaaaagaaaaggtaaaactgtcactttttacagttgatatrcaaaaagaaaaaaaattaatagactattagaactaagaagagaatttaacaacatcatgcaatacacatatcaacttaaaaaaaatcagccgattttctttgtatctgcaacaatccatcagaaaatgtaataaaaacaagatgacatgcatagaagcagccaaactataaagtaactgactgtagatacagaggcagtataatggctaagagtatggactaaactatgttaatccaggttctgctacttacttgctgtgtgttcttaggtgagttatttatctctctgggctcagtttcctcatctgttaaatgatgataataaaagtacctacagtatagagttattatgattattacatgagcttggataactacagaatagtgtttggagaaaaattttaaagttcagtcaagaatatagtgtgatttaattaaataattctatacccttgggtggaaggtttctctatatagaaagcttaagcctcttttcgttaattcacatgctcaatgtaattccaatacaagctacaaataaattttctcagaaacttaataataagcctactctaaaatacagatgtaataaaatctatgactaagttaaaaaaattttttttgagacatggttttactgtatcacccaggctggagtgtagtggtggcacagtcacagctcactgcagccttgacctcctgggctaaagtgatcctcccacttcagcctcctgagtagcttggaccacaggcaacaccatcatgtccagctaatttttatttttgtattttgtagagacggagtctagttttgttgcctaggctggtctcaaactcctgggctcaagtgatccacccaccttggcctcccaaagtgctgggattacaggcgtgagctgctgttcctggccttaagtaaaaatgctaagggaataatgaaaagggggactaaccctatcacatatggacataatttaaagccatagaaattaaagtagtgatctttgcaacagatcaggcatatggaccattgaaacagagtagagaaattatagatagatttgtatatttgggtattaagtataagataatacagatgattccctgatcaatgaggaaaacatgcaatatttagtagaaaatactcaatgggctgggcataatggctcacacctgtaatcccagcactttgggaggtcaaggcaggagaattgcttgaggtcagtagttcaaggccagtctgagcaaaaactccctacaaaaaatttttttaaaaagagaaaatgttcagcgtatgatgaaaaataaaactggactccaatctaaaacaacagaggtgaatccatttggaagtgaattaaagaccaaatgtgaaaagtaaaattgttacagtagtagaagaaaatatagaggactgtctttgtcacttataagtgggaaggacttttttaaaacttctaaagctccaaaccataaggcaaaatacctatcaattggattacataaaaatgaagatttctgttttacacatttcctctatgcatgaaccaaatgaacagacagctgacagattgagagaagatatttttcagtgtctaaaaccaatattttcaatgtctaaaaacaaggaactcttgtaagtcagcaagaaaaagacagaaacactagtaaaaaatgcgtaaagctcatgaataagcaatttaacgagaagaaaccccaaagactaatgagcatacctggaggctcagttatatcagaaaatgcaaatgaaaaaaagaatgagatatctctttacacctcttagactgacaagttgagaacactggatactggtaagtgttgggaaaatgggggactacaggatctattatatcacaccatgccagtaggctgacatggctgttttgaagggtattctggcattccttgaccagattaagtatattcacacccatgacccagctgttaaccctgggtgtatatcctatggagattctcatacaggtccacaaaggaacatgtatgaggatgttcattaagtcattgtttgtagtgatggggaactggaggcaatgtagctgctcattactgggggagtgggtgagtggaatgtagggatccacttcatggagtattctacggcagttagaagtaatagactagatgtacatgcagtaacatggatatgtattaaaaatataatactgagtaaaaacaggaaaacagagtaagatctctctctataatgtataagtagacaattaaaaccctttggggctgggcacagtggctcatgcctgtaatccaagcactttgggaagccaaggaaagtggattgcttgaacccaggagtttgagaccagcctgggcaacatagggattccccatctccayaaaaaatacaaaaattagtcaggcatggtggcacrtgcctgtactcccacctaccaagtaggctgaggtgggaggatcacctgagcccggaaggtcaaggctatagtgagccatgattgtgtcactgtactctaacctgggcaacagagtgagaccctgtctcacttaaaagaaaagaaaaaggaaagaaagaaaaagaaaaaaatgggggggctcagatttgtttttggaattcaaaatgcttggaatttagaaaaggaagaggtggcatcgcataatcaagcataatagttccgcagcaaaacataggaatagttacattgagtggctaaagaaccccaagtaaccccttgtcgcttcagtcagatttcgctgttaagaatttaagagaaaacttctggtgtccagagctgtgtaagtttaagaattgygagtaagtgattgcggaactctattgacttaaatgagaatgatatattcaaaatagtacacattatacaaagacacagacaaaaggrtatatattagtaggatagatcccactggggagtgaggggaatgagaatgaggactagtgataatgaaaatatataaatacatttagatatttgtatttgatggggacaaataacgtcatggattaaagaatatggtccactccatcctcttcatcagaagtcctttgtccaaaagacagatagacaccttctgtaagcagatgactcaaggtcattgtttgcaaacttcaattgctatttggtacattcaggtagttttttgttttgttttgttttgttttcgagacggagtctcactctgtcgcccaggctggagtgcagtggctcaatcttggctcactgcaagctttgcctcccaggttcatgccattctcctgcctcagcctcccgagcagctgggactacaggcggctgccaccacacctggctaattttcttgtatttttagtagagacagggtttcaccgtgttacccaggttggtctttatctcctgacctcgtgatctgcctgccttggcctcccaaagtgctgggaattcaggtagcttttattgttagttattcctttcccattyggtttgagctatgagtcaatcaggcattttcatcactgagagacaagggtcttttcaaaaatttgacagaatatattaaagatctatttctgtggttctcagttggagatggccttgctccccaggggacacttggcaatgtgtggagacattttgagttgtcataattggaggaagggggttgccactggcatctagtgggtagaagaatgttgctaaatgctgctgaacattctacggtacacaggatagcccctcacccgcccatccgcccccccagacaaataattttgtgattcaaagtatcagtagtgctggaagagaaaccctggctgatttgagtagatagctcgatatgcctgtcttcattgttattctccctgacaagtagacaaggtcagagtcataggamctgaacagaagatttggaactatatctttggtgccataatttarggtggcagctcatcctcagatgaagtgagatcccaaagaggcttgtgatcagttgagaccgtaaatttgcatgtgtaggtcagcactgtaaacgtgattttccttcataaaatagcaaggtctctgctgtcagttttcctgtggctcttgtccataaatgtcattcaacttgagcataaatcagctggtgcccacatggcatcaatctggattccaatcctgagcttcaatcctgaaaggtggcctgtcagggtaagaagcagagctctgtgttccttgttgaacaccaacccccagtgttacatgctgaggagcttggttctgtggagctctttcttctttgctgacatatctgagcagcagggggagaaatagtaagtgagcggagccagaaaggctatagcactaaaggaactttgggcctacgatcaaaagacctaatttctagcytctttctgctacttggtacctatgtaagctggggcaagccactgcctttcctaattttcatatcagcaaaatggagatggtaatcttttgttgtgctagttttgtcacgcagatcaattatacagtgaacaggtaagaattttgtaaagtggtagaatgtcaacaatattagatatcattctacagtgagtgatagtgaaatatagttaytaattttagattaagacacacatacagtttcttccaaaactatttctttgctctctttgaaacattaagtggcaacttctcaatagcggtggaggggagtcctaaatattcatgacacagtgtctgtagggaacatccatgagccatctatcctgtttttgagagacttcaaaaatcttgacaacgggcttcaagaaaaaaaatccagaaaggwgtcatttattacttattggtgctccagaataaagattgtatgaatacttttgcaaacttttctgcatcttgagacagtttagcaacttatctgaatatgatacaacacctgggcattgtagtctcatgaataattaagatcatctgatgcccagacattataaagaaaaaaaggataaatttgactgtaaaaatcaaatattttgattcgttgtctataggaattttgagttgtctataggaatattatagacaacttttaaagagaaatcataacccagaaaaaacatttacatgaacatgtaacaaaccaagagctaatgtcactrtgtaaatgcaaaagtcaataagaaaaaggccaataattcaattcaaaactgggmaaaggatatgaacagacagctcagagaaaaagatacacaaattacttataaacatatgaaaaatactcagctgcactgataattgaataaatgcaaataaaaataatagatataatttttatcctgtagtttgcaaagctaaaagtytgatagtttgtaaagtgtgtaagggtatgtggaaatgtgtaatctagtgaaatctatttggagggatagttggcaatagctatcaaaatgaaaaatgcacatacacttgttcagcaattctacttctagtaatttatcctataaaactatttgcatgtatgcataaagacttatttccattaaaaatatcatttttagtatcaaaaaacttgaaatgcttccaatgtcttattagcaggaaaccatttaaataaaacatgactcatcttttcaagggactattatgcaactatcmaaaagattgaggcagatttatatatatgacaggaaaaatcttcattacttgaaaagtcgtgcaaaatcaaggttcagactagtgtataatatgcttccatttgtacagagaaaaaagtatattcatgtacaracacacatagatacacgtgtagtatagatataaatctatgcttctaagagtagtgaccattgcctctaaagaagtagaytgagtctttgaagtaggaggaaaacctgacttttattgaatatgctctgtactttttgaattatttaacatacaaatgtattatagcttcatttatttttgttttgtttttatttgtattttaactgctaagacagctgctgtagccattctgacagcttttgagcagagaatttcctctatgtagcagcattcttgcaggatttaccatatgaacatcaaacattgagtatgtaagtggattaactctctaccctcaagtcaggggctttgtgtctgactctatctatccatccatcttttcatccatccatctatccatccatctatccacccatctatccatccatccatccatccatccacccacccacccatttgtcttctcactgttttgtaagtattctgcatgtgtactatgcacatttaaatttagaataccattttaactctattatgtgtaccaatataatttaactggctagaatttttctgccccatggccttgtaaagtggaaaaactatgggctttgcagttcaggctaaaatcagtttccatccctttctagctgtgtgatcttggtcatttctttaatgtttctaaacttctataaaatagggagaaatacacctgcctggtggggttgttgggaggagctattgagatactgtatacacaatgagatagagggtagagcactgtaacacaagcatcattgccccagcaggctgccagtttcctttcatggcattgatctctaaacagtgactactagggctttaaataatccctcaagggtccatcacatgccctctttggtgagtattagtaatactatgatggtatttgggctcctaatgtggaagaaaacagaatattcctagtcaaggtcatttttttttctctttatgaaatgaaaatttctcaacatgagacttgaaaagcaggctgctggcactagctttttaaagtgcccaaacacccatttttattgttttatacagtcattattcatgtttggcttccagtgtttatctctttttttctttttcttttccttttctttttagagacttttcactctgttgcccaggctggagtgcaatggtgtgatcatagctcactatagcctagaagtcctgggcttaagctatcctcccacctttagcctcctgatagctggggctacaggtgtgtgccagccatcatgcctggataattaaaaaaaaaaattttgtagatataggatctcactatattgccaaggctggtctcaaattcctgggctcaagtgattttcccacttcagcctcccaacagtgtttttcattcatttcacttgtatatgctcttccatcagtgataatgtttcttctgcctcaagaacaaatgcctttagactttttaaaagcacaagtctgctgacaacaaattccatcaccttttgtttgtctgaaaatatttttactttgccttaatttttgaaatatatttttgtttggcagttattttctttcatcactttaaagatgacatcacaatgccttctggcttccattgtttctgttaagaagttagccatcagtcttactgttgcttctttgaggtaatttatttgtttaggacgattatctgactgcttttagaattttctttttgtctgttattcccctctagcaatttacttattacatttctatgtgtatttttttgtatttatcctgcttgagatttgtagcatttattgaatctatagcttgatacctttaaatcagctttggaaaattttttgtcattacctcttcaaatgttgcacctattgctcccaactcaatttcactttcctacccttctgaagctctaattrcacatcagaccttttcctgtttttatggtattgcctacatattttttctttttaaaaatacttgggtgcttccatagggatattttctaccaaccaatcttctaggtcactaatactttcttcacctgtgtttaaactattgtcaaatttatttattgaagttttaatttcagttgttgtattttacagtttcataattttcaccttttttaaaaaaacacttagatttcaattctctggtgaaattctccattttgtcatctgttttcttaaacatattaatcagtgttattttatattctgtatctgacaattttagcatctggataatctgcatgtctgtttctattgtgtattttttaatctctttttcctgtctttgtacacctataattttaaattgaattctggacattctataggaaaaactgcagaggctctctatgatgttagtttctgtcaggcagtcagaataaagcagaacactttaaaccaatcaggaaataagctgatttgaacctgagttgcaatgcttatgaaggctgatttatgtctgtgtagtgttatttttaggatgtaattctattagttcctgctagaagcaggaggtgcttaccatggcccctctgctttggtggactctgaacgccagtgtttatttacccggcactatgagactgacaccagctctgtttcatttctcagtctcttagcagccactttttgttttgcctctctaactcttggcctgttctgggtctgctcacagttccagttgcaaagttgagccctcagagtgattatgacaaccgatgatatcctcctttcagacataatatactgctcttggtgctagatgggctgtgagggacatagactaataataataayaacaaccmgtggtgtaggcattgcaattatatccacatttttacggctgaggaaacctaggaacacagacgctaagtcagtcactgaaagtcatatagttagtaaatagcagtgctgggatttgaatccatgtggtccgagtcttgaagctattttcttaatagaaaggtagamcttcaaacaagtttttattgttgagaaggctagatggcatcttcccctctccctccaaatctgtaacaaacaatgagaaacatgagaaacaaaaacaagagccctttataccatagcatctttcaggaactcacagaagtattcttcatttgtgtaccctgcacgccttgcatagaactaggcacatggagattcaaaatacaatgttttgattgggtgggcgtggtggctcacacctgtaatcccagcactttgggaggctaaggcgggcggatcacgaggtcaggagatcgagaccatcctggctaacacggtgaaaccctgcctctactaaaaatacaaaaaattagccaggcgtggtggcgggtgcctgtagtcccagctactcgggaggctgaggcaggagaatggcgtgaacctgggaggcagagcttgcagtgagcccagatcgcgccactgcactccagcgtgggcgacagagtgagactccgtctcaaaaaaacaaaaaccaaacaacaacaacaacaaaaagttttgatttccagagcttaggtctgaagttgtattttaccacttgttcctggtgcttttcctgtgttaccgcaagagttaagcaacacgtatgtgaaaataaaatgkrggattgcatagtacagaccaaggaggtagtttggggcaaagtctagtctgtgctttgtttgtcaaactgtgatccttattgcagcatgaaggagggggtmcctttttcttattcaggttcctggcaactytaagatagaatttttccctaatccatctcactggactagtttcctatcttttcaggcagaaaaagttggctgagaagacaatctaagcccagctgtttattattacatatctcggtttatttggtgacccgcatgggaaatttacagatttgatgacactgaacttaaagagaaggaaaataggacaggaaaacactgggcatatttgtatttctgacgggtgcaaatctgttgaatcagttttctgttcccaaatgcttccttcagtgtcagactgaagctttttttatttagcagattcccagagaagaaactccagaagaaagcagcagctaggaccttttataatatcctacaatttcatttcccctgttgtttttacatcatgaaatgccccagtgtttaaagacacaaatttacccaatgtcaaaaaactccgaagagtttagaagaacaaattctgtgtatttatccccctggtagtaatatccttttaggcaatggacacagaacaattttgagtggtttctctccagaagctgaatactaatgttcccatgcctaataaatatgtagtttataaaaagattaagcaaatgtatgcwcataaagcaatagaaaataatctactttgtatttaaatagagctaaaccaatttaatgcaattgtttcagggcatccatctgacaaacagctttctataagtgattctgtttatcttgggatcatctcaaccaaaaattctgggaacaaccaaacaaaaaattgactgaatttacacaaaattccagaaagacttccaaattaattgcaaaggcttttcttaaacttctcaaggacattttttaaaggcttgtaatatagatctcttttgggggtgctgaggaccagactgtggcagattgatgcctgtgaggtctgcttatgatgattaataatgaagctatttatgtggacttcacctttttctgaaaaaaactcattttccaggttggagccgtttccccttaaataaatttgtttctcttggaataataaggaaatatatgccattgttaaaataatatgtcgagggcagaaaacacctttctgaagatcctttttacttccagtggtaaccaaataggctattatttttagaatactgagatctcttgtgtggatagggtagttgagtgacttcagctattaaacagttttattaaacagggaaacttggtactttttccaactgcgtttaggggattttgcacccaaatattaccctgtccaggagtgatttggggaagagtgatattactggttactggtaacagttgctaacatttattgactatatatgtgttatttgccagagactgtactagacaattttacattattgctttatttaattctcataggaaccctgtgagctggatattattactacccctgtattatagacaaggaaactggacgttggcaaggttaaataactttcctaagatagtaaagctgggatatgaacccagcatatttttgctgccctcttaaaatataatgcgggggtgagagggctgcttgagggtaggagagcctaaattaatacracctttttgaaaagcagttttgaagtacttatcaaaattttgtaaaattagcatacattttcatcaactaattccacttctagggctccagtttaaggcattaatcagagatttggacaatgattatgttcaagaatgcctaccgcaacattatttacaagactttacaatagaggaaagaaaacatactgttttcctttttcctctcacactcaacacagaacacttctgtgaccacatttatgattccccccactcccctgccaaaaccaagcaattctccaacagacaccaactgggtatgctatcattcaattctgaggctatctacctagagacagtgttagatcctacaggtctagggccgagtccagtaagattgccccctctccaggtgccaaacacaagtccaggccacccctacttcaaactgactggctacaaattgaggttcccttcaccccctccttgggttccataatttgctggaccagctcacagaacccagggaaatgcttaattatatttacggttttattataaagtatatgacaaaggatacagatgaacagccaggtgaaggkatggatagggcaaggtttagtggggcatggagcttccatgccctctctagtcatgcactctcccagcacctccacatgtacagcttatcaaatcttattgtccaagagtttttatagaacttgatctccagtaactccttctttcctagaggttgttgggtgggcctgaaagatccaacttttggaaaagtagggtagatatggggaagycttgattataatgctaaggactttcatttgtttgataaccagttgccctctgttttggaagctgactgtgagaggggagaatctgagggcaaggaccagacagcaggctttaacccaattatgccggaggttgcaaatttttttggtgaaaatcagaccttggtgatgaccttgagcagtaggatataaataactcccacaagtttagcgttccaataatggaacactaggcataaataaaagattggctagacagacaggatcaaagagaggggctttgatcaggaggtatctttaggctcagcattggactggatatttacaggtgtgtgagtgcggatgaaatgcacaaacgcaaaggaaactctgaagctttaagcctgagtgatcaggagggtgatgatgccatttagtggcttagggaagaaaagggggaaaaaagtagtgcatagacactactcgttgtagtgttggacatagacatccaacagtcwtgtccccgttcttcacagagcctagattttgtcaaatggttaacccatcctgagcccctgrgaagtgtcctaattkgtgcaagccagtcagctcaggacatccctttgctgactattcttggtccaggtgtagacatggcacttaaattggccgtttcatattgagtgcatattttgtggttgggggatgcatacaacatatgttgggaagtacacagaagagtagggtaactaaatgcccagactgaaaagggaagccatagtgtatttgagagaatcagggagatcttggagagagaaaggctcagaaaatccatcccatagagttgtttatgaaccccagggctcaccattgacctgcacttgtgtacttctgaccctagatagaataccagacactatgagaagagaactatgggattgggtgcacatgagacagatccaagtagctttgcaaaggctttgtaaactgaactgtcattaaaactataacccacagaagctggtctggcttttggcctgaacccaactaggtcagttgcctgctaaaacaaaaatatcaaaatcctccataggatttaaacaagaccctgagtctcataatgtaacattcagaatggaaagaacacaatccaaaattgctcaatgtactaagaaccagggaaaatgttgacttccatgagaaaagataggcaacagatgccaacattgagatgacacaattttgaaattatagcctttaaatattatataaatgcatcacaaaatgagcactgtcttgaaatgaatggaaagataaaaagtctcagcaaataatagaaaatacaaaaagaaccagatggaaaatttaaaactaaaaaatacaataaccaaaataaaaatcttttcagatagactgaatagcagaatgaagacaacaaaagaatcagtacatttgaaaaaagatcagtagaaattatccagtctgaacaacaacaaaaaaaggacttggcagacgtgggaaggggagaagcactctctctctcgtgggagaacatcaaaaattctaaatttataccatcagagtcccagaaagagagtagaaggagtaaacttcagaaaaaaatatttgaagactaatgagtgaaaatttcctgaagtttgaaaatgagcaacagagacacaggacargaacaaggcaaaaaataaatgtcatagaagacatataagtattgaaaagttttcaagacaccygaatgcccaatactgtccccttactcattgtgtaaccttggagaattttatttatctttcctcatctgtaaaatgggtagaataaggctaaagataagaatgtcatgaagattgaatgagataatctaaataaagcacttagcatcaattcctgactcacagtaaatgctgaataaataatagtttgttttttaaaggggaaggaaggagatcagcaaaggtttcaggaatgatgaggactctaaagagaacccagggctttgcaaggtgaagrtgatcctctgagattgttttggtagcatggtcagactatcttgaattgaaaagtaattaagagcagtggaaagggagaaaattggcataaactttttgacaaagtttgatggtaagacttgcctgagaatgcaaatctgatagaatataccttgattttttaagatggaaaatttgattctgttaataagctaaagggaaggaggggtagagaggaagaggttaatgatttgggagaggaatgcatggctgatggcacatggccttccagcagacaggaggagagaggctcaatcccacaggtgtttgttgttgttgttgttgttgttgttgttgttgtgtgtgtgtttgcagaagttmtcactgatgcaatggtttaagcagaaattaaaagtctaattattatcaaagagtatttaagattatcattatctgcagataatatgctagctgttctcaaacagtgattcctgacctttccacattatagaatgtgaaaaaaatgataatatctgtaagatatactggaatgaaccataggggattcagaagcaattttctttgtataattatgataataaaaataaaatgtaaagtatgggggaagatattaaatatcaaatttatgtaaaacttccaagtgaaatattctcaaattggttacctagaaacttaggcttatttctgtggacaaaactttcatatcagatagtatgcctaaaaaagctataaacatttcttgatgtcaattttttaatgattatctcttggtagtcaacatgaatgagaaactttgttcrtattagtagctgacaaaatattytattgttttctatcaaatttacaatagttgccaagagaatgtaacagctcttttattcttttctagaaaaatgtgatattgaaatctgttgtgataatgaaaatagatttttttaaaaacagaactwtttttttcccctttacattctttttttttaactctcattttaggttcaggggtacatgtgcaggtttgttacataagtaaacttatgtcatgggggtttgttgtacagattattttcatccaggtattaagcctagtacccattagttatttttcctgatcctctccatctgcccaccctccacccttcagtaggccccattctgtgtcgttctccccatgtgttcatgtgtaaacagaactttttttacaccatgaacttcaaagtagtgaggaagcggtcgtgtgaagaaagggcatgcrtttttggaggagtgtcactaaaaaaatccatcagccacaaaataagtgacagtatgtgctcagtgtcaggacaatgattccaagctgccagctggtgaagcatctgccccattcccacaaccarttgcaccttaggctgtgatccaagtacggcgggcacctggaacccagggtcctccagcaactccataggcccaagaccacatggcacagagaygcactctgctgccaaactgaaggagctgtccaggctgcagagcacctctttggctgtgtttgaggtgtggctaggaagctgggagtgcygcgaatcagtgtagggaacggtgctcattgctaatggtgacagcacatagtcaggaatactctgcttagggttcccttcaggggatcgaatgagcctaggaggttgaggctgcagagagcagtgatcaggccactacacaccagcctgggcaacagagccagatcctccaaggagttcatgattgcaggtgaccagctacaagtgactgccccagaccttccttcctactggtgcactcagtatctcacagagcaccaggatccccatgctcgccacacctgagggctgcgtgcagcacactcataggaaagctctggtctagaaaacccaagggaattgtatgagaaagtattggcattaataaaagagtgaaaagaatggcaatatatgaaagaatgacaatatacacatataaagaaaaacatatgaaaaattaccagattttctagatactataaacagagaggaaacataatgaaaaatattgcattctcaatatagcatgtttcttgttatttctagttagttatagttatctccatacagatgaaatgcctaggaataacttaacaagaaacgtgagagatttgtatgaagatataataagactttaccacaagatataaaaaatwacttcaataaatagagccataacatgttcttggatgggagaaccgaatattatgagattgtcaattcctaccaaattaatttatagtttaatatgactccaatcaaaatcacaatagkgttatttttggaatattacaaaaatcattccagagtgcatctggaggacaaataggcaatagtaactaatacattttgagggtaaataaagggtggtagggaggatttagccttccaagaaagtaaaacacaacagaagataacaataatgttatcggtttgtctctcctgcyagaataatttggcaggacagaatagataggccagaaagaacccataggatatatatgatgacgatgataaaggtggcatcacaaggcaggaaggaagggcaggattctccaatgaatggtgctaggtattggttgggggtgggcatggggttgaggaagaaatggagagaaactgttttcctaaatgtgtgtttctatgtactccaactacagttacacttctgggttctctcccaatcctcattttctttcttgggtcaggaaraaggaaatatctgattgatgagtttagaagaaatagaatgtgtggctcaggcccctcctctctttcagggtctgtctgcttgcagagaggctgcaagctggtctgcctcagctcagtggctcttaarggggcagtttctgcccctgcccttagggaactcagtaggggtcgagcgtggcctggaattgtgtgaataaggcagcttaatccagggtaagktatgttagcagactattttggctgcttatctaaaattacatattctaatcagctttaatcaggaataaagaaaacaacatcggccgggtgtggtggctcacgcctgtaatcccagcactttgggaggccaaggtgggcggatcacctgaggtcaggagttcgagatcagcctggccaatgtgctactaaaaatacaaaaaaattagctgagcgtggtggtgggcacctgtaatcccaactacttgggaggctgaggcaggagaatcgcttgaacctgggaggtggagtttgtggtgagctgagaccatgccactgcactccagcctgggcaacaagaatgaaactctgtctcaaaaaaaaaaaaaaaattccacccacattatatgtttatctcttaattggtttctaactcatgagggggaagggctgttatttgttggtccagttaaatctccaaaactggagtaattggttggagaaaaatttatgtcctaacacacgcaatatatgaagaataacctctacaaaagtttarctaatacaaattaaaatcaagatacatgatcaaatttttggatcaaggaagactgtctaggattaaaagcaaagacaaatatccctaggcaaagacacatagctctaacaagattttcatacagtgtgtaggccaggcacagtggctcacacttgtaatcccaacacttaaggaggctggggcagaggatcacttgggttcaggagtttgaggccatcctggacaatataataagtcctcatttctataaaaaaaagaaaaaattaacctggtgtggtggtgtgtgcctgtagtccgagctacttgggaggctgaggtgggaagatcagttgggctctggaggtccagaagcagtgagcagtgattgcttcactgcattccagcctggatggcaaagcaaaatcctgtytcaaaaaaattagtaaaataggccgggcgcagtggctcatgcctgtaatcccagcactttgggaggctgaggtgggcggatcactcgaggtcaggagttcgagacaagcctgascaatatggtgaaaccccatccctactaaaaatacaaaaaattagyggggcgtggtggtgtatgcctgtaatcctagctactcrggaggctgaggcaggagaatcacttgaatccaggaggcagaggttgcagtgagctgagatcaygccatggcgctccagcctgggtgacaaagcaagactctgtctcaaataaataataaataaataaataaataaataattaaataaataaaataaaataaaatagtgtatatatacattaataaaaaagcaaaacaaccaaaaggcagttattaaactggaaaattattgttagtaaatattatatgtaattactacatgacatttattaagaacatagacaaaataatcatgaaaatgaacatttcagtagatggatagaaraaatattaagaaggaattcacaaaaagaaaaatacaaatagctaatgaatatgtttaaaaagtcatatacacaaatgatcaaagagatgcagttaaaatgaaataccattctttgtctatccagctagaaaataattataaaatgagaattcctagtcccggtgaaggtataatgaaatggtcactgtaagtagtaggaataaatcagtgcaacttttctgaaaagaaatttggcaacattcactaagtcttaaaatgtttataccttttaactccrgtaaatctgatagtctaccctaagttatttgcagaaatgcaaaataacagctatgtcctaagatttttgtaataacgaaataaatggaagaatatatgtccaacattagtgaaggttaagtacattatcacataatggaatattatgcagccattaaaattaagcttacaaagggcttttaaacatcacctaaggacattaaaaaataaaattgtgtaacctctctgtttaaaaagaataataatttaaggcagcttatgagtagacytgaaatttagcaagattgcctaaattagaagtagatgagaaaaacagaagacaacaagagtaggaacaaaagacgagctgtgaagaacctattgcaaaaatgaaaayaattgctggagtctgaacattggctatgagtgagttgaaaatcccactctatgcaaatccaaaaaggaaaggtgttttagaacatcacagcatggagtttgctggggaggtaacataagataaatacaaggtttgtcaggcatgactgaggcacaagtgaggtttagcaatacgattttacagtgcatccacttggcagatgtctataattttctatggtaactctcaacagcctgaaaatagcagaagccacagcatcagaggctgagaaaatgatgatggataaattcaagttcggaagttgaaatgataaagtgggaggaaggtggggtggtgaaggcatctggggtgctttctgagtaatcatctattaattcaacaaaaagttattgaacacatactgtctacaaggcattgtcctagtcattctggggatacatcagtgaacataacaaagatctctaaactttgttcacagataaagtgagatgaggaatatataataaacagaatacatcatgaatacaataaaattgtgtgcttgggaacaaaggaaactaaggagcaagggatagggaattgggagtatagttagtgtgtgtgtgtgtgtgtgtgtgtgtgtgtgtgwgagagagagagagagagagagagagagagagagagagagagagagaaaggctgggcaataaagacctaaaggaggtgagggagtgagtcatgawgatatgttgggggagaaggtcaaggagtgagagcatctggaccactaggatctagaataggcagtgcagaaagaaaggtaaggcaaggacctgccttagatggagaaaacagagatggggtaggtacaattcattagggaaagagagcagtcaggaggtcatcagccaaagtggggaactcctgagcctggagtcacagaactttacaactctcatcttaaatctactccctttgctcacagaactactgttaaatgttcyggtgacacagtctgcagtggtgcacmcctcttcctgctatgagttcagaacaactgctaagtgggcatactgaaaattcaaatttcacaggagagggctttttggtaaaaaatgtataaaaagaattgagtgacttgcacattaaaatatgccttctttagaggtttaaaaacaaagatagaggccargcacggtggctcacacctgtaattccaggattttgggaggccgaagcgggtgaatcacttgaggtcagaagctygagactagcctggccaacatggagaaaccctgcctctactaaaaatattttaaaaaattagctgggtatggtagcaggctcctgtaatcccagctactagggaggctgaggcaggagaatcgcttgaacccaggaggcrgaggttgcagtgagccgagatcaccccactgcactccagcctgggtgacagagggagactccgtctcaaaataaataaatttaattaaataaataaatagataaatagaattgtgaggcatgtaattgtaccaataagatgatcacaacattgtcagataacaccatccaaaatcatatgcatagaaaaaaaggatagaagaaaacaccaaaatatstactgtagctggatatcgttgggtagtgggattacacaaactgttttctttatttgtttctacttgttttacttttaataatggctgaagaatttttacttaaaagtaggctgtttgtagcaatgttggtttaagtatagtcctactagacaagaagaaaatgtaatagagtacaaattgataactaacataggaaataaaaatagtaaagacatggaaatctactcaacatcattaattaccaaagaaacgaaaattgaaactttaaacatttttattttttgctcattaaattggtaatttaaagaagatttataatgtggaactaaaaaaaaaatggagacgaaataatcaatgaaatcatttgacaaaatttcccagaactaaaggaaattgaaagagtctactgagtggccatcaacatagatgaaaatagactctgccgggcacggtggctcatgcctgtaatcctagcactttgggaggccgaagcaggtggatcatgaggtcaagagatggagaccatcttggccaaggtggtgaaaccccatctctactaaaaatacaaaaattagccaggtgtggtggcgggcggctgtagtctcagctacttgggaggctgaggcaggagaatctcttgaactcaggaggtggaggttgcagtgagccaagatggcgccactgcgctccagcctgtgtgacagagcgagactctgactcaaaaaaaaaaaaagaaaagaaaagaaaagaaaagaaaagaaaatagattcatacatattctcacaaaattccacaacacaggggacatagataagatcctacaaatgtctagggagaaaagaaaacaacttatgtagaaaaggatcatgaatcagaacagttctggattgtccaacagcaaaactggaaactaaaagaaaatgaagaaatgtctccaaaatataggaacagaataatttccaacctttagttttcgacctaccaagttattaatcaaatgaggataggcatttgcaaaatatcgtaaatttacctctgattcattctttcttaggaaggctattggtgggtgcatccacaaaactggggagtcaaccaagaaagagaagagctaaaagaagagtgagggaaagagcatatctagactgatgttaaagaaagaccttaggccaggtgcagtggctcacacctgtaatcttaccactttgggagtctgaggtgagaggatggcttgaacccaggagttcaaaaccagcctgggtgatgtagccccatctctacaaaaaataaaaaattagcggggcgtagtggtatgcacatgtggcctcggctactcaggaggctgaagtgggaggatcacttgagcccaggatatcgaggctgcagtgaattgtgattgtgccactgcactcctgcctgggcaacagagtgggaccctgtcttgaaaaaaaaaaaaaaaagaaaaagaaaaagaagaaaagaaagacccccaaatgccrgttcagatcagaggtcaagaggtcagaggtctccaagagaaaattcttcagggctttgattttatgaatacctgacgcttctaaacaccttaagaggaattaagatgatccacagagactttgtgattgacacaatagaaagtatgtttaaaaataaaattagtaattattaactttaaaaaaccccacaaagctgtacaggaaagggaatataaatactagtatcgcctctgactcatttctgactaatgtctaagatgtcatcagaatgtaaatactgaatatgtctctagtagaattgtgatatgactctgttggggagatagggtactgagaagggctatgtgtatgtggagagaagaaagtgaaatccttttcttttatggaagcaaatttagaaagaacacctaagccagttaccccctctctttctggacattctcatgtttggatggggagttattaggaagacaaacagcctgagaataaagatgacacactgagaaaagcagaatggaaagcagaaactgggcccttgatgatctgtgactgaattaactaatcccggaattggtctacctccgatctatttgtgtaaggtcctcagtgacgatgctgtgagcatctatggcttccacattcaagtactttgcacaactatctccgcaaattggtacaacttctagacaaggcatataaaactccagaggccacgaaaaaggtcaatgttaatgataagatatattattattaagcactgacaatatgccacatccttcaggctacctgaagattgatagccctttccgactatgagttttactgcctatggccttaaatttttgtatccacagaattattgaaagaaaaaaatgactttactgaaaatarccacactaatatttatgtataagtttatactttwaaaaaataattttgacacatgacaagtaactattctgaagaaacacattattatgtgctacctacttcacaaatgataaactaaggaaatgagtaagaccacatataaatttctacaagaacttttaaatacagttgacccttgaacaacatcagtttgaactgtaagcatccacctatatgcgaattttaaaaataaatatatttgaaaactttttggagatttgcaacaatttgtaaaaacttgcagatgaactgtgtagcctagaagtagttctaaaattaagaaaaaggtatgtcacaaatgcataaaatatacacagacactagtctatcatttactaccataaaatattcagaaatctattataaaatgttaaaatgggactatgcctggctactcaggaggcggaggtaggaggatggcttgagcccaggagttctagtctacagtgagccatgatcctgccactgcattccagcctgggtgacagagcaagaccctgtctcaaaagaaaaaaaaaaaaaaagaaaaccacccacacaaacacagactgtacatggcactatttgcagttgagagaaatgtaaacaaatgtaaagatgcaatattctatcataactgcataaattaactgcaacaatactgtaatactgtactactgtaacaattttgtagccgcctcttgttactattgcagtgagctcaagtgttgcaagtatctgcttaaaatgccactgtgatgctaatcatctccaagtgagcagttcatttctccagtaaattgtggattgcagtagaaagtgatctctcccagttctcctgtatttttcctgtttagtgcaataatgtaaacctggaataacaccatgagactcatataaagtgctactagtgatgctggaagtgctcccaagaagtggagaaaagtcatgatgttgcaaagaaaaattgaattgcttgatctgaaccacagattgaggtctgcagctgcggttgcctrccattttaggcagatcattcacctcatatacagacaatgtaaacctgtggtgtcaatagagtgcagtgttgtaaatgtattttttcttccatatgattttgattttcttccttttttttttttgggataaggtctcagtctgtagcccaggctgaagtgcagtggtggagtcatggctcactgcagcctcaacttccccaggctcaggtgattctcctacctcagcctcctgagtagctgggactacagatgcatgtcactatgcctgctaatttttctattttttgtagagacaatgttttcccatggttagtctcgaactcctgggttcaagagattcgtccacctcagccttctaaagtactgggattacaggtgtgagccactgtgcttggcttccatataattttctcaataacattttytttctttttttttttttttttttttttggagatgggtcttgttctgttgcccaggctggagtacagtggtgtgaatatagctaattgtaaccttgaactcctgggctcaagtgatcctcccacctcagcctccagagtagctaagactagactacaggcacgcaccaccatacttagctaattaaattttttttttttttttatagaaatggagtcttgctatgttgctcaggccggtcttgaactcctggtctcaagacagtccttcctgggattatagacatgagccaccacacctggccaagattttcttttctctagcttatgttaagaatatataatacatatgacatacaaaatatatgttaattgattgttttatgttttcagtaaggcttccagtcaacagtaggctattagtagctaagtttttggggagttatatgcaaaagttatatgcagattttcgactgagagaaagatccatgtacacattgttcaagggttaattgtgctgtatatagaataaaaaaaaatttgtaacctcacaggacaaaataatgaaaataaaaataaagattaaaataggtagaattttttaaaattaagaaactcacctttataataaacaacaataatgttgaacaataataatgttgaaagtaatcttataaatatgtttgttggatgggtgggaatccaaggaagcttcaatctctaaacctttatctttagctgaaaaggaattcatctayaaccaaatataaaaacagtgataatagcttataactagtaagtttcctggatatgctaggcactatattcagtattttatttgcagttttatcatttaattttcacatttatcttaggtagggggtattattattgtccccattaggcttgaggaaagtgtagttcatagaggtaagatttgtgcttaattccagagcttgggttcttaacatctgtgctatatgctctttcattaactatgaagwaatctgaaatcaaatgcaataataatacctcatccattttctaatagatttctacattaaccattgcagtgtaggttaatatgggccagatgctctctgattgcaggcgcacacattcyagaggccccacacctcatattcccacagctcctatctctcttcatgcacaaatttacttgaccctggactggatgtactatataaaggctgcttcatatttgcttgggattttaatattctgtctgaaggtctttcacttattcaccatgtggtgtgtgatgtctgcttttgaatgcatgtgcccagagaccacggagtgtgtctgtctcccatgcttgttacagagctgtcaccgtcatcagctttgccaatcattcatgcaacctatgagtaaaaaaaatgagtgggctggagggcctcagtaaggggaagacagtgttcataccctcctcatgtacggagcctgggagctgtccgaaccaagtacccagggaagcatcggccctccccacrtcaaacacagagacacacagagtctgaattcttctgatatggccagtgctgacctgccagcctccaaaggtgtttcatttgcttatcaagaaatmtggataaaatggcttgtgaataatgtcccagcatgctcctgacgaaccccaaaatgagattcaaaagcattaaacaggattggattgtcaataaatgrtatgtaagaacattaacataaaaagcttttttatctgcctcagttatttaatctctgccagttcagatgtgcatctcctgtgccctgctgttaatacgtactgacatctgaagtgaagcgagctgtttccatatcctttggaaatggaaatggaggtgtcaagggagcacagaaagtagaaatgatgaaatgctgttcatcatagtagtgctaattaaaaatgcacaacaataccacaagggccatgaatttatacagtgggtcttctggatgataaaatgttagtcyacccttttgtcagacagaggagggaatataaccagagagaggagacaacttgctaaggtcaaagtgatgatktatgtcggggtccagaaccaaacccaggccttctgggagttctttcccctgctctgcaaggccttccctagcaaaacactctgttgtctattaattcatctgcaagagacattttcacacggtgccaacgcacatggtttggctgacaggacaggcccatgttgtgattgactggtctgatctttctcccaggcacccaaactcctggcgtcatacttgctcagccgtgttctattatttctgtagggtggatcatgggtgagtttatttttttccgtttttcctgttttttagttttttaaatttttttgtgggtacatagtaggtacatacatttatggggtacatgagatgttctaatacagacatgcaatgtgaaatattgttcctttcttttttaaaaagttaatatttacactgtttctcctataactagtctgtatttttttgtgctttaaaagaaaatattttaaaaagggtttcaaggtccaaataggatcatgagaataggtggttagattggagcagagtgttgaagctgggggaagggagatataagtacyttaaggccagattgtcagctgatttggccatgtaggtgttgaagtgatgatagtgtgagatggatcggagtcagagagaaagckgggagtcaggtgccaatgtcttcaataaaggggcaggggtgtggggggtagaaatcaaaaaggacagtgggtgccttakcaaggcagcatagacttcagtggaaaatagaagagttatactcttgaagcagcactgaggccctgaaaggggaggagagatgtrggtgasagtcagagctccagcaagaaaaggggattgagtgactattttgtttggaggttgaaggtatggggaasattagtttctcattttctattctttttattataaaatataacacacatagaaaaaagtacgttaagacctaaatgtacagcataacaaataattataaagcatatagccatgtaactgctgccctgttaaagaaatagtgtatcgttgacaccccagaagcactctgtgtgtgytctctctttatcacatccccttccctctggaattaaccactatcctgacttttggggcaattatgtccttcctttacatttattgagggtttttaaaaattccacttttcccgtctactcatttggaagttatacattacttttgatatgaaaacctgtatccttaatatattaaaacctagcgttaccctcctcaagagcaataaaaaaattaggatactgttttcctggtatatatgttatttttatcatatattttaattctatatattttaaaagcacaaagacattattatcattgttgttttatactgtcagtgttcatttagctttatacacatacttcctactttctttgctcttttttccttcttgcagctcagacctctttttgcaatcattcttctactgtraggggakcctttcagaatttcctttcacatgggggtgatggtggcaacactgctgttttgttagtttgaaatgtctttattttactctcttgtggggtatatttgatgagtataaaattctaggtgtcagtaatcttttagcatagtggaaatatcattccattgtcttcttgtttccagtattgctgttgagaaattatatgccagtttaacagatactcttttgaagttaatctgtcttttttacacctctggatgcttttcgaggtgttatctttgcctccagttttctgtaatcgctgctaataaacacatacctgaggctgggtaatttattaaggaaagaggtttaattgactcacagttcttcatgactggtatggcctcacaatcatggtggaaggtgaagtaggagcaaagtcttgtcttacayggtgggaggcaagagaatgtgtgcaggggaactcccctttataaaaccatcagatcttatgaaacttattcactaacatgagaacaacatgggaaagaccckcccccatgattcaattacttcccactggggattatgggagctacaattcaaaatgagatttsggtggggacagagccaacccatgtcactcattatgatgtgtctgacattttagttatattgcttaagagttgtagtgattcttgaatctgtggattgatagctttcttgaattctagaatattctcagccattatctcttcaactataatctctgccccattatatctagcttcttctgataccaattacacgtgtagtagacttttcggtctatcctctatgtttcttttcttctcttctgtgattctcatttttatgtctctatttgctacactgtggatactttttctggcttatattccagttcaccagttttctctttggctatgtctggatagctgaagagaaagctggatgccatctggaggctgaatgaacctacatttattcactaaatttttctttgtggattrcatttttctttcacaggagttctatttggttctttttgaaatgtgttattttgctttttatggttttcttgtccctgcagatattttcaagcttgtctttgtaactttaaacatcataaacatatggtctttgtctgacaatttcaatatatgaagtcttgcatgtgatttttatttattctggtgcatattgctctcaagttgttaactatgattgtgtgcttaccattatatttggaaaaaattagagtttacaattgaaggcttaggatgactctccagagagaattttctgtgcttgggatctttktccactaatagtcaaggaccacattatatcaaatttaagaaytgtagttcccagaatgagccaggtcagccttatcctgaggctgtagtcctytgaggttctagcttactatgggcatatttgtgtrtctcctgttagatccttcatcttgtgcaggtcttgggattgataaatattccttttgccccacaaggacatcaatactgaagtttaaacttttcagaataaggcaaatgcgctcagtcgcttttctgcttatttaactcactaggttctcattttctcttcagttttggcgttccttgctgtcttctcagcttttggatgtttttaagagtcttaaatgtagatttagcttttcaaaaaagtcatttctagtgggatgttgttccaaataacctatgatcttatcataaataaaaggtttggccattttcttacataaagtgagaactccaaaggraattgtaggaagttttcttaggaaacaagggtcatagtagaaggaggtcatagtagaggaggtcatagtagaagaaggaatataggattaatgatatatgagatactagaaacccagagaggcttaccatttgaactatggaatatgaggaattatggtttaactggtctctaagaccccattcatatcagttccataactggccagacatggagactggggctatgagcaccaactttgctgggaatgcaatcaggcactgaaaaggcattgttctagtgatcctggagatttctctccctggtagtctgggaagggaattctttagttccaagaatgctcacctcatgaaaaaaattaacagcagcactcggtggcttggaagcctctgtgtcctcactataattttggataacatctgcagtaggaattatgatcattactcatgttaaaggacctactattcattttataatttttaaagattatagaaatttgtagttgtggcagtattttatggtacatcatttgtggcctctgcaatgtataaaatgctgaaatccaaatcagaagacaatcccaattataacattgtttctatgagaaaacagaagatgcttcttaatgttataattacagatatattcacgtatgtacagaaaaaattacctaagaaaacatatcaaattttgacatgaaattcgttttataaaatttatcaataagtatatattatttgaataatcaaaaataatagaggttattttggaacagaagcaaggtgctgtctaccccacagctgaatcagggcaatccacaaatcttctgtaatgtggaattagaatgcaatgacaccatcatttagaattagaacataccaaagagtaagtattaggaatatgggggaatgtatcttatgttctcaggtttagggaataaagtcaaaagcttcttgaggacaggctccagggttgtcttgttatccccagtgcttaacactgagctgggcacagagtaaggaagaatgataacaagattaagtcaccttcagaggattagggaatgtttttaaacatgtgctgcagactctgaaggcagtaagcaagtgtttattaaatgcatgctaccgcaggcactaggctyactgtggtgactcagagatgcagaggacctagtccttatacccgaagaggtacagactaaaggaagagacagaggggaagctgtcaatcaggtgacagtaggacatgttgtggaagagctgaggagggaggaagccagcatgaggatggtgccttatgaggtgatttcattgatcactgatttgggtgacaaatgctggccctattgttaaaacagcagtctaatgagatatggttttatttttatttatttatttattttgagacagagtcttactctgtcacccaggctggggtgcagtggcgcaatcttggctcactgcgacctccgcctcccaggttcaagtgattctcctgccttagcctcccgcgtagctgggattacaggcgcgcataccacacctggctaatttttttgtgtgattttagtagagacaggatttcaccatgttggccaggctggtcttgaactcctgacctcaggtgatccatccacctcgtcctcccaaagtgctgggattacaggcgtgagctaccacgcccagctgaggtagggttttgaaggacccatctaggtttggcttggcctcagatgaagttctctcactgcctgttctccattgcctgacattcccattacagcctacccctttagagaattctattatttgctccagagttgttaaaatatgcatgtgtcttgttgagatgatctaacagtacctcatatcccccagacaccccaggatgatggaggtcatcctgactcctccawctcccttgcctcacacctctggtcactcttcatgtcctggggactcttcttcctcagtgtctctcacatctagcacttcttctaactctcatggccaccattttagttcaggtaacggcccctggaattatcttcttgacttcaggctctcctcactgtgatccattccgttgcctgattgattaatctactgaaaatagtattcaaaaatcttcagtggtttgcccaagcttttaatttagcattgagggccctttgtgagctgattccagctggcttttctaattttgtgtggcaaattagtggtttcattaggagatagattaggcagatgtaagaaaaagactccaagtatgttagcataaacatgataggtgtttatgtttttcaaaagcaaaaatccgtatagttggyccagggctaatatatggtttaatagtgacagggcagtggtaacctgtcttcaagatggcccccaataattcctgcctccttctgttcatacatttgtgtagcccctctcacgatgtatgaaggtaaatacagacaaatatttttacttatattgtgtgatgattgattttatgtgtcaagctgggctaagggatgcctagatagctggtgaaacattatttctaggtgagtttgtgaggctgtttctgggaaggattagcactgaatcagcagattgagtgaggaagattgccctccccaatgtgggcagccatmatccagtccagtgagggyccactgggatacagcaaaatgggggagcaagggtggactccctctcacttttgagctgatatattcatctttttctcccctcagacattggagcagctcctggttcttaagcttttagactcagggacttaaactagcaccccctgccctccgacacctactcccccactccagttcaaaggcctttggactcaaactgaattacaccccagcttgcctgcttctccaggttacagatggcatattgtggggcttcttgtgaaatgaatgaaatcaaacattttccatctactcaaatggttatgcacagggttaagcagtgccttcacaaccagaggtaatacacagtcacatttatccttcaaaattattttcagttaaatacattaataaatgatgagtaacatcaagaggggtgtgaaccccccatttcctccttcatctttttaattaatcaacccatccccttttctgttggctcagagatagaaagatttgcataatatcctggtgccatggctgataatgtcctctttgttagttaactcttaaaggaagagtcatgtaaaagcctgtaaatgaccatatgaattatgcataaagaacttaactcaagccatgcatataaaatgggcattcagaacacaaccttgactctcttattcttttataaatagactyccacagggcttgctagcctagtgtgtacacctctcctaagcacaaaatggagtttgctttgttggtttgaaactaatttacaaaattgagatgactaagaaaataaaattttataaatgcagttggcatctggttaataataataatgtctttaaaattttttatgtatcgggttggtgcaaataaaaaaccacaattaagtttgcaccaacctaatgtcttgcacaacattatataacattccacacacagagtgactgatgaaagctaacttcttcttttctcgtggagacaagaagatccagttttagactggtgagtgacttgctgaagagcccagagggaaccagaggagatccatatttgtattaatcaggggatgtcaaagaaatggaaccaataggagatgggtggggagcctatggtggaagtcctggcccaagaaccaggagtyccaatgtctgagggcaggagaagatgatgtcccagctcaaacagaagaaaattcacccttcctctgccttttgttctattcaggcccgcaatggattggataatgccaacccacattgrtgagagtggatcttatttattcagtttacagattcaaatactaatctcttccagacacaccctcagagacaccccagaaataatgttttactaatgatttgggcattccttagctagtcaagttgttgcataacattaactattgcaatgcttaaattctgtctcctgttctccaaccatacttcctatgacccctttaagatcaaaactgcatctccaaggcccgtgacatggccttgcctagcttatctaactaattttgtgccaccctctcccttgtccatcactttccaccctttagcttctttctacttcttgagcacattaagcttatatctaccttagtccytttgcatttgttccttttgcctggaatgatcccaccatcccatcttgacctttctaactcctttttttgtcatttatgtttcttgttaaatgtcattttcccagagaatccatccctgatcacccaatctgaattaatagttctaatacacaacttggttttattttcatcctatctgttcctgatacatccttgttatttaatctttttattgtctgtctttcccttaccaaactgtaagctccacaggcaggaacttgtgtgtcttattctcctttgtgcctccagtgcctagaacattgactggcactagcagatactcagtgtttgttgattgaataaatgcctttgttttagtttgaatcagtcatattggaagaatacgttggtttatttccatttaaattgatttagtcatttcataaaaacaagtcttttccagttaaggtcaatttctagcttaatagaaattaataagtgaaccaacctaagcttcagcaattaatgtgccatactgcttacatgaacaattcagattcctgactcagatgcccaaaatgtcatttgagttacaattgttggttctgggactgtcttacctttttctgagatccaagacccaactcaagccccatgtcctctgtaaagcattctttgaccaccccaraccacagaattgctctcctcctcttcctcttcccttttacagcatttagtatatcagttgctcataaagccctggatagaggtgactcttagatagtcttgctctatggagatgtatttgcaggtatgttgttaacactttgagggcagggtgaggatctatatatgtcctttatttgtcctgggtttcttgcttggactgcttcccacagtgtttgtcgtttggatattctttaaatattcaacttcagggggttattcctccagttttgtttgttttaaaataagtgtcttcttctggcaggaatggggctccacgatggactggtcctaactttggccatggtcagtggcagtgggcagggcagagttaaaagctggggctctttccaggatgccagaagcatgcagggcacttcaccttttctttgcagttgagatcatccagtgwcatcattcgtagccagaaactggttgtaaaaaggcaagaactagatcactttacttcccataatagctttctacaaaggagagagatgctgccagctgagataatgcctaattttagctgatgctgctggacagactcaggatggtctcctctccctggccagaacccaacttagyacccctttaccagataaataatgatgcattagcaagagactcccggygtcttcttcccctgaaaaggggtttggaccttaggagaaatcgtgtcctaagcatwaagatgtggtaaaaatcctacttttctcaacagcaaacaagtcttctacttcccatggagaaacctgttactattgagtgatttttttaataagatactcagcctgagggtgggggcatttgaattacaaacatgggtcctaggactgatttctaataggagtggattcagatgattgaaatgcaacaggaaaatccctgcccccaaatatttattactggtaagaagtttctaccctacagatcaattccttttcatcttgaaagtctttctgtcttttagcatttttgttaaaacacagctctcccagacaggggtaaactctaagacattcatcaggtgatgaattatggacatagaccctgtatattccgtggagtcctataataacatacctgtcctatactggcagaacttactacattattttttcctcatgtctgtgacctcaccaggcagacagatttcctggagagcagataatatatcttatccatcttttcactcccaggtcctagcacagcacctgacacatgagaggtccttgatacacgtttctgaatgaatgactgacattaccagatgcatccaaatctaaaagtcaacttaactgagaatacagcacagatgctggaatatttgtggagaataggtctctatagtgaactgtataaggagccccagacttctgaatcttccattcttggccacaagaaacacagatggagataaggagagctgcttcaccagggaggaagtgaaagttccctgggagcgctatctacgtctttttttttttttaacaacatgtattttctctgtcctactgacaagccaaggctccttcttctatgactgtgatgactaagagaagtagtttcatctcattgctaatcaataaaattctcttcttgctaaagcatttggagtgggaattctaaagataaccctaggaacatctccttcaataaacygggggaattgatatagtcttcagggttgcctgtgcctgagataatggcaacttgattttctcaggtcacgtctcctcctgcaagaagcaaacagtgtttccttgcctaccacatgctaagggccaaggttgaggctgactgtatgagtgtggagtgttcccatagtgcacactgcaacagaactggaagccccaacctgggcagccctcaaccctggacagcccccatggctttccaagcctggggtgaggcaggactgtagctggtgggattctggtgccttggctgaaatggcccatctcctaaagcagaaggcatcagttcagcagaatgctttttgagaactgctagcatgctgtcaagatgcatatttgtcactgaggggtgtgtgggttcctccggcacttcttttcttggagctgttgcagcttctgtttaggtttagaaacaacagtaacaacaataactaatctttgttaagcatttactatgtgctaagcagagtattaagtgtttataaatgtatgagttcaccgagtgcttacaatagccctatgagaaagaaaggcacagtttaagggccacaccttagcagttctctcctcatttgagagtgatgttttataaaaaggtctcagcttttatgttttccatctcagagggtctccatgctcctggccccattgtctgatttgcctccctcttcatggctccctacgcctggcccttcatttccattgcagcaggtctgactgttgatgcgacctttgtctgtctgagtgccctgggctctggacttacagcacacaaaccagccccacctcatcctagcacccagctggtctctgaaacccctacctggggccagatgagtggttccacaggcttccagggtctgggattagagaatatagttgaatggaaacgtcaggtcctcttgctaaagcagatacttagcaatgggcaggtctcccagtgctaagtattaacgtgcttaagaagcacattaatatttcattttcatcatctgggggttctctccattttctgagatgttasagagtaaaatggggccataggtaatagagtcatttcttctttgaagagtcattattatcactcaaagttcatagttcacrttagggttcactcttcatgttgaacattctgtgggtacaatgcattttgacatgtatctaccattactgtatcacacagaatagtttcactgccytaaaaatcctctgtgctctacctccttctcccataacacctggcaaccactgatctttatactgtatccatagttttgccgttgccagaatgtcatagagttggaaccattaagtatgtaacctctttttaaattcaacctcctacttttcatctgttaattatcttctttgctagaccgttttcaaatacaatgcttggctcctgaggtatcttaagtaatcacattgtgagcaaagcctataggcttcccccagagtgagtgatccaagagagagcagggacgaggccacaatgccacaatgccacwcatgacctaatcatttctaccatattttatttgttagaagtgagtcactaaatctggtccatgctgacaggacgaggaattgggcttcacatttaaagggatgggtattgaagaatttgtggacatattttaaaaccactgaacttatgttgtatgtgcttctgcagtctggactcctgggaaagtagagattgagagataatgatagatacattgagagagagagaggtgattgtcttagtctgttttctgttgtttataaccttcttgctggtggggattctgcagtgtcccaaggcagcgcaggatatcacatggcaagggggctgagcatgttaatttgcaaaagtgcttactcaagtctctcttcctcttttataaagacacccgtttccctcccatgataacccattaatccattaacccattaattaatcaataaatggatttattcattcctgagggcagagccctcattatccagtcacctcttaaaagccctacctctcagtactgtcatagtacattggggattaagtttcaacatgagttttggaggagacattcaaaccatagcagtggtgtagtggagagaataatctatttagcagcataagacctggcttggtcactgctcaccagctggcaaattgcaactgctctgaatcttagttttctttatcagaattatttagtcaatcatgcctccctacaagctgccaagagccttatagagggctaaaggttatgtttgtgagccctatttgcacatcacaaaatactatgcaaactcaagctacttttattttacttaagtgggctgtacatgtggctgagggaaatattcatagcaaaatttttctgcacacagatgtcccctcttctctcacccagttgcccacccctttttcgtcatacagtacaggtctcagagctcytgcccaggttaatttctggatcaaatgccagggagaaattcataggatcaggtcttcttgttacatatcctttcccaacctcatcccaaaggcctaggtggaacattctatgcaagctgtaaccccttttcttgtagaaacgagttggaaacatctctaagatcaaatagacttgaattcagagagcagattcagcatttttttgtgctaacagatcgtttcatatatagccatatctccctattgttaagccttatttgattttccattttatttgcttacacggtatcaaattttcagctcaaacatcaaaatgatataaggccagatctgtgttgtgggatgctataattttcctccctttaaactcactaccattggttattgcattttaatttcctttaaagaatttttatgactaagtcatcaagcacaggaaaatatccaactcagagtcttgtgataagaactttaaatggtgtgtttgctctaagggatgctgtgatttccacccccacccatccaaatgtttttcatgttgggaagattcttggaagtgaaaagagtagacattccaatttcagggagtaatcagtgaaatcagctcattagtgtagccatctgagcaggcatcatctgaaatactctagatacacttaagaggaaagaaatgyatcttgctcactggaaatggattcttgcaaagttcatcataacctttatttctcaatgaggttttctgtatggctttctgtggtatgatgtctaaacaggacacaattttttcttgttgggttcttgatctgcctagcatttccagttttctggagtatgatgggccatagtagtttgagctcagattgttttcagggcaaatctacccttacaacacagttaggagatttgtgttgtctcagggtatcyaaaaactcttacagttgaatcagtttaaatcctctagaagatatttaataatagatgataaacattttttaaagtattggaggaagtaaagaaagtgagggattatcatggctcccaactggaaacattcatttcctacccaatctcctttcttttctatggcagagattgccaattattccaatattagagctctttttttatactctagaatctactgaaacatgcccctagtttttagctggatacatgatcacccaacatcacttacagctagatgtgccatgtgactaatttctgaatagtgggatgtaagcagaaatagagtctgtacctttcagaatgttttctagaaaagaggggtgcctgctcttctattctatccatcttccttatgactggaatggagatatgatgcctagagttggaacagccatcttgggccaggagattatgttaggaatagaaaccacgcatggtagagccttgaaataagaggagcctgggtgaacaccatggagaatgatgccagccctggcccattcatcaacctcatatgtccakctgaaagatggtccagctagcatctttaccctaccatgttgcctcttggagttttactcacaggagcaatgtcacctggtagttaagaatgcttgctttcaaagtcaggtaattttaggttgaaatcctggcttcaccaagtacaagctatattaccttgggcaaattgtttagcttttctgttatgattatgtattgccatataaagaattccccctgtattgtatactcataaattttggggtcaaaaatttagacaaggcatagcagggcaatttgtcacttttccaaaatgtctggggccttagctggaagttaaggttgagtaccaactcaacagctggaagatgagataatctaaaggctcattcactcacatgtttgggacctcagctgaggcttttggccagagcacttgcacgtgacctcttcttgaggcttggacttcttctacatggtgtttgtaatccaccagcaggtgtctggagagagagtcaagtggaaactgttattgcctttgataacccagctccagaagtcatacatctgccacatccgattcattgagacagccacacaggcccacacagtttctagggatgagagatagactccaactcttgatagggaagtgacaagtttcttgaagagcatgaatgattggaaattatttttagccaattttggaaaatagagtctgtcatactccttaaagcttctggttcctcatctccagatgaagataaccatatctactccataggcaagggtgacattagagatatttagccacaagtacaggatggtcactgaccaatcgcaacagtcgttggcattaacacttcagtcctgaatcatggaacagtcctggaagtggaaaggtaatggtagagtgtgtatgcatgagtgggagggggctgttactcagtgggktcagggcagtgagtatataccaaccagtaaagaaatacttctgtagtttaacaatctgctattgtgtagtakcagagtgtcagctttgctgctargatgattttgaggattaaatacgatattgcatataaggcacttggctcatggtaaatacagaacaaatggcaggtattacggctgtttttggtaattttccattctaacctgcagcatagaaattaaaatcttaaaaacataaggtcctaatrttttctctttcttttaacataaggacagactctacttcccaagagctaatacatcatgcagcagcaaaggtctttaatagaacaagtagatgacatttcaatggatagattattcttaagaaataaggagtcttggtttttatccctcttattggaaaccatgagtcaatrgcagtattgctttgtgtaagtctctttcaacagttatacaatgctttaaaaattcctagaagttttgatacaagttttcagctaattaatgtgataacagaatagaaacaagagtattacccaactgaaaatttcagaagggatttctgtggcttcatacagaagtgtgcattacacaatggaaccccatatcctaaaattaaaataggccaagaggtagagtcccaatctatagttcctcatagaatagtaacattttctaataatgaaattatgcttatagggcctgactcacgaacacatttcctggacataaatgagcttcccagagttggactggcagatatctgaattatctggaaaaaggctgatttatgctgaaggattttccacagtgctgggagggaggtgcctattttttgccatgccacatcagttgggaaaggtcagacagtgggttcactaataatggtgacaggagtgaagctaacttcaattttccacggcttcccaatgatggggctcagaaagtgatacctcaaagactggtgcttagacacgctgaggggccttagaagctgcctcagaaccaaggtccctctagccttgcctttttctttcccctgaagtgcagggaaagggctctctgtggaattcttatctgactgagaaaaacttcagaaagaattggccaggggcagtggctcacacatgtcatcctagcattttgggaggccaaggcaggtggatcacctgaggtcaggagttcaagaccagcctggccaacatgatgaaatcccatctctactaaaaataccaaaattagctgggtatggtggcacgtgcctgtaatcccagctactcaggaggctgaggcaggagaattgctttgaacccaggaggtggagcttgcagtgagccgagattgcaccactgcactccagcctgtgagacagagcaagactctctcaaaagaaaaaaaaaaaattgcaattgtcttaaacaccttccccaggaatctcatcaaataaccaggagagattaaccaccagagaagagaagaacctggaattatcaccacacccagmcagacttttcttctattctcctaagggcagctctgagagataacctgggggtctttttctgcataataaaataacctttgttcctgtgcagttcttcccctcaccttcccaaagagaattatttactagctattatccgagcattgggtctattcattgccccattttcctctctcctatgaagagggaatttaagcctcaaccatccagcccctctttgagttcatattttgtatgactcctatgcacacatgtgcatgtaatacattggttatgcctttcttgttaacctggttttgttgttgttgttgttatgtggtgttggctgcgagcctttgtgatggggaggaaagggatcacttcgtttctgcccctatagcaacagtctggaccagaattcatctcaggattctcctttcctcaaagtctctgagagtctccatcgctcttcttgatcccttttcaagtatttctgtggctgctgtaggctccagactccatctctgcagggtctgaacaggagctgctactgccatggtctcctctgttctaaggattaatcttaaagctatctcggtgaggacattattgctggggaagttcacayttagcggactgagaggagataggccctcccctccagtgttacatctcctgaattagcacagaaaggatgstatatagtctcaatttttaatcwccctctctctcaaggattggtataattccacttggagaaaagttggggtgcagctgagaggcatcaagcaggtgccccctagaaatgtctctcctcaccaagtttcaactggtttccagtatggcatcccagcatcttctctggcttctgggtatgytcctgatccccctggggaggttctctctgagaaactgggcttgacccctttctcctttgctcaggagtctgtcccagatataattcttcttcctctcccagctgttctttgtgttctaatgcaaataattgtcccatgggcaactctcactggaggctgtaaattgtgggatgggaacacacatctcccagatccttcactgtaacttgaaggccttcacttaatcctggtaattgcaagaggaggaattctaatttcaaagccagacatgyactatgcaagcaaatctcgttaaccctctggttaatgaaataacttagcaaatttaaatgtggtacatcacctagtggatcttaaaagatagcagatttgctcattttttaattcaccaaacacttagaaagtgcccaaaactacatgtaaggcactgaattgtgggaacacagggatacatagttccagacatgagggacttacaatttggcgagagacaagtgatgagattgtgacatctttgtatggtcaagttgcaatgggagcacagagtggggccacttgctcagtatgggttcaccgggggtctgcacccaaaactcagtgcacgaccctaaagtgagcagaaatttaaaatttgaagccttcttaggtggttaagaaaaagcatttcagaagtgatcactcrtgttttctctgtctccttaaattgaggatcaaagtttgggagagaaccttcagacacagwgaaaaaacctgaaagtctcttctcaaacttgtacagtgagctgttaggttggtagaaaggaaaactttggaagtgtttccaacttagcccaacaattgtggaaatttgatagtctgtgttttaaataattttttactttgaagatcaaggccggtgctactcaaatgtttttagactgcaaccacagtaagaaatacatgttgaaattgtatttcagtaaacatgtatattaaataattatttcaactggaagttgtttcacaaaacagtacttactcatactgtatgaatgcactttattttgkctctttctcttttcttcttcctccttcctccctccttctctctctccttgcttccttcctccctccttccttcccttcccttcccttcccttcccttcccttcccttctgttctcttcccttcccttcccttgctctacccctcttctttttctttccctatttcctttttctttctgtcatgttggttactactcagtaaattgatctaacagataactaatgtttttaaaacattgctctagaatactgagccaaaaacctcragttgtcagtcacccgcttccagcaggtgaatgactcataatgagatgctatcttcctatcttcagtcctgctcatcatgtctacagtaaaggcaattagagctcagaagtcaaggttggatcactggctgggtcacaacgactcacctggagcactgctctgctctgttctgcccaattgagtcaattaatttttctgcctgtggttgatgaggcttgcaggattggccaaagcaggaagttggtgttgctgtgtcatataattattttattctgtaatcctcagagcttacttggacataataagcctagatacttgggaattactttaaaatgtatttggagccatttttaggaaagttagcttcaaaatcaactcatgattataaagaatactctggtcatggtgaatacattttcatttcttgggttgagcttcaatagtggttagaaaagtcccactcagtgtgctgtagtggtggggttaacaagctctgaagtcaggctttggtgtcactaagcagtttgagcccccgcttgctcatctgttaaacggggataatgataatcctgctggcatgggagtgttgcaaggattagatgaaggcatgactataatgtgatgtgcttggtggctcatggtatgcacacagtggcagctgaggttcattgttgttatcattctgcacttctgcaaactcatttccttacttactttgctcaggtcaaccgtccttgctatggctatggagactcagttcagccgaatgtagattcttgagatattgagacttccttgtttagattcttttttttttatatactttaagttctagggtacatgtgcacaatgtgcaggttttttatatatgtatacatgtgccatgttggtgtgctgcacccattaacttatcatttacattaggtatatctcctaatgctatgccttccccctccccccaccccactgcaggccctagtgtgtgatgttccccttcctgtgtccaggtgttctcattgttcawttctcatctatgagtgagaacatgtggtgtttggttttctgtccttgcaatagtttgctcagaatgatggtttccagcttcatccatgtccttacaaaggacatgaactcatcctttttcatggctgcctagtattccatggtgtatatgtgccacattttcttaatccagtctatcattgatggacatttgggttggttccaagtctttgctattgtgaatagtgccgcaataaacatacgtgtacatgtgtctttatagcagcatgatttataatcctttgggtatatactgggtctaatcctttgggtatatactgggatggctgggtcaaatggtatttctagttctagatccttgaggaatcaccacactgtcttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcatatccttcgcccactttttgatggggttctttgtttttttcttgtaaatttgtatgagttctttgtagattctggatatcagccctttgtgaaatgagcagattgcaaaaattttctcccrttctttaggttgcctgttcactctgatggtagcttcttttgctgtgcagaagctctttaatgtaattatatcccatttgtcaattttggcccttgtttagattcttattggttcctccttcaggaccaccatccttaatttgttgaatgacaggaaagaaccttacattaataaggaagagaaactccccactgctgttcaggaggacacgcaagggaaagtgccaagttcaaacttcccacaaatatctttattcaaattttcctggggatgtcctccacctagtagacttgcycctaagtgagagagaccgagagaagactctcgcatctgcctgaatttggattaaagcctaatgataatgatttgtgatttggggaagaggaaaatgaggacaggtgggagttctatgaataatggaaatctcgagaacagtttttacaaacatttattgtacacctactgttcatgttgccctgtactaaaaaacacagatgtagacctccaggaactggccttctaactgggggttaaaatataatgatatatattgacatttaagaacaggctgggtgcagtgtctcacaccagtaatccctccactttgggaggccaaagttggggaattgcttgaggccaggagtctgagaccagcctgggcaacatagtgagatcctgtctctatttaaaaaataaaagtaaaataaaataaacatttaagagtaatccaggagaattcatgggccactgaacaatgtattccatgtctgttacttgatgcaatatgctatgasttctagacattctccaaacaggccctgtggaggaggaggaactgaagctgtcttcctaagttgtagactctaggtaagtgaacaggctggtgatacggtttagagtgtacggtttagaggagtgatcttgggagaaagagagtgtcaactgggatgaaccacaggatggatacttgaaagaagaagaaactgagcaggtagactgaggccagattgcacaagataaccaagatgtctgtttttaaagatcagatttgttatgttcctgcaacaagcctttcactagtgttactaacaagcagtgaaaggaccaggactggattaaggtcaactgataccctaagcacaacacaataatggtgccccttgcctcttctattgcttaaaacaaagggtctgttacacaactcagctgatgagttaaatgstagtcagacccagcccttgtgtttatattggatggaagtgaaactctcacaccatgagatggaaacaaatgagatatctgatgacaccttcatgccaaacttttaaactttagtcactcaccatgccaaagaaaatgttttttaaacaatgcagattaaagacaagcgtggcagataaggacaattacaagaacattctactgaaatcgagagtggcaatgaaagagtgaagggcatgaaacccatggggaaactccatgggcagaaaagaacaaggaaaagaagaaggaggcatgaatactttctagacttaggtagtgagtctgggataactggaagtggataattgtgagctccttgaagsccaggccattgtctcattcatctttttatcctcagtgtttgaaccaggatctgtcacacagagttcaaattaataagcgtgtattgaatgtctactatggccatcagtcagaggtgggaataaaaatataagtaagacctgggccttgcctttaagatgctcatggtctggtatgggagacaggtatgtgagaaagcaaaatatagtgtgatcaattgatataattgtataataatctattgtgttatatatactatataactatagattgagtaacgctacatgtataaaagttgagtttttataggagcaatataaaagctctttatcctgccctattcttcccaaggtggattgtttccagagctgacagatcacccacacttgtaggtaaagtgattgtcttaggaaaggatcagaatgaatgtagccaggctcatacaaatgagtacatttgctttcctctattaccatctatttcactttactttctctcctcacgggtggtcgggtgagcagagttctaagaccagaagcagaaaatgataggttgagtctctcttgcatcccaccaggggtgcctttctttagctttaaggactaggcaggcctggccttcagaggcttcctgggaatctttatccctcatgtcctgaccacatttacaccatggtgcttagcttgaatccctatcccaytggtaataatatgcttttagctttatagtctctctcagagcgcttgcatgaacatgatttygtttgaaactgacagtagcccttgctctgtgctttgtttttacagatgaggcaaatgtggctcagatccccagactataaaaggcctctgagctgaactagcctgtttgatttggctaagaagtcacagttgtttctcccccgagaaggggacatatatgcctataagcatataaatggattattttcaattttttcagagagaaaatagccttcatttttttctagtgctataaaatccaaaatgcccaagcaagttcgtgtgtgtgtgtgtgtgtgtgtgtgtgtgtgtgtgtgtgtgtgttctataaactgtttattaggtaacaaaacccctcaataaatgtcaaaagtagaaatattaaataccgtttttcttaaaaggcaataacatcagacattaacaataataaaaagagaaaaataacccaccactaaaccaggaatttaaaaacgttatctttggaactacagagcaaataactgaaattgtaataatatcaagaaaataacaacaatgaaaagtctttatttccccaatctgtgatttagactttgccaaatcattactgagagaaaaattagaaatcaatccagtgttatattaggtagctgttgatacaagtttgataattaatatggaaaaataaaacaaaaagatgtaaaaatgcatgtcaatttagtcctaattgagggtcactgatagtagaaataatctttccaattgtgttagatcttttctctaaagattgccaacagttctacagaagtgaacaagttttcatatacaaaaatatttccatagcatagagaaataaagttaattcaataagcaaatatgaatgcttataggtaatggaataaaggtggtcacataacacagactttttttattatactttaagttttagggtacatgtgcacagatttttaaagaaaattccaacttataatgattaaaaattacatagctgattatatrtacatgtgtagctaaatctattttttacatgaattttgcttcaataaaataatttgttaagcataccactgaatgtgactcataggtcagaaaatgatttgtcctyagactttatgtactaatttttagttctgaaaaatgtagtcatcatatgtaaaagaaaaaatatattagcttttgaattagactgtccttaaggtagactggcccaaaattgacttcaagtggaccagattggtacaatgcagggctatatctgcagaatgtggcagaactcagatggtgaacaactggggtgctactgtcagggcaagactctgtaaaaccagcatgatgctggccattgagccattcctttctgccagtccttgccaaggtagattgcttccagttttgagagactggttagacttacaggtgtaaagtgatagtgaccacagctataaaaacaaaggaagtrccaggacaaggagttaagtagatcattacaatagggacatttgtccatcatactgaagagccccaggctgctagtttttttttttttaactgttagaattttaaacttgtttttatacttttacgcaagttcataaaattgtgagaattatgtgtgatatgaaagtaaattggtgccrggcacagtggctcacgcctgtaatcccagcactttgggagtctgaggcacgcagattacaaggtcaggagttcaagaccagcctgaccaacatggtgaaatcctgtctctcctaaaaataccaaaaacattagccaagcgtggtggtgcatgcctgtgatcccagctactcaggaggctgaggcaggataattgcttgaatctgggaggctgaggttgcagtgagctgagatcacrccactgcactttagcctgggcaacagagggagactctgtctcaaaaaaaaaaaaatgtaaattggctctgagtgatggtatagaagttacttacaatgaagaagattgcaaatttcaaggcataaaccacagaaygtctcttctggacattgtgagggcatttcaaaataaaatttcctttctgcttttgataagttatttctgagtagatgtaatattattataaataattgtgaatacacatggggcacaggatgcatggaaagcttcaggttttttttaatatctatcagtggatgcrttttcttggcattcacagaaggcaggaggaggcggatgtctcacagatgcatgggacactgaggcacagctatgttaaatgttatctkgtactaaagcctctagaatagatgccccttaaagtaaagctactgcatgaaaaccatactgttattaaaaactatgtgatatggtttggctgtgtccccactcaaatctcatcttgaattgtagctcccccaattcccacgtggagctggtgggaggtaattgaaccatgggggcaggtttttcccatgccgttcttgtgacagtgcataaaactcatgaaatctgatggttttataaaggagagttccccttcatatgccctcttgcctgctgccatataagaagtcccttaactcctccttcctcttccgccataattgtgaggcctccccagccatgtggaactgtgagtctactaaawcctctttttctttataaattacscagtmtcagatatgtcttkattagtagcatgagaatggattaatacagtaaattggtattgggtagtggggcactgctgtaaagatacctgaaaatgtggaagcgactatggaacaggcagaggttggaagggtttggagggctcagaagacaggaagatgtggaaacgtttggaacttcctagagacttgttgaatggctttgaccaaaatgctgatagtgatatggacaataaagtccaggctgaggtggtctcagatgcagatgagaaacttgctgggaactagaataaagatgactcttgcaatgttttagcaaagagactggcagcattttgcccctgccctagagatttgtggaactttgaatttgagagacgtgatttggggcatctgctggaagaaatttctaagcagcaaagtgttcaagaggtgacttgggtgctgttaaaagcattcagtcttatgtattcacaaagatatggtttggaattggaacatatgtttaaaaaggaagcagagcataaaagtttggaaaatttgcagcctgacaatgtgatagaaaagaaaaacccattttctgaggagaaattcaagttggctgcagaagtttgcataagtaacaaggagtcaagtgttaattgccaagacaatggggaaaatgtctccaggatatgtcagagatcttcctgtggcagcccctcccatcacaggcctggaggcctaggaggaaaaaatggttttgtgggcttggtccagggcccttctgctctgtgcagcctagggacttggtgccctgaataccagttgctcaagctgtggccaaaaggggccaagatacagcttgggccatggtttcatagggtgtaagcctcaagccttggcagcttccacatggtgttgagtctgtgggtgcatagaagtcaagatttgaggtttaggaacctctgcttagatttcagaggatgtatggaaatgcctggatgtccaggcagaagtttgctgcaggggcagggccctcatgcagaacccctggtaggacagtgcagaaggaaaatgtggggtgtgagcactgcctagtggagctgtgagaagagggccaccattctccagaccccagaatggtatatctactgacagcttgcatcatgcatgtggaaaagctgcagacaatgccagcttgtgaaagcagccagaagggaggctgtaacctgcaaagccacaggagcaaagctgcccacaaccatgggagtccacctcttgcatcagtttgacctggatgtgagacatggagtcaacagagatcatttcagagctctaagatttggctgccctgctggatttcagatttgcatggggcctctagccccttcattttagccaatttctcccatttggaatgtgtgtatttacccaatgtctgtaccccccattgtatctgggaagtaactaacttgcttttgattttacaggctcataggcagaagagacttgccttgtctcagatgagactttggactgtggatttttgaattaatgctgaaatgagttaaaactttggaggactgttgggaaggcatgattggttttgaaatcaggggtgggatgatatggtttcgccatgtccccatccaaatctcgtcttgaattgtagctcccgtaattctcatgtgtcatgggagggacctggtgggaggtaattaaatcatgggggctggtttttcccatgcagttcccatgatagtgaataagtcttgtgagatctgatggttttataaaagggagttcccctgcacatgccctcttgcctgctgccatgtaagatgtgacttgctcctccttcacctcctgccatgatcgtgaggcctccccagccatgtggaactgtgagtccattaaacctctttttctttataaattacccagtctcaggtatgtctttattagcagcatgataacagactaatacactatgcatgccaaattttatttgattcaggtattttgggccagaaaacaagacaacaaatgaccaaaaagcttctattttgggagactcaaccaatcagtcaaggtcttcagtgcatatgacttctctaaagggccaataatcctcttctattgagatcttttggagaattccatggaaaggtgtatgcataggtgggaagctctttttcatgatttggatgaaaatatgcttgattataataaatagttaaaaatattttasccaggtgtggtggctcatgcctgtaatcccagcactttggaaggccgaggcaggtagatcacttgakgtcaggagttcgagaccagcctgtccaacatggtgaaaccctgtctctactaaaaataaaaaaaaattagccaggtgtggtggcatgtacctgtaatcccagctactcaggaggctgaggcaggagaattgcttgaacctgggaggcgaaggttgcagtgagctgtgatcgcgccactgcactccagcctgggtgacagagcaggactccatcttaaaaaaataataattttaagtagctttgggtcaaaagatataactggctagagtatagtgaatatatcactttggaggagaaggaactaggtcagcatttcttacactaatttcctctacataacagtgttccatgagatgatacctggcattcactgaaaaataagagtgggatcccttgggcaggttttgagaaaaatctcttagagatttatagtgcacaccaaaacagtaaagcttctgagaagtcctgtagatgtgtatttagttcatgcattcaatcaacaatacttattgtatacctattatgtgccagcactgtttaggtatgataaacttaaacatagcatttgtgccactttcttgaccatgaaatcatggtttwtgtaatatgctaacactacttgttgcaaagagtggcatttgggagatgttggctaggtcttcctgatcttttgttagcatttggccgtctaggatagatgccccttaaagtaaagctactgcatgaaaaccataccaatattaaaaactatgggtaccaacttttatttgattcacatatttggggccataaaacaacacracaaatggccaaaaagctgattttctcctcccagagaagaggagccttctttagggagctgagttgtggtgttggagctgatcagtaacactgggtaggatttgcccataggctataaaatataaaaccaaagatgagacagcaaatgaactagggctgaaacaaaaaacaaaacctgcatctcaggacaactgagtaatccacccagagactgtgggaaaactctaggtttgggggaaaagaatggcgttttaggaagcagaattggagagggagggggctcaaatcaagtgtgatgtgagagaagcctagaaagttctcaaaatctttgatgcctggttatcagcatttttacarggtgctggtgaccttggccatggtggctaggggactatcaaggacagatgtgatagctaagataatgtgtccactcatatgaactcctgtattttactagtgatctttattctgttaaactggccaattgcttcatggcagccattttgaaaaatgacaactgcagagaaagtcctagaatgagttttacatagttttgaagcacaagcaagcttcacgattctccaaatagcttttgacacagaggatagtagttgagggaagagagtgtgcaaaacgggttaaggcaggggtcctcagtgcaggggcccccacctttgggctgtgggctggtaccagtccatggcctgttaggaactgggctgcacaggaggtggtgagcagtgccagtaagaattaccgcctgagctytgcctcctgtcagatcagcagatcacaggagtgtgaactctactgtaaaatgcatatgtgagggatctaggctgtgcactccttaagagamtctaactcatgcctgatgatcttcggtggaacagtttcatcccaaaaccatccctgcctgccacccctgtggaaaaattgtcttccatcaaaccaatccctggtgccaaaaaggttgggaccactaggttaggtgactgagtggctagttaagtacattttctcatttttcctctgtggatttaaaaagatcttgctcaccatttttcacataactttttatatatttaatgacacttaacaagtgatctcctcccaaaagccccatcagcctctgtgggcttttcttcttcaacccgtttctccagatgaaaaaagaatccaattactgtagctttcctagttaatggtcaatttctcagcccatttatcattttcattgattaccaaaagagactctcggtttatgaactcattttcaggagccagacttagtcaaggctggtccatgctagtgcatgctagtctcatatgcatcaatcaatactattctcctgactgggcacagtggctcacccctgtaatcctaacactttgagaagctgcagcaggaggatcacttgagcccgggagttcaagggcagcctggaaaacatagcaagaccctgactctacaaaaaacttytaaaaattagccaggtgtggtggtgtgtgcctctagtcccagctactcaggaggctgaggtaggaggattgcttgagcccaggaatctgatgctgcattgaactattattgtgccactgcactccagcctgagcaacagtgagaccctgtctttagaaaataaacaaaaataaaaataaatgctgtcttctcaaagtccagtgcctgagtaaacctcaaacctagacacttgagttgtggtattcagagatggggagacatgcttccatggaaggatttttattgtgtacgtggtttgtaaaataactgcttgtttcttgatgatgagatgtgctcatcattcctgtgtgtataattcaatacatggttaatatttacacgtgtcaagttttcatcagtcttttcaaaatggcctttcaaaggtaaagactaatgggaacttttgaacactcgagcctcatttcttcctgaagaccctctgaggatgaagccatgtgcaggcagaaacagagggctctgtctggcccagagacctgcctcatgaaacccttgttcctgaacagcaagaggaaatcccgctccccttggctccactcacagagccayagttcacatttgtggtagttttagtttccctctttgtgaggtaagcagctttctcccaaccaaccccatgtcagcgccccttctttattttggcttccagaatgagtgttggagtcctgctgtcactgagggcagggcctggacttcctgccggcccctccccacacaggatgagctcacaggccttcccctattgtgtttccctcactattactgctgaaccttgtggagttcacaccattcttttaaaaccattctttttgaggaatgagactctgtcagggtgagttgtttgcggaagtaatgctgtttcaatgttttagtgttgctgttgataccaccctggagtccaagagaaagtgaaagttcatgtttactcttttatgggaaacatccacctccctcctcacacttcttcctcaaaggtctggctttggttccctctggtgttcactatagcaagtgggccagatggagcttctgttggttggctatgaaatggaaggcttggttttttgcaagacatgtgatcgacggagccatgttgaagtctttaaaacatagcccagttggatcccataacttaccagtcacgcctgggacaatcacaatttccagcttccattcacatcaaagctctgtccctcctccccaggcaagctagagtgctcagcggaggcctatctgaggaggtgacggcaagcccaagggccagctcattttttttttttttttttttgaatcagtctcaccgtagcccaagctggagtgcagtggtgcaatcttggctcactacaacctccagccccagggctcaagtgattctcgtgcttcagcatccctagtagctgggactacaggtacgtgccaccacacctggctaactcttttgtgttttagtgttgcccagggtggtctcaaactcctgagctcaggtgatctgcctgcctcggtcttccaaagcgctgggattacaggcgtgagccacttcgcctggctgggccagttcatttttatactcgaatcatgaccatggaatgctgagtcagacacacttttgcttacataaaacccaacactggcttctgctgtcctcataagtacaacttctaacttggtttacaagcccttggtgaccttgcccatccttgtcctgccagcctcctttctccacattccatwgccatcctatcactcacattcttcacagcattccctaattaaaagctgaggatttcttcacaaaccaagacctctgcatgtgttcctctctctgactcaaatcctctttcgcccagttctccttcctcttcttcattctgcttgtttaaactccattcatgttttaaatctcagatttcctccagaaagtctttcctggccccccagactaagctaggtttcctagccctataatcattagtctttgttgtgattgcctgtgtccccattggaccatcaattctgtaaagcaggggaccatatttgccatatttaccacttgatctctggcactgagcacaatgcctggcacatattgtatgcttaataaatatgggatgagtgatggttttaaagtggctgtgggtccctgaaagcagtagcagagttagaaggcttttcagaccaggttccttgtattgcaggggcatgaagtaggctgatgctgacatggctgggacccagaaacatcagcacaaaggagatgagtctgtctgttctttgacagcaggaagtagctgcaaaaatgtgctgcaaggcaaggagtggtgtgtgtgcagcccaggctcagagatggcaggcttgaggcctctgtccagattccacaggcctgccttgctcagggccagttggagtgctttgcctgatagaccccagaggggacttttgactcgacatttcatgagggccctgtatctaatccgcagatctgtctcaacccatctgttgaagtttctccactcaaatgtcagtcctaattggagattggtgatttgttccctcaaagtcaggcaaaggccaaaaggggctgcaggacttggcgagagaggagtggcgagggctcagctggagggtgggggctatttgcttggcccccattgtgtctccaagggcttttctgkatgacttgggagatgctgggaaatcactctcccaggctgactgaaggctgggagaaaacagcrgagaacaaactcctctctagtttgttgcctgggctgccactgaccccatttctgctctctgcctcaagatcaggccttgtgtggcatgctgggtggtgaagagggtatcctgacaggtatgtgggagaagggctggtgccttgcagtggacccgaggcctggcagcttccagtgggcccacattctactccccatttagtaagacagacaggttagtggtcaacagtgtggacactgaagctgggccgtcagggtttgaatctcagccctgccatttatgcctggctatgcaatcctaggcaagctacttaaaagttctttgcctctctttcttcctttgtacgtatctcatagtttcaaagtccttagaatactgtaaatatttacaatactgaagcagcattttcatctataaaatgagaggattggactcaatgaactcgaagaacccttttgatgtaaaactcacaacctgcctgggttcaaatcctgacttcaccacagaccagctggtagttctcaaggttagggactgtacttgtacctggctcaattctggtgtgaccaaagtacctgagacagcacctggcacataataggtactcagaaaatgttgttgttattgttggtcggttttttagaaacggggtctcaccctgttgcccaggctggagttcggtgatatgatcatagttcaatggaacctccaacccctgggctcaggagattttcctgcttcagtttcctgagtagctgggactacaccaccatgccaggcacacaccaccatgcctggctaatttttatttttatttttgtagagacagggtsttgctatgctgcttaggcttatctcaaactcctgacccgaagtggtcttcctgccttggccttcaaagtgctgggattacasgtgtgaaccactgctactggctggtctctaatcaggaaattttgaatgggtggtgcatggatgagaatcccatgaagaggtataaataactgttatgaagcaatgaatacgggcttgcctcggcccaggggccaaagccttcaggaagaagaaaagaccgcccccatcttaacagatggatttgtggtcttgaggagcaccaaagccctgaagaaaaggggggaaactagggtttgggagaccaagagtagaggaatatgcagaggaagtcaccatacactatggcctgccctcctgagcaggaatgcttgcttcctgctgacctggaaaccagctgtccagcagaatggaaaaacaggtggacttagacccaaagacctgagtatgaatccagcccygctcttctctactgtgtgccatggcacagagcacacacacgccatgccagacaattgattttaatcaactttatctagttgataaagtacttacaatattgagagaatgaatgggagcatcactaaataccttctcaggatgccaaatttcatcttttgacatgaaaatgtttagttttcaaagtcgttttaacataccttcccatacacagaatgcccctgcagggcaggaacctttcttatgcccattttggagatttgattcagagcaattgctcaagatctgctggctagtttgaactcaggtctttggactgcaaatttttctttcccctctgcctcctagtatgcggcatgaatctccagactaawgtgagaccttttagatggctgaataaggaagaaacctggagaacatacatgtgggttagaagtcattatggctccgagatcgcaggctgatgccattgttactgggaactggagacagagctgaaggacccagggagccggccggcccagctattaacacctcagggagctcagcttgtgcatggatgaggcatccaggaaggcaagacaaggtagatgccaggctcataagagggaaattcttctaaagaagggaaagcactggagggaaataagtgtaattgcttctcatttgagatattcagcaatgtctgatgtatatctccagggaggatactttcagtttaggggrggatttgagaacttggtttggggattctaagcctagcatgaacagtgaagaaaatcttttatgcctctgtacagaatcatcaccaagcaactttcaggcacatattcattcattctcaactctgagtacttactatgtgccaaacacagtcctgggccctttggggtggtacaaagttgattcagctattgtctctaatcttgaggaactcctggaggcttagtcatgtggtcagggtttgaacccagacaatctgactctgtgctgtaaattagcatcatgctacctctgttagaaaacacacccaactcggcctggaggaatccagaaaggcctctaagaaggagtatcagctttgagtggagttgaattgaattcagcaaatggatgagaagggaaggatgttctagggaaggacaatgtgttgaaaggctaaaagttgtaaggagagaaaggcatattcaaggaaatgcaaataatgtggaatgacataagattaatgataataatagaaagagggtagaatgtgtgtaggaagtagaaggagaggaggctggagactcgagaagggcccagtttaaagcactttaaactccatgctcagtattttgtctcagtggcattgaaaagtgatggatgtgttttgggcagagcagtgacatggccagcactgtgacatgggacattgtgtgcaggagcttcctctagggcagtggttcccaagcccagtcatttacttcctggagtaaccattttttcttctttgaatccactccttctccagccttcttcatctcagtaaatggtacctacaaatgtctgcgtctcaggtcaaaaatctaagggtcatccttgatttctgctcttcctgtaccatgtacatccaatccatcagtatggtctctcagatggctcctgagcccatttgcttctctccatatccatcatctctggcctggacaactgtgtctgcttcctactcaggaaggagtcttcctgcctccctgcaatctaatctycacacagaagccaggggatctttggaaaaatctgatactgtctgtgataaagaataacttgaggaggtatgcatgggacacagagcacagagccagattgtctgggttgaaatcctgatgacaccattaagaagccaggagttcctttttaaaaacaaaaacttttttttttttttctgagacagggttttgctctgctgctcaggctgaagtgcagtggcatgatcatagctcactgaagccttgacttcttgggctcaaatgatcctcccactgcagccgtctgagtagctgggactataggcatgcagcaccaaacctggctaatttttaaatcttttrtaragaagtggtcttgctacattgcccaggctgscctccagtgaaccttctgcctaggtctccctaggtgttaggattataggcgtagccacygcacctggctgtccccttcttaaacccctttcagcagctcttggaatttcattgcccatggaatacaatccaaactccttacgatggccacgcgagtcctggctgcctcttcagccatctcaggccagtccactcgttcccttgtcagcaggctctagccaacaggccttctgaccctttctagaacttgccaagctctctgtgactcaagactttgcacttcctatttccagcccttccctgagcagttctatgacctgcttgctccttctccactttccagcttaaatatcgttttcatggaggctatctgcagacctcctcaggttatttcttatcacagcaccctgtgactttccttcatagcttattttatagaaacctattttttttttgagatggagtcttgcttttgttgcccagcctagagtgcaatggcatgatctcggctcactgcaacctccgcctcctgggttcaagagattctcctgcctcagcctcctgagtagctaggattataggagcccaccaacatgccaggctaagttttgtattttttttagtagggacgggttttcaccatgttggccagggtggtcttgaactcctgacctgaggtgatcgacccaccttggcctcccaaagtgctgggattataggcgtgagccacctcatccagcctaaaaaaatctttatagtctgaatttggtctttctgctyagctatttgatgtctgtcttgtcctggaagaatgtcagcatgccagtctttctactgtggtggcccccaagcctagaacggggctggagtgtgtaggcattcgagaaatatttgtagaatgaatgaataaatgagtgcaatttaatcctccagagcacgaatttttttcttaagttatccctctcattttaataagggaagagatgctgagtggaagaaaaagcccacacaacgatggtttattccctttagtcttgtctttttcctttgcgagacttcactttctggttatgaagatgaatgtctgacacgctttttttcccccaagatgctctttcagagtactgactggttgaaacctgtggcgacagctttcatcgagtccaagaggtgttgcatgctcctgctggttagaaaacagcactgtgtcacagtaggggaacagaaacaaaaccagaccatgcttgagtgcaagctgcagcatggaagggacttgagagagcatctcaggcccagcccccttgctgtataaatgaggaaactgaagctttgcgaggccaaggaaacagaacccattctctttttcctgactccccttacccatcacaccccacccctcaccttcccactcccagtgagagcctggatctgagttgactggtgatactgtcattctcttgtccattcctcatcaaggtttgttctgatggggccatgaaaggctgtgttgtcaatagcctgtgtgaccttcttcagcacttagggatgtgtcttacatctctgaataacctcgacaattctaattttggttatgccttgcatgaatttagtgaaactttatgggaagcttatttttattctcacccctaattgtgtcctaygggttaatgaggttcctcattttactacttattttgtagcagtagaactttacttatcttcaattaacttcttgtaaaatctaaggcaggaaccaccacaagcaacttgcgagtcttatttggctcaactgtctcagggcaagtgtcctctgttgaactcccacaactaatttgaactaattggtaacactaacaattgggcagttttccataataatttgagattatgtcttctcttgggaaataagaaaacctgggacagtgatcctttgtggcaacagttagctggaactgagtagttgcatgcatcagcatttcactgccccatttagacctggggaacacccagtttaacacagtcatcamcactcctcattgctttacatgcagctgggtccactcagttactttatttccccagctcctgaaaatattttgagttcgtatccctgaaatatccttccaaagcattctggaacttgagatctgtgatccatgatcacatttatgatctatagatttttagtatagtattcttcagacttggtcttcctcatgtgacacccagcttcagagaccagggctggctgctctccactgggggcatgatcctcaagtgcttcctttagaacaactatgaaatttaaaacaaagttagtccagagggattttggaagcaggatgcagaatgcggaagaaactcaagataaggtgtaacaaccaagttaggaagggtgcaggtgaaagttcagagaatcctactaagcggtcagtcatttaactaatatstattaaggttttactatattccaggcacaaagtgctaaaaatataggtggctactgccacccattccctatcattaccgtctgtttctgctcctcctactcttctgaagtttctgtctcaacggtcattaacaatctctgctgtggactgaatttctcccctctcccaaattcatatattgaaggcctaatctcaaatgtgatgacatttaaagatggggctaggaaacaattaaatttacgtgaggtcatgaggaggaggcactcatgatgatattagtgcccatataagaagagaaactagacagcttactccctccaccatgtgtggacacagcaaaaagatggctgtcttcctgtgaagctgggaagagggccctcactagaacttgaccatgctggcaccctgattttagattttcagcttccagagtggtgggaaaataaatttctgttgtttaagccacccagccaatggcattttgttatggaagttcaagcagactaatacagtctcctaatggacagatcctgtggtcttaatcatatgtggattctctgtagcctctgaaagggaagacatactctactgcttcactcatatcccttagcattaatgggacattctcctcttatatcttaggctgcttctaaacttccttaacttaatcatgtctgcaaagtcatgtwatctaaacaaggtaacattaatttggttccaaggattaggacctagtatctttttggagacattattcagcctgctacagactgctattgattttggtgtgctaaccttgaattcagcaacatttgtctgaagagtccactttatatagacaattatttcacaagcaaattacaattttgtgtttgctgactcaaaaaatttctattctttctcctttgccttctgtctctcctctccctttagatcctcttccccttcctcctccttctatttttggtctaattttcttaattttgaatgatttctttttttgtatttataacaactttttgagacataattcacatactgtaccattgacccatgtcaattgtaaaattaaatgtctttagtgtaagtacacagctattcaaccatcatcacaatcaattttagaacattttcatcaccccataaaaaactgcatatgccttaggtgtcaaccctcagtccttcttctccaagccgtaagcaaccactaatctgttttttgtctttatagatttgcctattctggaatttcttataaatgagatgatataatatgtggccttttgtatctggcctctttcacttcttgtgttttcaaggttcatccatgttgttgcatgcatcagcacttcacttcttttttattgtagtaaaatataaataacctaatgtttatcatttttaaccatttgtaagtgtacaattcagtagcattaaatacattcacaatgttttatgactgttactgctatctatactcaaaacttttttmttgtcctccccaaaaactytgtagccattttataagtctctcttcccctaccctccagccatataagttgattcatatagtatttgtttttctgtgtttggtttatttaactaagcatartgttttcaaggtccctccatgttgtagcatatgtcaacatttcattcctctttatagctgaataatagtccattgtatgtatgtaccatatagctgaatgtatagtccattgtatgtatataccacattttggcagtttattatctgttgatggatatttgggttggttccaccttttggctattatgaataatgctgctatgaacatcagtatacaaatatctgagtctctgctattttactgagttattttcagttccctaggagtggaatcgctgagtcatatggtaggtctatatttactctcttgaaaaaccagcctgggcaatacagtaaaacctcatctctacaatagatacaataaaatataaaaaccatcaccaccaaactgttgtctacagtgaccacacttttatattcccaccagcaaagtacaagggttctagtttcttcacattcctgtcaatatttgttactttctgtatttaaaaaaattatagccatcctagtagatgtgaagtagtatcttattgtggttttgatttgcttttactttatgactaatgatgttgagcatcttttaatgtgcttattggtcatttggagaaatgagttttaggagttccttgtatattctggatagaaatctcttatcggatctattatttgcaaatattttctcccattctgtaaattgtcttttcacttcctttgatgcactaaagttcttaattttgatgaagaccaattcatagttttttcttttgttgtctatgctttttgtattatatccatgaagttgtggccaaatcatgtcatcttattgccaaataacattctattaaacagatataccacattttatttattaatttatcactttatggacatttgggtgtttctaccttttggttattttgaataatgctgttataaacattcatgtattcatgttgttgtatggacatatgtttttatttctcttggatatatacctaaaataaaattactgggtcttatggtaactgtctgaggaactgctaggctgttttccaaagtggctgcaccatttcacattctcatcatcagtgtacgagggttcccacttctctgcattctcaccaacacttgttattatctgacctttgagcatagccatcctagtgagtctggaggagtgtctcattgtactgatatttatgtgcatatgttttattttgtttattaatacacaagggttagcttgtatttacagggctttatttacatttccttagtgactaatgatgttaagtgtcttttcatttgcttattggctatatcttatttgaagaaatatctattcagatcttttacccattttttaaattgggttgtctttttgttattgagtagtaatagttctttatatatgtgaaaataagtaatccaaaatctaagctattggaactctaaattattttaagcctgaaaggaatgtgattatgaagcctgagtcacatgacaggcagctataaccttggcagctatatcttaggaagctataaactttgtttctctgattatagattagccttcttccttacctgcattgttttgtaaagtattgtaagtaactgaaaggtgccagggaaggcctcttctctcttcactgttgatcttcattataaattaacttccctctttctcacacaaagacttcatagctatcacattgtattaagatggaatgttaaatatactcttttaaattggaaagaagatcaaaacaaaccatgcagaaagaaaacagactataactaattaaattgttgtaactcacaaaccagctttgtatagaaaatgctataatcttgttaaatttctttgtttcatgcctatataagcaagaagttaacttttaagttgggaacattaaccccatttctctggagtctgtgacttctgcatggccattcccagctttttgcttgaataaactcttcaaaactgaattctgatcctttcaattatatcagattgacatatattttagatgcaagtttcttattagatatatgatttgccaacatttttgtgaaagtgttttttaatgtatttgttttgcttcttgaattttcaataatttcttcagtgagcatggattttattttaaaatttaaaaatctgtttattaatttttaaatatatatttccttgtaaaaataatgcttgttcaaaagcttttaaaaataagaaaatgtagacattttagaaagttcttgcccaacttctagaacatacatttattaatttaaaaaatagtattatataaaaaaatatataggtatgatttatatatttatatgcatgtatacttaaacacatgattgtatgatttacacacctaccctcctcaaatttcactgaagcaatagcacagatacagctccaaagagatcaaaatatgaaagcaaatcctgaaaaaggtaatgaacgataaaacataaagagagaaagccctatcaagttcttaagaaatgatggtaccagttacccaggaaggtgagggtctaaagcacatgtgttgaaagagctgaccatctctgcttccttccgggcttcagtcaagagttaattcttctgagaaatgaaccagggaggctccaaacttggaaataccagacaargaaatttctccgggatacaytgggaagtgaaacaaacaaacatgttatagatacacatgagcaaatctcttgtatattaacaaacaaaacaaaacatatgtacataaatataaatgtgaatgcatacagaaagtgtggaaagatacacccagaatctgtagccacattatagtttttcaggacttggttctggggctcttctgttctctaaattctctccctggatgatttgatccaattctgtggctttaaatgctgaagactccccaattttttcttctttgggtgcagctccaactctgactcagcataaaccaacgaggggactgcattctgcaaccacagtggttggtttagggatggggatctgacctaggggatatgagtccatggaccggatgggsatatgagcccatgacccaggggatatgagcccatggaccagatggaactttgaggcacaccctttttcaggtagctttgaacctgagaggaagacaggtcttgtagcattcttgctgttgactgcatcagttcacacggccaccaactgttactaatcctgggtatcaacaattatcccaatgtgttagaagaatatatgctagtttacattgtgtttattgttagtgagattaagcatctttgtctattaactttgttttgtcatttgtaaattgaattgttaatcagtttctaattgataactaaggttttaagacattgtgaataaaatacctttgttatatgtgctacaaatatatgtaatgtgcggttgtaaataacttttttctaattattttaatgctgttattgatactgactgtgtcctgggacagtcactaatctactaaacctataaatttacatgggaataaaagagcgtaatagactctttcctagtgtttattcccctagcagtgtttcccagtgccggcttagtgtacatcggtaaaatatgaaaattctcctcyactgaccattaaaattatgaaagcacagactaaattcttattaacattttaaacaaatggagcaaaatatttgtacacttctttcctctttttttcactgaaaacacaaattgcattgaaaacactgacttaccatataatttaccttattaattaagaataattggagtttgtatcttaagagtccatttagtgctaagtttttgtggtctctttgagttccatggaccagcagttaggaaatgtagattcatctgactagtaaataatataataagaatgagtagaagactagtcaacttttataagcatcaatataatgtgtgaggcatcgttctaagtgtgctacacacattatatcttttatttcttaaaacaaccccatgaggcaaatactatcattatccctattttccagatgaaggagcaggcacagtgaggttaattagcttattcaagctcacatggctacttgaacttagataatctgtgttcactggcactttaaacaactatgcgttcttagtgctttcttttcttttcttttggtttgtttgtcttaaccttgattttatcatttaaccccatatggtgtatatctgagtttgtgttatatagcatgacagtgggaatgtatactgagttctccaaatggggttggcccatctttctttttaagatattgagaatcatttaaaatactctgtagagccttatgcagccctagcaagaactgaagtcaaattctggaataattgtaattttgacctatacctagaatatgatattcactgagtttgtctttatcaaactggtggtcggttggttcagatgaccagaaaggcaaatccaagcagtcttggcaagtttatggggctccaaagtgtcactttagggaatgttggccattgcctggagtcagttgagctagtaggctggcctgggcagtacaggcttacaagaacctggctacaagaggtgaagggaagcactagaagaatccaggtgaagggccctctgattcttggatgcccagctgggggagagtggtgctttgtcagtaggcctgcggtccagcacagtgggggcacgatagctcaggaggtggaggtaggatgggcctgaggagttcccggacatgtatttgggaagcatagtggccactgagtcattctgagtagatctgtgattattttatagggcacaattctacatctggaagaagaaacactactctcaatctgctgctttcactcccttgctctaccctagtgctagtaagaaaagttcctggccaatagggaaccccaaaacaatgatgtttaaaaatattaataaaaactgacatctactgagctcatagtataggttaggtatgattataaggcctttcacatgtaccaattttctgagacaggtattgtaatcctcttcctcattgtataagtagggcaggtgaggtaaaggagcttatgaaaattgcccaaggtcatacagcatgtaaaaggggtaagggttggtggggaaagaattcgatctgcgagaatttggctccagatgctgcacatcaagctattctgctatattgccttcttgatattttaataaaatgaattttctctctgggtttaagaggagcattaaatactaaatttactaccattcctttttgttttgttttgttttgttttgagacaaagtctcgctctatcacccaggctggagtgcaatggcactatctcgactcactgcaacctctgcttcccaggttcaagtgatgctcctgccttagcctcccgggtagctgggattacaggcgcctgccaccatgcccagctaatttagtagagacagagtttcaccacgttggccaggctggtctcaaactcctgaccacaggtgatccaaccacctcggcctcccaaagtgctgggattacaagcttgagccaccgcacccagcctaaatttgctacattccttagaataaaatatcagtctcaaaacagtagtttcagccccacagatttgtctcagaagtctaattgtacacattcctatgtgaggctgtcatttgtctgaaagtcttcaactttagattttcttgggctgaggaagggcttaggtctcagcttttaatccacaggaggaagttttatttaccctgtggatacttaatacatatttttcrttgctgtttctcttgtccagttgggcttatcttgcccatgaagttgcctctgaagaaccaagtccaactgtgtatgctgagagatgtctggctacttcctgattgacagttctggcaaggtggcattgggccctggcttttcctctggaggcatcatcacttataggaaaatgtcccctgaagtccaaggatcaaagctgctggaacactgagaagctgaacaaaggagaactgtttctcatcaaacccagacttccagacttccaatagggtagaatgagcaagtcagcaaatcatcttccttggaaacagtgataaaactagatgacattgtcaacaacagccatttcagaaatctagaaaatgaccaaaggcaaacaacaaactgagaagcatttttttttccatgaaaaatcgctctatttctgcaaaaatagtgggagtctatggcttctcatccagggctgtttctctccccaccccagctmagtcagtacaaaggttctggcagcatgaggcagactgaacagacctgaagtttgattgctggaagaaactgactccaggtttggcagagggtgagaaacctactcccagccatgttgtctggtgacacagtgaccttagggacaagtgaatagggaaggccagtgattcattaacctgaggttgcagtcctggttggggaaagcatcagaatggcagataagctagaaatttagtagggatatgctggaaatgagacaaccccaaaggggcttgaccccaaagttgtccacacaccccagctgccttctgagcagatgtagggagagaccagagaaggcctaggctatccacacatctctggctaacccaggctgtaaacctgtggaggagacacaagaggtggattgattgctaatgggcatatgggggatcttactggttgataggaacattctcaaattggattgtggtgatgcttgcacaactctaagtttatcccaaattgctaaattttacactaaaaaggggtgaactttagggtatataaattatacatcaataaagttgtcataaagcattcacattctaataaatggctctaagaaatattgttttgaaaattttcctttggtatattatggcactccaaaatcaacttctgtcagaacaataattaactatttctgattatagatattggtcatctacaatgatttattcagtcttttatgtcccgcataagggcttagaatgctttaaatttctaagaccatcaatagccaggactcacctgaaaactatatatatttttaaaaagacgtatgctctgggacaccatatgctaacatttgttgagcacacagtttgctacagaggttaagaggtgtactatttaaatctaacttcctcaaggggctcacactattacaatagtaagctaaagagatagaagaaaagtttatatataaaatctcagtacagggatggggttggtaacaaataagatgctgccacttacacttgataaattataaaatatctattgcattcattattggaggctgacccttataaaaaccttgtgggtactgcaaaagacagggaaaccgaggctcagagtggttcagcaacttgtgtgaggtcacayacctcatgtcaaagctgagatttaaatgtgtgtggctaggctggacatggtggctcacacctgtaatcctagcaccctgggaggctgaggtggaacacactccttgtttgtgtccaggagttcaagaccagcctggacaacataatgagacctcatctctacaaaaaataaaaaattagctgggtgtggggccacgcaccccaaggttctcaggaggctgaggcaggaggactgcttgaaatcaggaggttgagcctgcagtgagctgtgatcatgccactgcactctgcctgggtgacagagtgagaccctgtctcaaaaaaataaaaataaaaacaaataaatgtgtgtggctgattctcatgcaaatattggwgaagatctggtagtgatgtaaattggtagaacctcagtgggagataactttgcaatagctatcaaatgaaaactgtgtatattctttgtttcaggaatttcacttctaagatgtttttaatatagcagaaatggttatccataaagaattagttcaatacattttatctgtaaaatggaatgcaatgcggccattaaaaaggaggcatatctgagtatactaatatagaatggtctgcaagatatattaacttttttacaaaagctgttccccacacttcttcgtgttgtttgaaaagacgtgaaggctcagacaggccttcattgtgacttgcccaggatgagtagcagggctggaattcctactcaggagtccagatttataggcttcctctttgctttatcctatttcatagctgtctctgttgccagagccatggaagggctttaaggagtggaaaggttggtaattgggttttcctttttgaaagaccatgaggaacaatgtggaggacggactggagttgacctaagtggaggctcagactctgggtagaaggtttttatagcagttcttatgagaactgattacttcactagggcattggccctagaacttctgaggaggagaagggtgtggatttacttagcaggcagcaatggcaggacctggtgatgatcatatttgaggtggtacaagacaaggagtcaacaataagtcccgagtttcagacttggatacctgggtagatggtagggctgtttgctgaacaagaggaaacaggagaaagagcagttttaggggaaacaatcatgggaatagatttgaaatgtcttccagaagcaggtgggaaatgccggcttagaatgcagaagagctcagggatggagctaaatacaaggaartcgtcatcagaggttgaaggattgctgtgaaaggatcttttcttttgggttccttggcccctacccctgagtgtgatttccagggtttcttattcgaaggccatgagcagaaacttctcacggcaygtcacctcatccaaatgccacagaaatgaaaagtgaaaccactggggacagactcagaaatcaaaacaaaacaaattctcctctcagaggcttggtttccatttgtgccagtgtaattaaacaattctttctttcttttacttggaactcttcatttgaccaccaggaacttccctctggcaggggsaacagccactccaaggacttaccccagagatttcagagcagaagcaacggcgtttcctcttgaactgttatttctctgcccaaggaatcttcttgactgtcattccactaacccttcatgggaaatttgacctctgggctctataacagatctcaaattcatagtgaaactgtggaagactcccattcattaaaaatcccattcatactgtgcatgtgargtcaagaaaccacattttgggttgtagaggcagccactcaaaatgaccctcctgaccagttgttcctgttataatgtacatttcctgtgaattccaargaattcatgaatagtggaaaaaaagaagtattttcttatttcactttttatatagacactaaagctttgttgggaggttacatgggcatgggccagggacattttctcagtggcagctatcaactgggactatgataaagtatcatgggtgcagaatttgtctggattcaaggtatctagagattgtttacttgctacaaacaggatctaatgctgactagattggtgaccttggcaagccacttcatctttccaggcttcattttttttttctctaagtaaaagagaaatggratcaagtgattactaagttcccttctgggcctaaaaagttatgattttataaatgacactaaactaattagacaaatatgttttgagagcctattatgtgcctgtcactctgctcggtcctggggaaacttacgacaaaggccatagtacattgccctggtgggctacaagatcatgtgttccaggagcagcaacagcctgagctttctatttctctctgtcacattcttagtttgctcagtgtaaaatggaatcaaattccaactctttattatctgtcttctccactagtgtggagggcagcacttttgtttcttttattctttgctgtgtctccaatacttggaaaaatgcccaaaacattttttgtgattgatgtacawggtgcaatgatgaggtaggcaagtttgaaggatacatctaaaggtcatggaagaatgagctacaggaatggtctttacactgcagtatgcttatctcaaaagagtttacaaagactttccatggatgtgtgggcatggatagctttgggggaatcaatttccagatccagaacttccacatgaacaatttcccaaagttgatctgtctgaatgtccactgagagagttgtcctgtcggcttctttcccctcttaactttctacacttgctctcctctcacttaaagaactaatgaatttttttttctagtcttactgagatgcattctctcaggtggtaaaaagaaacagaagaaacccttggtggtataggtacaggcttgggtcagtaaatggctataatgactggctaataagatcctgccactgcactccagcmtaggtgacagaccgagcccctgttgcaaaagaaaaacaacaaacaaacccaataatttttgataatagatcacaatgtgattttggtatataattcaaaggaaactcaaagaattgattgacattgcmgtagcaagatttttcccatttccatctacttattttaaagttttctcaaggtttacatctataaaaacaaataatagaaatagaattgatggagaactctgtctcattctgtcaataaataatattaatcaacagatacataagtgaattggaaagacaataggcttctttttcaacaaaaggcacattttcaatacagttttcctatttattctatgtaatttttatcaaagtttataacgttgttattttaatcaagtaatgattagaaattataataataactcaatatagaataattttattwcttataactttatggtcacagaaaatgttaaaaaatttaggttgatatttatattcatattctggtgcaacaaagtttgatagaatgatcaataaaacatttctaaaaatgaaataaaattacattaggactaaattctgagggggaagtggaatggaaataaatatgaattcaagaataaaggataaaaaatttccaatatttaaataataactcatttattcattttttttaaaaattggatataatggtcaaattgctctggtgtttatattccattgactatatttcaaagatacattgtattggatatatcagatatctttaaaaattttcatattgagagtgatctggaaatgatattatttgcagttctttaaacgtacrataaacattttgaggtcaacttagaaatatgtgagtagtatatggctttgttttttgttgttgagacagggtccagctgtgtcacccacgttgcagtgcagtggcatgatcatagctgcctgcagccacaaactcctgggctcaagcaatcctcctgtgttagcctcctaaagtgttgcagttacaggagtaagccactgtgtctggcccagcatatggttttaaatatttttctttcttttttctttttttttttgagacagagtctcactctgttgcccaggctggagtgtggtggcatgatctcagctcactgcaacctctgcctcccaggttcaagsgattctcctgcctcagccacccaaggagctgggactacaggcacatgctgccacgccggactaatttttgtacatttaatagagatggggtttcaccatgttagccaggctagcctcgaactcttggcttcaagtgatcctcccacctcggcctctcaaagtactgagattacaggtgtgagtcatcgcgcctggcagtctttaaacatttttctgggggctttgcaagcagcaaagtttaaagaccattaggctaatagtataagtgcggcgttctaatcctgacccaactatcgagccttgggaaatgcccttcttaacccctctgcatccatttctctttctgtaaaataaaaatcacatctgcttgcttttccttattcttaggaaacttctgagatcataaaagataatgaaataatgtgaaaaggtctaaattacttcctggrggcaaattgaacacctctgggaagtttcaataactttttcaggccaacaggatactggttagttcctcaaagagtataaatgaaaggtattcttattactacttctactttaccacttcccatgttccccagctttgactcagccattggccatccaacatcgtagagttactctctgcatctctgcaccataaggttagcaagaaggaacctaaytgtatttcagggctaagcccaagagtctaccctgatgttcactaagttaaaccacagaattacacaacaggaaagccaaaaagcctaaactcccttcccaaagggcagtgggagcacatatttcttagcacagaaaatactgatagaagttctacatattgccacctattcagataaccaggaatggtcagcccatatcacatgggcctttttcagcttgctaggccatctgtcatctgtcttgtactcartccctttcctcttaaaaagatgcttataattttgtccataattaatggacagttatcacttgagcctgtcatctcagtttataaagcatattaggttctgatatctagcaggcttaatacacttcagaattggctctgttagagaccttatgagaacattgaatctcaagcrggggctttgaagacacttgccatcttgaaaagacacggagttttaagttgtttcataaggtctaagaactggtggagaaacagattggtgaggaactgcgtgggtagtgagaagctaggagtagaatttctctatgagatggtattgaacacttatttattcaccacttcaacatgtttgtgagtgt

SEQ ID NO: 13237 - DNA, 87672 bp, Homo sapiens
gcccttctctccttccattcattcatttgacatttgccaagtacttatccaagggtgcctggtacctagtgctgggcatacagaggaaacaagacagagcctctgcccccagcaaacttccagcccagtggagagtcgatggtaacaatcttccacatttgattcaaaatgctgaaacacagccaggctgtttgaaggaaattggttcccagaagaatggccttggctacaacagatggaaactggtagcgtgtcagttrgcagagtcctgtgtgacatcttttgataaattaatctcatgtgaaagaagtcacccacaaaattctttagccagttgtcttgcccatacctttggttytgagggagaccattatgtaatcacttgactaatcacctggtattgacagtgacacaacttgacgccacaatttctacaaggcttgtgattgagaaaacttcattctttgtcaattatcaacaaacttctcagacattatactcatgcgagctgccttcagggcattttytttttccttttcacatctgtgcttaatgagtagcatttttgcacattgtttttytaagctttatatcctcatctgtaagaggagaggatgatagtgcttaccttaaaagtttgttgatggttagatgaaaaaaattcatatgaaacacttagtactggatctggtttagagtgtttaataaaatgtagctatttatttctatctaggtgctgaaatctttgtgacttcgtgactacttaaatgtgcatgcatgtaagcagtgccttagttttcttttttttttttttttttttttttttttaggcagagtctcgctctgtcacccaggctggagtgcagcggggccatctcggatcactgcaagctccgcctcccgggttcacgccattctcctgcctcagcctcctgagtagctgggactacaggcgcctgccaccatgcctggctaatttttttttttttttttttgkatttttttagtagagacggggtttcaccatgttagccaggatggtctcgatctcctgacctygtgatccgcccgcctcggtctcccaaagtgctgggattacaggcatgaaccaccacgcccggccagcagtgccttagtttttaatgtttaaaatagtaatgattttaaatgtccattttatctcagtaaaatggtcatacttaatgaaagaatatatcaaacttatctagaaaatagttcaatataaatttacaataacatgtatatggcatctttacaattcgattgaatgtattcttaatttattttaactaattaattcactaattagacaggtaggcataaatattgacwgctcatatcaaaatagtctattgttggcataaattgttatttactagataatgtttgtggttatttttaagcatttggctcaactaacttttgtgattagctgcatatgagatgtttaaagtatgttaatgcaaaaaggatagaaaataatttaaatatggcaaaacttctatttttttttaaattcagcctttcaacaacaacaaaaaactctttaatgccagcaacatgaaataacatacaaaattaaaatttttacaagaagctgctactttgcttggaaagatgaaatgttctccaagacagttttggttacatgttccagctacacagtagttagttcccattttactggataagttaaacacctttgccatgcctgttgggagttacatcactctaatgagaaaagaatattcctgttaagaagcaaaaagcatagattaaggcttttaaaaagtgctgattaaaaaataaagtcacttaaaatgtaaacaaaatgcctattaagcgmaaactggttagctttcatggcataatttaaagcccttatccagtattttctccctggttgcaggcaccctgtcaattcttgacaaacttttcagacattctacttacgagggctgcccgcagggaagtttatttttaacttctcacacctgtggttaatgagtaacatttttgtaaacgtggccattttcaaggaagaagggaagcattttatgccaaaaaaaaaaaaaaattcaaaataagaaaaaaaaaaaactaccctaatttatctccctctaatctacctatagaagaagatgaaatgaaagttcgagctctccagagtcaatggcctcctctctagcagaactggaagaaattaataacaggataaaagccaaaggtttcaggaaaaacagcccatcaattaaatgttacacctaaatgtaacatttgaaatgtaacatctaaatgtgacatatttaaatgtaacctttaacatttaacatttcaatgttaaatgttaaatttttgagacaggatcttgctctgtcatctaggctgggtctggagtgcagtggtgtgatcacagctccctgcagctttgatctctcgatcttctgggctccagtcatcccccaggactcatgtcagactcctgartagctgggacgagaggtgcctgtcaccatatctggttattattatcattattattaagagtgtctcactatattgcccaggctggacttgaactcctgggcttaagtgacccttccacactggcctcccaaagtgctgggattacaggaatgaatcaccacacctagcctgtttttatttcagtccttctaaatgactggatctgatcaattattttttgtgcttaatcaaatgtctccattgctaatcttcaaaacaaatgaaatcaatttaattcagatttccataattgctcatgctcctccttaaccttctggaataataaaatttcccaataccattgcccccygccacccacacccccctagttcccraaaatatatgtgcttctttttgttacaaaaagtttaaattgcctgaggctctgggaaaattctatcactatggcaattccaagaagaaacaaggcacagtcctaaatgaagatttgttctgtctctaccacatatatgccttcacacaaatagtaggtttcagaaggagttactggtgtagaagaaatccactactatattcaaggcaaacttcctctcagaaaaatgaagaaatgaggacgccttgtgtatgttgctgctacctgagagcaagtctttgaaaccaaaatcaggagatggttaagagtaaaaaagaacaaatactaatttttaaaatcaacttttgaaaaaaacaactttattgaagcataatttacataccgtaaaattcactcattttgtgtataatccccagaattttgaagcttttaccaaattgtacagtcatcactgcaatgtagttttagaacacagatttccatcacctcaataagattccctgtgcccttttacagttaattcctgttcccagcccataaacttgggtacccatgaatctactttctgtctctattgatttccctttttttgtcacatttctctctctgaatacagttttagaaagaaagaargaaagaargaaaaagaaagaaagaaagaaagaaagaaagaaagaaagaaagaaagaaaraaaraaagaraaagaaagaaagaaagaaatccaagagtatttcctaccaataggagaatacaatttactgaggaagaacccacctggataaaatagaattcttaaggaagtccaacgatcctggacaccacacacgttggttgaattagagtcagagtggtctttaagatttaattatctctccaattagagataacagacttagagttacaagggaccttgataattaaagaatactgtagtaagccctgttatcttaactaagaaacgcctctgtytctaaagtttaaaaaaaaaggcaaaaaaaaaaaaacctttcaagtaraagagtaaactcccaagcattcctataaaaatcagtcagatgttattttttttcttatgagacagagatatcctgtttccttaaataaattagatatctatgggattgaaatataaaagtttcttccaaaatgtaaggtgggctttccacttcaagctccactatgcataygattctagtgtattttcagtgcagtaaatatatcaaactatcatggttttggttgaccaaatacttttctaatcacttatttccttcccccagaatcaatgaattttaagaaagctttagctacaggtttatcttgcttacatccggatttccaggtatccttccctctggaagaaacactcggcttcccagaaatttaccaagcattttacaaggagctcttttatatttgaaaagagaaaactgttttgtcaagtgatgagaaattccaaaaaaatcctctaayccagacaggattctaaatttggggaaatccatggcactctttcaatttrgagtgtgggtcacaaagattcctcaagaggtttttttacactatttgtaggaaactgatatttgctgggtgttttgctttgttttggtttggttttaaatccttgcatgaataaaaacaaatgctaattttgtgtctttaatgtgtcaggcattttatagaacacagagttctaattactcctgtggcaattactgaaggtgaaacttttggagaaaataggtaccttgccgaaataaatatattttattagtagcttcttgtgttttaaagcaaatggaacctctgaactcctaacacaaggagaaggcaaagcattcagttcgggtctctctggatctactgtggaagtggtggactcctccttctgaagatctttaaaagcaattgtgcctgtgtttatctgacaaaaaggactgatgtgatgtgttgctaaatgagagacttttcagattccctttccactctgagtttagagttcaaggcgggggaatcttaaaggagaactttccacactcttggagtaaataacaattgaaatataaaaaatctggcggcgggggatggagggggcattctgtaatggaacttgtcagcaaaaagaaaatggcaaataaatgtgagaaaggggccgaaggagggcaagacagtacatagggtgccccccacccacccggcttttaatgattcaagcaaaaaaatctctgctttgtgtgtaactggcacggtgaacgtgggaaaggacacgaagacctttctctccccacagctggtccaactttccaattttcaggttgttcacagtgatttcactttcagtggaaacgggcgtcccatccccaggaaaggaaggctttcctgcatgtgtaaaaaagtaaactgttactttgtccttgcaaaagaaaacttcattctctgaacttccccgggatctgcaaagcgccccgcggaactcccggtacttagtagaagctcattaaaggtctctgttccccttwgctccccgttcgcccgctggccctttctcagagccagacaggcacagcgctgagaagggaagaagtccgaacagggagctgtgaagacaaaataagggagtcccgagtcagtaccctttagtccaaagaaagggagcgggatggggggaaaggcagccccgccctgggactgaaaagtctggattcttaacagctgcaaggtcgtggatattttatgggttttcttcctcacaaaatacactcctataagcagagattccccccctccaccccgaagagaggtgacgcaatgtcctcaaacactaccaccacccccaataaaaaagaaaagggaagggggagcgtcttgcaaccccttcgcttcacacaagtccagccactccctttcctcccagccgcttcccatcccttcccccatcccctaaaaagtttgatgaccgcaaaggaaaccgaaaaaaagttgtcttgccccagtcctggcgggccatcagcatctcttttgttcgctgcgaacccacagtcccccgtgacgtcacccggagcccgggccaatcggcgcgcggtcggctgcggcggccggcgggcgggcgggtggggtggggcggggcggggacagcccggcgggtctctcctcccccgcgccccgggcctccagaggggcgggaggggaccgtcccatataagccccggctcccggcgctcggacgcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccwgtgcctggggacagcggtgccctccacgggagcctcgaagagcaagaggcaggctcagcaaatggttcagccccagtccccggtggctgtcagtcaaagcaagcgtgagtactgaccgcgggctgaaacaggctgcctcagggatgggaccctaaagccgaccaaagttggggctgaagttttgtgcgcgcgygtgtgtgcgagtgtgtgcgcgctttactgagagaaaccagctgtgcacacaaaaggaccgagttttgagcacgctggttctgagggcctgggatgataagaccrtgcattggaggacgaggactctgcgactttcccgtgttctaataaattctgcacgttcagattgtccttctaggaattaaccaaaacttgcctttaaagagaaaaatgatgcatgtctataaattttccgtctgggattagtgtggtccttactgctacttatttccttctgttaaataattggtcaaatattttcaacatgggggtggaaagggggtattgaaatagctgtcttgtttctaactaacttggaagagatgtaattggttcagacctctttagggccgctcaggatacttcaccaagaacagaggttggaattctttccgtttttcaaagacacaccctccttttgctttgagaaagctgcttaaagttgtcctttttgactattactccaaaagaatatttaagttccttgcatgttttaaaaatgtgacttcaattgtctgccttccaaaatgtttccaacttttttatgtagacccctggccagatggaaatgacatcattgtatataacttttagcaaagttaaaaggaaaaaaatatgtacstcaatattcacatgaagaaaattccataattttgggaaaaggagaaatgcaaatgtaacgttttccttcaattatttkyagccggttgttatgacaatggaaaacactatcagataaatcaacagtgggagcggacctacctaggcaatgcgttggtttgtacttgttatggaggaagccgaggttttaactgcgagagtaaacctgaaggtaagtgacaacaagccccatagttagtatcttttaatacatgaagtggtaattgttaaactttgcattagtaagtaaaaatacatacaccatttttctaatagaattacctgtcatttcctcttaagtttaaaaackgcttatatttgcttttcacatgcttttacctttaaaacaaagaaacgaatctttcccaaattagttcctagagtcttctttttgctttactctcccaaagtttttgatgagaaaaatgaaagattttgtgtgtcctccgacaaaaaaaattgcttataaaattttaatttattagaaagcagtctcaaatcttaaactgttagtttatgagccagaaaacactttggggacttacatcgtaaaatgatttgtcagcggcagttaacacaaaaccattagccacttcaaagttctcattcctttaggaccaatgatatttttctcataaattatagcaactctgtcagagaagcactgatcaggggaaaatggaaatcataggattaacaactgtcaaggccttgtgggaggtggggatcttcgaattgtttgtttgtttttgttttgttttgtttttgagacagagtcttgctctgtcaccaggctggagtgcagtagcrctatctcagctcactgcaacctctgcctccagggttcaagcaattctcctgcctcagcctcctgagtagctgggactacaggcacatgccaccacacccagctaattttcatatttttagtagagacggggtttcaccgtattggtcagggtggtctcgaattcctgacctcaggtgatccacccgcctcagcctcccaaagtgctgggattacaggcgtgagccactgtgcccggccaatcgtttgctttttatgtgaaccttgctttgactttctgagtcagagattggaatgtgaaacccttcacaaatctagctctgtcataagttagtactttatatggccttttcctaagagcctgagatttttctacaatatgaataatttacagaaaatttgacaatatgtcaaggtcaaaaaccatggccttattagagcttaggataaaaatctgtatctctcacttcattttattctttgaggtgtaccatgttacttgtggaatagagaagtgggttttcctttagaggggattagtgaactagaaaarcttgtacctaagtgaggctcacatggactttccttttcccctcagctgaagagacttgctttgacaagtacactgggaacacttaccgagtgggtgacacttatgagcgtcctaaagactccatgatctgggactgtacctgcatyggggctgggcgagggagaataagctgtaccatcgcaagtaaggaagagattgtgtaaaatgatgccaaaatatcaaatatgaatttctctgttaccatcactgtcattttctgttatccatgactggatattccgaactttgaggtttgcccctggtgaccaggtactcttaagtggtcacccaactggttcctgtgtttcttaaagaygggtatgagcacagatggaatcagtgtttgatgtgtgtgcgtttatgagtgtgtgtgcatttatgagtgtgtgtgtttstgtacatagtagaaccaagagacctcttgggttccatttcagtaagacatgcttaggggagttgcccattttaaatcacctggatatcttcaagctagacaaatcatgagacttttctgcagtgactgggaaggtgttcrtgaagagtgaaccagccatgtgttgtctggtcttcatgtttgcaatgcagagacctcttgcacctcacagaaacagtctggtttcttggtgaccagtaggttatacccaggaagcagatgtcactattcctagggataatacaaaattattaacccaatagagtttgctaaggaactttgggaaccgggctgattctcaactctagtttagctaaggcactctttccagtatgattcactgggttaccaatagattctattaagatagtatttaagttttttaatccattctttaaatataagtcgtcttaaagacttctattcaaaagaacaagtcccgtgtgaataggcccaatcaactttccccatatttcatgttagggtttatccaagttcacaggcaaatcgcaagaggcaagggtccrtagtgtttacaatctagttcagcatttgaatgtgccattgggcttaacaacttagaaaactaccaggatttccacactttatatgcatatgtctgtttgctttccaccaaaatgacatttctatcctagggtaaaatacaggctctccatgctcccaaaagctggagtgctgtgcctgatgtggccttttcactgaattagtctcagtcttagcctgctgtgtatgagtgaagaccaagcctcccagcctttcttttctgcttaggacccaatttcctgtgatctctctgggaaagcaggattcatgacctcttccttgccatccagatttctctgtggttttccattgtgttctaagcaagacacttaaytgaattgactccaagtgaccagacctgttaacgtttcccctgtctctgatgggaaagctgttgtctgtgtctctactttagccaacctaagtacctaccatgggtggaatatgagaccaaaaaaaaaaatctgttctgccctctcctaacattttcgttgtatcttcaacagaccgctgccatgaagggggtcagtcctacaagattggtgacacctggaggagaccacatgagactggtggttacatgttagagtgtgtgtgtcttggtaatggaaaaggagaatggacctgcaagcccataggtgtgtgagtcttagggctgagcaagagctgggatgcttagttctaatgtggggttggaccagaatcacatctacataggtcatagacctgaattccagtgaaaaccaataaagaaatgggaattttgtttgaaataatgaattattatataatccatagtcttcttacaggagttagatcaaaaagtactgactacacatagaagtcttaactttgcttcaaaagcataaggtagaattgaaagatttagaatggagtcatttcttttacctaatagctgatctcagattcctccttsgtcaagatataatttatttaaaagaaaaaaaartgacactttggacacatttctatatggaatgtcctggaccgaaacatgaaatagtgtgtgcttgtcacactctgctcatttcttttcaaattaaaagttgttgagcttctttggatctcaatcctcagttgaattttgtaagtacaagcctgaaagtttctggctataaattttactctgtttacttgtcttctaatttagaggtttttgtcttgttttgtattgttttgctttccaatatttaaaaatagctttctttgtcattgtatttaggccactcaaaattcataattggtcatttataattaagattggaattttgcatatgtagtctcccacagactagatacatacatagatccttgctactggaaatgctgctgggaagtttggggctcgctgaaaatatgtagtccatgtacttattaggagaatggaatttctgcctgccaactcagcttgagctttcttttgccttggctacttactgtgtgcttagatgctgggtgtgtcattctttctgaacagagtgccacttaaaaaaaatgtggctgaatttttgcttacacactacactttaaattacagggagcttgcayaattcaaaataacctttttttcctgtttttcttccaaatttccctacagctgagaagtgttttgatcatgctgctgggacttcctatgtggtcggagaaacgtgggagaagccctaccaaggctggatgatggtagattgtacttgcctgggagaaggcagcggacgcatcacttgcacttctagaagtatgttttacatctttatgttaaagattaagccaggtattgttttctggattcctagagagaagggtaatactatgttactcagaacacatccagtataycagcatgctttggtaacttctggawgtcaagaaaactttcataaccaacttattcygcatcttcagagaagactacataaatagaaaaacatatcactttgataaggttcaatctcagctcactgccactgacatagagttgaammaaaggtttaggtttccttctatgtttgaaatttaaatagggcacattcacaggctaaattgataaaattaaaaagaatttatcccataaattaaaatgatttatctactctggagttagggatagtgtctctgacctaacgcatttgattagtgctgtaaagaagctggcctctggygtctttactgctccttctaagattgtcttggggtcttaattgttgcctttgggtttsaaggctccttttttgatattgtaaactaataacagctagagagtttgttgaagtaaaacagccattaactactggtgttgtaaataagtttaaaatcaaatccaaataatttgaacctgttttatttatctagctgaacccatttaactacctttaacatagccatcatccaaattcaaattctttgctaacaaaaataggtctctcatgaaaagtggtaaccattttgaccaaagctttcccagaaacttgctggtttattagatattttgcatttaaaatgttactgtgatyatcagacttccaagatctttgtggcaatattttagcttaagacaaattagatgtctgattcaaaccttatctgttatttagaactctttaaatagcaagttgggaaaagtttctcaaagagaagtcatttattccagaaaattttataaggacttactttgttcaaggtattataggggtgcagatatgaaatgaacattagcccagccttcaaagagtacttagggggtcagggagatgagaaagtcttatacatatttatcatctgcaaaacacagtattaaagatttcaacagaaatactgaaagtagtgctatggaggttcaggggatgataatacttttygctggggatttgggaaaaagctctaatcagtaattataccttcatgcaaacttctattcttgtggtagatggatgtgggtgtgtatttgtttgaacctacatcaactattaattttttttctctaacccaggagttgcaacaatatccaattcacaaagacatcagatcctctatactcacatcgtggcayagarcaaatttggattataatttaaataatctatttaccagataaatgcacgcatagactaatggtcatttagttacaaattatcattttatgttgatcccactcttccaktggagggctaacactgaataatttggggctattttgctagtgatttttaaatactgtagatgtttgggtataggggaagggaaaataatattttagtcaaagaaattgtgcatcctctacattttttacataacaaatgaagaaagagatactaccaccttcttatagcttctttgtagccattggtgaagaccctttgatacctgcttgcctccccattgttataagcttttttttgtttgcttgttttttttgttttgttttgttttgttttgtttttgagacagtctcaccctgtcgcccaggctggagtgcaatggtgtgatctcagctcattgcaacctccacctcccgggttcaagcgattctcttgcctcagcttcccgagtagcttggattacaggcgcccgccaccacagccggctaattttttttggtatttttagtagagacgggggtttcaccatgttgcccaggctggtcttgaactcctgactgcaggtgatccaccctcctaaagtactaggattacaggcgtgagccaccgcgcttagcctgtttttagttttctaaagcaaggtccctattgaaaggcaggccataaacagtgatgactaagaaaaatcctggaagagcctgagaaggaaaaagatgaaatataatgccagagaatgaagttagtcaaaggaacagtgtgaaaacaataaataaatagataaatgaaaatgttatttgacagagagatgaaactagactaaaccattcagctgcctttccactgtaacaaatgtaatttcatctttcagaagtgtaataccttgcagcaccagagctgaatatgaacatattaccaaaaatagattaccaggcatagatagcattccttttttaagtttgaattgaccacttgcgactctcgacctgatgtatgtatgtgcttcctttgtgacacagatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggtgaggcacaggacgagcaggggcgggaaatggggaagcaggtcaagaaatatttccgcaaatccatctttcctttgacatgccatttgaggataatttgcagtgtttcagctaataacctaagataatttacacattattggttgttaaaactttttttaatgtcaagttttaaatttttcagaaaaaaagaaaaatgacatacaaataaaccttagggggaaaaragccagatttatctccaaaagataaaactgagttttaaagaatgctagcatcataaaacttaccatggatagatcacgcacacacgcacacacacacgtattttgaatatccaaagttcatttgaaaggaaatgagagttataattaattatatgactacctggttcttctgctaggaaaggacaaaaaaagtgcatttggattttttgtttgtttgtttttgaatgaaatatacttccctgtcccgacattgaactctttttgtagtggaaaccatcctttatatgtggtttctatgctctggcaaactttgttacattctataaagtaacacacaattatttycttcatgtattggcattcgaaattttagaaattcagagaggacttagagatggccatgaaagacatgatatctaagcattctttttaaaaaacaagttttaatcatttttggcatgagaaaaagatttttacgtcataaatgtttcataaaaatctgaagagagaaatatggccaacaaggacgtgcactcctctcattatttttaatatgttttgattaactttttactatatgatgtgccaacatcattacgtagtgtctcagccatccttcaattaaaaatattaattgttctaatttttcttcttttgatgagtttttgtcttgctttgagcacttatgaaggtgaacaagattagatttgataatatctttgagttattttattatcattaataaaattgctactggccaaaaaaaattataaacatcggccacgcgcggtggctcacgcctgtaatcccagcactttgggaggccgaggcaggcggatcacgaggtcaggagatcaagaccatcctggctaacacggtgaaaccccatctctactaaaaatacaaaaaattaaccaggcgttgtggcgggcgcctgtagtcccagctactcgggaggctgaggcaggagaatggcatgaacccgggaggtggagtttgcagtgacccgagatcgcaccactgcactccagcctgggtgatacagcgagaccccatctcaaaaaaataaaataaaataaaaaataaaaaaaattataaatgtcagtctaccaaaatagattaaaagtgtaggtgrgaattaaatggggataaacactcaataaatgttagctatatatgaatattgccaatactgaaaagattccattgttcaaaaaagtttgagaagcaatgggttaaacaaaatggaacctgctctgcagaatctgtgtgttcctttacatcatactctccatggtagagtgtaggggatgggcgccatgtctccctagtacgtttgaccttgggattctttgtctgtgaacatctttgggttctagtgttcagcagcacttagggaggcactgaattcagtgtacctttggtctagcctcagccctgattctgttctgcggtgggccctggccttcaagagaacagatatctaaaagttgaaagaaaagatcggccgggcgcggtggctcacgcctgtaatcccagcactttgggaggccaaggcgggtggatcacaaggtcaggagatcgagaccatcctggctaacacggtgaaaccccgtctctactaaaaatacaaaaaattagccgggcgtggtggcgggtgcctgtagtcccagctactcgggaggctgaggcaggagaatggcgtgaacccgggaggcagagcttgcagtgagccgagattgcgccactgcactccagcctgggtgacagagtgagactccgtctcaaaaaaaaaaaaaaaaaaaaaaagaaaaaagaaaagatcaacacatcctgttgtgttattctgaaaggaaagctgtcttaagaggatcaattggttttagaaaaaacacaatagaatcacaaataatccagaggagaaataaaatgtggaaggtggaggtgacctccagaaaatccaggacagctgctgaaggcaccctctgatgagctcggttactcagaagagtgaggatgtgttgaaggtatctgctgtatggagtggcaggatgatgtctgtgattgagaaatataatcccggccaggcgaggtggctcatgcctgtaatcccagcactttgggaggccgaagcgggtggatcccctgaggtcaggagtttgagacaggagtttgaggtcaggagtttgccaacatggcaaaaccccgtctctactaaaaaatacaaaaaaaatcagctgggcatggtggtgcgtgcctgtaattgcagctacttgggaggttgaggcaggagaatagcttgaacccaggaggcagaggttgcagtgagccragaccgcgccactgcactccagcctgggcaacagagtgagaccccatctcaaaaacaacccaaaaaaccaaaaaacaaacaaacaaaaagaaatataatcccagtagccccagctgagctggaggatggagaccacttggtagacacttgtggattatttcctaggctaaatgcaaaagctactgctgaataagggwcatttttttccagtcccaggccagtagcgacatagatttcagagtgatctctgtgagatcctgaagatcctgactgcagaaagtagtgaattgtcttctctcacccagttttgtgacattcccttttcatgccattaggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacaggtatgcattatctttttgaagaataggactgatgactttattatttagtttttgaaggacaatacattttcaatgtgaaacaataaaacaaacaagaagcctgtaatcttaccaccctgtgataacaattagggttggcatttgaaatagtttcttccaatctttttaatttatgtattttctttctggtcatggatatcatgggtaaaaattttattgtatttatctgtctaaagtgttgttacaagagagctactttctgaataatcatcaatgttttatattctaaatctcaaatttcagcagctttgtgatgtaaacatcttccaataacctaatatatgtattctgcactacaaacatggtagtcactatggcaataacaattgctacacaattctcccccagaatagtctcatatattaattttatggcatagatatagtcataaatattatcccaacatccttaagyagcatccttaattgacctgtataaatatagctttacaaatagagaaactgaggcatggcagcagaagtggtcatgaaggacatcagcagaagaactcaggtgtcgttctatccacagtagacatggattcctgagtaatgcattttgactgaaattaacgagatgatcatctatactcatagcttcttcctttgagggcacaagctcagtatctcattgaagccataaataagcagctgctggtgggagataaagcatctctgtttactgacactcttttgattatgattgtagctgtaacccagacttacrgtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactggtgagtgtcccaagggggagccacagaagtgagaaaaactcactttcatgccctagttttatttgccagcattytagccatttattttgaacccgcccaagaagcatcgcttttgttcagtttggactcaagagatcgcagcgctcacgtaacagctgaggattcttccatcttccccagtactgttgggaaatgacaccaagggagtagccttccagttcatttgatttaacacattgggattatgatgtgattaaagatacttgtattttggaatcagtagatgatcccacagggctgaggaatacaaaggatgaatgttttagtgccttagcttattttccagttaaaacaatgttttattcaaagctatcatttaatcttttgtggggggggtgctggggaaatgacagtgaaagtgggatttaaacctgttttgaaggtgtgaaggtaaatatgctaagaagcttagaactatattatcagacattttttattctgagatagactgtctgtgaatgagctgcagaaacctggctctctcagaccagtaattctgtgtacattggaaagctcagcggtaatcttttccttctttgttgtgtattgttcctggcagttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctggtaagatgaagcccttgtgggttgtcttgtttgacaacaatttagggagtagagactaaagactagtgtccagtttactcccatttcattcattaacacaattttgagacaacagaaaacttcatgtgaagtgtgtttgtgtgtgtgtgtgtgtgtgtgtgtgtgtgtgatgttacatcatatacataaggattgggaagaataattagataattatttatataatttttaaacctcattgacatgatttaatgtcaaaaatataattacttatttstaagtctggaaatatgaatttgcacaggtttgtctttgtaaagagcacacaactgagtagcttacaacatttaatatatgtatgacggctttagtcacagagctacaatattgacacatggttgtggtttgatgggcataagctctatcacttattaataagtgccaaagtgactaaaactcaatgttttctaacaggtagggaatctcactctttttttaaaggtccccagtttgtatagatggcgaacaaatggaaacgaataccttttacttgttttcagatttcaagaaccccatagattccctttaattttccagttgtagaaacaagagcctgggcggtaggcactgtcaagtgtgactatgagacaaagaaattgcttatacttttatttctttcaacaaaagaagatgctgagtttagaagaaaaaacccacttttgcttgtaattctatatccaaacccatagtttttatttgatccagaataaactggaactgggaaaagttatgaagcygtagttaaatccaggcttctagaacagcaagaaccctttgtgtggatgtgtagatattatcttagtttaacatcccctaacccttcctgtaactattttctatgacacgtttggactacgttttctgcctccagggctcaaaaattctaccccttcacctgacagcacttagatgtctytgaygcacacaaagcttcttcccaagtgagaattcttaggatgaccaaactgaactgatccttttgcacacatacatgtttagacctggtgatcatttatcaagtgcatttcttatccatttccaaacagcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgaggtatgctggctgattaacaaaaatatttgagatggcaaaaggtacagaaagggacacttttttttatgaaaacttgcactatgccaaaagcaggggaagaaatatggaatgccacgtcattcattagtctactgtgcatggtaagataagcctgaaaggcttagcaggcagcctgctaagacaagcggcatagcaatgctaatgttctgaaacactcctagcatgtaagtacttaggctgagccaaaaagatggcttcaaaagtaagaatgaaacatttgatccattcagctttaggctatgccactggattcatgtctagaaaagataggataatttctgtaaagaaatgaagaccttgctattctaaaatcagatccttacagatccagatttcaggaaacaaatacataggggactaactttccttgttcagattagtttttctcctttgcacccagctatataatatgaggaagtattgactttttaaaagtgttttagttttccatttctttgatatgaaaagtaatatttcgggagaaccctgagctattaataatctatgtggctagtgcgtagatattggtctgaatttgttctccttttgtggtgtccagtgggtaacaccatccgggagtaataattacatgtggtgttgcagaactgaaagagaccttaataacacatagagacctcactctatatagatcaaggagctgagacccaaaaaggaaaaagtaattttctcaggatctctcaaagagtgagcaacagagttggcctaatttattttagcgttgtgaatactgttgacattttatttcccaaatctaagtatctcctccccttccccctattccagagaccagaccaccacatcatgctgggtgttagataaatatgtttaatcttcttcttatttatcctaacaagcagatatttaaaggaaattatcaactaagcaagaaattttcagaaagtaagacatgtatttgttcaaatactggcttctcacaggaaagtgtattttaccacattctttacttgagcatactgtaacctctgcaaaagttacacattttrggaagaaaaaaatttttttggcaaaaattgtattactgaccaaactttgaaaaaaatgttattctatgcttgtagaaaagttattttagtggaaggtgttgataattaagtggaagtagttgtatgctttgagaagcataccttttttctttcatcaatggaactttaaaaagtttctcactcacccacctgtttcctraacagatcagtgcattgttgatgacatcacttacaatgtgaacgacacattccacaagcgtcatgaagaggggcacatgctgaactgtacatgcttcggtcagggtcggggcaggtggaagtgtgatcccgtcggtgagtagccctatttccctagatgagtttgcacagggggaatggttagcaagtttcagataagaaaagctatgtgaaatcacatgactgaagttggctccagactttgatcagttgcttgcaaagaactttgcaaagtcttctctctaatactggaccaaaatatctcgatattggtagtcgtctggtttttgctgaatttggtgacaaatttaggcttattttaattgaatggaatttattcttgggtttagaatcataaagataatccatgctattaaaagtattctttccttttttttttgtttgtttttgtttttgtttttttgagagagagtttcgctcttgttgyccaggctggagtgtatggcacaatctcggctcactgcaacctctgcttcctgggttcaagcaattctgctgcctcagcctcctgagtagctgggattacaggcatgcgccaccaggcccagctaattttgtatctttagtagagatggggtttctccatgtgggtcaggctggtctcaaactcacttccttaccagctgtgtaacagcatgagcaaagggtgtaaatatcacccaccaaaacactctaggtttttttttggccgcccttcaaaatagaactaagcaaatagtgaaggctgagccttaaaagagctgtgttaccagcactacaaagtttaaggtgatccattactatttctttaccaaaagagacaggttgctcactgagaaaacaaactgataacatccgtttgtttgacgtgagattaccagaactgagagagaagcctgagaggttttcttagaagctgctcagcaggtatactcgtaaagtctagttcattcatttaaatgtcaaacagtttctttaaattttgaagaagtaaggaaaatgaaattattgcagatttttttcttgctatttaaatgttaagccagttatattaatatgggtaaaaataataactaatatttaaaattaatgtgtagattatcaatatacactgaaatctaaatctttacatttttatttagaaatattaccttttagaaaactaaatattcctcctaataggtactttggttttttttttactacaaactgtcctgtaaggtaaagaatgtgaacaaaatatttttttaactgcatatatttgtaagaacaattgcaaatttctatttaagctaaatgtatgctctagcaccctgaaattaaattcgtagttataagtcttcaaggctgtttatcttttccttccatgtattttagaccaatgccaggattcagagactgggacgttttatcaaattggagattcatgggagaagtatgtgcatggtgtcagataccagtgctactgctatggccgtggcattggggagtggcattgccaacctttacagacctatccaagtaagtwgctctattactgcaagttgagaactgccarttgggttataacaacagggcagtgattattaatgctctcatgcctaagttgggggtctcccctctttcccacccttttctcttgttattatctaataatcaattgaatttttgattaaaataatttttctctcttcctctatcaagtaaaaggtagagaaggctatgaaaatgtgcctgtttataattttacttcttaactctgtaaaatattctgttaggttaagacactctggctaatttcatcttatatccatacatggaaataaaaaccaccaagtgagttatgctgggagtaaaggtttggggctttatattatgattcttaacagagaagctgcatagagagatggcatgaaatgcagcataakgtacgtgttcattcaacatgtcatctaagctccctttgcatcaaacttttcatttgtttgatcagttgccaccaggaacacagtatgttgggccaagggttgagtaacttggtcaactctctgcccacacagttcaaacactctcaaatgtttattgctgggtttttccaggtcacaaagacatcatgcctagctgtaggtgtaattagttcatttggggggaaaattgcatttaaatattcactgagtgattataataaaacatgttaataaaacatgaaaggctaattaaaaggcatcagttatttgagcaactgctgaggtgcaaagtctccaaagtcttcactaacgtttgactgaaaatatggcctacattcagaaacaaaagagtttcagggtgtcagaatctgcatgcgacagaaattaagattaactctgtgataaaagattcrctgtgacagagaacaagctatgggaacaacttggccaaaggtagtgttagccaagcctcattcctccatttcctcatctgtaatatgggaagattgtagctgattacctttartgttccatcctaaatactraacacccagatgcaccttttctaggaacttggaagattctgcttttcccaaccctcagacactgtcagtgctggggaaggtgacttcacttttgaaggcttatagcacagattgaccaacctcctaaattgtatttcttggaggatttaggtgtaggaatcacttaattttttgtaacttaatatatatttaaatctgattgtggaagtactataagtatatgaatggtttgtttgtttatatgatgcaaatgatacttaaatggtagaaacttctaaaaaaatgctctgtgktttctatatttatgattgttattggtgttgcaatttgctgaaaatgatttccttctgaatgattgagagagatcttcgtctctctcaacataaggctgtccacatagctgcttgctggaagcatttaggtggacatgttggagataaaatctggaaaggaaggaatccttgagtattggagtattacatgttgaccttaytcctactctttaaaaaggagaacagcaagatcccactgagcatagaggtgatttcggagggaagagattggaatttgacctcagatatgctctttggtgcttatctgtatgtctggtttgctccgtggcctagcacgtagggctttaagagtgtggtgagaataagggaacagcagattaccaacagattgtctctgagtcctgccttgtttgttcctcctacagagaacttggtagagttgttcaaactagcaaaagataagaggcatttggtttgtcaataagcaactagaaaagcacagatctcagcaaaataaatagagaaaaaaaggactgagtcaaaaaatcataaatgtttaacttctccaaggacactactattggaaattattcatttagactttatttgaaactaattttaaaagtgtagacattgtactatctcctttttttggtatcatctyaactattttattgttagtttattcatattgaataagagagggagtaaagatttcacaatggcgatagctagtatatgccaattaagttaatttaaaaagttataccaactaccagtagcgaaaaaggactgtcaaargtttaaatctaaataatgtaaaagatgtcataatttttaacttttctgtctttaaaggatacatagtataagctagagtaattatacgtagtataagctagaatataggaatttaattgatctaagaaataactgacacaaagtctctttacttcctgaacaaaaacatgctaaattccattgctgttcagtccatttcctttaaaggtgggctatgccacagggctagattttaaaacgtggaatttcasaccagtgctcsaaatcttatgaaagcaaaagggacctctgtagttgtactccactttggcttgagtaaaaaccactgctgtaccctttttctttcctttccctgcccatttttatcctcctccttgtgtccttgtggacatagaaatatgattaggcttagaggtgaacagtaaaggtcatttatgttatcttttcaaaacttaatagacatttawccatcataagcttgtcccccctcaaaatcatgattgacaagactaaataaartgtatatcaggtgtctctttatggaggaaattgtagtaggatttatttaaaggatcaatatttaaatagccctatgccaattatcataaataattaaggacatgatattcctagctttcctgatttacatggaagtacgttaaatagtcacatctccaaaatttttcttgaatagttgtctttaaaaatgtgtttacatttgtaaggatcttcataaacagaaggggtaattcaaagatrggcatggaattgacttatgccaattgattaaaacaaacatcctgtgtgttctgtgaaatacatacaactttaaaatgaaaaactcataattttatgcatgaattttggtgttcatgtggcttggaaatatgtgcattaaatggaattaagattcaaagtatttgctaatcttcaaccaactttgaattgttactggtgtggaagtgagcatattgttttagaatttctgaatctacatggatatmcaagttatatattttttctgctacagaaagctttgttttccaagagaatttaatggcttagataataaagtttgaaaatcaatgtattttttttcctagaagctttcagaaaacttaaatctgttaataatctggtgaagtgctttattacacatrcaaaattttgctctgtttgacagagtgtcagttagaaattcttgaaaaggttactataagacacaatttttatttctagtaatttaaacattgactgacatcataaagatagtgttttaagaaaagatagttttctgttctgcaagcrtaaattttctagctatttcattattatcttaaatggagttaacactacttwgaaatkgatgctacttcccttattttccttttattttaaacaaaagaaccaaaaccatactttaaattttgttgataacagtgatatacatcaaggtgtagaaatactgaatttagtatacacttcataaagtcatttctgttgacaactgattttggaaaaaaaataaatttaatcacttaataatttgatggatcaatggtgtgatttgggagtaaacttcttgaataaaaataaaacttgatgttttttccaaactgatagactgcttagactgatgagaaataaaactaggtctttaattattacctttgctatttgtctaagattctacccccatttagaaatgtgtttgttttacatcatctcatatggcctttggaatgttgtttccttcttaggtagtagattcattcttgatgaaaaccttccaaaattagaatttgctttaaaagaggctcaatacaataagtaaatgaagtctgtgttctgtattacattatttttgtaggatcgtttcacaattttctcacaattcttactttgatagtagagaaaataaaagcaagccaagagactttttttwaaaaatatattttatttgctataaacaactatgatttgcatttctcatgtgaagaataataattatcggctaaaaatggatttgctgcattgattttcaacgtaaatatttaaaagattaatgccagataattttattatactcacatttaacgacaagcaaagctgtttataatgatgactgtccatgtacacagttttaagttgaagtgagtgaatattcaagataattaaatgctacattttcattttcaggctcaagtggtcctgtcgaagtatttatcactgagactccgagtcagcccaactcccaccccatccagtggaatgcaccacagccatctcacatttccaagtacattctcaggtggagacctgtgagtatcccacccagaaaccttggatactgagtctcctaatcttatcaattctgatggtttctttttttcccagcttttgagccaacaactctgattaactattcctatagcatttactatatttgtttagtgaacaaacaatatgtggtcaattaaattgacttgtagactgaggggattttggttttggttttgggttttgtttttttgcggtgggggggctggtatttggaagaatttagctctttatgttacagaaatcttttttgcaaggacttagaaatgataatgcttaagattgttcttgcccaatgtgggaagagaatctaaggtttttatatgtcttgcaacctcatcaaaggaaaattactggcatcattttcataatttgaaaaaaaaagccaaattaatatatttcttttttgattcactttttaagtgatcatttttaaaactttacttttgacccactgwatttatttagatagarggaaaagagatgatgggagggaagtttagataaaggatggaagttggttttatttaaacaatagccctgtgatttcctaatgagaagtgactagaaattgaagaaaccaaataaggaggatattggtcaatttagctttagtttctcttactctctcaagcctgccctgtttaactccaaagttcatggctcataatttgagaaacactgttttaaacacaggagaaaaaaatgtccattttaaatcatagctattgaattctacaattacaaagaaacaaacaaacaaaatttgaccaacccaggcggttaaatttaaactcttcaggaaaaatttaagctgttaaaattattctttttctaaatttctaaagtggagggacagaatttttcagatttaaaagggcctcctaggtgcccagaaaattagtggaaagaaccacgtctagacgcatctttgatgtgtcagagttccaaggataaaaagaaacttttaaagtcttctatactcagccaggttatcaatcaaatatgagggcaaaataatattttcagacagattttaggcagtktatcttccatatatccttttctttaagggtatttgtagatacactccagaaaaacaagagtgaaatatgaaggaagttgtggggtccagcaaacagtgcttccaaatcagacccctgatagaggtggaaaactttgcaatgcaacaactgcgtagctggcttagaggacagccaatacagatggaacagaaagatgaggatgggattgagggatcagggattgaggtctccaagaataaaaagggacttcatggaaaaagtaggcttgtggataattaatcacaggggcaaataatgcagttaaaataacaacatgacaatcaggtggaggaatgtataataaacccaaatgtggctgggtagagtggctcacacctgtaatcccagcactttgggaggccaagccgggcagattacctgaggtcaggagttcgagaccagcttggccaacatggcgaaaccccgtctctactaaaaatacaaaaattagccaggcttgggggcgcacgcctgtagtcccagctcctcaggagctgaggtaggagaatcacttgaacccaggaggcaaaggktgcagggagttgagccaagatcgcgccattgcaccctagcctgggcaacagagcgagattctgtttcaaaaaacccccaagtgtattataaggcaataattcctatacgaagcaaactaaaatgcagcaatattaaggtataaaaacaaagaggaataattccattgaaccttgattctggaaactttgatccacccagcagtcatgatgttagactcattgaaaagaatgtatttctaatgcatgatgcratcggtctatagatgtgtcatggaaacttggttgcaacttcaagacaaaataaaaagtaaacatttacatgaaaaatggtggatatggaaggtggagaagagaggagataacagctttatctttcaaaatagagaattgagagatggtaccaaaagctgatgaagtaaaaaaaaaaaaaaaaaaaaaaagatacttaatataatactttaaattacaaatataaacacaagaagaacaaatataatgatacaaatgtcagacactgggaatgtccaagattctggaaggaaagggtggtattattgagctaaatcctcaactttgtctgggcacagtggctaaaaattagccgggcatggtagcatgcacctgtagtcccagctacttgggaggctgaggcggaaggatcgcttgagcttgagaggcggaagttgcagtgagccaagatggcactactgcactccagcctgggagacagagaaagaccctgtgtcaacataaataaatatataaataaatcatcaagtctcatattaaagasyctgtaaatatgactyattgttgacaaatgaaacaaatagaggtgtaagcatgttgtctacatggaggcaagaccagaataatagaaaatggaaacagattcccttaaagaggggaatcgtgtctttctcattggctcartgtagtctccgtagagtctagaatgcttcagcacctggcacactgcttaacaaatggtgaatgaaaaaaaaaaaagaaaagtcattctttttcttctttcaccctatgtycataatctggccatttgcagaacwtgatgtccagtgatcgaaatcaacagcatcagtgcatccaatatcttctagtctctcatcttcttattacatcattaattttatttactttaaaattaaggatatccaaagtattatgtgagaccattgcaatgggagacttaaaagtggtataaaatgtactttgggccaggcgcagtggctcacgcctgtaatcccagcactttgggaggccaaggtgggcggatcacgaggtcaagagatcgagagcatcctggccaacatggtgaaaccccgtctctattaaaaatacaaaaaaattagctgggcatggtggcgcatacctgtaatcccagctactcgggaagctgaggcaggagaatcgcttgaaaccagaaggcggaggttgcagtgagccaggatcacgccactgcactccagcctgggcaacaagagcgaaactccatctcaaaaaaaaaaaaaaaaagtacattgaattgraaagtcttcaaaaagcagcagtgatgaattttttgagatttttaacaattacaaaaattcagggttttttctaatggatgccacctgagactttattttctgttattttcttgtaataactaaccaaacaagctcatgttgaaaaatgattactaaatttgagctaattgcaatgactggtttcaaaattttccacagtgtatttgagttaaaatttcactgtgaagagtactacgatcactctcgcttattccaaaaatataaatggacacttgagtatttgaattattgaggaaatggttgactgggtaatttttaaaaatcactgggcayaaaaaatatattttgacttatattagtttagagtatttacacttgaaagagtctcatcttttctgaagggtgtttctttcatacacattttattgcactgagttttgtgacccatggcatattaatgaagctgaacaggatgtgaaatataaactggaagcaaaagattaaataaaccaaaattgcattttttctgtagtcttgtccaaaattgggtaaccacttctgatggggtagctcatatccaagaatgagtcacaaaaccagactygttgaacctggtatatgatgagtcacaaagcaacattctgcctttgttttttcaggacaagaaacttgaattgtatcccactgagttaaaagataaaatatatggcattggcatttctgtacttcagagaggaatatatctgtttgtggtaggaataaaaaataagtgagagaggcaaagcttaggttcatcatattatgttactgatataacacaattaacttggtaaaagtgaaggtgtgggtgggcgtggtggctcacgcttgtaatcccagcactttgggagtccgaggcgggtggatcacctgaggtcgggagttcgagaccagcctgaccaacatggagaaaccccatctctactaaaaatataaaattagccaggcatggtggcacacgcctctaatcccagctactcgggaggctgaggcaggagaagcgcttaaacctgggaggtggagtttgcagtgagctgagattgagccactgcactctagcctgrgcaacaagagcraaactctgtctcaaaaaaaaaaaaaaaaagtgaaggtgccyagtgtctgcaactatgtcaccccgggcatatcacatatcactctgtttttccgtctgtaaaacgggagcaacaatgccattgccttatcatcagaaggatatggagactaaatgggagaatgtaggtaaacagcacagagtatgggtatcagtaagtaaactgcagcagtttgttgatgttaacaatagttagcattatatctaactatatctaacgatataaccattgggaatccagttttccatgattttcctctagaatggagctgcctaagtcctgcttaagtcatttttctttgaagattactgaacatcatcttcaaatgttcatccttgtaaacacgtgtgtgtgtgtgtgtgtgttaatttaaattttcagaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagtatgtacacaaccaccctcatgcctcctacccccgaggttcctagagctaggctctcctgaggcaatgctttccttctcaattcatattcttccaggaggggcaccaacgttttttaaaatgatgttggcgacgaggacggtaaattttctagatgactgaaggctgactttcccctttctgtgactctctaggcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctgggtaagctcaatatgtcgctcaagacaggttcagggcagctgctggaaaactctccttgtgggggtgggtggcctctaggcaggtggtatctgtggtttggaactggttgacagctcagactgaacaaaccaccctctggcatgaggaagggaaggactgactctttctaagaagtggccgggtttttcccaagccactgtcacatgttcctggtccctgatgccagctgcatcatgcgcctacctgtgcacaagttcctacagcaaaagctgtgttcttggtggaagtaattaccaggactgcagctgacaatgtgagcacagtacggtcactcatacttttcaaattgttatggtgaggggcctttaaaaaacttcattggcgcactgaagtgtgtgccatcgtaagcactgagttcagtgaatttgaattcttataaagtgaacacaccacaagaccagcacccagatcaagraaaagaatatctctctaccctcaccccatcatcttccgccaataatcactaccctgactcttactgcagagagctatttttaaaaatttggcattcgattacaaaaattatacgtctttagaaaaaaagttggaaaaatgaaaggaagaaggaggaggaggagaaaggagaaagacaagaagtggkgttttcccatagtacattaataatcacagattaggtgggtgcggtggctaactcctataatctcagcacttcgggaagctgaggctggtggatcacttgaggccaggagttcgagatcagcctggccaacatggtgaacctccatctctaataaaaatgcaaaaaaaatagcygggtgtggtggtgtgcacctgtaatcccagctactcgggaggccgaggcagaagaattgcttgaaccggaaaggtagaggatgcagtgagctgaaattgtgccactgcactccagcctgggcaacacagcaagactctgtgtaaaaataataataataatcactgattagctattagcacattaccttctagtcgcttttccctatgaatrtataattcttaaaatatccttcttataagctgtagagtcatttgagggactagtttgctctgattagttaccttttcttttcatttcaaagatcttccaagcacagccacttctgtgaacatccctgacctgcttcctggccgaaaatacattgtaaatgtctatcagatatctgaggatggggagcagagtttgatcctgtctacttcacaaacaacaggtacatgtgtgctacatagtgttaaaagaatcttttyctgtaaaacacaggcctgtagtagcacttcctgactgttygccccactttctttctttcttagcgcctgatgccccwcctgacmcgactgtggaccaagttgatgacacctcaattgttgttcgctggagcagaccccaggctcccatcacaggtcagctaagcstccccctctttggctgctatgttaatsttaatgacatcagcagggagggcgcagattctgactgcggacctgcatatcactttaaatctccaatataatttatgggagaggggtttgtgtgtgtgtgtgtgtgtgtggtggcgggggtgggggagttattttctatggcacatttccccttgaaaccatttcaccaactcccttatacacacacaccacaacatacacacaacctgtaaagccagctcattggcttattaaagcaagtgttcccagggttgaagaggtgtaatttcctgaaaacgttgctctaagatttatccttaaggagaaagctgagctgtcgtcttagctcattaggtgattcaactgcctcatcactgaagttccaaaaagacacacacagtgctagacaactctgcttaggctggttcattaattgcttccctcgtctggagctcaaagaggaaaaatcagcttaacatgaatattttcacctaatggcatctctaattgacatttattaaggatgtcaggtcttcaaggatgacatttattattaaaaaggttcgcatgactgttcttattttatcttcgtgctgaatagtcattattagaagaagtggcaatattcaaagagtcaaaaagtatcactggctcttcactaatcaagcaagatgctaagggatattagaaaagggaggatttatggtgtttctaagcctctgtctcaaagaaaacagtgcatcttacttttgctcatgaatctgcagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcaggtaacttttttaagaagacacttcctatgttatcttawcaggattgttcctgaaggagggttgttttgtctctgtcaacagtcctcwcattcaagaaatcttatatattagtttttccctaaacttctgatatttagctgaaatgtcataagtaacttatcaaagctggctactggcctttctgattaaaaactgacaccataacrtccatctacaaattttcccctagaagcttaagggtcatttcatttttgattcttaagtattataaaatgattcagtaaaacaaaaactgttacattattttctgcagttatttcaaaggctttttctaaaaaawtttttagtatcttttcttataaccctctccccccaccaccatatgacacttcatatgctggtaactcacttattacctattttagataaaaggttcaaatgtcataatttaagcactatgactggaccatgaaaatgtgatctgattaagagacaaaacttagcaaaactctcgaatgagaggctcaatgaactgcctaacatatccaagaaactggcttcttaaaagtaatcttcagcagagaatgtgaatgaccagttgactcttgtctgtcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccagtatgtcttctcctatctctatctcccctccaaattctccaccctcacttgcagcctgtgagaaagtgcagtaaaccattcactcagaggtgtatggcttasagagagggaaatacccagccggcaagggaatgcatagtgaacacaaagcacattaaacttgaaaacaaaactcagacaagctccatggatgctaagtggtaacccatttctaaaatacatgtaccagctgaagggtactaagaggggagaactgaagagaatctaatttgagtgcatttttcgtgtaactaaatatatctagatcaaagttaaaatgcaggatcataacacttagagtagaattcatttaacaatagcaattgtcaagtgtctagtattactagccaccagcttatctgctcagtttttacaagcattattctcatatttactctttgttttgaccttaggaaggaaggtcttattattattattttatttatttatttttttgagatggagtctcgctctgtcgccagggctggagtacagtggcaccatctcagctcactggaacctctaccacctgggttcaagcaattctcctgcctcagcctcccgagtagctgggactacaggcgtgtgccaccatgccctgctaatttttgtgtttttagtagaaatgggtttcgctgtgttggccaagctggtctgaaactcctgacctcaagtgatccacccactttggcctcccaaagtgctgggattacaggcgtgagccatcgtgcccagccggaaggtcttactagtatccktattgaatacttaaagaaactgaggctttaaaaaagttctgcaacttgtagggtcacagagataggaagggatagagctggctctataacctatgtccgaagcccatgctctcaattattatactcgactgcctcttaaagatttcctctatttgaaaggtaatttaaatttcggtgggaaaactgctggttattattctcaagaataaactccacaacttatgtgattctgatagtgcaaactcaccagtatcctaccatgaatctgaggatacgttatcattactgtaattactgtctaatctgaaccatgtgaaaataacttttatttctctagcaaagggctattcacagaatattgcttttgacccatagagagcttcttcttgytgtcattttaggaggcatatccctttttccttaatctgtttggctcagagctaactgtgaacttcagaagtgtttgttttgcctttttaaaaataccattgctttaatgtaactataatttctgagactgatgygaaagtcttgctggaaaattagacttcccaaaggatcacagtcaagcaaaatggttccacaatttctcatgactggcagagttttggcaaagttttgtgtagcactcaatctcttactggctcagtttttccagggttttgactttcacatagttacaaccttgaggagagaaaacttagacattcaatcaagtttcaggacttgagttatgatcattactgatctaaatatttcttggcatgtttcatcttttttcctagaactggatgctcccactaacctccagtttgtcaatgaaactgattctactgtcctggtgagatggactccacctcgggcccagataacaggataccgactgaccgtgggccttacccgaagaggmcagcccaggcagtacaatrtgggtccctctgtctccaagtacccmctgaggaatctgcagcctgcatctgagtacaccgtatccctcgtggccataaagggcaaccaagagagccccaaagccactggagtctttaccacacgtaagctgaaaattaartgccttttcttaactatatttacattctctattcttcatgctttaaaamaaaacaaaacaamammaaaaaaacattaaaaaattagtacataatttaaatcagtgatactaaaaatgtgctccatagactggctgctggcccgttaattgtttgctgctagtctgcaacaagaaaaacggttgtgccagaacrtaaatcacaaagcacactgcttagtacagctgagaatttttctgaagccagattttcttgatgaaggaagcagtgtgttaatttgcacacattgccaagctcgctctttcctctagggccagcactttgagtaacatgggtttaaagcagtctgttattagaaaaattaaattcgattacattaaatgaatttaccaaacactagttaacgcaagaaaaaattagcacctatgtctacattctattactttgggcattgaatagtaactataaatgcagaataaaaatatctatggattgaatgggaaccaactaattgaacatgaagccaaggaaatgatttctttatgagtgttggctgcagaagattaaagtacttttgcagacggaatcgctcttttcttaaattactcttgaaattcctcagaggagaaaaatactaacaataatttttggtyatgtctatccttttgctcaacattttaaaggaagtggtcttaaatctcccacatatctacatcacaataacaacctctattcacaaacygattcctattaaatacatttccatttacattacagagaattatgagactccttatttctagctgaacatcatttgttattttcaactcgacattttgaattatagaagcacctaacataagtactttttcagcatatattctaaccatggactagtttgcaattttctaagagctttcaacaaatgttactcttcgactaatttaaaagtatggatgttaaaaagcattcaaaaagtccatacaagcctagtttgtaaataactatggaattgatttcccaaagaaaatacaaacttttccccataagaattcatactttaagaaaaacttacttccatttaaatttactgtatgaagtttggctcatgaaggctttttcctaaataatagttaatcgtaagcaagtaaaattcacttttaatttgcaaataagcttacttgaaaatttggctaaaattttacacggttctaagatagtctaagatctactctcatgaaattaatgtctttatatttcttgtaaatattcatttcttataaatgtccttcagtgaattagaatggagatttcagtgaatgcgccctttcagtagatgtcgtcttttactaaaatgtagaattctatagttgtcttgttcattccttaacatgagacatattttatgtagtttcttttgttgaacacagtgcttataaaagaaaaagcatttttaatgatgctaacaataattaagggaaggtggtgggccaagatatttcaagtacttctgaagactgatatattggatatattattttatgctttgcataatacattcatataaaatataatgattttaactgaagtactgatagccaaaactaattttattagataaaggttaacatagtgtctggaacattgtatgctttcaaaaactatttggtgaatagataattgagaaaggaataataataaaaacagctaaatgaagcttatatttaaataaactaatgtaagcagggtattctacaactccatttgaactttaagcactccctaaggctgtaaacatccacaaggcttgcatgtttttgaaattactaaatttctgtagttttttactatcttactaagctgaattctgggagtaacttttctgagttttataacttgtgctaaattcttaagagcaaatgtgagaaaagttaggggaaaaagctgtttctggggaaaattcagcttagtcttatattgatagggcaaattttatttctttaacagctgggctgttcttccctaacaagacctgccagaacccatagctcacacttagaatcacatcctttgtttgacatcgtttgkgggtttgtggtttggtgattttcccataatggccttcccaggcagagagcatcatcttaaacttgggaagactctaggtggctggctcaagcaatagaaaatacctagtcttaaagcccaggacagttgaggcgaatataatttgtaaaaaaagttgtggttttcacagatgttcagtgaaagaaactgactgttctctgaattgttttttgtgggccattaaaaatggtcacacagggctggccatggcattttggcacagtcaccagcagycaagtggtgtataatttcagaggtactaaaaggcatcgggtcacccatcccagtcatgtccccccaccccccaccaaacaccatcaaaataataacatacatagatgaaacagcccactaaaccagtagtacctcaattcagccattagagctatcattatgaagtggcccacacatatatttggctttttctcacacartatttttaaaataaaaataaaaaatggctccttagaatccagactgaaaaaaaaatgcgagaattgcgatgttgattctaaattcccacatggcaaagaaaaaaaaattgactggagttgagttgagactggagtctgaacactttttaatccctgtttgtataactctggagactaattctttgtcttgccagccattcataatttagtataaatgcattcagaggttttttcccaatgggaacaaaatttgattgagatgtaaagagaggaagaattgtggagatgtcaaacatgtgaccagagctatkaacacacttgatacccttgaacttaaacttacccaactcaaaatatctggccttctgcgatcttacctttctacatttataataagatttgcaaggttgttggaaatctctatcttaactttatatatacatgcctctttctttctttttctttcctttcctttccctttctttctttctctttccttccttccttcctttctctctctcttttcttcctttcctttcctttccttcctycctycctttctttctttctttctttctttctttctttctttctttctttcyttyctttctytctctcwcactctctctctctttctttcttatttttggtgctaaaacccaaaacaaatcttttatttaaaaataagattttttttttttttggccaggtgtgatggctcatgcctgtaattccagyactttgggaggccgaggtgggtagatcacctaaggtcaggagttcgagactggcctggccaacatagtgaaaccccatctttactaaaaatacaaaaattagctggatgtggtggtgggcaactgtagtcccagctacttgggagtctgaggcaggagaatcacttgaacccaggaggctgaggttacagtgagatgagattgcgccactgcactccagcctgggtgacagagcaagagtccatctcaaaaaaaaaattgtttaagtaaaattttattttctttcttttttttttttttttttttttttgagatggagccttgctctctcaccctggctggagtgcagtggtgtgatcttggctcactgaaacctccatctcccaggttcaggtgattctcctgcctcagcttcccaagcagctaggattacaggcatccaccatcacacctggctaatttttatatttttagcagagacaaggtttcaccatgttggccaggttggtcttgaactcctggcctcaagtgattcaccyacatcagcctcccaaagtgctgggattacaggcatgagccactgcgccyggccaaagtaatattttcaataagaaaaataacagtgatgtcaggatgctagaaaatgcaaaataaatttgttataattcctgattctggtgatraaatactaaatttttgcagtattattctgaaagaataatcacgtatttaaagtacaaatctttagacttcaaagtgcatccatggtggcagattttgtttaacttttatatagcatcttttattgcaaccaaaaatagctgaccattattgtggaataattcagcgtaaagctttttttttttctttttttgagacrgagtctcattctgtcacccaggctggagtgcaatggcatgatctcrgctcactgcaacttctatctccagggttcaagcgattcttgtgtctcagcctcccaagaagctgggactacaggcatgagccaccatgacagttaatttttcatatttttaatagagacagggtttcaccatgtttgccagcctggtctcgaactcctgacctcaagtgatccacccacctcggcttcccaaagtgctgggattacagtcatgagccaccgatccccgcccagcataaagctgtttttagatcaccttctataatttaccattgttcttaaattaatggttaagaaacaatatgataatcagtttgtggtggccagttttacattttataagggattttacactgacgatatagggaaatttattgtcatcaaagtcaaatcccaacaatcataaaaagacatgaattagattatataatttcaatgaaaggaccaccttagcaaacatctaaccccttgttactcaggtatcattcacgggccagcagaattggtattatctgtgtttgtcagaaatgcaaactccctagttttttgttggacctccagaaacagaatctgcattttagccagacccmagatgatgtgtgtggcacattaaagattgagaagcctgatcctctcccaattctcacccaatgaaaaaatatgttacatcctctatccactgcttggttaaactgaggttctccataaaaatacttgttatctatatgctatgcaatcatctgtgagtttgagttttgaatatgtgcattgattctctctcacagtgcagcctgggagctctattccaccttacaacaccgaggtgactgagaccaccmttgtgatcacatggacgcctgctccaagaattggttttaaggtaaactgcagatgttcctaatctctgtgatacagccctgaagctgtccttgtgkttcccatgtagtggaaacagggtgctcaggagtcaggagacctgggttttgtcacctgcttctgtccatacatctttgactacattgtcagggcctaacagtccttccctgcctacctcactgaattgttggaagggtagatggaggctgcgaaagtgttttgcaaaggataaaacattagcacgaagctgctgcttattgttatcttattttctctatyctttcctgcagggaattacatttcaaaaaaacatgggaaaactttatttgatgtgttgttctaaatgagtgtgaacaagttcacaaaagccagtttagggagaccagttaaactcagagtcacttaaaaatcgcattttcatccaatcagtttcatctccaactgttcaaagcactgagggtgaatctcttaatagaagttaagattaaggtttccctgtggatatctggattcatcttctttaaagtaatgatattagggaagcggtgaatacaaatgaatatgtttaaaagaattccattctttggcatttagtgtgaagagagaaatatttgttatygctggaaatcatgactcaatccccttgatygtttaaaaaaatacaccaaagataaagtttgtaaatggccatatttatgattatgctactcaaatatagaagaactttctgaagagtgccagtataccttttaattcccttaataatgtcatgctgactttcagaagccttatgatgtgtgaaggatctctctagagttgaacactattggataacagtgttacctaagtttttgaaatagaatcttaaaaggattttaaattatgggcatagttattctaattcttctcttgtaatgtatcatcctgcagttgaagctatgtacatatctcttcaaaaggtgtgtttttgcaatacagttgctacaggggctggtgcctttaaatggcaactaaaaggttaattgaatgtgaataactcgttaaagggagagctcagacattccttctagcacacacacagaaaaatagaaatgaactaccatgtgacccacagtccctgtatacgtctggtttgtaacaagagattctttatcaagcaaaacagtatgtaatgacatttctctggaaccttccatyacaagccaccttaaygcagtttggaagatacctcccccacctgggggaatttccagctaaagtatataaaagagtccccaaatcatttcccaataaaagtacactgtgcagtttctgaagagtttacactatttaaagcataatcatagcctcacagcagtaacagkcctctggaaatatttgtccttggtgtttactttgcattccttcctctagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacacgtaagaagaattttttcccttttctattagtttttaaaactgttctacttttcgaaaaaagctagtgtcaatatcactttttacttatgagaatggcacaggggagatatcttatccttacttatattattaatgctattcctgaatttggagtagcaggttcaattcatgctttatattttatggcatcagaaatgttctttccatgtcaagaatatttatgaactggcaagatgaaaataatttcaatagtattgcaaaatcattaatcataaaraagtctttgtcagagaattactgctgtccatcatattttcataatgtaacctatatttttatgggagggagggagggagggaagaagcatggaagagagggaggtagggaaggaggaaagattacacaggtcaagagctttgtgtcagctttgacttttaaaatgttctttctgcatagcattgtctccaccaacaaacttgcatctggaggcaaaccctgacactggagtgctcacagtctcctgggagaggagcaccaccccaggtaagtttgggatggatcagagggcaagtatacaccataccttcccaagacaaagattttagaaactgtgtttctttcagagaaagaagggattcaaattacaaatgcttagctctccataaaaactatagcagtacatgatgtacatcatggagcagcctgcaggatgctttaatgcacgttgacttcaatcacaggaagcagaacaaccttacactagtctagggggacaagacagatcctcacacagctgtagggctgaagaaaagcactgtggaaggtggcttttgctgagtgcattaaaaattgccaaacaaatggttgaagtcatattacgtaatttcccttttgtgagttgttacagagcctaagtttattattccctgaagttttatgaatgttttgtcatgggttgcaccacaaatatttaagggtgatgaaaggcagaaataccttcattttacagaataagaaaactgagacttagaaaaaattggcctactcatagtcacacattttaaatgttacaaaactgggattgtaacttaagtttgtagactccttctcacacccaatgtcacatatttggaatgtaatttttttttaattatattctatgcaaactgaaaattctgattaaggggtttcctgaccatttttagagctttaaatgaagcatttgtctaaattccttgttcacatatatttgaaaattatttataaaatgctaaaatgtataaagatagttgttaacaatattcaaacagcatgaygtactatagcaataacaggaaattttagatacccattacttttgccaaaaccacatggaagtctcaacaaacctatggagaaaaatcttaaacaaaaataaaagttccaattaatgttgattgcattcttacctcatatacttgttaatttaagggatatgtttaggttattatttagctatttctaattttactgtaaaattcttgtgaaatttttgtttaaaaaaaagtattatatagttcttatctttgccggggcacagagctaaggctatcatctctaaatctgattaatgtatgcaaacacacagaatgaaactagctcagaatatctcttttaatctccctctgaagtagagtgattttggtaaagttttcattatctgcggaaacattgtttaagccaaagctatacaatttccagctgagttgctctgaatttgaaactttaagttgacaatcttcgtgcttgttagcagcaggatcattaatatctcgtctcaatggcccagcccacayatatggatgaycactagcaagtgtaatgatctcaatatttatttctcattcagttgggtttccttgtatttgccacattagtgtttaccctgttcctaatggcaaaatattctgtcatctccttgccttttataaagtttaatatactttctcattttaatctgtccccacagatctctagtcatcactgtttttatttgaatgtctctcatccctctcaactcttttactgcccaatttctgtgattcctgaagacttcaacaatcaayactctctttttttgtttgttttgtttttttttttgagacagagtctcactctgtcacccaggcttggagtgcagtggcgccatctcaactcactgcaacctccgtctcctgggctcragcgattctcgtgcctcagcctccccaagtagctgggactacagacatgcgccaccaagcccagctattttttagatttttagtagagacagggttttaccgtgttggccaggctggtctcgaactcccaacctcaggtgatctgcctgcctcaacctcccaatcaatactctttctagaataagtatcascacttttgttyctcaccttttctcctttcttggttctcttcctataaatcccatagtttcagaccttttaaattaggagagctctctggggaatgtgcttaaggtggagarcgattctatactaggcaggtagaaaggaatattcctcagctgtcttcaaatgattcattaaggaaaagcagggtacagtgataggaccatgagatttggaaacaaagaaagctttggggaatcactcccctggttcaagatttcctttaaagtgaggatcttggcggaggttgaagtgagccaagatcacaccgctgcactccagcctgggtgatagagggagactgtctcmaaaaataaaaataaaaaaataaagtgaggatcttagtactgcctgaaaggattgttgcaagcattgaataacagtgacagtggagtcctcagtaaatgccaagtcctgcattccgccctgtgaatccatcattggagtctagttaaatatgctctggctcacagatyctctgtgcaataacttcccttttcttttttctccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccaggtaatagaaaaataagctgctatcctgagagtgacacttccaataagagtggggattagcatcttaatccccagatgcttaagggtgtcaactatatttgggatttaattccgatctcccagctgcactttcyaaaaccaagaagtcaaagcagcgatttggacaaatgcttgctgttaacactgctttactgtctgtgcttcactgggatgctgtgtgttgcagcgagtatgtaatggagtggcagccatggctttaactctgtattgtctgctcacatggaagtatgactaaaacactgtcacgtgtctgtactcagtactgataggctcaaagtaatatggtaaatgcatcccatcagtacatttctgcccgattttacaatccatatcaatttccaacagctgcctataaaatagttttgtccctgtatgtgagcactgaaacagcatttggttgacacatctagtttttcatcttgcagtttcaaatccttctttttgaaaattggattttaaaaaaaagaagtaaaagtcacaccttcagggtgttctttcttgtggcttgaaagacaacattgcaaaggcctgtctaaggataggcttgtttgtccattgggttataacataatgaaagcattggacagatcgtgtccccctttggactcttcagtagaatgcttttactaacgctaattacatgttttgattatgaatgaactaaaatagtggcaatggccttaaccttaggcctgtctttcctcagcctgaatgtgcttttgaatggcacatttcacaccatacattcataatgcattagcgttatggccatgatgttgtcatgagttttgtatgggagaaaaaaaatcaatttatcacccatttattattttttaaccttcttcatgcaagcttattttctactaaaacagttttggaattattaaaagcattgctgatacttacttcagatattatgtctaggctctaagaatggtttygacatcctaaacagccatatgatttttaggaatctgaacagttcaaattgtaccctttaaggatgttttcaaaatgtaaaawatatatatatatatatatattccctaaaagaatattcctgtttattcttctagggaagcaaactgttcatgatgcttaggaagtcttttcagagaatttaaaacagattgcatattaccatcattgctttaacattccaccaattttactactagtaacctgatatacactgctttattttttcctctttttttccctctrttttccttttgcctycccctccctttgctttgtaactcaatagaggtgccccaactcactgacytaagctttgttgatataacygattcaagcatcggcctgaggtggaccccgctaaactcttccaccattattgggtaccgcatcacagtagttgcggcaggagaaggtatccctatttttgaagattttgtggactcctcagtaggatactacacagtcacagggctggagccgggcattgactatgatatcagcgttatcactctcattaatggcggcgagagtgcccctactacactgacacaacaaacgggtgaattttgaaaacttctgcgtttgagacatagatggtgttgcatgctgccaccagttactccggttaaatatggatgtttcatgggggaagtcagcaattggccaaagattcagatagggtggattggggggataaggaatcaaatgcatctgctaaactgattggagaaaaacacatgcaagtattcttcagtacactctcatttaaaccacaagtagatataaagctagagaaatacagatgtctgctctgttaaatataaaatagcaaatgttcattcaatttgaagacctagaatttttcktcttaaataccaaacacgaataccaaattgcgtaagtaccaattaattataagaaatatatcaccaaaatgtaccatcatgmtcttccttctaccctttgataaactctaccatgctccttctttgtagctaaaaacccatcaaaatttagggtagagtggatgggcattgttttgaggtaggagaaaagtaaacttgggagcattctaggttttgttgctgtcactaggtaaagaaacacctctttaaccacagtctggggacaagcatgcaacattttaaaggttctctgctgtgcatgggaaaagaaacatgctgagaaccaatttgcatgaacatgttcacttgtaagtagaattcactgartggaactgtagctctagatatctcacatggggggaagtttaggaccctcttgtctttttgtctgtgtgcatgtatttctttgtaaagtactgctatgtttctctttgctgtgtggcaacttaagcctcttcggcytgggataaaataatctgcagtggtattaataatgtacataaagtcaacatatttgaaagtagattaaaatyttttttaaatatatcaatgatggcaaaaaggttaaagggggcctaacagtactgtgtgtagtgttttrtttttaacagtagtacactataacttaaaatagacttagattagactgtttgcatgattatgattctgtttcctttatgcatgaaatattgrttttacctttccagctacttcgttagctttaattttaaaattacattaactgagtcttccttcttgttcgaaaccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaagtaagcagttsaatgtatctgttccataaatattaacctagagcatagcaaatgaattctaaattctcaagtaggaggagctaagagcaagagagctgcaaccaagctacaaactaaactctgaattsaatgcmcagctccattaattttgaaagatgtaatgtttgttgctatcttaatatacttttgatatctacagctttwaaaaaatcatagtggaaaaacacctgcaggaaagttccatgacttcaaacaaattctgcttctaaataagcacgtaaaaataagtgaatatcaagagaaattatatgactaaatctaaatctttagagaaaaaaatgagaactgaaaatagtgtcaccatatgtgctttattctcatttttataaaaaaagtgtcagcagttgattgatttaggatttgaatacttagaaaagtgactgattgtttggtctagattagaatgttgttgtgaagagagtcagaagtttaatttgtacttcaaaaagaatctgttagaaggatttctcagaagactgagagcttagaaaaaaaactgacattaaataaataacaacaatttatggaaattgtctctttctagtcccaaccattatagaatagacatcttttgttaaagaataaaacagtaggctgcaagatggtgctgtgtttcacataaacagtgctttttattattttcactgtaatagtcaaatatataacaacagcaaaagattctacataagggaaaaatagcttacatttaggtacattaccaagtattagtctgaaaacatctacctttcaaacataatttagataatgaaacacaaagaagagcagctcagcgtgaccataatcttggtttcttactttgtggctgagggcaagaatatctttatattggcatatccaccaccccagggctgttgcttctgtmcaccctggaatcactaattacagcatcacccagtatacaagcccctgcatcacaatgtctgtcccttagccgtagacctgtcacatgytaatcatgtgttctaagaccttattataatcctaatgctacagatgacctcarggtagcccctctccctcctagcaaagtcattattatcctcttttaaagatgaagcaaaccagtgcagtggctctcgcctgtataatcccagcactttgggaggctgaggtgggccaattgcttgagcccaggagttcgagaccagcctgggcaacacagtgagaccaagtctctacaaaaaatacaaaaattagccgggcatggtggtgcacacctgtggtctcagctatgtaggaagttgaggtaggaggatcacctgagcctggggaggttgaggctgcagcaagccatgatcgtgccactgcactccagcctgggtgacagagtgagaccctgtctcaaaaaaataaacaaacaaataaacatgaagccgtcgaggtccccagcagttaagtaaattgccactggccagctagtatggtggaaatggaatccaggcatctggtcctccattctggcacttttccaaacttttgtagggggctttatagaaacgctgaagggcaaatggtgtgcaggggaatgagggtttagtgagtaggagttccaaatttagaaacctcactctctgtatcttttagatatacaaatatttaccatatattacagttgcctctagtgttcagtacagtaacatgctgcacaggctcatagcctaggagcaataggctagaccacatagcttatagcttaggtgtgtcawaggctytaccatctaggttttttgttttgttttgttttgttttgtttttgagacggagtctccctctgttgcccaggatggagtgcagtggcacgatctgggctcactgcaacctccaccaccaaggctcaagtgattctcctgcctcagcctcccgagtagctgggattacaggcgtgagccaccacgcccagctaatttttttgtatttttagtagacgaggggtttcaccatgttggccaggctggtttcaaactcctgacctcaagtgatccaccctcctcggcctcccaaagtgctgggattacaagcccatctaggtttgtgtaggtacactctatgatgcttacacaataaaatcaccaaatcacacacttatcaaaatgtatctccaccattaagctatgcctgactgtgtatcaaaatggaagaagaagctgggcacagtggctcacgcctgtaatcccagcactttgagaggccaaggcgggtggatcacaaggtcaggatttccagtccaagcctggtyaacacggtgaagccccgtctctattaaaaatacaaaaattagccaggcatggtggcaggcacctgtaatcccagctactcaggagtctgaggcaggagaatcacttgaacccaggaggcagaggtttcagtgagccaagatcacaccactgcactccggcctgggcaacagagtaaaacctcgtcaaaaagaaaaaataataaaaataaaaaaaaatggaacaagatactcagggatgtatatttaattttttaaaaaatattctgctctcattttaatatggcagaaccgattgctttctaagtgtggcttttttccagtaaaggttaattattaagaccactagtcctgscctgggtcaatcccagtatgatcctgggcaagtaaattaaagaagataacttctctgtgcctcagtttttttttgttttgttttttgttttttcatttacaaaatggagataattgtagtaaatcaaatttttagaggtgataggtttgttcatttcttgaatgcggtgatggtctcccaagtcacacatatgtaaaaacccatcactttaaagatatgcagtacrttgtatgacaagaaattgcttttaaaaggagcaaactaccttccagggttgttgtgaggcataaatggcaatccacagcaccacagcaaggattatcatgtgccctccagagacatactctcaggtggatgcgagaaatatccagctgttgcagcaacttcatcccactcgaaatccagctgagtcacactcacaggtggaatggagggcttcgagaggccatggggcaaggtgacccttccttatcatctaattacagaccttctcaaggtctgttcactgaacacttcgctgtagtgttcacttaggtgtaagtaggctataggactggacatttggatatttcatcagttcaaatagtcctgggcgtgctttagtttctcatgcttttgagcagagttttaaaataagcccsatttgcccctacagatctcctgcctggtacagaatatgtagtgagtgtctccagtgtctacgaacaacatgagagcacacctcttagaggaagacagaaaacaggtgagtggtgttggcagtatgactatccagtagcttttgcctatcaattctgtataacaaatgaaatgctacttctaaaaatacatctccattttttgttgtcatggtgtgtgtacctttgtcatcacagtatgattttatcgctggtctcaaaaactaaaagataccttactcaacartcacctagactttcagtcactaacaaattaagaaatttgttgtctgtccttttaaaaaacattttctaagaagatctttgttatttagatttagcagacattccttttcattaggcagctctgtctaatggctgacccaacactcattgtcatctatttgtcttcctttactaagccagcaagtttacattttctttttacttaataaaatatgcatttactagaaggaagttgaattgaatctcataaatattacatacttaaatatgaatgcttttaattttttctttcaaaaggtacactttagtgtattcattaatttatttatagtccacttgcttccaaaaaggacttatgatatcttagtttggtttcttattgaaaagaactagtaaatgctgtaactgaaacagaaatttgctggaagtcccagagactaagtgatttgaatttgcracaaactctgaatttttgtgcatttttgaaaaatgcatttttcaaaactgtcaattcacgaggaattatcagcattgtaatttgtctgggataatgtctttagtttcagaaagttttgtgtttggcatcattaccactctgttgacatataaatttcctcttgagcttaggaggcttctctgagagtcaaacatttactttgagagtgggcagatcttgctttacttggaaggatacacttacaggatagaaacacagaatacttgaacactgaagaatttgaaaatgtcaattctcagaagatcttgaacacttatctccaaatgtgacacagaaacttactgtaataacccctaaaatctgcttgaattacttagcacaagaaaaaaatgaatgcttgagctggctattttgaattgagtcaatttaagattttaaaattcatatgtagcttagaatcagtacatcttactctttggtttatggcaaatcatggtattgatgagacaggaacgaaatgttggatgtacgttaatttcccctacaccttcctcacttcctaaactggtggtgtcttttcttttttttttctcttcctccccygggtgggaaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacaggtaacttttcttgtctgcaaaraaactcagaagactttcctacccagttggtagattctgtaaagtagcttgctgttgtctgtcatcagctctcaaaaaaaaaaaaaaaaaaaaaaaaatagatcattgtcatggtacatggagagggaagtgagaaaatgtggagaaacatcttccttagaatatggtaaagaagcccgggcgtggtggcagtaaagaagataatttttttcctctcaagaaatttctcacctgatttgggtatttatgcatttctaataacacaagttttgttgaaaatgtaraaaattggccggacggggtggctcacgtcagtaatctcagcactttgggaggccgaaatgggcagatcacttgaggtcagaagttcaagaccagcctggccaacatrgtgaaaccccatctctactaaatatacaaaaattagcaaggtgtggtggcatgcacctgtaatcccagctactggggaggctgaggcaggagaatctttgaacctgggaggcgaaggttgcagtgagctgagatcaggccattgcactccaacctgggtgacagagcaagaccctgtctcaaaaaaaaaaaaaaaaaaagggccaggcgcaatggctcacgcttgtaatcccagcactttgggaggccaaggcrggtggatcacgaggtcaagagatcgagaccatcctggccaacatgatgaaacctcgtctctactaaaaatacaaaaattagctgggcgtggtggcatgcacctgtagtcccagctactcaggaggctgaggcaggagaattgcttgaacccaggaggcggaggttgcagtaagccaagattgtgtcactgcactccagcctggtgacagagggagactctgtctcaaaaaaaaaaaaaaaaarggtggaaaactgaacactgtttcaaagtacctttaaaaatataattttagggtaatagtgtcattgttcttagcagatagaggctgaagtacttacgggaacagtagcatcatgttatctgtattttagtctcaagtcgtcaagccagagacaaatacctaagggaagggtatataggtgttcattgtattacttttttttttttttttcttcctgaaatggagtcttgctctgtcrcccaggctggagtgcaatggtgggatcttggctcactgcaacctctgcctcccaggctcgagcaattctcttgcctcagcctcccaagtagctgggactacaggtgcccgccaccacgcccggctaatttttgtatttttagtagagatgggattttaccatgttggccaggctggttttgaactcctgacctcaaatgatccacccgcctyggcctcccaaagtgctgggattacaggcgtgagccaccacgcccggccttgtatcacttttttttttttttttttttttaacttttctgtagttttgaaatttttccaaataaaatgttgagggaaaaaaactcttccccaaatttgaaataatcattttatcacaatttgaatgggctctgtaaccccttatcttgaattcgtcataatataaaattctgctaattacacrtagtatttacatgattgtatggaagaatcattaagacaattatctggaaaatgaacaaacagtaaatctgaatattgtttgaaaattacggatgtgaaaagtttcccttttttttctagtttctgatgttccgagggacctggaagttgttgctgcgacccccaccagcctactgatcagmtgggatgctcctgctgtcacagtgagatattacaggatcacttacggagaracaggtacagcagtaaaatgctattttacactctgattaaatcagattctgttgtggataacctgaaagcccaacagtgaacaaagaattaaagaaactttggcaagtccattcaacggagcccttgttttttccaagaaaatacgtaagatatagatgatataatttgttctaaaacccaaataaaaagttgtttatatactacaactagagggggaacggcagagctgaggaaataaaaggattgtaaattcacaaacatattatcagtggtggaaataagtgatttttattttttcttctctttacttttctgtattttccaaattttatttaaaaggaatgtattctgttaaaagttttaaaaaggacacaatgcatgcaatcctgggttgagggcttaccttctcccacttctaatgctactctactactcagtgacattttaaagctgaaatgttaaaacagcgctaactgtaattttctctcaatgtttatacacttaccaaggtttgctacatgcataaatacccctttctgttcaagatagcgctctttaaaagggaataagcaagaagatgtgatttacatgctgctataaatgtggtaattcaattaatcagtaatacccaagtagctctaaacccctcacactctgaactaaccctttttcatacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacaggtacaaacttctactctggggtgacaccagcttttacttattcagatactgttttgcaatgttctcccaaggtatttttctaattgtagaatagattttcctttttaatgagcaacaacctgcagctagcacctgcrgcgaacagagttttgagccagataaagaaggaagcaccccaagggcaggaagttcagtcagttttgtcgatatattccgcatgtctgcaatacgacaggcatagagagtgttcagtaagtatttgtgggaaaagaatggatgagtkgataaagtaggaagagacacctgcttgtggaatgtagcttctttgtgaatgaagcaaccatctcaaaaataggaaatggtattgagatgcctgccccatccctctaaaagctctctctgtattctttcgagaagaaatacctttctcatgtaagmgatcattcgaatatgtaccagacctagagaggaggacttgtccaatcttgtctccaaggactggggcttcactggtttctccctgcttttatttgtagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccaggtaagaatcatctgcatctcggccaggtgcggtggctcactcctataatcccagaactttgggaggctgatgcgggcagatcacttgaggttaggagttcgagaccagcctggccaatatggcgaaaccccgtctgtactaaaaaatacaaaaaaattagctgggcatggtggcttgtgcctgtaatcccagctactcaggaggctgaggcaggagaatggcttgaagtctggaggcagaggttgcagtgagccaagatagccccactgcactccagcctgggtgacagagtgagagactccatctcagggaaaaaaaaaaaaaaagagtaatctgcatctcatatacaacaggatagatggggtaggaccacctaatattcttttttatataaatggctaccttgttgtgagtactatgtatttttttgtcctatgtcatcattgtccccattcatgagttcagggctcaagatcattatcaacccttttcacagtagaagtcttaagtgcatttctgtttttacatggatagttctatttagtgatatggacatcttaaattactagattcacccttctggttttgtttatcattcacactaagaagagataaatggcctaactgactttttcagctctttttagctatgttgtctttgtttttaaatagaatacttgtgaaattaggatcttaaggcaatttattagagtcaagttaattttcattttttctgagagcagtatcactaattgttgggggcatcatattaagttttagatcttatccttgagtgtgacttcactcccatatggtaatttgtattagcaatgaacaggtttgtccaagaggaaatcaaagtctgactctccatatttttgttacaattctgcaaataaaaattctaggccaccatatgtttactaccaaactctagacgccacttgaggactttatagtggatgacgtggatgttgcatttgcttttcactccctttgcagatcaaacagaaatgactattgaaggcttgcagcccacagtggagtatgtggttagtgtctatgctcagaatccaagcggagagagtcagcctctggttcagactgcagtaaccagtacgtaaccactkcttggtttccattttcaaagtcaaattttgttcttgggtgtctgaatgcccacgacatgtcttttgcaattacacatagggaaagtgaacttgttggttagtttatgtcttgagctgagccctttacgaacatcttttttccttctcagtgccaagcgaggaatttacagagaaagaagttgtgaaaccaccatagttagttgctgtgctttgaatttcttttgctcaaatggcctcagcgaaatcttatttgcctatagcawatctacaaaaaattttcctagaccgtcttttctacaactggatggtaaagttgattgaagtgtgcctcatgtagctttatgtttggggcatttgaagggctatggctggaccagagtgtaatataaatgcttaatagagaggggaaaagaagagtgtaagaaccattatagggctgggctcacgcctgtaatcccagcattttgggaggctgaggcaggcggatcacgaggtcaggagttcgagaccagcctgaccaacatggtgaaaccccatctctactaaaaatacaaaaattagccagtcgcggtggcacgtgcctgtaatcccagctactcaggaggctgaggcagaagaatcacttggacccaggaggcagaagttgcagtgagcyaagatcatgcctctgcaccccagcctaggtgatagagtgagactccatctcaaaamaaaacaaaacaaaacaattataacaatttgaatctgacattgcaaatcagctttaccacttccaaggtatagaaaatccaggtctatgagactaacatcacattgtaaaaatcaaatcgtggtagaatayctttaaattaatataaatacatccccattgtggggacattttgcagggtatctgcttatctcacatacacctatgttttaataagtgatgcaacattgcatattttctaaaccaagaaaaattaagcaagtgtttaagtgatttttccttttgatagtgggttaattggacttcatcaaagaaaatggtatctgcaaaactgctttgcatgttataaaaatgcttatttcacaacttgcttttcacataacctcttaccattaatttgcctaacagacattgatcgccctaaaggactggcattcactgatgtggatgtcgattccatcaaaattgcttgggaaagcccacaggggcaagtttccaggtacagggtgacctactckagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacaggtatatggttaattgcaccaccaggtgcccatgggagcagcggctttatgccctactgaatgaattatgcttcactgggctattgattcccgtgtaagggtgaaaaagaattattaggaaagatcctctttaaagaggaatrgtaagaaacaataaaacttaggtgatatttaaggaaacaagtcwgattaaaagaaattttggagtatcctggcttatacacaagaccataaagcaagacatttgaagaggatactaaagttgtggattatttcctaagctctgactccctgtgattaccctcactatgtataaagaaaagaagtttggcattacagagcttacttataaaaaggaacccaaactcgggcatttcatagcagcatgattctgagcacacgtgggtaagacctttcttctctggttagatatcatatgctggtgtataattagcttaaatgattgtgatttagacacctaggaaataatcaatagggcaattgctttccataatactttatcttcttgtgctttatttctgaagcagagtagaatgctaaagatgtatcctagtgacagcataaaccctagaggtgacagtctgtattattgcttttcgcttctcttttctgcttctgttgggagccagttttcttcttacgccgcattacagagagaacgtcaaatttagcagccatatctgccatagggtccaaataaagagacaataaaaacattattctctcttttttggatggaatactgcgtgaaatggttatccatacaaagatactttatgtagaatagaaaaaggaggccgggtgcagtggctcacacatgtaatcctagtgctttgggaggctaagccgggagcactgattgaggccaggagttcatgatcagcctgggcaatgaagtgagaccccgtctctacaaaaaaatatgaaaaaattagcgaggtgtggtgacacatgcctgtagtcccagctactcaagaggctgaggtagaggatcacttgagcctacgagttcaaggctgcagtgagctatgataactccactgcactgcygcctggatgacacagagagaccgtttctaaattaattaattaacaattttaagaaagaaaaagggccattgcttatttttccatacaaaagtaaaataaatcataatggccaataagccaatgtaacttttttttttaagggaaagcaaaacttgtaaaacctaaaatctcttagagttttggcatttacccaaatgttttcagtgattctgagaattggtggatataaaacacatttctcagcaaacactttcttcattttgcatcccttactgtactttcttgtactgaatctttgcttgaccagggaacccacctagcccaacaagaacaatccattctacttcttggaactcactttattttccttttcccccatttcctataagataacctctaaccaatgacaatctcgacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtaagacatgaccgttgttcrttggaataaagatggagatcatctctaacacagtttctaaggtggtgaaaatataatatcataataaatctaactgttcttttcctctgcatcaaataatcttattgtaattttatatcaacggaattcctttatgttgacctaagttttccagatgactattgggacagaattttataaayagctttggattttgtgcagctcttttagatgtattgtgcttattttaaaaggttgtggggggcaatttacatatccattggttgaatgcataaatcgacttagttatgcattttctgagctctgttaccttggtaaagaatattttacagtttgtaccagtctaccttgagcctaccctcattaaaacattttaaaatccttccagacatacatgcagaaaactgctaggaacctaggggactgatgtacctcttaacataaggccaatttcaggggaaactacagaaagagggttcagagacaaaakggaacattctctttgcctctctatgataaggaaaaaattatgatttacacctgtcagatcataaaaaagaaaaatacgctaatacccacttttctcattttttttaccagcttagtttaagtatataatctatggcttacttaagcttaaccgctaagagcattttaaaattgataaatacatttatcacctgcactgtaggaatgaaattaatctaggaattttcaaggttgtgggttttgctggtttgtttattttttattttctaaccattgcatttacctaatgctgtagtgaaactccttgggtttcagttgaggacgttgctaaagctcaccatgcccttatttctctaggtggccaccaaatatgaagtgagtgtctatgctcttaaggacactttgacaagcagaccagctcagggwgttgtcaccactctggagagtaagtaacaaaatgtcttcatatggacaaaccttctgtatagacaaaaattaaagaatggtaaatcagtggggttcagtggctcatgtctaaaatccaagcactttgggaagctgaggcgggagcgtcacttgaggccaggagtttgagacctacccgggcaaatagcaaggccctgtctcttaaaaaaaataaaataaataaaataaataattttttagatttatatgttaacagtggaatgagtcctaatttgaaaatcaatttgattgcctttttgacgcatgactgtcatcttttatactccttcagaaaggggtctactgacccataaaatggaatcacttcataagcttataatgttgatattatggactatgactgacatctagtttatgctctacttgttagaatttgttttcatagagctaagcttggggagaccactggcttctgctatatcttaacaatgcatattasgccattcttgcattactataaagaaataccggagactgggtaatttctaaagaaaagaggcttaattggcccacaggccagcaggctttacaggaagcatggtgctggtatcttcttggcttctagggaggccttgggaagcttactcatggtggaaggccaagggggagcaggcacatcacatggctgtggcaaaagcaagaccgagagagagagagagttggsgggggaggaccttatacatttaaatgacccagtctcttgagaactcactgtcataaagagggcaccaagccacaagggatctgcccccatgatccaaacacctctcaccaggccccacctccagcattggagattacaactcaacagagatttggacagggacaaatatccaaattatatcacagcacagtaaccattggaccaaatcaggcttagattctagtcttctgttatatcaataccttgatgtatgccttttcaaaagtcaggtaaagtgtcaaagttttatcatttataaaagagggatggcattgtacctgttgagagaaaatacaaaatacttgccgtaatattagacacacacacacacacacacacacacwctcwctctctctyacacwcacayacacacacacacacaaaattgttagctggccatgttattgtaactcctaccacacatatttttacattataatacattaataattttaatatttattgaagtatttgtagatactataaagccagccctgggaaccactggtagtatctataaagcttttcagctcttcaaaataaaatgtctgagaggtagawattttcctattttctaattacagttgacctttctctctgaatrccaaaggagrtaatctacacattactagttatatatttcttgaaatggatgaatttgatatataccaaggaaacgttttaaaataccaaaactttacatrgatgagccaagcaggcactaatctctagctatgctcctgtgcagatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtcagggaactcattgcactaaccacatttgttaacaaatacccacaatgtaaacgggcttattaactgttctacgactgacactgataaaatttattttcagtgttatcatcataacccagttttagaacgttattttcatgctatgatcagaaatagttttgtcctttgaatgcctgattttgtgtaatatttgtcatggaaattgcgtaagtgtcaatcaacaagtttgatcttccatcattgtgccctttcttatttaaaaaattgtaacataaggtttaaaactaaaagaaataaaaaacagtgatgtatagatcttagcattaaaaagcatagttaatataaaagtaaacaataccacttaataaaggccaaaattgtaaccgaagaatattcaatatctgaggtcttttttagctttttaaaattgtgattccaaggctcaactattgaccatctgattacggtaaagagaaaacctcaataagtggctgacccccattctgcaagagggcctcttccaacatagcatttttgcattccagaatttactttaccagtgtccttgtctgtatcagtgattcactttcgagatatgtttcttgttaacagttaacatccatagcatgctctmctttactgttcaaatgtggaccactttggtagtctatataaatatgggatgatagaagaacccagaaaaattgcaggctagcttgagaattctcctagtaaaaagcaagaactgttaaaaatcatctcttctcaaatcccaggtttacaaccaggcactgactacaagatctacctgtacaccttgaatgacaatgctcggagctcccctgtggtcatcgacgcctccactggtaactataccttctactgaggaaatgccattgacttgtatgcaatcagtttcatgaactcaaaaaacaaatgtgaggcrtatatttttgtattatagattccagagaatcttgtttccggtttacagtattctcagattcttttaagtgtgtttagaacggctcgggagaaaagtgtgggagtaattttcttggttatttgccttcttagagacttaattttgttttctttcagccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggtattgctgcttccatgctgtcattttccttcttactacctaggacacatgaagtccttagcaaactcccacagcgtctttgatactgtgtcatgagaatgcgaaactctgttcctgataacctcaaaaagcattctctgtgtaggagtggtagagcctaatacatcccaaaaggcaygagtgaaggaaaatgcaatttcaagactgtactaatggcatgactagactcatgttttcctttcgctgcaagtttgccagatacctgtcaattcagtcctggagaaagatatttttcaaagcatactagctgattgtgattctgtcattacactcagctctctatagatatggcaatcttgcaggacttgccagtgcaccacctgccattgaccttgttgaccactatcacaggataggtcttgaggcagagcagtcccaaccacccacattggaagaatgcctggaatggggaataagagttgtctaccttggtgggaaagactataagcctctagtattatttttgcccaagagatgaaatatttaaactatctgtattagtctgttttcatactgctataaagaggtttaattgactcacagttccgcatggctggggaggcctcagaaaatgtacaatcatggtggaaggaaaagcaggcatgtcttacatggcagcaggagagagaagcacacaggaggaacttccagatacttacaaaactatcagatcttgtgagaactcactatcatgagaacagcctgggggaaccaccccatgatccaatcacctcctctcctcaatacatggggattacaattccagatgagatttggatgcagacacagagccaaaccatatcagtctgtatagagtatcacctggactttaaaattcccacagaacatacagacattagaaggagacactggctttttagaattggggggaacaggaaaatagaagcagacatgagaggaattgaactagacacttcccacagaggctgcacaaacactggccaatctctcctacccttcacttgcctttagtttcacttttcattgatctgccactgaggactgcttggttattaggcctaagtagattcatgtatataatctgcaggactctctttcaaatttatattccagtggtggtatatgatgctgatagattttcttaaattcaaaaaggcaaataagaccacgttaaaagaataccctggaaaggccaggcgcggtggctcacgcctgtaatcccagcactttgggaggccgaggcaggcagatcacaaggtcaggagatcgagaccatcctggctaacayggtgaaaccccatctctactaaaaatacaaaaacaaaattagccaggcgtggtgatgggtgcctgtagtcccagctactcgggtggctgaggcaggagaatggctgaacctgggaagcggagcttgcagtgagccgagatagcaccactgcactccagcctgggtgacagagccagactccatctcaaaaaaaaaaaaaaaaaaaaagaataccctggaaaagttagccaaaaaatgtctattcaggcgtcagatatgatagtaagataattagtttgcgaygcggactttatatgcaggatatttgggtgtttatggaggaaaagtgaagtcgattttaccttcaagaggccaacagccagctggagaggaagtgcctgctcccagtagcgtctgctggtgagaccgacttccacttgactagctgagcccattgacataatgtgatggttctattctcccttcaggcctggaaccgggaaccgaatatacaatttatgtcattgccctgaagaataatcagaagagcgagcccctgattggaaggaaaaagacaggtaagagtatcttgcaggtaacaaggagaaagataggacaaaactaataacaaatgagcaatcttgcaatatgaaaaggttctccatgttttgatgcatttcttgtgatttttttwatctaacagcatagtgtatatattgtattctttaataggagaaataatttaacatgcactgcagagtttggttttattttttttctttactacagccactcaatataaagccttgttattcaccttttaaaaattcaaacaagatgttaaaatgtaaaagaagagctatcattgctcttcttttataccttctgttgaattttaaaatgtttccttttttaaaggagggagagaaacctctcacatttatctttatttggtttctacaacttagagctaaataatgtcttacttttgcatccagtttcagttaatttcaagaaaatgtgtattcctgatataggaaaatttcaaaaatgaacatgtgtgttttatctatttttaccatttcaaaccatgaaaaactgttgagccaaacctctgtaattctcatacttatgacactgatatgattagtctggattctacttcctacaacttgcttctcaaatttaaaaaagaaagagagaaagagaaagactgcacatttcagttccattaggtctaatttgagcagaggcagcttctacggggctcagcggtttaaagctgtgtgtatgataaattcatactaacacttttttctttctaaactataaagaaacctttgagaaaaatcctaaagatttctttctggaaaaagtgttttgtgatctcagaactgctcattttctggtggcttttatcaaattgatgaacagtcattgttgcctgaatcgattattatcattgctgctacttcctggagcttaatgcgctttgcttttttggctctaacctctctcggctagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccggkactcaatccaaatgcctctacaggacaagaagctctctctcagacaaccrtctcatgggccccattccaggacacttctgagtacatcatttcatgtcatcctgttggcactgatgaagaacccttacaggtaattaattgttctcttcacttctcatggggcagcacagaaaggaataagttaggtaactgaagtgaccagccctcgaataaaaagtggcttcatggcygggtgtgatggctcacgcctgtaatcccagcactttgggaggccgaggcaggtggatcatttgaggttaggagttcaagaccagcctggccaacatggtgaaacctcgtctcttgaaaaaaaaaaaaaaaaaaagtggctccacttttagaacctcttagaagatggcacatttaagccctgcttttttttttttttaaatcccaatatggctctactttggaggacataccagagagtcactagcttttatttcatagagaaaatgaaactatttctcttattctcacacatttgaggttcctttttgagtaagatagatgattctagaaaagaaagatattctacctgaatttccatttgtgtgcagaagtctaaaacactacctttacgatttgtccttgaagaaccccactatctacaacatatctaaagaaaaaaaaaaacaggcgaagctgtgcatagcagctgataagtgattgattctctaaaacgtatattatttaatttgtgttgacagtatccatttttttttttccccgagatggagtcttgctctatsgccctggctggagtgcagtggcgtgatctcggctcactgcaacctctgcctcccaggttcaagcaattctcctgcctcagcctcccaaatagctgggattacaggcatgtgccaccgcacccagctaatttttgtatttttagtagagacggggtttcacgatgttggccaggatggtctcgatctcctgacctcgtgatccgcccgccttggcctcccaaagtgctgggactacaagcmtgagccacccactacacccggcccactgacagtatcaatttttattgtgttgttacttttagaaagtggcagaatttaaaaactgacaacactgtaggaaatttatgagcttagaaacatgagtttgaggatttgcccaactgttttaaggactccacactggggtcagatgtcacctggaggagcatgacygtgtctcccatatagcgcagtgtccaggttttatgtgaagcaaacatggccagggcttccagagggcttatgcagacctgcgactgaagcaagatcaatggcaggccgtctctagtattgtcgagggctcctgttaactacggagcacgyaggtagattgttggcaggaaaatctggcaggaacgatggcccctatccttgttccatttctctcctcagctggttaggaccactataccctccctcttttttttttttttkttttttkttttttgtcttcctttgctttgtttaaacagtgagggttattggtaagaggagagcccgtgtcattcctcactataatgctttctctctgctttggatgtaccgataattgcagttcagggttcctggaacttctaccagtgccactctgacaggcctcaccagaggtgccacctacaacrtcatagtggaggcactgaaagaccagcagaggcataaggttcrggaagaggttgttaccgtgggcaactctggtatgtaaacacgtactatttagacacargctcccctctgctgtacaccagagatgggcttttctgttgactgtacctttgttgccattgtctttttatctttgggatttaatgcaacacatcaayatgaaataaatgagcaactttatattaaattaatctctcccccacctcctgccatatcctgttgtcttcacaaaatgcatacgtaattgacagactctcaaatggtgatatgattatagatctggaagggatttcaaatattatttagtacaacactctgagtccttacttstgagtatctgagttgatatagggcacaggtttcctgatgtcttttcccagaccctctccatytcaccatgctgctgtcctcttgagtgattaaatactgaaacgattacctataaagaaaataccccttctgcagacatggggacagttggcttttgctcctgatataaaatgctaccaacattgtgcatttctgtctgcagagaatgttattccaatgttatttccattttwttccaatgttatttccatttttttttctgactatacaggttaaaagcttctatagaggttaaaagatcattaactcttctttgtagcacctgggaaatccttttaaatcaatagcgtgccacctggctgctcaatttgcagcagctgaaaattcaccaaggcacatgagataggggataatcaaaaccgtgaatccccaatcttccaacaggagagttctctactccacaccaacagagagtgctaagtcctgtctatgccaagtgacagattttattcctaaggccagttgtttaattttagccccttccctcatctgatagaagactgtgctactttacatgtataaattcctgtgaattaagcagttgagcatttggctggagagaggttgggaggagattattttgtgtttgttgtattacatatccacagtaatgcttatctttgccttttgtggttttactagtagaatgccacgtgaacagaattttcaagagcaaaaaggtctttgtgcttttctaagtcattttttttttttttttttaaagattccatctctttaactttagttaggatggaatttgaactcctggctcttttgagtatagaaacccctagtaacaatttaagttccttccatttttcttttaaactccttattcccagcagcagtattctacattctaaccaggttctcccagctttgagacgtctcagacttaccagttctccaaaacgctattttctttaagggtgacaccttttaaaaattaggcacctcaaayatctactgcttttgagcttttgagttttgcactgtaaaaagaaaaatacacagtgggattttaagtcaaattagtttatctaatttttagggaataatttgaagcatgctttgtttgcatagatttttttaaaataagcttttccaaatcataaagagataagatcttaggtaacatgaagagactcccttacttattcctaaatmatctatattccaagggcattttcttatttggaacagttgacctcactgataaagctgtctcaccactataataacaatgtccaaaatctaggctttctgcactattatgcaaaaattacaataataaaagtgaaaattacattataatggtatattaaaatgctaagacttttgcattataagcaaaagacagcctttaataattattctttatttagtgaacattttctaagtcttggaaaagggkcaatgttttgaattcatggccttatataatcttcacaagattccccaggaggtatagatatttttattattacgctagtattgcagatgagggaagcaaggcagagtggtattaaatagctggcccaaggtcactcaggtaccaatggagaggcatcattagtctttgcatcccactaaagttctccactagcttcaattgcctcaagatctgttccatgttctatgaagtagtttcaacagaaatggcaattatcttagaagcaakggaaaaataaaagatgggcttcctgtcgggtgcctgtgacaggtgtcacatctaaccatggttttttagagcagttaatgccttgatagaacagatgaatgcctcttaatcctcctggaattcttgttttagattaagtcattgtatacagtcattcgattttcttcttatggtccaaatcgattaataagatgtctctttttgctttttcttccttttcttcatagtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagtgagtagttgctttgtccatccacttccrtgtttgtctcctcaagttccatgcatgcactcatgtgccaaggaagcatgtttggaagacacaggttcttccaaacatgaagcaaacaagagaatactgtttgactcgaagtaatattttgcatcatagaaaaatgatgggaaattttacttgttggacattgcttcatttcaagggttgtatgccaatacaactattaattacacataagattatggtgctaatttgatttttgaaattttctgtgaaaacaaatkgataaagacttttggaaccaggtctatttaagagtattagagacacagaaaaacctcaaatctcttttaatcttcagtgttgaatgagatcagaggtgaacatttagactcaaaaacagcctccttcaacataaaccaaacatgcacatatcatagtacccatgcacacacttttgcrtcacacacatagyccaggtagcttgaacgttgctagaaatatgaaagaaaaaacagataatctgcttttagatcattaaaaatcaacttgaattgataaatgtttgattttcaaattctaatacgttttaattttcaaattttttaagttaaaatgtgcctaggaaatatctattatgctttgagattaggattagaatttataaacctttcatttattctttgtgtttaggagatgtgatgattattgacaattggttcatttttataggtgttgaccgttatgcctataaataagcctcctatagacatacagaaatcatatcctgtggaattagaatataagacttggtaaaagagattttcaaagtattttacttaacttgtatacttgaaatcatttaatccagactgaagttgtaaaagccagccagtgttttcaatatagacttccatgtttgaccatctgaaaatgaaaaacactaaaaacatcacatgctgtttaggagctggaaattttaatatttgacttcaagtagatggtttttaactcctgaaatcgaactacgtttaagtttgtatgtttattacctgtttgagcacttaggtgcaattgtgggagcggggatgtcaagttcatttatgtgactctttggctcaacttacataatctttgttttgatatcacagttgtctaattattttactttgtagcttaaggcaggctgaattgttgataaaatggaaaaagtagtatattgttatataagcttctgaggtgtgttttgttgtataagccctggaggttaaaaagtcatcccttatgtatagtagttaaaggcataaaactgtgacttttagatattccacagaaccagacttatttgatgtggataataaccaatgatttagcattttgtttgcttttgttttattttatccgggttcattttttactcttcccatgtacatgaaacaggtggtggcgtgtagagatcagctgatccttgttttatggttaattgaactactttgtatccagggtttctgcaaatccaaaagtgatttttcatctaggatctattcctaacagtctactccaatcccactttagttttccacaattttaaatcttaatagtgagaattcaaatgaaagtcatttcatttgactattctgatgacatgattgtggcagaataaattgggtcttaaaatgccctagaaaatggtaaatgataaaaaataatattttaaaattcaaccaaagaaatggcccattggccaggtgtggtggctcacacctgtaatcccagcacttttggaggctgaggcgggtggatcacctgagctcacgagtttgagaccagcctacccaacatggtaaaaccccatctctacaaaaaatacaaaaaaaaaaaaaaaaaaaaaaatagcactgtggggagtgcctgtaatcccagctactcaggaggctgaggcaggataactgcatraacccaggagatggaggttacagtgagccgagattgcaccacttcactccagtctgggcgacagagaaagactttgtctcaaaaaaaaaaawaaataaaaagtaaataaataaataaaataaatggcccattataggggtttttatctttaacttgctatttttccagatcatggttctgaagaccctgtgacacgtcccagttcacctactgtcttgtgagtcaraatatacaaataactttttggtcctgactttccccacccctacaggatggtgccatgacaatggtgtgaactacaagattggagagaagtgggaccgtcagggagaaaatggccagatgatgagctgcacatgtcttgggaacggaaaaggagaattcaagtgtgaccctcgtatgtcatcasagatcatttttagtgccttattaagcattctcactttcattatcaggctgtaactctcattcacagaaatgattggagactttaggtctccttgaggagtgaacagtgggtttcttaatcttttgatttgggaargtggagacaagcttcaaaaatgagtcatgatttaatgttattacaggrcactttagcacttgtccaacctgagtattttgaccattatctgcagtaaaatgctacaaagaagctttattggtctgtagattcaacttttaaaatatgatttccatcttcccgttggaccctttccagtgtattaggtctaatttttggaagtgccaccctaagatctgtatagcagtactrctcttagggatgattcacataaatatgtggtgtttgcgctgtgatgatacaaatttaggacagaaatagaacccacccctagatcaagtctgcagtattgttctcagcttatgcgtgcatctgtcttgtgtctatatgcagatgaggcaacgtgttaygatgatgggaagacataccacgtaggagaacagtggcagaaggaatatctcggtgccatttgctcctgcacatgctttggaggccagcgggtaagactggatgtgccaggctccctacaagttagataagataaagggtgggctcctgcaaggatgtgtcgtacacacaggaggggcagagacccttcggaagtattaaaataccacatttcctgttggcatacaactgctgacatagagctctagagcagctctatgtctaccttacatgccattcattctttctattactcttagtagaaagaatgaatgaatggcatgtagagtaccaaaaacacaagtcttgagtcattcttaatagcaacacctgtcatttatatgatgttagaatcattttcctaagctccctagcatgtcagagatactatttacactgaaaaatagtgaagcagagatactattcaaattaattagtggtaaatagaatgtgtttcatttcagccggttctccccatcctgggcagcctgagaccctcccctcccctactattctcaggctgcttctatttttcagcaaagtgttaagtgcagtgtagctctaggcctccaactccattctgatggacaggtgtccccatggcaacgttgttaaatattttgaataatatctcagatgtaagaaaatgccacttcttttaacctctctcttgattcagaacagatgcttgttataggtctagcactgtgctaagtagtataggaaaaacagaggaaatgagaaatggcttggctcttaatgatatagttgaagatgttaaattagcatacatttcaaagtcaagctaattaarttctaagtgggtctgacaaatacagttctgggtaggctggaattagcaagaaagagaagcatgaactggctgaggtttacgatgactaaggtttagttgggaggggagaaagcagagagacacaccccctgggatagaaaggagctggcccaggtgggctttggtgagccaaccctctgcctgctgtcttctggtaagaaaatagatgggaagaagtggcttatggagggccttggcaacccattatttaagccagtacttctcaaccatttctaaaatatgcccagtataacaaaaaataataagcctttctctaatatgatttcaaatttcaaaatgaaattatgtgtaactcaaataaaagcaatggaatgtgacagccctttgttttcaacgaagacatgccctcccagcaactccccaaatcctggtgggtgaggggcatgcttcacactcaagggtgagactcattggttaatgccaaatgcattaaccaattacaggtatccaagatgcaaagaaacatgatggaaaatagtctttgggaaaattaatctggcagcaggggtgttcaggggcctgtcttggctccaccaggggcagcccatggaaactactatgatcttgtttcacccccagtgattacatggggagggaggtgctcccaattctgatggaggagaattggagattggaatttagattgaattcagtatctctctctgtctctctctctctctctctcccattaacacttacaacgactgtgattgtatgaccttagaactcagtcattctggtatgaaattgtgtgatggagaatgaatttgctgggaagttgattttggtctcacttcagcatcttctcattatttatgcacatgaaacctttcatgtgcgacacttattctattctcaagtgctaaatgaaacatttaagacaggagtggaaactgttcactttctcatatgaaagcaagattcagtgattctgtaaggaggtagtcactggtattgtgttaggtattaaggggcatatgtgcttaaacagagaaatatgtctaaaatatttaaattctaatataaaaaagaaagtgactgtattatttagggctgcattttagttgtaagaaaaaagtccaactcaagcaaaaatggcccacacaatggaacagtcccaggacccaccggcttcaggggctgctccagcaatggcgcccggactccctcttgctccgcgtgccttcccatgcactggcttcgtgcttcagcggggtctctgctgatggtgccattgatgactgacctccatgagcttgctttaccccctgccagcttaagaacagtagtgaaagagaacatgtgtgtcctcccatttccagtaaaaacttcaggcaggagcctcactggctcagcttggtcccgtttccatctcccatgccatctccggccaggtgacaggctaccatgtcactgcctagggaagtttaggaagagagtggcaaagtggtgcattagaaagaacatggccaggtcaccccacctcctgggcggcaggcccaactccaccagtggtccactgtgtgacttccctgctccctctaagcaagtcactcctctcctctgggtctctgtttccttacctataaaatgagaacrtttcttcatgtgatctcaagtcccttttaaaatcgctaggattctttgaaaaccttttctatcatctagtgcagagaacttgttgaggaagttgggattggaatgagcctcagcagatgggcaaggtttgaataggaagagaagagacatttcaggagaaagaaacaacatagagagmcagatgtaggtataagatatggtaataagccaaaatgtattaagagttataaatgcatgaaatcatcatcaaagcttgcttagtgattaactgcttatattttgccagtgcatatgatgtgacatttttctttaactcaaacactaaattacgatgtcctcaggttatcataaaccccatttgacttcatgcctctactctctcagggctggcgctgtgacaactgccgcagacctgggggtgaacccagtcccgaaggcactactggccagtcctacaaccagtattctcagagataccatcagagaacaaacactgtaagtgcattagcagcacaagtgtgttccctcatactagacagtctctktctacaggtatstttcttcagaatgaaccaagtgttttaattaattaaaaaaaaaaacaactcataaatgacttaagtgaaacactgtattccataatatagtttaagttataatttatgtaactcttgaacatctcctattgcccagtatgctgctaggttcttgaaactaggaagaaatattatcctatctataagcagctgtcatgagtccccacctccccgcatttttttttctgtacactttacagtatttgccactaatttttttttccttcttcctttttaacagaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctcyagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaarttgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggacccmaatatttaytaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaagtatttgaatagtataatatggaggagttttatcttagggaaaccccatggtatgataacccccatctaacatgtcttactttgggtcagctgacacttttggcatggcttgataaactcccagctaaacagtttgtttactcctgatctgtaaaggtcatttctttttcaatttaacattgaggaaacaaactttgggattaaatttgacattcaggccaggcgcagtggctcacacctctaatcccagcactttgggaggctgaggcaggtggatcacctgaggtcaggagtttgagaccagcctggccaacatggygaaaccttgtctctattaaaaatacaaatgttaccaggcatggcagtgggcgyctttggtcccggctwctcagaaggctgaggtaggagaatggcttgaacccagaaggcggaggttgcagtgagctgagattgtgccattgaactccagcatgggggacagagcaagactccatcccaaaaaacataaataaataaatgtgacattcagaatagtaaatagtggaaatggaaataattattagtaaaaaattagtagttcataataaacaagacatgcaaagcactttttaaatatactaatgtacaatgaaagaaggtatttcaataaacacctggcaaagaatattaaaactaaatacagaaagatacttcctcatgttcatttgaaaaaaaaaaatactaactcccatttgaattgatttacagtttataaaatgctttgacatttagctatctcatttaggggaggttttagagcttaattttacagggcatgaagctcagatgaggtttccttagcgaaatacagacccagcccctggacttctatttattactgatctttaagctttatcagcccaatagtcaccaagagagctgctctgtatgttttttaaaaatcacagaaagtacaaaataaaggtgatattaaacgactgtctcacatatgtcggtcatcactgcaccctggagagagaacgtcatctcgatgccaatctacacactgtgggaagggacaaccccctgagacacatgtgctgcaaaaagtaagctgatgcttccatattcataggtgagctggtaaagcaggcccttcatctgaatcttgcttaaagccttgatatctaaaaacataaggaaagagcagctttaggttgagactgatgatgcttcaaaccacttgcctaactacaaacctaaaaatatttaccctaaaatgcagtgtaagggccgggaagggtggttcacacctgtaatcccagtactttgaggcgccgaggtgggaggrttgcttgagctcgggagttcaaggccagtctgggtaacatagcgagacccctgtctctacaaaaaataaaacaattagccaggcatggtggcacatgcctgtggtccccataactcgggagactgagacaggagaatcgtttgaacccaggaggcggaggttgcagcgagtcaagattgtgctattgcactccagcatgggcgacagagtgagacttcgtctcaaaaataaaaaatttaaaaaatgcagtttaggcaaatacagttggactgtattaactaaatggatagcaagcccctttacttttatgttgaaatgtaaaaaacctcaagttccccacttaaggtcaggaaaaatgccaccttttccaaaatgtctgttggattctccaaagtgatacattaaatttatgaagtaaacgaatagcaaattaaacacatttacaaggccttttcttttagcatcacaatgcaagaatgatgaaactttcttttgtactgatcatttctcagcaaatagcatagtatagagttttgtcttggggaaaccccattgtatgataaccccaatctaatgygtcttactttgtgtcagctgacacttttagcatggcttgataagctcccagctaaacagtttgtttactcctgatctcaaacaggagaaccaactatttccaaagatcttttgccgtttttattgattcaggttattgcttcccccgagaattgttttaagcgggcaagattgaaaaggcattactaaaagaaaaatctatatttaggcaagaaatcaacaatgcaagaaaaattaggtaaaactagtaaatgttaatcagactttaaaaagaaatatcatcgttttaaagttttacattgccttgctacacttgatttgtaataaaatgttacattttatattgttttcagctctaataatctaagtgaattatgcaaataagtctgtataataacatcactatacacctgtagggcaccctttctatggaggtgaataaagaaatgatcagggggaaattacaagtacaggaaatgacttttctatttaattatatttccattgaaacttctattccatttctagtggtatgaaactcattaaagtgattaagaaacatcacatcagcacatttaagtgctcaaattgcttcctatttagtaagttcccattactgtgatagggaatgtggcaggttacaattaaaaaatcccattttcaagggagacaattcaactcttaagaaaaaaaaaaaaagaccgctgttgggacttcccatrtttggaaacatttaaagattaccattaaggctgataaagcagaagaaacacaaagatgaccttgcagaaactaaggaagttttttcaaaatacttgaaatgcacgttgttttcattatcacatcgtctcactccatatcctcattaaaataaaagattcaacttgaattgcaaacagaaacctatataaattacaaatgaagaaaagatgtaataaaagagcaagagaaacagggcttcagccgaaagtcccaaatgggaaattccttttttaacattcctcagtagagtcaggtatgagatattaaagcatgttttacatttccttgaattcctttttacttactctttagagacatacaggttttaacaatctcaggagccaaatttatctctaaaacagctcatgtggagcccccaaaggattgaaactagcattggttgaagctgtacgaggcagccagcccagaatgatggactggggctggcgtcaagtgccctgaagctacccagcagagcaggctcccttaggcaagatacatcaaaggccaaggagtctcccattgggccctttgcaacttggtactttgtaaatggccatttcattctagaatgaagcactgcctttgccaggagactgctggacaagactttacaatgaaacatgcccatctctgtaattcagcttcagatgtaagatgctgagccaagtgctggaaagctatttttgactcaaaaatgtacggcgatggtggagcaactggaaccctcattcatcgctggtggaaaygtaaaacggtgcggctgctgtgggaaacagcctggcagctcttcaaaacgttaaacagttaccatacgacttcacagttccattcctagatatatactcgagagaacagaaaacatatgttcacacaaaaacttgcacacagatgttcatagcagcatcattcatagtagccaaacacggaaacaacccaatgtccatcgactaatgaatggatcaacaraatgtggtatatccatataatgaaatatctgaccataaaaggaatgtacatgctgcaatataaacctttaaaatattatgctaagttgaagccagacacgaaagagcacatattatgtgatccaatttaggcaaaatgtccagaatgggcaaatccatagaaacaaaaggtagatttatggttgccaggggctggggcgaaggggaaatggacagtgatggctaagagttaacttttggggtgatgaaaattttatggaactagataatggtgattgttgcacaattgtgtgaatatactgaaaactgctgaacaatacgctttaaaatggttaagatggtgaattttacgttacataaattttatcttaaaaaatgccacttcagttatagaaaatctaatttttgctccttcatgaggaagagatgtggggtaagagtagatgaaggctgaaggaactcagaaactttgtggctaccaatttggaacctgaaacaaaattatccataaatagacatcatttttcatagtaatttccataggttatcttccactagttcctatgcttccatatacacaaaagcattatgaaaagaataatcagcatctttttgaaacagtatttatcgtgactcaggtggtattttaagtgcccgcaatattttgtctmatttgctcttcagagcaactctaagacgtcagtattgttctcatctcattctacaaattgaaagtgcgggaaaggcaatgtgaatcactaaacatcacatagcttgtaagtaggagaactgggactcgaacctgatagactagcaccagaatatgtgctttcagccagaagctattcagccttttggaggagtgaatccatccccattttacagaagaatcaaactccaagagggttaagctatgtgcccaagattgcccacctactgactggcaaaacaaggtactgattatcctaagaggcayaaagacaatttcctcgagggaaagatggagccgtaatcaagcacaggaatgtgggggccttctagcaaaatctccttcttgacctggttggtggtgacacaggtgtttgcataaaaattatactttaaatggtaaaagtttcatgcacttttctatatgcctacttcattacaatttcttttaaagataaatttgtgcctggcacagtgtttggcaaaaataaggtataaaaatgtccatgaatggaaagcactgcgagcttaaagacctgcagggttctgtgctctgaggaagggacataggctgggctttagaaaggtggcctggagagaagcaggtgtcaaagggcaaggcaacgggargaagaatggaggatccctttcatggactgttttctccctgtgcccaggggatcccccaatagaaatacactcagtattggtcaggacgttgttacattatggatcttctgtccttctgctggaaacaacagacataagatcattatgcatttcacttaaacaccagtgaaactccactcttgacgtttcgaatgaytgaattatactagacatatatatgttaatggggttccagtgccagaccctcccaaagtgctcaacttccttggttactggctacctccaccaagattaacttgagtacatataaaggaaaayaccacctcacagagcaaaatatgaggaacccaggagtaagcttgcatgtgaggggtggcactttggcttaaggcaggacacygctttttttggcataacacagggaagtgagacagtaaaatgagaaaggagctgttgacagccctaaactgagtcgttttccagagtgaagaatggttgctcttattgcttgggtgctcctccccggggttcattcaatcctgtccttcatgaaccccttggggctggcgaggagtgcatcagctgggctgtctcaagcacacgctgctgggtagccaatgttagtcagggaaaatgagctcacaggccaacataccacaacacttgagtaaagagactttaaaagaatagtaacatactagattacagatcctaacagaagtagaaatagtaaaacaaagctagaaagatgataccaacaattggaaaagaaaaccagaaatatttgaagggaaaaataaaactcctgaaataaagggctcaatagacaggacacacagcagaatggatacattgtaggaattcatgagaaaattagaagaccagactaaagaaatctcctggagggacgaataaagaaaatgaaatataaaatataaaagaaaggctaagagatataggaattgcttagaaatgctaacatttggataaaaaacagaagaaatgggagagaggaaatatt

SEQ ID NO: 13238 - DNA, 53641 bp, Homo sapiens
ttacagctgatgccggaatgagttaagattttggggatatttggatgtaataaatgtatttagcatgtcagaagaacatgaattttggagggctggggtagaatgctgtgaattgaatgtttgtgtctgatatggtttggctgcgccccaccgaaatctcaacttgaattatatctcccaggattcccacatgttgtgggagggacccggggggaggtaattgaatcatgggggccggtctttcccatsctattctcatgatagtgaataagtctcaagagatctgatgggtttatcaggcagtttctgcttttgcttcttcctcatttttctcttgctkacaccatataagaagtgcctttcgcctcctaccatgattctgaagcctccccagccatgtggaactgtaagtccagttaaacctctttttcttcccagtcgtgggtgtgtctttattagaagcatgaaaatggactaatacagtgtccctccaaaattattatggtgaaaccctaattgcccatgtgatggtagttggagacagggcctttcagaggtgattagatgagagtggaatcctcatgaagggattagtgcccttacaagacacatgagacagtgcgacctctctctctctctctctcaattcctctcagctctccaccatatgaggacacagcaagaaacaggctacttaaaaaccagaargagggacctcactaagaactcaacaaggttggcaccctcgtctcggacttccagcctctagaactgtaagaataaatatttaagccactcattgtatgatatttttgttattagcccgaagtaagacaaagaagaaatattgctccaamaagatttatgagtatattttacagatctgcattggacaagttagctttccctgcaacgaccatttactgaatctttactatgtgccagaatctgagagtcatattagcatctgcaggtaaatcagccaaggttcaaagagatgactaaggccaggcacgatggcccatgcctgtaatcccagcactttgggagacccaggcaggaggatcgcctgagcagaggaattcgagactagcctgggcaacgtggtgaagcccttcctctacattaaaaaaaaaaaaaaaaaaaattagccaggtgtggtggcataagcctgtagtcccagctactcaggaggcagagatgggaggatcacttgagcccaggaggtcaaggttgcagtgaaccatcattgtgccactgaacaccagcctgggtgacagagcaataccctatctcaaaaaaagaaaagagagagagagatgaccagatttgcccagggacaccgagtgagttagtattcacactgggatttaaccccagatctgtatgactccaaagctggggctacctctattccactgggttgcgtctgcatatgtaaaaattagctgcattttaaatatttgtctaaaataaaccttaacctatcgcagggcgtgctgccccagcctgagactggctgcttcatctacagttgtttctctayttgtccttgcgtagggaagttttatcaccacaaggaccgtttctcctctgtttaatctaacacctgctagtctgagattctctaaatgtcccacaataaatatgaaaaacagtctcaggcatatttttcccctcttaaataatggagtctaaatgccaagtggccaaaagcaggcctttcagccattggcggctgaacactgtctgaacatgaaatccgtctcttcaaactatgtcaaaattgcttaataagaactcaggggaccccacattaatgaaaggatgcatctgctttgggtttcacattattgggagtgatggttcagagccagccacctatgcttgactttcactctttaaaactctgcagttaatcacagccctcattatacaaaggtyacatggatataaagtttgaaagattcggttcaagactgcgagcggtggccaggaaaaaaaaaaaaaaggagaagacacaaagacaatgatcaaagaacaatgaataacattcaagactaagtcggtgcaaaattttcagaatgagaaatgaaacggaaaacttagaggataagtaccaagcacaagttttaggtattctggagacaggaaactcagaatattttagcaaccgattatgtctatgagggggatgaataatttattatctgataaagaatcttccctgagcctgtgacaagaaaggtcaaataggcaactgaagtagaacagtaaatacacgatatactactcgaaaaggaagtctggaacggaaggcgaaggaaagagcttccttggcccatgttcatcaactccctcagattacaagaagcgcagcggatgtactttttaggtaccctcatattaggaacccagaagtattcatacaaataaatgcaaataatgtatsagtacaatacttgtctaagtccttgaaaaaggccaatcttccggcatcacccacacaccagctgcaaatcttggatccaccccgttatctcccagctgtgtgagcctgggaaagtctatgcctcttccagcctctaaactgcctcatctgcacaatgggtttcacacataatataaatactttactgttaaatgctaagcacagtacctagtacaaagacaaataggaatatccaaccccccacctgcaggtgacaataataggacattttgcaaacgccccaaagaagaacttcagaactttacgttcctttgtgagcrtgcgcttattgacttgagcaagtggcttatatagttcttgctggtttgcagacttgtttatatcatmctttatttattgaaaatccaatactatacagaaaaacaatttgtaaagcaaagaaatgaggaacaaatctaatggctgatttaggatgcgytcttccckgtaatctacaactattaataatattaatagcttttatctttttgtttagctacagatcgttcagaacaatggagataagccctgtgacttgtgatgcrttgacgaatgatcatcttttccaagccaagtcaccagcttagacaggcatgaggctcgtattttacccgcyccacataccacatgcctccscccaacacatatatcataaaagaaggccaaggccttccatccacaaaggcaaatcatgggacttaagcttttagtgtcaaaggagattgcatggaattcccacaaacagtgaagctataccagctcataaagtcactgaattttaaggagcctaaaagtaggtggagttttgcagaagtctttaaaagtgcgagcaayttactcctcagcatcctacccatcgttccttaatatcatgccatgaaaacacaggatgcggcagtttcccggcagggaaaacaacaacaacaacaaaatgaaaacacargtgtcagtatctatgaaaagyacagcaaaatgttgagcccatgagcctaatataatggttggtactgagtgctccctatctgaaaataatgttaaagtcattatttcygatgctwatcaatgaggctgcaatcacataatgctgtcagtactatccctatcccttcactcccacaaaataaatagacccgatatcaactctattgaaaacctgaatcattacagcacttcagcagcaaaccgtgtggttgcaatcaactgagcatgcgctctctccctaaaacatgcacattccattacctctggctaataaatcttttatttttacccctcatctctctgctttctcaataatcattttgatataaaccattgcttgctgttcctgatgactaatcccttaatcatctttccaaaatatatgcagagtgtatttctttgtaaatacaaaagaaaaagcaatcacataaatagttaagatggcttttcaaatgacagttgagtgctaatatgagctacactggaaaatactaatcaacaaactaaatacacatccattaaaatgtaggagtccagacatatgaagacagaaaaagaattcattgcaactccactgaaatcaggctgataaacatctgccctagagctcctctttcagccagttggagaggttaagaaaagtaagcatcactttgcactttcatgcgtgaagaaaatattattattgttgttattaatagcagcagctaacatttaattgagcacttaatttattccacaatgggttaagactttatawmcacagagttgatgtgtttaatagaaccacctgtatctctgaatagagatattatgatgtgcatkttacagatgaagaaactgaggtttaaagaagttaagaaacttgcccaaggtcataagatgtatctgattctaatctttgccactataatacagcatgttttatagccgtggttatgaactggggacgatttgcacccccaagagacatctggcaatgcctggagacattttggttgccacaaacatacttgggtcacccctcccatatgagagggkaatagactcaagacacattctgggaagtcaggggtgagtcaaatagtaactctaagggagagccacctgcccctcttcccataccagccctctctgaccaacctgtggccatctcaatgtccagcagatgctgatgtttcacaacacttattgggcccctcgctatactaatggccagtccccaacagaagctcttctgcactctctgttaaacagatctagtgagggcctggcaggcatgaggaacattggttactcataacaatccctctcctctctctcaatccaccgcscctgcctcccagcctcagcctcatcccttttcctcctgcaaacaacgtagggagatggatgacatcaggtccatctgctcccactctaccctacctccttcttccacaggaccagagttttagatcccaagttccggggatctaaaatttagaaactaaaatttagaaatctaatagaaacagaagaaggaggaactcagagccccactggggtctttcaagagctctacactggaatgtcgaggtcttgctgtagctgttcatgaagtatgttttgatacctaataagctcttgttctttamatgcaatgcccctcagaggtcctgagatctcaagacagggagtgggatatgccagaccccgagaaataaagcaacagaagcccaactccaatasatactgggtaaaggaaagaataaaccatggtaatgcaggactcagacacacctatcgttgtcccagacttagagaactcacatggattcctaacacatagacactgctgytaaataaaagagagtccactscatcttgaaaacaggaaaacatcttattccaccagccacactggcctcttggaatacacaggaaaacgataggtgcttgtcttaagaggtgagggcaccagtgtataatkcacataaggatgtgaatgaggtagatcacatctgtgtgctgttccacaacataggaacaagccccactgccccgttttctttatttaaatatgaatgggggctgatgtgcctccatctcctccctctttttttaattatgccaaatggattggccttttaagacagtggtttacttctgtactgtccatgttatcctgttttaattgttttcattttttctcttctaactttggagcatctaaaacatctcagcaggagggcattttcccatgaaataattagtagtcatagtaattacatataggttcttaatatacttctatatggaatgtgttttcacttaagttgtattttattaaatagctccttcttcccaaaagtaatttgagagctctataaaggatatcttgaatataaagagacracagggtagatcagagtggcttcctctaagaaataggatggatcctgaaattaatcactcaaaccgcagctagagagtttgaaagcaaaatctgcaaagtatgaacattgatactaaacatggtaaaaagatgggccatggggtggagcagacagacttgsagtttggaagccagatggaccaagcaaggagmctgactctgagctcaccagctgtgcaattcgggtgagttccttcaccyttctgagccatcycttggctcgtctggaaaatgcaaaaaaaaaaaaaagaaaaacaccaggtttttgcatcctcctggatgagggatataaagtgcctgacacagcatatgacagggatttgataaatgggggctrttagctgtcccattgtggatgtgagaatagcattctgctggctaaaaggcagacatgaatgttctagaacatggcgatcccggaatgtgcagtgaaggcaggaagaggaagaatgggcagggaagaacaagttgggatggaggaatgaactcttatctccagaagcagagctaagaatgcccacggagccttggcacatgacagcctccgctgagccaaatggcccaaagacttctgaatgagcttttgctgcaacaaaaaactttggatcattttgagagcctcccgtgaggygccaatatgttgcagtaccttcccggccccgacactgatgtgattcatcgtaggtaacatatgaatacgctcaagctggccagcagcttgaaaaattggagtctatcaaattgaccttgagaaacacaggaaggtaatatttagtgacataccagatgaaatccttgcgcagagatgtgaggtgaggaaggacctgaagkgaagtagaccagcaaatatcaagggtcaaggagttgggggatgatatagagacgaagcctaacagatgtcaccagagcaagaaggccttacracttcacatcctctctgcagggtatgaatggtgcaatggaatgaaatggtaactacagcttctggtgcaaaatttgagttwccataatcatcatcttgggaaaatgaggaacacaatataatggcatacasagagaacaagtgaaaagatgagagatgatgaacaggttgagtttcttcagcctacaacctatcaaatctaattttaaacatctggagccacgtgtattagttttgtttctgttccattttcctttttctgtgtccccgacggtgaatgattctgaataattcttagtctgggatcactggtctatctcaaggtactacatgttagagtaaaactataaaacagcaaattctatcatckgaaattgactcacagggacccaattaaggctcaaaatataagaaagaaagactgaacagtgggtctttgacatcatccatccaacctttttccttaaagatgaggaaacaggctccaaatagatccagaggcttacccaaggtctcatcgctaattggggcaggtccaggaatttctgctctaagcatcaaacaataattaaaataggataaatgcagatgaatgtgttctcatatatattgtgttctcagaaaagaagaggataaatttaatgatgcaaaaacagttgtgctacagcattatcttccaagactggtttaaacatgaatgtcactgtacaatcaggttaccatagtgtcactagcrtccctggaattttacctttctagtttcaaatattacatcaaataggcagagttttacaattttgacacgccctcctgctagtcccaagaacactgcaagccctcagcagttgtctgtctacactgtcagtgggaatggaaattggagcaacaagataagaaatgactcgggaggtcgggcacggtggctcatgcctgtaatcccagcactttgggagkcctaggtgtgtagatcatgagatcaggaggtcgagactatcccrgccaacatggtgaaactccgtctgtattaaaaatacaaaaattagctggrcatggtgacgcgtgcctgtagtcccggctactcgggaggctgaggcagaagaattgcttgaacgcaggaggtgaaagttgcagtgagtcragattgtgccactgcactccagcctggtgacagagtgaaactcagtctcaaaaaaaaaataaaaaagaaaaagaaaaaaaagaaaaaagaaaatgactcgggaactgttaccaaaattttaaatgcatatgccctttgaatcaaggagtccagtgctaagattctgccccaggcatttactcacaaatacgtaaataaagaatgctcacagcagcatagtttaggcccaatatcagatgatatcgyaagaaagactgatgcaagaaagagagaactgtgaaacaccattgcttggaataacaaatagcaaaacaatgcaaacaacctaaatggccaccaaagggaagactggttatagcataagcacatgatggaatattatacagcagttaaaacaatgaagtagatctatatgcactaayaasagatctcctrcagtactaagtttaaaaaaaaaaaaagtacagaacagaatgtgagtgtgtttgctggtatatagataacctttttctggaagaatacataatgtttatcttccaagagaaggaccaagaacgactttcacatttcatttttcaccttcccattctgcgtgtagattcaaataagatgcacgtattcccatttgtactcttctcaatacatccctaaaaatcccacctactagaggttactactttttaacattagtcagaaagacaataaaakgatcagaaaaagtaagactctgttttcttttttatttaacccaaaataataagctcagtgagctcaagataagggctcatttcaaatatactgaatttcaaatatttcatcataaatacactgaaaaagcagaaataaatcttccttttctttattttcactacttttcagtccagagtaccaaaaattttcttaagtacactgtagtctatttcttcaaatggcaagaaatctttcacagcattcaaaaatgaagacggcctccacagggtgtacccagcccccttcaggctctgctcccaaacacgctgctctatctcctcctccccctcctcccagggcctctgcacctgccattcccctaccccatctgacccttctccaccctcttcaggtctttcttcagatcttagttcaatcacttcttccttggggaccccaaaggtctcccaactccctggcatcattactgattcctaggaccactcactgctttttcaagtttacattaagatctgtgttttttgactaaatttgtcttccacaataggctgaaagctctacaaagacagtggcaacgtctgttgtccttaacagtagaccccagcacccatcacagaggtgcacttcatgaatatgtgaatgaatgaaaagtgaatgaatgcagtctggacttcattctgaaatccagcgatgtttcaaaaatcaaacagctcgcatcactctctagctcaaaccctctaatgtcttcctcaccgctayctcagagtctaccagatacccatcccccaacagcacctctcctacccactccattcatctccagccacactagcttccctgatgatccttgaaatctccaggcttgtgcctacctctgagccttagcatatgctcttctcactgctaagagaatacttctcttgacatctgcatggcttacccctacttcattcaggtctcagatcaaatgtcacaactttggaaggctccctgctgatgactccatcacactcacgctatcattccccccaccttcctctgctttacagtcctttatttactgacattatggcaaatattaaacttgattatggtctatttttcctacctagaaggtaagcctatgagggcagggattctgtttcgtttaatactatatccttggtcccaagactaakgcaagcccttagtaaatatttatgtagacacgtatcaacatcaacttctacatagacagagaaaagtaagaaatyagagatagggttaaagcytccttctttctaatcttaacaaccataagcrtaacagtctcctagttgcaatcatgggcgttcaccacgttttatttttcttaataaatgagttaaaggaagaaacattctcaaacccctgactaataaagcagatgacactgacaatgarctacaaacaaatgcgtgaataataatkgacttgctcatgctttcattcataagacaaacaaagtgaagatgactttaaaaataaagacatgattccaagagcaataaactttacacactccactraaatctccatatggttagccyggcatgtgtatttgacaattaaaaaaaacaacaacagtcaagcrcttacccattcttctaaaatgcgtgacactgcttcactcgcccttgccatgttcctgcaggccaagrtcacatgtgcaccatggagggcaaaagacttggcggtttcgaaccctatggtttaaaggaaagtcaatgttagaaaacataacatcaacacagtgagtcawgttgaatggcctttaccggagcaccacttaaattaccccaagttctcaaccaggggtgattttgatccccaggggacagaagcaaatgtctggagacattttcagtggccacrgttgtggggtagagtcctactggcatctagtgggtaaacaccaggcattacaaaacatcttaccatgaacagggcagcccctgacaacatagaaccatctggcccggactgtcaacactgtgatggtgagaaaacttgtcctagggatgcagtgatttcaaagatgaagactgggacatagaagagttcacggcatgtccagccatttaaccatcaataatgaccagatcctgtgcccacgataaggactttatgctctactctatggtaagtgtcgccagcacctctgcttctaccagtgttacctaggtttcttagccccatttcctactgagaacaattagaaaagatggacaaaataacacacgtgcatacacacccatatctgtttgaaggcatcagaagggcactatgactaagaattttkggggccaagatctgcaaaaactgcaaggccagcatttggcagcttttttccttcaaggcatatttcatttccaaacatagtggttggaagcctgagaagatgggctgagcttttggcaattttataacaaggaaaaagacataaatttgagctcaggacccaccaggaaagggccacggtaaacacaccaaaccttkggtcgggatcctaaagagttataccctcgctgtaataacaagagacagtccagccttcacaagagtggaaactcagcttcaggccatttcaattcctagtttgattaaagtgatcagtccctatctatccaatttccagaagcaagagaaaatgttctctggaggaagataccattatctagagtctcaaattaccactatgattatttcaaatactcatataaactctcagacattcaaacaaaatagctaagcatacaaaaagaaaaaacttcaccaaaagccagaggggaacaaatggaaataaatgcacaggagatctgtctaatcaagttattcagaaacagtgattaaaataagtctgactgacaaattcaaggaacaaaaaggcaagatggagaattttgccagggaattagaaacaataaaaaaattcaaatagatattctgaaacttaaacaaaataagagtaataagagtaaagaagaattcagcatatagtttaacagaatacaagacacagctgacgacaagattgaggaaactacaaaataagttaacaaaaaaatccaaagtgaagcataaaaagaaaaaaataacacaataaaacaaagcacaaaagagacatatgaaacacattctcccaggctcttacacatacatgtaatctgagttccaaaacaagtgaaatasactaagaaaagcaatatttaaagacagaatggctgataatgttacaaaatcaatgacgcatacacggccaaaaaaagaagtatcctgagccataagcagaaatatgtatgtgtatgtgttgacatgtatatgtataaatgtgtgtgtctacatgtatgtgtgtgtgtrtatatatatrkgtgcaagctacaagcagaaatgtacgtttgtatatatatatatatatttatgtctgtgtgagccgcaaacagaaatatatatgtgagtgtgtatctgtatgtgtgtatgtgtgtgtagatacacatatatacacatacatgtcaaagcaaggcacatcagagtaaaactgctaaaaactgcagatagttttagaagtagttagagaccagtagctacaagactgatagttatacctctcaggaaaatgatggaagccacagctgaaaamaaataaaactttcatcttagaattctatacctagtgaaaatattyttgaaaaataaaggcagagaacaaaaattttaagcaaacgaaagctgctttttgtttgtcacctacactacacctagtgtcacgtatagacccacactagaggaaacactaaaggatgctcttcaggcaggaggaaaatgaccttagctataaacccagagatgcagaaagtaacaaagagcaacataaagggtaacgacatgttaagayccaaatggtaagagtgaaatctgtgagttttaaaatatatagcaaaaattactatatcaataataataacaatgcttaacctaggaggtgagtaatggaagcaaagtatcctaaggttcttgtcttctccaggaagtgatataatactgatttatattagattttaataagtcaaagatgcaagatgtaaatctctacaaatttaaaaagctaatggagaagaaaagcagaatgataaaaaggcaagaaaggagagaagatgactaggtacagtggcctgtaattctagcaccgtgggcggccaaagcatgaggatcacttgtgaccagcttgggcaacatagcaaaactctgtctctacaaaaattaaaattaaaaaagaaatagccaggtgtggtggcaggtaccggtagtcccagctactcagaaggctgatgtcgagggattgcctgagtccaagagttcaagggcacagtsagctatgattatgccactgcactccagccagagtgacagagcaaggccctgtctcaatttaaatggaagaaagaaaggaaagagaaagaaagagagagagagagagaaaggaaaaaggaaaagaaaaaagagaaagaaaggatagaaataagggaaagaggaatatagaataacttaacaggaagccaataataaggtggtatatttaaacccaaactcaaatatatctgtcattacattaaatataaatggcctaaagatggcaattaaaagaaaaagtttgtcagactgaagaaaacataaatatacatatactgtccttaaaaamgaatgtacattatgttttataccttatttaaacataagcataaaaaaagtaaaagaatagaaaaggtatactgtataacacgggccaaaagaaatctgatatagctgtactaatttcagaaaaaaaagactctaaagcaagaagcattacaagagaaagtgctgaatatttcacaatggtaaatttcaatccaccaagaatacatgacaattctaaatttatatgtacttaataatagagcctctcatatatgtcaaaaattgacagaattaggacaataaatagacaaattcacaattataayggaagattttaacatatccctcttagtaacagataaaataagcagacaaacacaaagtatatagaagacttgaacaacttaattgataaactgaaaataattgaatatgataaacactgaaagcaacagcaaaatatactcaagtacttcaagaatacttaccaaaactgatgatttgcaggggcaaaagcaagtctcaatgaatttcaaaagattaaaattagaaagtatgctctttgaccgcaatggaattaaattacaaatcaataacaagatcccagaaaattctcatttctggaaatatatgtataaataaataagacattatggctcaaaaaattacaatgaaagttagaaatattttaaactcggtaattacaaacacatatacaaacttaaggagtatagctaaagccatggttaaaagaaaatctatagccttaactacatatattaaaaagaagaccaggcacagtggctcatggctgtaatcccaggaatcggggtggccgaggcgggtggatcgcttgagcccaagagttygagaccagcctgggcaacatggcaaaattccatctctacaaaaaattagttgggcgtggtggtgcacacctgtggtcccagctactcaggaggatgatcatgccacttcactccagcctgggtgacagagtgagatcttgctccaaaaaaaaagaaagaaagaaaaaatgatgatctaagcatccaagatgatctaagcatccattacattaggaaaataacccagcaaattaagcctaaagaaagcagaacgatggaaataaaaggagaaaggagaaacttataaatctaaaacaaacataaaatacagagaaaaaaagaagctaaaagtctgtcaattgaaaaaactaataaaattgataaagggctagcaagaatgacagagagagagacagagacagaaagagagggcttgaacaaccaatatcagggatgaataaaaggacaacattatgccacataaaagcataagcaacaaaagcaaaactagacaagtgaggttacgtaaaactaaaaagcttctgcacgttaaagaaaacaatcaagacactgaaagggcaagctacaaaatagtaaaaaatacttgcaaacctcataactgatagtgttcatatccaaaatatataaggaactcctaaaacccaatagcaaaaaaaaaaaaaaaaaaaaaaccacagattttaaaaacaagcaaaggaaccaaatagacaattctccaaagaaaacatacaaatagccaagtgtatgaaaaggggctcactgtcacwaattctcaggaaaatgcaaattgaaaccacagtgagatgtcacctcacacctcttaaggtggttctcatcataaaatgaaagataacaagtgtggttcagggtgtggaaacaagagcccccttatgcgtgagaaacttacattccttagtggaatgtaaattggtgcaaccattatgaaaaacagtatggaggttcctcaaaaaacgaaacaagaattaaaaattgctggattatgatccagcaatcctacttctggatacatatccaaaggaactcaaatcaggatcacaacaatatgtctgccctctcatgttcactgcagcattattcatactagccaagacatggaagcagcctaaatttctactgatgaatgaatggataaaggaaatgtggaagacacacacacaaacacacacacacacaaacacacacaatggaatattattcagccttaggaatgaaggaaattctgctatttgcaacaacatggatgaacctgaaggacattatgctaagtgaaataagccagacacagaaggacaaatactacatgatacaatttatatgaggaatctaagacactcaaactcatagaggcaaaaaatagaatggtgtaggcaaagggctgaggggagagagaaacaaggaggtattagccaaagggtatgaagtttcaggtacgccagatggaaaagccctagagatctaccatatagtactgtgctcatattgtatcatgtacttataaaatataatggtttcacaggtatatacttatctccaaacttatcaagttctatacrtcaaatacgtraggctttttgtacrtcaatcatacctcaataaagttgtttttaaaaatgaaaaataaagaaaaggactacagatcctatgaacccwaagaagatcttaagatatggtgaacaactttataccaatgaatttacaatacaggtaaaaaagacaaattcctagaaaaacactacaaaaaaagttgccacaagaagaaatggaaaactgaaaaagttctgtatatttaaaaaatatgaatctatattttaaagtcatctcaaaaaaggggaaaggagaggaggggaggggagggagggaggaaaaagaagaggcagtctaatccagagcttgaacaccaacccattgctctaaactaaaaaataccatattttgtaatctgtggtggaagaccctatagagtacagtacaataacaaagtagtcaattctactagagaaggcagctatgcaattcagccaaacccatgtcaaatggccataaattattgtttacaagataatgttaatatgcacgcaaaatcagcataccgttatcttcctgacatcaccatgtgaaagagcctagtaaagttcattcattcatatcactcccacaggcctaatcttcatagaaaacagtctatttatacagaatacttctcaaggaaaatcagcatagcacagaggaaaactcaagttggacacacttgtgttgctgccagttctaagcacgtacaagctgtgggatctaaggtcacgccttgaacccatgtgaaactcagttatcgtttctgtaaaatggggaataagtggtaaacatatattgagagcctaacataatcatagtaggtggaaaacaaatgttagttgcctgctttttgcaaaatccttggtgtcctatgcctcttmcccaattcgtacgacctaccaaatccagcacagtcactatgactaaaaaattaaaacttgctcctagatgtgctaccaatggtaacccgagggctgaatgactttaataccaaccagaattcaaagaaatcaacctcgggctccaccattccgtttgtctgaatatggactctggagcacaatttaacctcattgctgagacaacctgaaattatttcttgagattttgccaaatcccatattccaaaatacttacttattacctaaagatgacctctgatacttaaatcagatgctgaaataatgcacaaaggatttcaaacctgaagtatttaacacctaaatccatttgactccccttgggtgtgtgggtagtaaaaggtttttgaagctgtatctccaacctttaaagcaagacgacaataatctcaaatttactcayttttacctgtgataccaatgtcaccccttatcaccagtgagcaaaagacacctagatcatttggggaaaatgagagaagtaaaatgccaggttttgtagcccagctggctgggggcaggcaccgaacaaagtcttgctgactgatctgccccatcaatcaggctaatgagatgccaacagccatatgcaagcaacacagtgaccaaacacaactgcatttgkgagcccgggacttcacacacccagaagatcttggacggaatggtggactgtgggtccctttgaaatttccaggtcaaagcaatgatcaggaatatctttcttcacagtttcatcacagggtattaaaagaaaaaaaaaagatgtmagagagtggaaatgagagtaaacaattcttagtcattcaatagcagctacgtttttaacagattgagaaagcatcgatataacacaaggccaggcaggttccagaacttgattgattgactgattgactgactgagacagagtctcactctgtcacccgggctggagtgcagcggtgcaatctgcaacctctgctcactagaacctccmccgcagggattcaagcgattctcgtgtctcagtctccccagcaactgggattacaggcgcgtgccaccacacccagctaatttttgtatttttagtagagacgggatttcaccatgttggccaggctgctctcgaactcctaacctcaaatgacccacccacctcgacctcccaaagtgctgggattacaggcgtgagccaccacacccagtacagagctttatttatccagtttctcaggtaagctccttgagccttacaccctccaatctccgtatttcgccagactagcacccagtaggattcaataaatatctgctgaagaaacaaatggttcttgcagactgctaataggctgcagctctggactattttaaaacaatccaggctgtttcaaactgcaacacgatggccctcttccttcctttataataatgaataaatattaaaatcctgcaaagatactgctcactgtagttttgaatgatgctaccaagaaatctgtgggggaaaagcaygccgtttttctatcarattttattttcccaaacaaacctgttaagtcctgctatctcacttgacaaaataacccacggcaaaggactttttattaccagaaagggcacatctgacaagacagcagcaacaggctacaggctcaagcttccaccctctctcctttagagaattcctgactgtagttacgggtaagccatctgtctctgtgtcttgtgaaattacactctggttcttacatcttcctttatytaagcaatgcattacccgttgctagtctacttttaaaagctgcaatagacaactccattttcttaccctttacaattgcctttggaacagaaacaaagcgtggctatttcaaaagatgatagtttaacaggaaggacaataacacttttatagtaaaccatatctctagagtgtggagttttatataaaaaaagcttaataatgctacctactgttaaagtcctggataaaacccaagagaataacatccctcactcttgtaatactgcagctgacggccagtttaattagctaaatgtagtagtgctaagcctattctgcacagtgccaaagtttgtgcaaaataatgaaggcaatggtttactaaatttaataacctgattcatcttataaaaaattaactttatgacaatgtttaaattgaactagcttaactgcatggagatggcaagagtgtgttcggaagaatatgtaaacctaataataccaagaaaataaagaaagacgttttaaagcaatgaacagcatcagtttttctagcacttgttacatcagatgcaatcagaaaawtgacgtggccatggaggcttaatagctcactgtcttgggttttaagctttgaacacaaacattcaagttctatgaaatggaaaaggtgcaaagtaatttaaatacctacttatctkatactatcttacatagttttcactctttagaacagaggtcacaaactgatgatcagaggacaagtcaagcccacagacctgttttgtgtggcccatactttcttcccttcccttccttccttccctttcccttccttccttttctttccttccttcctccctcccttcctccttctctcctttcttttctcctttgctccttctttctctctctcccttccaacctctcttccttccttccttcctaatttgaattagttgccagcattaaaacattggggagatcacaggtccaaaagctagatgtgtagcttctctgaaaaagcttacaccactgggggcccaatcccacgtrgtgacaggttagctgagaagccactgtcagctagaggtggggtttgggctttctagttggtcatgttgaccatgatcatcacccgtgctgctggcattacccgccaggccactgcaggcacttgatgctcagtgcacattatycaggaaacatccttgctacagacatgactcaagccttaccacaaaacaccctcagtccataygttcacaactcaatcaccgaatctcaaagaacatctcccactgatctggttgagattttatttaaaccatgtcaaaccctactmtgtcaagtgtgagactattaggatgctagctatgccttggaaaaccccgcagtagcacttggctttgcgtggacagagaagcacaagggtagcaggctcagggatctgcaggagcttgaacccatggtgcaagctcccttgcatttcacaaatgtcaytgagtggcagcagaacctctgggccaagaactttactggaaggagagataaagacgaaacagacaagcaaaaaggcagggtgcttggcaaaaaaaaaaaaaaaaaaaaagatcaaggattggggagcaactcygtgtaaataaatcacatgaatacaacagagatgaagctccatgaagcaagcgaaaactgtgggactcctctgtaggcagcgggagcctgtggatttaggcagggagtaaacactatgagttattattcatattattattttatccatttacagtacctccagtggtcacaatggactcgctcaagatactgtggccttgtgaccagccagaaatggacgaggtgccctcttatcccgagcagctcaaggtataaattagaaaatcatgtaggaagcaaaaaaaatctacaaagccagggactgcctaagtctaggtgtccaaggtgccctgtgggccactggtgagcttggcaagttgtttacccagacagggaacacaaagggagaaatggcttgggcatggtggtggagagcatcggagcaggcagccgcacaccatgagactcactggtaggytggacaggtggggacagtcgcccacagaatcctcaggcacaaaaaacatgaaggtgggaacyctgtcccctcaaatactgacaaagctcccacagaggtaggagctaagaaaaaggcagcttctttccccgatgccaggaaggttccttctggtttaagtttttwaattttctccatattgtggatgtacttgggcagtgtccccatttactgtaaattatggttttaattatcatttttattaagacgcccaaaggagttggggcttacaatacccgtaatttctaatgggtggttattattaatttataattgtgaaacactggggacaaatgttacttgtaactgggcacaattaaaaggccacagagatggtgatttccagccccctccagccccgccccacaaacatagcactaaaacsatctttaggaaccaatcaacaagttgtagaatcttccagcacacatcctctccctccctggagatctgccattatgcataaagcaagaagataggcctaatgtctttcagcttgggttagatttggggacaatgcaaatgtggggactgtttttgtattaacagactactatctttaaggatgagtttctcctatatcctcctaaaagtaggaagaccatactttccaaactaatctgattaatgtaaatgaaattacagtgacatgacattgacgatgatcttgaaatccaactcccccacaggcatttccagatgaagttctaagawgtacaccacgcytatatgctcaatgccacatctgcaatgactagctaatccatacctctgtttctgtagttactttgattacctgaatgatcacayttgcctcccaggccatttcaattacatagttctgagttccaaagagttagagatcgtgcttactaaacacgatccacagctgccaaatcttaagaacttacaaaactacacaggtctctctagagaaaaataagtcatagccagccctgctttttaaaagtatgtgttatatacagcaagcaacaaatccctacagagcttcctaaatagccctaataacataaatacatctcaaatatattaatcaaaaaaaacataccaactcaagaagtgggaaacgggtcagttcatgtggaatatctttaaaatacaccaggcggcatctgcatgctttgggcagtacaaggctgaggccgtaatgttttgtaaagctgtacaataaatcccagttgactgcatgagatctctcgagaggcaagactgaccccaggctggctactagtgctgccactgtgctgggtgaataagttctcatttaacctgccagtgacagtcctggttaggaatgagtgagaaaaatgcccaaagattacaattaacatggtcctagacaggcacatgcagacagattctacaagggtaactacattgagcggcagtcctgtcggtaaagatgtggggcaaccaggcaacttcatagattaatgagggatgggggataggaaatggcttaacatatttgggggcagttgggacatagctatcaaatttgaagtggacatgctctttgacccagccacaaccagaaatttatcctacaaatagacttgcaaatatgtgggagkaatattcagtacggcattatctacgacagactgcaatcaaccaaaatgttttatcaattaggttatataaattatattgcatgaataggacaaaatactgtgttacacctaaaaagaatgaggagaaatgatacggagatgcaaggaaacatttccatgttataattttttttttttttctcttgagacggagtctcgctctgtcgcccaggctggagtgcagtggcgcgatctcggctcacttcaagctcygcctcccgggttcacgccactctcctgcctcagcctcccgagtagctgggactacaggcgcccgccaccacacccggctaattttttgtatttttagtagagacggggtttcaccgtgttagccaggacggtctccatctcctgacctcgtgatctgcccgcctcggcctcccaaagtgctgggattacaggcgtgagccaccgcgcctggcctccatgttataatattaagaaaaaaagtcaaagtaccgaacagcgtgcacgtaagacayaaaagtggttaaacaggtgccaacattgattactgcaggagagagttaccggttgggggcaggaaaacttcttgtgcatttcataatgtcgacgctacttccatttttaacacatgcatacatgcctgctataggaagaaactaaaaataacaaaccaaatgctatctaattgataattcatgrgcctttatgaattttaatacagagcaatcaaggcaagtgagaaaaaaagggaggagcctattcctattccaaacaaggtatttcctgagcatcctgatttatacaaaggatgctgtaatgtccaggtaaggaggagcacttcagagtgttactcttggctgggtaccacgccatgtgctttatgaaacacattaactaattctaaggtrttctctacagaaaccctataaagtgtcattgtcatttcatgtaagagaaaaaccactgatccccaatgttaaggaactcacaagatcagagggcaaaaaagggggaggaccccaatgggcatggtagcctgacttcaagcaggtgtaccccaccatcaggccccccamactaccacaatcaccaygtgactgtgsatttgtgatattgtgatataataagaaatacataytgggtcttcatccaggttcctggcacagagctcctaaaatccttgaaattggccaggcatggggtctcatgcctgtaatcctagcacattgggaagctgaggcaagaggatcacttaaacccaagggtttgagaycagcctggacaacacagtgagatcccatctctaaaaaaaaaaaaaaaattgtggagcacagtgccatgcacctgcagtcccagttactcaagaggctgaggtgggaggatcacttgagcccagaagttggaggctgcagtgagctatgactgcaccactacactccagcctgggtgggtgacagagcgagaccctgtctaaaaaaacaaaaacctttgaaattttctgagcaatgtgggtgaggggagagtcttttattattcacaattagagagttgtgaataattgataacccccacattccccrccttgggggaagaggaggggctggagattgacttaatcaccaatggccaatgatttaagtaatcatgcctagggtaacaaaacctctctaagaatcctaaatggagaggcacagtggctcacacctgtaatctcagcactttgggaggccgaggcaggaggattgcttgagctgaggagttcaagaccagcctgggtgacatattgagacctcgtctctaataaacaaaacaaaaaaacttagccaggcatggtggtgtgcaactgtagtcccagctactcaggaagctgaggcaggaggatggctttagcctgggaggtcctggctgtaatgagccatgattgcataattgcaccactgcactgcagcctgggcaacagagcgagaccctatctcaaaacaacaacaacaaaaacctaaacgatagggtttggagagcttccagattgctgagcatgtggtgcctggagaggggcatgccrggagggggtatggaagctccacatcccctccgcatgcctggccctatgtaccgcttcatctgtactctttgtaatatcctttatcataaacaggtaaacataagtaaatatttccctgagttttatgagccattatagcaaattatcaagcctgaggagatggtcgtgggaaccccaatttgtagccagtgagtcagaagtgcacttgacaatcttgaacttgctactggcatttgaagtaggggatgatcctgtaggactgagccctcaaccatggggtctgtgctgactctgggtcgttagtgtcaaaactgaattgtaggacaccaagctggggtccagaaaattggagaattacgtaaaaggagggaacactccacacattkgtcatgggaagggctctgtatgagagaagaggaagacacagtgtttccttcctttagggttaagagcacacactagaagcagctcctkgaggcaggagaaaccagcctggaatgcccccaccaggctcacaccccacagggtcttgactgtcagtcaaatacaaatcatgggatttgccatctattctctgtggatattaygagatataggcttctcatatgtgtacatgcttggcatgtgtataatttaagctaaacctactaagcagctgtcckgaaagagggagaagtggtccaaataccacctgtttcatcaacagcctaccagtgctcccttcggtgtaatcccatcaaggcacagaattgaggtctcttcagctactgtattacataaacctacctgctgtatggaatccattcccagacagtgatgcattggcaaatgttcttctcttttacttgatatttcatcttggggctcagaattaacactgtcctttgcttttacaaacatttatctgtaagggctgtgagatgggatcaccagtccacaggaataagtttctctctatgttcttccaacatcaatagtttacaattatagacttaatttaaccccacttctatacttccaaccagtaaaaaatgatctttacaccatgaccgttacaagttatactcaattttttttctttaatttccaaaagtcttcactgtcaaactttaaagaaccaactgtattaacgtccaacacaaaggccagccaggcacagtggctcaaagtataatcccagcactttaggaggccaaggcaggaggatcacttgagcttaggaattcgaggttacagtgagctacgatcctgccactgccctccagcctgagtgatggagcagattctgtctcaaaaaaataaaacataaagaccctcyaccaataaaaagaaagtaacaccgcatgaaattttttgtaatcaaaatatacatggcacttttttttttttttttttttttttttttgagacrgagtcttgctctgtcgcccaggctggagtgcagtggcgcaatctcggctcactgcaagctccgcctcccasgttcacgccattctcctgcctcagcctcccgartagctgggactacaggcgcccgccaccatgcccagctaattttgtgttatttttagtagagacggggtttcaccgtgttagccaggatggtctcgatctcctgacctcgtgatctacccaccctggtctcccaaagtgctgggattacaggcgtgagccactctgcccagccaacatggcacttttataaacttgtctgagaaccttaggaagaaaaataaaacagcacaaaataaaacataaaaaatttaggcctcctgttaaaaaaaaaaatgtaatggagctttttagaggcagagacctctgtgtcttttaaaggttctcaagaagacacagctcttttgctccctttcttcttaatacaagaaagtaacaattgctccataattccaccccctacacgtgctgtctggcccaagttcatgttcttcagagggcaatccttttgttaactaascaatgacacacacaggcatgcgcacacacgtgcacacacacacccatggtctcacttcgtataattctgtactcacactcctatctactaagacaaccaaagtgtttctggttgtttagaagtagaaagatttatcctgaagtttggccttttttattttgatgaattaatttatagccacttcaagagaagaagggaacccaactctgaatttgtaagcacactatattctattactgaaygtgtctcattgttttcacagctggtacaggatttcctttcaccattgaggcctccgttactctttctcgtctgctcgagacagggttctttatgatttagagcaagcaggccagccaccaggattctacacgcacacactcatccaaagagaccccgttccttgactttcttaatgaccaaaagggctgtgatccctcttggcaacatagtttccacccctgtcaattaagaaatgcttaggagggaattgtttaaaaaagaaaaattaagaaaaaaaaaaagaccttcattccattgccagctctcagaaatgaaaaagccagccccatcctgcactgtccatgtggacartgtgctacctttctaattcaagcaccttttttttwwwaaaaaaaaaaaaaaaaaaaaaaaggaagaaagaaaaagaaaaattcagattgaccttggctctcaccattaaaaaagcgaaaagtggtatattactttgcctcttgaaaagactaaaktctttatgctaccaaagtcacgtggaagtgctcaaaacacaatgttgggaaaattcagcagttttttgaggctcacttttaaagtgtccaaattgacttttcattctccatcgctagtaactttttaagacgcaacttttcaaaaatatgacttaaattcaggcttcraagctacatcaacggccagagttccattaactctgtgctctgtgggctcaccatcaccttgcctaaaatcaatgactcctccaactccaaaccggacatttattgtgattggttaggaagtggtactcaaacatacaaaaaagaggcaaaatgtaaaaaactttaaagcaaattgagtttaatagaaaaacactaaattaamggataatccttaccttgtagttgcttttttaaaagtatctctgataatcaaaaaaaaaagtatctctgataatctatgtaaccagatcactatcttagatatctttaagataattactttttaaagttttgtaaaatcyaacagtggcttgtgtgtgtttgttactmttgttgttttggtctttaaaaaaataatgctgacaccatctcaattcacactgataacatttaaagcaagccctaagtttctgcttctgtgagttttcttgcagtggtcaaatatccacaacagtcccgcgtggaaggcaygggcaatgctagctttaaaacaaggaagtaaattrtactctttacctcacttctttcacatgccaggatgcacggaacaaaacacaccgaatcattgcgagtttgacctttttggttataacatattcagtgattacagcacccaggttcccacagggcatacaattggtaaaagaaattctccatcactttttamgctatctgagaagccatctgagcttgaataaaatcagacactcagaagggagagctgggaaggagttyttcatttgataacattttgtttggggataccatgatgagggacgggtgaaatacaccaattttgaaatctatacctctcaggaaacgtgtaatctaaccatcagctgtgatcaggcacctgcttgtgtgaatgtgagggatgcacggaggagcttccagctgaggctgattttacatgacttctggagactcgacagctataaatttttgtttcattcccctcaccccgctgctgcttctgggccaaaaagagggtcttggtaggatccccaacataggtaatgtgaacattgtgactaggatcaatttaaattcaaaaaagagaaacagagagagaaagagctctgagttggtgaaggctttggaaccctaacagaggattccaacctgcasggcttsccaggcagagggtcttgtcagcagcgggagcctaagcacttgggaggcaagtactccccaraagatcccaacagagattctccttcctagagtaaacagcttatggaagcatgcgcaactagaattgttatctggctcaaagctgcccctaagcacacaccattttagcaaacaccattttaaagtccttatcagggcaagggggacttgattttcttcagtgctttgagacagatagggaaaaggagataaaatcaacatgaaaccaaacaatttcttggaagagaaacagatcaggaatcttacgattctyacgagctgaactgctcccctgccatcccaaactcatacactgaagccctaacccccaacatgactgcatytggagatggggcctttatggtcataattaaggataaatgaggtcataatgggggagccctaatccaataggactggtgtccttatgaaaaggggaaatctggacacagcacacggtgaggagactatgtgaacacgaagaagcctrctgagatggttratattgagtgtcaatgtgattggattgaaggatgcaaggtgctgttcctgggtgtgtctgtgcgggtgtttccaaaggaggttaacatttaagtcagcggatgaagagagacagacccaccctcaatttgggttggtaccatctaatcagctgccagcgagccaagagaaaagcaggcaggagaagatggaacaacacacttgctgagtcttccggcctttatctttctcccatgctggatccttcctgccctggaacatcggactccaagttcttcagcttttggactcttggacttacaccagtggtttgccaggggctcttggggcctttgaccacagcctgaaggctacactatcggcttctctatttttgaggtttgaggactcaaactggcttccttgtccctcagcttgtgattgtgggagtcaatactccttaataaactccccttcataaatattaatgcacctatcctattctgcccctctagagaaccctaatacactcatctacaagccaaggagagaggcctgtaacaggtatctcctcccagtcctcagaaggaaccaaccctgccaacaccttgacttcaaccttctggcctacagaactatgagacaataaattttgttgtttaagctacccaatttgtggtgctttgttacagcagctctagcaaactaatagacttaacttctgtgaacctcaatttcctcatctgtgaaaggggaataataagatgtactcttaagagctgttaggaaaattgaataaaataactgcagagctcttggcaagcagcaaattcttattaaaagaattatttcaaattttaattattaaaagaattatctttgccattaaaagtaacggcaggccaggcacggtggctcacgcctgtaatcccagcactttggtaggccaaggtgggcggatttcttgaggtcaggagtttgagactggcctggccaatacagcaaaaccccacctctactaaaaatacaaaaatcagccgggcatggtagcrtgcacctgtaatcccagctattgggaggctgaggcaggagaattgcttgaacctgggaggcagaggttgcagtgagctcagatcgcgccactgtactccagcctgggcgacagagtaaaactccatctccaaaaaaaaaaaaawatatatatatatatatatatatatgtgtgtgtgtgtrtatatatatatatatatatgtgtgtatatatatatatrygtatatatatatatatatagtaatggcaaaaaccacgtttgcaccaccctaataaaacatcaggctatcaggctatccagcttattaattattgctacattagctaaaaggctctccatgtgagctgtatctcagattctcccatggaaacctaaaaatttgtactgaagactaaatagaataaatgaatcttaacttctccagctgtgctattcaactattaatcattagtgccccagccactaccgaaaactatttaaaacagcttgtaatagacaattgcatacaacccagggttttaaaataacgcaataatcagtagtaagactgacaaattgcctgagccaaggggcaggtggaaaatttcttacagatgtgaatattctattatcttgactggggtggtggtttatgtgtgtgtacacacttgtcaagaccttcatgtgtatgatttaaatgtatgggttttacaacatgtaaattatgcttcaaaaagttgatttttttttaaagtgaaaatgtatccccgtgttaagaaaaagaaagctgatccgaaacgtgaagtgagctggttacttaaacattttaatgtttaaagttctgagcttcctggcaaccaaggtaaggaaasgaaatataatactttataatgtcctcctcattaaacaaccaccaccaaaaaaaaaaaaaaaaaaacataccaattcttttagaggaatgagctttgttttcttaataattctgaaaacttattagaggaatccttatataggaaacatgttaacagaataaaccaggggttgccaaactttttctgtaaagggcaagagaataaacataaatacagtaaataaatgcagtaaatatcttgggctttgctggccatagggtctcacagctactcaattctgctgttatgatgtgaaagcagccatgggcgatatgtaaacgatgagcacccgtgttccaataaaacctgatttacaaaagtgggcctcggggggctggatttggtccacgtgccacaatctgacccttcgaatagacaatatccttttaacattcggttctaaastgacctgaagcaaaacaagaactaaagacgtgaagatgaccttgayctgtagattttcactgcaagaaaatgtgaataattataacagcaagttcagaacccatgtggatgacaaccacagaaaatttaattttagacaatttacaagtttctatgaaagcagatataaagagaatctcattaaaacaaatataaaacaaattttctaagtattcaatatgcatcaaaatcttattacacagtttgtttcacccagaatttcattcagtgtgctatagctacattggcttttcattgcaaagctggatgtttaactataaactacatcctgcctctccttttgtgtgtaaaactgacaaatgtgttgtttttggattctagaattctggagaaagccaacttaaatgaattaagatgactaatatgttgattctgtttccagtccaacaaaatgtgaatgtaagactccatgtcatatgatgctatgtgttttagttcaaatttaacatcgaatattgaataaggcagtttctaagtaaattactaagctaaaaatattccttcaacatagcaaaaactctatcttgtttaaataagtggaaatttgaacatctttgctcagatcagcctaaataagaaattagaaaaactgtaaacctccattacagtcaagagcattgattccatctttctgtggaaagtagcacaatattgtatatcaaggaaaacgatttatttatttaaagttattcacccacaatcatgatttcacacaaagttcttcctaaatacaacacttgcacaagacgatgcttttctggcatacttgaggaatcacatccaaggtgaatgaccactaagataccacaaatataactgtgagaatgacaagtgtttttgaacacccagctactagggagtatctagcatttctagttcttttgyagcttgataatgtttttacaaatgttttcattgcattaacttaacatttggctgaggagttcctgtggctataacacactgctacacagttttgttttaagtaaaccaacattagtttttcattacataataggtgggtaatttctatttccacagaggcagtaactattttgctttttaaaaagctgttgaaagtgttgcaaagcctcaactcaattccataaatattgaccatgttgcttccataaataagactcttagatgttcacctaattctaataacaaatatttctagttttcttaaactaattatatttattgactaccaaaggaagcattttaataattaccttcattgtgaaaatcaaatctgttatgagataataaaatgaaggaaatcagttagggagcaccatctttaaaaaaaaaaaaaaagaaatttaaaattttataaggaagaatttagaaatccagggtctagaaatggaaactacatagaatatatgtattttgcccctagctcttagattcaactatgacaggctgtcagtaactgaattttttttccattacctgccagttatttaggaaatttccattgtttagcaccgtataattctgaaatcaatactactttattaattacacactgataaatttctatccaaaaaaaaccattacaatgaaaaagtaacaaatatttctatgcatatttttattcctaatcctattcaatgaatttttatgaataaacacactctctaaagcaagtatgtgtatttaatggaagtatgtctacgtaactgctactaatgattacaattcccataaagtgtagggatttcttaattcagtgtctatgaacaatcctttcctcccctacaaaattgtacacaaatgcctggctaggaatacatttatttttcccttgtagaatgggccagaggttccactatattctcaaaggagtacaggatgcaaaaaaaaaaaaaaaaaaaagaagggggatggtggggttgacatccagtggtctagaatctttttatttaagcagagacctgtgaaaacactatttgttccctttaaagataaacagaagtgttgtatacttgacaaaacagacagaggcccagaacctgtccatttgtacaatcataccatctccgcagtggaaatggactttaaccatcacaaacccaaagccctgctcggcatttaaattgcctctgcaacatcctcactaagcagccaccaagctatgcttaaacacctttgcaattcgaactcacttgctcaaggcagcttgctctgtgatccaaaagcaggcaatccccccttggttcctaatgtctgatgataacgaggcaaaagaacaattacttctgaaaatcatgctccataagaaagtaagctgcacgtaggcaggagcactttgttcactgctgtaatcaccaggtcctagagcagagctgagttacatactagaccctcaggaaatacctatttctttcgaatgacttgttgaatgattgctatgcatctggatagcatcaatgataaaaagcaacatctcttttayagcacagttgctattggtctaattgtgtccccccaaaaagatatgttgaagtcctaagcccagtacctcagaatgtcaccttacttggaaacagggcctttgcagaggtcatcgagttaaactgagggcattaaggtgggctctcacccagtaaaactgtcacccttagaagaagaggagatcagaaaacagagacaaacagtaatagagggaagatgatgtgaaaagatacagggagaatggcttgtgcwgatggaggcagagactggaattaccctgccacaggccaatgaacatctagggcyaccagaagctgaaagaggcaaggaagggtccttccctacacattttaaagggagtatggccctaccaacaccttgatttcagacttctagcctctagaacttggaaacaataaatttctgttgtcccaagccacccagtttatggtactttgctacagcagccccagaaaactaataccacagcagaaaaggctaaagccccagaattcatcaaactgggactcatttatagtcccatcagagagccttttaactttaaggatacactgtggtagattctgcttactcttaagagacctgagcatggtgcagggggtggactgtatcgggcacctctcatgcaccccttcaaattctcacagctccattttactcaaaccatttttacgcycaccatgcagttttcaaccaacttgacacaaatgcaaccagatggcctcacctggggctacaatatggatccccccatttccatcctagagattctctgactctgcagcatgggatgcctacaagaacctgcttggcacttgcacatgtgcaaacccaaaattctgggacatcaaaacttatgggacgcccttgtccaacggggtcagaagccggtggataaatgccctttattccgcaggcagacagctatgagatgcatttcctaaagtgcctggagttgagcactagttgcctctagtaatgactaactaaaaaacacatttttatattgcctctccttccttcctgaattccccatccctctstttgtaatcacatcccaaattatgcataaatatgtctttttctctggttctgtttttggaggaacctaaggtaagacaaagaactcttaaaacattttcaatacagaaaacttactctctacttttatttatttatgtatttagagacagagtctcactctatcgcctgggctggagtgcagtggcrcaatctcagctcgctgcaacctccgcctcctgggttcaagcaattctcctgcctcagcctcccgagtagctgggattataggcgcctgccagtacgcccaactaattttttgtatttttagtagagaaggggtttcaccatgttggccaggctggtcttgaacccttgacctcatgattcacctgccttggcctcccraagtrctgggattacaggcatgagccaacagtgccagacctactgtctgctttttatacaatgtgaatcattagaaaagcaacaccctctcgccaaccccacccccgacaattctaatcagttaaatgctgcctccttgcagattytgtccattggtcctggttctgtcccttgaagaaagctaggattatctctctcctagatagctactgagagaactaatttacataaatcttttcttctaccaactaaccagccattcactcttcctttaagggttgctcctaggacatgacccaatgactttgccatcctttagcctgtctatgcgccacccctaaatgaacgtaatattctagatacggtctgattggtgggactgtgtacctttctttacaacaaaccatgaaggtttcaaccacccagaggtataaacgggttgtctgcatcagaggcctcgttgcaaatgttaggagttgcaagaaacagttgcatggggggaacatctttgagcagctgtaggtaatagagatgccaaatgatgattgcaattcagaagccccattttgagcacttgctccccactcacatccgtggagtggcgcattaagcacttcgctgggactctcccgcagcgtgctgcacgtggttcttgaaagcttgattacggtctacagcagttgggtgattgctactgaaggcaggcagatgcctggtgacttctcagggtgggctgtccccagtgtgttttatgaccatgcagraaggaaaaataaggaatttaaaaaatcttctttcaaaagatayggattcttatcggactttcattccttagtaaagttgcattaaacccagagacatttattctttaattttccctattctctcatatggaaggtaggaagaatttgcactcaggccccactgaaagataagtgccagattcactcctgtcctcctttcccttttggttttcacatccttattctgagctaaccacatcacgagcacatctttactgctcaactgagttctcctgaagcattayaaaaaacaaatcagttacatgttttaaatatccgttggcaagcatcatagcatggctcttaatctgagaaataatttyaattaaactaaaaagaggtaagtcattgaacacacaataattaaacagcagactgtgctgtcagcaaaactgggckggctcttgcaggattatcagagggactggcgttgtcatgtgatgttttgtgactcttctacagtcctaccatcagctctcgtgaagaggatgcagcgagccatttagacagttggccaagaacagtctgctagacaactttcctcattgcatccattatagaagctgatcagaagaattctcattttccttgagcgaggttctgtttcctttgaacaatggtttgctcacccactctgttcctttcacttcctcttgtgctgtttgtgatatccacacactatggataagatttaggtctaaacggataaggaaaaagacctgctttcatatatcaattctattaagagtatggatactgctcaagtacagcacatagagccatagctttgcaaaaaacttttattatctgttgacaattttgcacactacctaagagctgtcaaataaaacaggccaatttttatcaaactcccaaagtggaacagagaccacaacaactttagaatccctcagcagactgtttcaggaatctaaaacccaagcaaaccctttttccctgtttcatatgacggtgcatcttaacccagctcctttttacctacaaagaaaaacggtaattccctctgtggcggcatatatatgaagtcatccataagaagaaaataagaacttggtcctagacacaaaacaatacgtaaggaaattcctcatggactaacrcaagcggtcagacaccacactagttgctttcattccaccttgtcgaattctcacaactctgtgatgcygacgtcatggttcccattttacagatgaggaaactgagactccggggtgaaagatactgtgccaggccccagaattggcaagctggaaagcatagacgtcaaaacagcacgtctagttatcggagggtgaggattcacaatccaaaagaaaactagggggtggacacacatttacgttgcagtcttatttcccaaggcgtcataattttcatcactctcttattggttgcaggaggaaaaargcatcttctccatttcagatgtgtctttctgggtgaagggatctccatttgcgttaacatccctgaccccctctgccactcacttattcctgctcaagggagctgatccaacttatgttgtgaatggtatgtgaatggtaattccaggattgagaaccgggcacacgcagctctgcctctcctctcctcttacagagagcacacaccctgctctcctgcactgtcttgaacatgctgcatgaatggggtctgccctctgcgaaggtctggcctgacctagcactgacccattaccctgtctaattgtggtggtcaggattagaaagcccaccagctcacacagctatacatattctccagtatcagcttcatgaatgactcaggtgatgttttggtcttccatttgcctaatgggtggtcttactgctcagttaggtagtaacttgggaaagggaaactgtgttatttgatagacctcttaaaacccaaacatctctttacaggttaacgaaccaacctgtgcttagatttctctagtgagagtaaaaagctctacgttcctcaagtctctgtaatttaagaataacacggctacacatttcatttcagtttgaaactcataaacagatgtgatatgacagcactttattaggttttgtcctctagatttgaaagagctcacaggccccatgatgaagactagatccagtaaggtctaaagagagagacatgactcaatgaacaccaaagcagacacccaggaaacagcatcctttgctcaccctgtcctgggaatcaaataagcctrttatgaatctgaatgtatattacaagcaaatactatttttccagctacacgttcttccttgtttcactgtatcacaataattttttaaaagcataggsatatcatgaaatcccttgctttgtagaagattccattataagagtaatcattattgaaccttttagcccagatgtaatttcttacatgttacaacaagtttggcacgcattgtgaatttcagccaaggttgataaagttcaataacttggctaaccaaccatgtgtactactcattatagaagtaataaatagattcatcaaaatggacatgaaaaagccataagaaaatcggatgccatttccagcctgcctcataaaagcacctcttggactttaatataattttatatatagttatcacaactgcccatcattcaacaccaggcatctataaaacaatcacccacccacatttgcatgctgaataaattccagctacaaaggtgaattctctattctagacgtctcaaaagtcacatagaggtacatgtgcttatatgttcaactcccaaaaggactgacaagtaaaaaaggaatcacagaycgacatgtcattttccctgctattatctttttgagtcagttttagtggaaggtgttttttttgttgtttgttgttgttgttttgtttttttttcagtaatactgtcagtctaattattctcatagcctattggtaattgaaaaatttagtagaaagaaaagaaagcctgatttagataaatgtcatggatagaaaaaagaaatctaagttcacagaatggaagaatctcctatgattaaatgtgcagaagtcagtaaagctggcttctataataatatctaaacaacattaacaaaattgaatttagaagatttgaattgaagataacttcagcaactgtatagttaaaaatccagattctgcctactgtacgtcttttatgcttctaaaaggaaactcagactctattagacattcaaggaaactaaagcttcccctccttctcagaaagaaatagtccctcacacttggtaaaccacagtagagctctagtgtcaagctctaaactaaacatgaaaaggcacgtggtacatttcaaacactgtcatgtgaacactttgctaggtaaataacgactcttgagttgttgcacgtgggtgagttttctctgcatcccaagacgggaagcctgagggtggaatctgcatcctctatttctcagcaaggccccatcttcatttacaggaatggtgggagtcaggtttgtctgtattgcagggactgcattgttatggcactgggatttttcaatgcgcaggtgacaccctttctatctgtgcattgcttctgccctctcccgttctcactgtgccatcagcaccattwgtcaccagaaatgtccccaggcttcagtgaaatgctttcttctggattttctctcttgcgtatctatccacagtgggatcaccatatgacaatattaccaatatcctcacactctcctggttcttttcacatctaacatggagaaaaacatagatcaagctttctaaaaccaacgttatactcttaacaacaaggaaaatatctcctgccattaattgcaaacaacacctaaatgatcccaagtttggccaaatattgtgagtttttcacttgccataagcagctcataacaacagtggagtgctttattttctcaacaagttaacaaatgcctgatgtttccaagagcttaaatactataatggcagatattgatgtacagaaattaaagtaaaatatgaaactaaacagagaatgaagagataagmcagaggtgtgctctgaataaaagaagtaatgaaaaggaaaaatttcataccaattgycataataaaaacaaaggctaaaggcaactaagagaagaggggctcaacggttcccaaaaagacttacagaataggtaaaattcagcaggcattgcgaagtattcactgcacccmaaaaaaaaaatagtctttgcaaagtctgtactattgttgactgcaatgcccaccattaaaaatatggttaaatttctaaagaaagacttctgacagccatccagaaatgctatcaataatagcagatagctttctatcacatggttttaaaataaagccatcctgctagcatgttgactctaaaatccaatgctaatatttgagcaactagtaaagtcaacattaacaatgtttgccatttcttattcgtcacaagggttagttctcctaaccaacatgagaaacacagacacatagagccgtaccatacaaaagcaattytttaaggaaacagtctaggtacaytgaagaaaacacatcttagggataatacctgtgcaagaggcacaaaatctcttaagaagatggaaggcatctacagtccattgactgtaaatttggaatcacttatttctaaatgtgacaactctctaatatttttcttcccttgcaagctcagctcagccttgcaggtatctcccttgcttttgtgagctagcttccccaggattctacttctaygcatgacatgcagtctggaggttctagcagtytgatttttctattcattgaaagtcatgagcatttgttcctcaggggttaatttgaaattatttcaggccaggcatggtggctcatgtctgtgattccactactttgggaggccgaggcgggtggatcacctgaggtcaggagttccagaccagcctggccaacatggtgaaaccccatctctactaaaaatacaaaaatcagctaggcatggtggcgtgagcctgtaatcccagcactttgggaggccaaggcgggcagatcacttgaggttaggagttcaagaccagcctggccaacatggkgaaaccccgtctctawtaaaaatacaaaaattagctggacgtggtggcacacacctgttgtcccagctagttgggaagctgaagcaggagaatctcctttacccaggaggtggaccttgcactgagccgagattgagccactgcactcaagcctgggtgacagtgcaagactccatctttcaaaaaaagtaaaaataaataaaattttcactttcaggtacttctcagtttaaacataacacgcggataaggttttttaaaaagcatcctttgaaaagttaaatatgattaaattcttcaatccaaacaagactagctttataaccagtaatacayggcatgtagaagtcactccctcaaggttgatggtgagatcttaatttggctaacccttccattttacataataagaagtaaaaagtttgcttggaatttgtagatccaaataccatccagaaacatgaccgctttccctgcagccttgacagaatgtaaaatcataagctgaagtgacgattctctacttcatgttcaaatactgtgctttgcagctgccaccccatttgagaagctgggaaatggaatggagcaaataagaattatggcaattataaaacctccctggtatagattgtcagattaataaccagcattagcagagctcagctacaccatcagcacgtgagaatcgaagagcycagagctacagggctaagtcgtaayaggagcaaagcaaagaagccaactaaaagaaacccagccagaactgtaaaagaaatctgcccacaaaataaaatgggtaaggctgccactcagactagctactcatttttagcacataccatctcaagagtacataaactgctcaggttataagcatggactggacatcaagatactggatgaccttttaaaaaatcatcacatggccgcatacgtattaacaaaaggcaagcaatggaagcgtgattaatataaattacagaagaagcaattaaacttgaccacagatacacacatttgttcaagctgatggtgactctgcactcactccatacctacygtagattttgcttttctttatagttactcagaagatgcataattggaaataaaggttaagaaaaatcaaggccgggcgtggtggctcacgcctgtaatcccagcactttgggaggctgaggtgggcagatcacgaggtcaggagatcaagaccatccttgctaacacggtgaaaccccgtctctactaaaaaatacaaaaaaattagccgggcgtggtggcgggcacctgtagtcccagctactcgggaggctgaggcaggagaatggcgtgaacccgggaggtggagcttgcagtgagccaagatagcaccactgcactccagcctgggcgacagagtgagactctgtctcaaaaaaaaaaaaaaagaaaaagaaaaagaaaaaagaaaaatcagagactagtagtaagacttaatgagagtgtcattcaaaatagcaaaagttctttttaacttataagaacatatttgctgttagatgtttcctcaagtatgaaaaaaaaaaaatccttgccaggcgcggtggctcacgcctgtaatcccagcactttgggaggccgacgtaggaggatcacgaggtcaggagttcaacaccgtcctggccaacatggtgaaaccccatctctactaaaaatacaaaaaaaatagctgggcgtggtggcacacacacctgtaatcccagctactcaggaggctgaggcaggagaatcgcttgaacctgggacgtggaggttgcagtgagccaagatcgggccattgcactccatcctgggcgacagagtgagactccatctcaaaaaagaaaaaaaaaacattttagtatcctgtacttttaaatacaaatagaaatacagaaataattagaaactacccagagtttcgccagatgtggtggctcacacctgtaatcccagtactttggkaggctgaggcaagtgkactgcttgagcccacgagttcaagaccagcatgggcaacatagcaagacctcatctctattaaaaatacaaaagaaattagccaggaatggtggtgcatgcctgtagtccaagctactcaggaggctgaggtgagaggatcacttggcccaggagggagaggctacagtgagctatgatcacgctgatgcactgaagcctgggtracagagcaagaccctgtctcacaaaagcgaatcaatttaaatgttctctagaagcacaaagatcaagctgctggtacagtcacacactgcataacaacacattggtcaacaatggagtgcagatacaacggcggtcccataagattacaacactgtatttttactgtaccacttctgtgtttagatacacaaatacttaccattgtgttatgactgcctatagtattcagttcrgtaccatgctatacaagtttgcagcctggaagcaacaggctatcccatacagcctctgtgtataatgggttataccaygtaggatttgtaagtacatcctatgagggtygcacaacgatgacactgcctgacacacttctcagatcatatctctgtcattcagtgaagctgactgcattttggtgtgttttgtatcctccacaagggcagggaccctgcctgtttctacactgaagtcttagcacctggtactcagtagtcaataaatgtttgttaattgcacaaaagactgaataagggcgtggcagtggctatgagccagtgagtccaatatcatcacacagttttcattgcagactctaaaccaagctcaagcctctacaggaagcaggcaggtaaactgaccatggaaaatagcctgtgcctgcctacagggggtcagcctataggaacagctctgttcaacctcagtgcaactatgttccttgatagacataagccatagtcagctgaagctgcagcaacaaaatatcatggaccgagtggcttaaatagcagacatktctttaacacagttctggaggcttaaagtccaaggtcaaggtggcagcatggtcacgttcttggggagggccctcctactagttacagatggctgccttcccactgtgttctcacmttcacatagcttaaggaaagttagctacctttctatcctcttctcatcagggcacaaatcttacttatgagggctccaccctcatgatctaatcacctcccagaggcccctgtattagtctgttttcatgctgctataaggacatatcgaagactgggaaatktataaaggaaagaggtttaattgactcacagttccacgtggctggggagacctcaggaaacttacaatcatggcaggagaggaagcaaacacgtccttcttcacatgacagcagtaagagaagtgccaagcaaaagggaagaaagccccttataaaaccatcagatctcatgagaactcactcattatcgtgagaacrgcatgattcaattatctcccaccgggtccctcccacaagacatggggatcatgggaactatagttcaagatgagatttcagtggggacacaaccatgtccaaataccatgaccttaagattagggtttcaacataggaatttttggggaagacataaacatttagtctmcaatactcattctgatttttcaaaactgtcataaatctacatttaagtaaaatatcctgattttagtatgctggcaagtagtctgacaaaaaaaaaaagaaaaaaaatcccactatagaccatttttgtgtggtccatacaaaaaacatctggaggccagatccaggctccaggccaccaaccagttcttacctctgtcctaaaggctgattgggaagctttacccttgagcttatggaaataagcaaacacaaaaatgtccacctcccttaatcactatcacatgacaatggactgcacacacaacggcagtcccataagattacaacactgtatttttactgaaccatttctatgtttagatacacaaatacttaacactgtgttatgactgcctataatcttaggtttgcagcatagaagcaccgagtttgtggtggtccattatagyagcaacaggacattaatacaccttcccaataattaagtaaacatgtaaggaacatacaagtgagatgcaaacatgtgtacactcgggtaagtcaatcactaacagcgtcgcgatgatgacacaccaacaagactagctttcccaaatccctcccggatcaggccagcaggaaataaaaaagaaacactgggcaagtggcgacgctaaccctgggaggaaaaaggtcctcgtgcacacaggctgacagctcccaagtcagcttttcaggctgaaaggatggtatcccttgccaaaaatctgactccacaccctgactgagatgttccccatatggatctactacagagctctctaccttgtcaaacactcaatctagtaactgtacgtgaacttagaattgaaacttcctttgctaatagataaagctgtaacagcatttttaatgccatttggaatgtactgatgatctctcagctgatagaagcttctcaaacctagctgctgaatttagaagccacagctgccttgctgtatcacacagccacacagtaaaatcaaaggcagttggaagacattatattgcaagatacaaaaagttttgagagttcatccttatagccaatggtggctgacacagcggagtctctccatttgaaagagattgattattttcattcttttgctttgtgtgatcaccaggaaaaagagtttctataatcaagatgtggccagcaattctgttgatgttatataagcaaggagcatcccgtttgtgtctgaatccccaatcagtatctaaattcgtgctgcactgtgagcagaagtaaggacctgggcaggtgaaacttaaggcaagcaggaagaaatcgcatcacccaagaactcgcaacatttccacctgtgtaatctcaacacaactgcaacccacagaagtttctgcctctgcaggttcccttcttattgaatcaagtttctgctcctgaatatctggctagagtcagagcctgtcaactttaaatgagatcgcatcattaaaattttagtcatcaccacccagtcaattgcatgacatgcaaccctgttaccggacatccggttcacttcgtaaaccctgaagaagatatttgcagaaacctctccccatatcctaacaacaacaamaaaaaaaagtcaagagctcttattttattctttccattaaggaattaaattactctcttcctccatcttcttccaaccctaatcttccctttaggagtctttcttctataactatgatttttccccaaacgccagcaaccttatattcayacactattggacttcttcattacagcatttcacacattgttttacttgatctgtacaaaacagtatgtgacagagaagttattattctcttgaatttacaaacgaggaaattaaggctcagatggttaagtgacttgccttaagtcacccaagttaaggacaatctgtgtcaaattacagctctcttcctaccatgtccagtagacgccaataaaactgtcctacctttttaagtggcaataaaactatattcaaacactgacactttttggatatgatcaaaaaaataggacagcaaagttgagcatttctacttaatacaccaggcagtcctatmaactatcacaaacttgggtgaacaagtgtgctaatgcagaactctcagtaaaaaagatgttaccatgatgcatggtataacggttttaaagaataatagttttccttctctttttcccccaagtttaatatatccctttttgttccttgactgtaacaaaaataacctcgtctcggtggtttttttttttttccgttgattattcttttctggatgaaagctactgacctccagccaaaaaaattctaaaatgttttccttcataccaaagacaagccagtgtctaaagcagttatttatacaggtcattttaggacaaattcacagagattatggcagcctcttgaggatctgggaaccaggaagctaggaaaataccaaactaatttcactggtaactcgatcctcttgcctcccattccagaaatggctacacgttattaaacgcctgcaatgatgagtagacaattccctgggcactctggagttcccatctttaacaactttgcaaagtaggagtactgtccatattgcacagaggtggaacaggagttctgagaaggaaagtaacttgctcgggtcatacagataggaagtggttatcccaggtttcaaaactaggtcacgtctgcttccagagtcagtgttcctstcctacatctttccagatagaaacttgctaccaatgaagcttgccctaactgtcagcgaagctattttcagcaatggtacaatttctccacctgaaagcaggctcatcaaatgagagaatgcatagaaaagctctgaagcgctgttactgtcattaatagaagatctaggggaaatttgcataaccaaagtaatcaaatcttgcctactgtgtcatcttgggactccaccaccattgcaaagccasacaagtttaagttttttggggtattccctccttaaatgcgggtaccaaagcaacagtgcctttgatttgagttgcagctggcataatagacaagatgtgtgcttaaaagattttagtgaagcaaactgaggagttaggccaatttctttctctgtgaatttcctcttgatcacaggattgaacaggtacttaaagtaatagacactttataaattaacttctaagggacattttgaaaattaaatkatagcacatgaggcaagcaatcaattagtaatcgatacatatccaayagtcatgcatataagatgaaagggcaattcgttaaaaaacaaatggcccgacataagaaaagcctatcaatcttgctaatcatcagagataggcaaatttaagtgatattttttaaaaattctaattctcaagtttggcaaggatgctgggcaaaggagcattcaaattggtacaatcttccagggcagtttgacaaaacaaatcaagatattaaggttggggagcaaatcacttcattcagcaattccacttccacaaaataaaactatagaagagtcacggatgggtacaaacatttaattacaaaatgtgcttctccattccacagctattaaaaagctggaaaccacccgaatgtaccacactgggagaagagctggaaccacataatggaatactatgcagccatttaagatgtggagtatttaacaacacagaaagataatcacaatttaaatagaaaaatcacgaaagaagggaaaacatgcttacaatcatacatgctaaatattaatagtatacttctaactggtaagaattggggtttttttaaatcttttattcttrtttttatttttcttcgctttctaaattttccataaggaatacatgttaatcacaataacctttaaaataattacttatattaaatgagaaggcacatcaagctaatctagcctaacacctggcatatacaggcgcttgatgaatgctacttcccattcccccagacttattccttaatgtttgttttacaatcataataccaaagtggttttggtaaagaaagcttcagcttttaaaaaaaatttgatttggtagagatggggtcttgctatgttgcccaggctgctctcgaacccctgagctcaagcaatcctcctgcctcagcctcccaaagggctgggtttacaggcgtgaaccaccatgcccactcctaagcttcagcttctgaatccaggatccaatgcagtctggaaatgacatctgccttggccctccccrcagatgccactcccagcacttgaccgggcacagagcgaggcttcacgggtttaaataaattggttgattccaaactcaggattaacaaaatgaatgagctgcttagaaagagctcattcaggagtgtgctgttattcctcccaacaggatggtggcatgtacagtggaaggggccccaggcacagactcaattaccctttgatctatcctgcaggcacccgccgcccaagacctgtatgatctcaagcacgttacctcacctcccttctctttcctttcgacattatcacaagacagctgtaagcacggtgctgagaattaaatatgacaagtacggaatcttcataaattttaaacggctatcaatgtaatacaayatgataatcaataaatacgaatctgtaacaattaagtacattgtagaggtaagggtaaaaatgaaaaacattgtattagctttaacttcagtttctgtgcaactacagaagaaatttgattctgattttgttcctctttatawgaaataaacttcatacaaaaggcttagctccgttcatctggctagttatcctccacctaggtagaaatagtagagacactgaaataggtttcctccccgcccccatctctctgtctcagatctcctcttagagtstagtgaagaaaccttgtcttgctttcagagagcaccatatgactatggcttctaacatgaaggctccaaaaatcacaaaaagtaaaaccatcaagcacagcctggtgagcaaataactcaaagacttaaaacaattagatttaaaccttgtcacacaatgcaacccttcctatgyaccccattcagttaggcttgtgtagactgagaccagctcttcatgaaatgtaccgttatttatgaagccaaagggagatcacaaatttaggcaagaaactaaaagcgagctattggaacctgctttttgatccatctactggtgccttaatttaagacatctttccaagaaggcctcctagtgaccccaaccttattttggagaaggctgaggattcatatctrctcatgtataggctacaaaagtccaagaaggtctgtgtcataccaaacaggcaacggtcaagggggtttcaactgtcagcatcttatttattatgaagtctataataattcccagaatcgccatctagttttaacaatttattagataaacaacgaacacactcgtatatgaacaaccaaaatatctttactctggtgaaatagctttgcaatgttacaagtatattcacaatgtttttcaggctcttgcattttcaaaagagaaaaagttrctgaaaaaaawattatataaataaaagtatataatatagcatattcgtttttgtccccatttaaaaatttgaaaataagcagttttgtaaagccaaagtgtattcctttctgggccaaatttctatttgacagctgaaatatgcgattaatgggctgcctcaaaccataattacacagccaaaacaaaaattaccctccctaagattgtacatggagaacactggctatctgcttcacattaagtagctggtttaatatgatccctcttacttaagaaacatatactgtactgagcccaaaaggacacgttttcttctacagcaagaatgtatcattaataaacaatttaattacaataaattatgtaacactgggtaaggcttgtagcagggggcaagggacactatattcttagaaaaaaacatagggttgcgggtgcagtagctcacgcctgtaatcgcagcattttgggaggccgaaacgggtggatcatgaggtcaggagttcaagaccagcctggccaagatggtgaaaccccatctctactaaaaatacaaaaattagccagacgtgttggcrggtgcctggactcccagctactcgagaggctgaggcagaagaattgcttcaacctgggaggcgaaggttgcagtgagccaagaatgcgccactgcactccagcctgggcaacagaggaagacttcatctcaaaaaaamaaaaaaaaaaaamaaaaaaaaamaaaacaaaacaaaaaacaaagaaaaaaacatagggtcaccaaggcgttcaaaatgaaccttaaacagaggtattaatacttaaatattacaatttccacttaggaaaaaaaaatcatattattgctaggccagcacactcaaaagcaataatgtcatgaaaacacatgcccttgtgtgatttggcagaacaggctgctccctgaacacaatgggcctttttattaagtggatcccttcatcccyggcattttatacaaacaaaacaaaagagagagaaaaagaaacaaacacgacactagtaacagtcttcagtttgaacttcatcacagagaattagaagacctaaaagatatgttagaaaagtaaaagacattatttaaccaaaatgaaagcaagatggactgagaggaacagaactatattgcaatgctgcctcttttgtttaattatatcaaagggcaacagagccctctagtggaaaaaaataaaaatatataaagatggttctgcttttagattaaaggaaatatgtacaacacccccgggcatggtggctagtgtctgtaatcctagcactttgggaggccaaggtgggcggatcacttgagttcaggagttcaagaccagcttggccaacatggtgaatccctgtctctacgaaaaatacaaaaattagccggayatagtggctcacgcctgtaatcccagctattcaggaggctgaggcaggagaatcacttcaacccgggaggcggaggttgcagtgagctgagatcacgccactgcactacagcctgggtgacagagcaaggcaccgtctcaaaaaaaaaaaaagaaaaaaaatgtaaaataacatcttccattacaatttttattgtgccactctatgatgtaaaagcaaaagatcaaattattttaattgggttttaagtaaaacaatttccaagttttcaagctttacgtaatgctacaaaacctcaagtagaacaaaaatctattattaatttttttaattatgggtttgacccactttgtcattaaacaayagtttgtatgactctcatttgttatgctgacaccataaaaaagtaattaaaatctaaacctacatgcaggcatgaaattcaactgatggcctcatgtgacaaaaaagtttcagttgagatctaatcaggttcacactgacagyagcccccccttatcctcgggagatgcgttccaagacccacagtgatgcctgaaaactggatagkaccaaaccctatgtattctatgctttcacctatacatacatacctaggataaattttaatttataaattaggcacagtaagagatcamcaataataataaaatagaactataacaatgtactgtataaaagttatgtaaatgtggtctctcacactctctctctctcaaaattagtattttcagatgcctgttgacctcaggtaactgaaacctcaaaaagtgaaacacgggccaggcacagcggttcacacctgtaatcccagcatttggggaggttgaggcaagcagattgcctaatgtcaggagttcaagacctgtatggacaacatggcaaaaccttgtctctactaaaaacataaaattagtagggagtggtggtgtgcacctgtaatcccagctactcaggaggctgagacatgagaatcaccaggccctgggagacaaaggttgcagtgagctgagatcacgccactgtactccagcctgsgcaacagagtaatactctgactcaaaaaaaaaaaaactgaaacaccacggataaggggggactactgtatacatgattacaaatttattttwaaartatatataacatacacacacccctattataagcattttacatgagattaccaaattatgagatgatgctcattagaatgttttaaattggtctcttcctttagatatttacttctcaaatactttgatcacgtgatttccatgtacactcaatgtccaataatatctcagtgtaaaatggttaagtcataaggtactaattctcaatttttatataatgtcatttaaggactttgtctaacactgtcaagaatctccatagtttcttagaacaaagtaacttcaaaataattttacttacaatacctgggtataatttagcataagataatagtaggcacaaatgtttttaatttaaaatggagttccaatgcccaaaaggttatttcgattatttcagaatattttcctttccttaatgagcaccaggtttttaaaaagataaatgccaagatcccactagtttaagtctggtcaacaatcagaaaggaaactaatcaggcatttcaagatcccaagtgcaatgatctcatatgagtgtgttttacccatgaaaatgactaaatgtaagttagctatggccccagatttatgggaccttttggaataactagaaaaaaaaaaaccatcaatgacatgctttaggctcaaaggcaaaattta

SEQ ID NO: 13239 - DNA, 30151 bp, Homo sapiens
gaaccttccatttgacccattcaaattattgaaatatatacctccttgtgcccaattcagtttcaaggatattccaaatttgtcgaaaataaatgtgctgaaggcactaaaacaatctgaagtccgtttaccaagcagagtgtcagaaactttggagtgagcatggcatctccatttggctctttctaaattgaaatgttactgcaggttccatcaccaagtgtattgaccgagtgaaatgactcagcactgcttgctggacaccaaacactccctcctggccaaacggtcrcttgaggacctaccacctgctctaccaactacatctgcacgacagtaaacagcaaaataaataccttctacagccacatatagattaggtcttcattaccttaaacatagataaaactgtgagtgtgatttatatagacaagagtcttttggcagctagatcaagcagaaataaatattgatattttgttttagagtcaaggagattasaagctggctctgaataaaatacagattgttttacttarcacagccattttgttgttgttataaaagaatagagatggacaaaagtacctaagaaagggcttcttgctataaccacaggttgacrgctgtgcaacactctccagcccggcttccctgtattcacttgtagccacaactacaatttcatactgtttaagttttcattgacaacggcagccaaatatctgcttatttcagatattctgaatgctaagaaagtagatggtcagatgtttctttcacagcctttgctatgtttgcatcttgtacttttgaaacaagtttcagttcaggtaaaggattacttaatcctctaaaggatgaaaaagtgtagctgaggtgtctaaaattcttsattcaagtttgtccaactgagagagtttatcaggagctaatttggctcacactggacccagaatcccaccccccaacttcatttgtggtccaattatagtcttttttttttttttttttttttgagacggagtctcgctctgtcgcccaggccggactgcggactgcagtggcgcaatctcggctcactgcaagctccgcttcccgggttcacgccattctmctgcctcagcctcccgagtagctgggactacaggcgcccgccaccgcgcccggctaattttttgtattttttagtagagacggggtttcaccttgttagccaggatggtctcgatctcctgacctcatgatccacccgcctcggcctcccaaagtgctgggattacaggcgtgagccaccgcgcccggcccaattatagtcttatattaaacagtatccactgcagctcccaaatatccataagatcacctgttattagtctcttygtgtcagtgaacctgctgcatttgtgtcagcaagtgcaaggctgcctstggacgtgttcctcacctctgcactgtactataagccccttggcttttgtttttggaatraccctttgaaataagtaaaatcctgaaagcaatagtttaggaaatctacctgtcacttctgtagtcatacaatgccacatgtaaggttatcttgtaggtgcacttataccctggccagctggctaatctggcagcttatttttcaatatctggccaatgatacagactcatgagttctgatactttattgccctagttatttaacgttatattatctgtacagcgargacagaaaaggctgttttaaagctgtttgtgagagacaactattattttccttattttttaaagcagactctmcataatatcagcaaacaatataaagacattttggcaattaatttgaattacctgtgtatttcaaagggctaaaatgggcatgttttaaaattcaagattgtagttcatttattcattttccattattcttccattggtaagttccactttaatggaaacacatgccatatttggtgagagagcagattttttaatttttaawttttaaaaaatgacatatactgtctgcagacagatatttttaagtattgcaaagcaaaagttgaatgatgcctaaaaaatagtttatcctaagtactcctggagttccttgccagatcctgtttgctatggttccaaaggggaagtgcttttaatcactgttgagcagaatttatgaaacaaacctgaaaattgccacagatgatgttaaatgtaaacattgggacagaaggaggtagtaaatagcacttactttgtctacatttactcctctccaactttccatttttcttttcttttcttttaagagttggagtcattctttcacccaggctggagtacagtggcaggatcactgctcactacacccttgaatcctgggctcaagtgatcctcccatctcagcctcccatagctgggactacaggtcggcaccaccatgcccagctattttttttttttttttttttctgtaccaatgaggtctccctatgttgcccaggctggtctcgaactcctggactcaaatgatcttcccactttggcctcccaaggtgctggaattacaggcatgagccacctccaattttstattggcctctaattttctaagtctgatcttttctcctcttagagggagaagatcttttgtcctcttagggkagaagaggaaagagagactttttttctgcttctgaaatctcccagcatattgctttcgacttgtcaatggcaacacagcctttggatgctcacttgaccctcaacgtgtctggtcctttacaattctatgcattttcctgtagcgagatcccttctccgtcttccaccacccactgctttggctcccctcttgctgttccctgcctgcatctgggcaggaagttccamtcctgacttgaccctttttcagctgtgtggcctaggactcattgctcttttctccccatttcatcatctgaaaatggaaaaaataatacctgactagaaagtgaaagtaaaaaagagatataatggacaatgtgcctcgcacagggcctggcatggagaagtccttgatgtacgtcttttccttcccttttatgcagcygtttccctcacacccacccattgattgatttttctgaagagactacttttgtcatgtcaycctctaatccccagactttaaactgggaggtagcagagtggtctgattaagaccttagacaagggtttcttgtctgggcgcagtggctcacgcctgtaatcccagcattttgggaggccaaggtgggcagatcacttgaggtcaggagttcgtgaccagcctggccaacgtggtgaaaccccatctccactaaaaatacaaaaattagccagatgtggtagcaggctcctgtaatcccagctactcgggaagctgaggtggaagaatagcttgaacccaggaggcggacctcagcacttctgcctgggtgatgggagtaaatcctgtctaaaaacaaacaaacaaamaaaaaaaacttagacaatggtttctcagctttttttaatcactccccaacaagtccttttagmtattatattcttttgtgtgtggcggggtacatagcgtgtgtatatgtttgtaggttacatgaaatgctttgatacaggcatgtaacgtgtrataatcacatcagaggaaatggggtatgcatcamctcaagcatttatcctttgtgttacacacaatccaatcatactcttttagttatttgtaaaggtaaattaaattttttttactatagtgcccctgttgtgcttgtaaatactaggtcttatttattctaagtattttttgtgcctattaaccacattatatatatatatatatataatttttttttttttttgagatggagtctcgctctttcgcccaggctggagtgcagtggcgctatctcggctcactgcaacctccaccttccggtttcaagcgattctcctgcctcagcctcccaagtagttgggattacaggcacccgccaccacgcctggctaatttttatatttttagtaragacagggtttcaccattttggccaggctggtcttgaacccctgatctcgtgatccacccacgttggcctcccaaagtgctggaattacaggcgtgagccaccatgcctggcccacattacattcttactcacctccccctaccatggaattttattccacagatatgctattggtttagctactatatgtatatctgtgttttatacataaagcacaagaaccttccagaaccaattttcgccaccttggaagtaataccacctctactaagaatgcacagcatagaccataaaacctcaatgctaagttcaaatattggccctaccacacatgagctgtgtggtcttgtacaagttacataacttctcctccttgtctcaaactcctcacatataagatgaggataataatagtacctgcggccacacacagtggcttaaacgtgtaatcccagcactttgggaggctgcggcagaaggatcactcaaactcaggarttcaagagcagcctgggtacatggcgaaactctgtctctacaaaaaatacaaaaattagctgggtgtggtgatgtgtgcctgtagttccagctacttgggaggctgaggtgagaggatcgttcgagcccaggagatcaaggatgcagtgagctatgatcatgtggctgcactccagcctggataacagagccagaccctgtctgaaagaaacaaaaacaaaaacattagcacctgcatcatagggtcactgggggcactacatgagttcatgtacatcgaggacttaggacattgcctcaggcagacctagtgctgcacaaytgcttatgtaattattcccaaatttctccagggcccacagaagaacatggaagtatcttggtttggcaattaaggtgaatcacattctcactctccttttctgcatctctaccccacattcccacaaagctttattcacaccaagtctccagtccttgcctgcattgtgtgatgggtgcctgcagtgatgggtggggacacccatcactgtccagggygtccccaccatcctcacagcctctctgtctggcctcctgcctttgagccagcccaccacactctcatttctcygcccagcagaaaccaaactgtcctctgcatttactgtctcaactggaagagaaatgcagaatgacaaagaacttgtgaacaagggtcagctccaacagagagtgaagccaaaggggctgggcagaaagagagatgaagacggggrtctraggaataaggctgtaccagagtgagagtacgggggaggggttgaacaagagttcagggaggagagaattcccagcgcwgagccagagactcctttacagaggcccaaggaggcgtggagggagggggaaggctgccaaggctctttctgtctccatgagtgtgtcaagaatgcaaagcactaatgctcttcacttggtccatcttgcagggttgagtttgcagtgagcaaccttgaaggatgagctgacatctcgctcagggccaaataaccgacttgcttactgcttgctataaaatggcacgttacccaaggtcagagttcccttcctataacctccccatccctcacacattcacaggtatctatccaagccatggcatcactctgtggggcttgggggcaaggcaactgacactgsacgctggttctcatgcttgccaagcatgaagccctgtgctgctagcagctgtggaacatagcygttagctttaaaagagggtaaaatcacgtcctggacaggacagccaggtgagttgggaagggaagagagcctgccacgggcacaggcatgttgggggaagtggaagtggtgagagcacagtaggaagtgagaaggggcgggccgtgcttaccaggccgtggacttaaaccaggatgagagaacccctggaggcgttkaagttggcagacttggatttcaggaagagctctctggcttctgggtggagaatggccagtggggtaagtggtgagaggaaagacagagaacggagaaggttagatgggcttgggaaattatccaggccctggatggaggtagagatgtgtgctcatgaacacggaggggattactgatgtggggtggatgagactgtcgtcaagagtgtgggacaggaagagagggagagtcttggccagatccaagaaaggagccctcagaagaggaggggagtcagaggcaaggaaggggctgaggcagccagcccagctgagtggascccaggagaggtatcamrgggtggtgtggggtggggaggggccagtgtcaraaagtggatggggagcggcctgactctgcttttgtcctgtggccttctggccaaaggcagggaaaggtgrccaaacactgagaccaagaacaaagaaagaaaactgctggtggacttcttccaccaygagcaggccaccaagcccgcagcactgcactgcagcccccagctctgtcctggggttgggggaggtgaggaggggcaaggtggggagcacacagagcacccgctgtcctcggaacaccacagcgactagaggtaagggagcwccggatgtggctgggatgtgggcagcaaggggccagaggggccttgaaggggtcacrgaccatttaatgaaggtgtattgaaggccaccatgggccaggccctagttagggatggatcagaattatatagcatatgccaggggtcaggcaggtaatgaagtgatcggaaggtgatgaggcagtggcagttgagattcacgttgcagtcgccccaagctggccaggccagggagcagaagcatggctggatgccggagcccaccaggctccccactgcagggcaagagtggcagggggagagactgtgaaaggagcataggccaggtcctgggtgaaagctgtgtcctcagccttgactgatgggtatagggagccactaaatgccttggggcagagaggtgaggaaaaaaatatttaccgagcatctacaaggtgcaaggtactcactagatgccttcagtaccaaagcttctcaaacttagtatgcatatcactcttctaagaatttcattaaaatgcagattctaattcagcagatatagggcagggcttgaggtgctgtctttaataagctcccagtgcctgggactgcactttgaggagaagagctgtgtgtgccccagtgtggtccagtgagtactctgggctccctctcrtgggcagggaagctgagggccccatgagctctcccagcttcctgaaggctccccattaatgagagctgactgtgctgtgctttgctgactgcagggyctgctccctgccccccacctccaggttggggtaagtggcacctctctccctccagctccgcagtcttccctgaggtttagatcttccaggtttataaagtcaggccctcctgttggcagctggcctccaccctggagtatctgagcttgcctgtggcagcatctaaagatagtctcccttacaggaaacaagatactattggctaactctgcaaataaaatgctcttagagggaaggaaagggaaatactcgtctctggtaaagtctgagcaggacagggtggctgactggcagatccagaggttcccttggcagtccacgccaggtaggtgcacaggactagttgggtacctgtgggtggggtggagcagtggacagctaataggttaataatgcctgtttgcttacgtgcagacaatggaaaccattttcctggggatgttgtagcctaaatatgtccaaggggatggaagagtgggaggcaaggggtgatcagatcatttataatacactcaacctggtggaatagtattagaagcattagtaattacrttttagagacatggagaaaagctcatgattttaaactaactgaaaaaagcatgaaaaattgcatctggatgctgttgaggaattattgctaattttttgagatgagaaattgtattaaagtctttttcaaaaaagagtccttaacttttagagaygcacacaagtgtttatgggtgaaattaaataattcagtagagacattaagtgggaaatagaggaaatattgaccatgggttgctaatagttgaagccaggtgttgggtataaggaggttctcgctgcttttatttgaaaagttgctttttatttgaaaatttaataataaagagtttttaaatttgtatctgtattttaatataaatataaatgcacttaatataaatataaaatatgtataacatttagatagagaaaagctaaaagattactgtggttgattctaggaaactgcattgcagatagtttcatgggtttttttttcctttttcttccactttttgtaccatctatgggtttttgtttgttttttgttttttgggttttctttcttgtttgtgttttgttttttgagacggagttttgctcttgttgcctaagctggagtgcaatggcacagtctcggctcactgcaacctctgcctcctgggttcaagtgattctcctgcctcagcctcccaagtagctgggattataggcatgtaccaccgcccggctaattttgtatttttagtagaggcggggtttctccattaataaattcctggcacaaatttagtgttcaattttgatatatgttgttataaccattgtgaggatactcaggctcaggtttgtgtgggtggaaaacatggtcttcagaaagaaattatgagtgcaagacaggaggaaatccatcagaggccccagctgaggactgaccacggcttgttatttctcttgccttgcctctggcaatcacagcctcacagagcctgcaatccttgctttgtgagtttatagctcagtccagagaatggctaagaaagtttaggattctttcaacacccactccacaaaaaaaaaaaaaaaagaaaagaaaaaaaaattaatttttgaaatacttgaggtagaaaacttgaggcagaaaaaaattgagccaaaaaaaaggaaaattgaaccaygtgaaagcaggcaagaaagcttgcattgctcagggcatcccaggcccagagggcrctttggagggagctgggtttcctgagaggaggcagggtgggtgacggacctgtgctggagagccttgaggaccactgtgggttgggaatgggggcagtggattggggttcaaaaccsctgggaatgagaaatgggctcaggaaggctagggtggattctttcatcttcctctttgcttggctttattttcacaaaggaaggcagggcaggaaatagtctcagcccaacttcagtgtggttcttcttagtgctcaggcttacctggcacttgccacacctctgggatgggagcacctactatccatcagccacgtgccagtctccacaaagtctgctcctgaaccctgctcctcagctggccccacttcacagatggggacataggcagcttggctttggaatgaaggaatgaagtcaggaatgaagtcctggctctgcacttggtgactgtgcactgggcttgctaagtctgtttcctgcttttaaaatggagattgtccatcagcctttgaagccatgtaatgggtatgtgtcaactttctgcaaggattaaaggcatggtataggaagtcccaaacacactgcctgacccatctttgatgctcaagaaacgatatatgttgttgtcatgaggaaactgagcctcagaaagtttggatacctgaaaaacactgactactattgaatgaggttgtgaagaatccagagctgtaggggcaggaaagcaaagaacgtattagagctgacccagtcaggacgatcgtctatccccttcctcaccccaccccatyccaggaggaagyctgcccggccctaggcagctatggcacagtggcaatgtcaggtatggttctccctagccagagaccctagcctcaaaaaacctccttcttgggatccaggcatccaactgctcctccccagccccagcctctgacccagtatcctgagtccagagacgtttggaaccagcacctgtaatggaggagctgaacaaggaggggaacttctgctgctccacagcaggtcacggtcataggagggagtggaaccagaatggcagaatccagatcttggctgcctttcccaaggacttgttctgattcctagcagcacagcccaggcattccgagaagttgggctctctggcatcactcactctgcccagaagagccaggggaaagttggggcttctagctgaamcttgatcccacctgccctcttgaggggctcagaatctgctggctgcttcacaggtgggattctcacggcacgctggccacagctgatgcttcraccccctcatcttgtttggccaaagtgcagctttttagcttgtgagtaaggaagaaaagctgtatcatatgtctttaaacatcttcctagaccacctttgttttccccttaaagtgtgcttaaggagaaaatggaaagtctcttttcagtgtgttgtattttgtttattgcaaaatacaacacactgaaagaacaatgtctgggttagcaaagtattagatttaatttcccacattactaccatccaggctgagaaagagaaccccagaagcctctctcatgtcccttcctgaccacagcctcttcctctcccacaaagaaccacaagtctgacttctatggtgatcacttccttgcttttccctatagtttgactgaatctaaatatcatccctaaacaatatagcttagctttrcctatttttgatcttcatrtttggattcatactttttggtttggctcaagactaaacttttaaaatgcatccacgttgtaggagatgtacatgcacaaaaattttcacggcaacattgtccaaactagcaacaaactgaaagccacctatgtgtgcattagcagtagaaatggcaataaaycatggactagtcacacagtggaatcctacgcagcaaggagaattagcagtctacagccaaaccaacagcatgggtgagatgcttccagaaatactgagatgaatttagagataaaggcacaattggtccatatctacagggcacttaatccagtgcatctccactagacaaaatttgtatttccatgagcaagrgtcatttgcactgctatctgctataacctacggtgctgtaaaattagctcaggcaataaaagggggaggtagccccaaagagtatgccagaaaggactcccagtaatcttcagtgtgtgtctatttcaaagtctttcatcatttttccttgtagttacttagtgtggaatttcagacccctctctatgtccctcttctcccttttcagccttggctttctctgcatccttccccgaagccctgcactcagcctaaactgactttcctgaacactctgggagcatgtgggctcctcccaactccaccatcttcactgccttctgttcctatttccctctgcctggccttggccccaggaaaccttcctatgctcagaccctctgtgcctttgtcttcaaagcccacccactattcactgccacctccatcttggtcaacctggaagactttccccatccttaaaacatcagctcaaayggcagattttttttttttttttgtgatatcctcttgatcaccctcccccagtttttaaggagacagatatagaggttcaatccttgggcttcccatgacttttcttatattctgttactgagcaataataaacacttctaggaactgtatcttaaacacttttgcctctacagaatctagcacagtgcctagtattggtgaaatataattaacaaagtcttctttcaacacagagattctctccacaaaaggagtagagaaagaacagttttattatggaataagcagtaaaccaaaatatgcagagcattataggccatctactaagaggttgcaagaacagaaagaaatctcccccttttgtatagccaagtagatacaacctgttacatacatgttatcaaggcaaacaataactgttcctcaagtaagaggtcttgccagcaccgtttgccrtayatggttcactctaaatttacctggtaattagggtaaccacttgtgttagctaactggctctacccagaggaaaatcaaatttatctttaagacaaggggtaattttgcagcactgagcaaggctcttcagttaggctcataccttccsacagaaactargagatagaagcactatctcccttaggtttgtttacatttcaaagagatgacgcccaggtccttgggaaagactagcttagctcataaagctgacaaaaagcctatctagtttcaaaaggatttacacatgttcaaagagaggagaaagtatgtaaaagttttctaggtgggcacggtggctcacacctgtattcccagcactttgagaggctgaggcgggtggatcacctgaagtcaggaatttgagatcagcctggccaacatggtgaaaccttgtctctactaaaaatacaaaaattagctgggcatggtggtgggcgcctgtaatcccagctacttgggaggctgaggcaggagaatcacttgaacccaggaggtggaggtggcagtgagccaagatsgcaccattgcactccagcctgggcgatgagagtgaaactccatgtcaaaaaaaaaaaaagttttctaaagtaaatgctctgagaaaaaaacagaaggtgaggagatctctgtccttatttttaacaagaataattaaatgtttttatttttaatttctacttagactagaatatggtacagatgctcaaaaatattgacttaattaataattaaacaattaacaagtctatctctttcctaattattaaaaaaattatgaagtatttcccttcaaaatttcacagtttactttgacataaataaataaataccataaagtattttgaagaggaaagggaagggtggggcttcaaacacaaaataatggcaggttttgtaaaggggcaattcactaaacccaataggattctcctgttgctattttttttttttttttttttttttggtggtggttggagggaagggttgggtgtgcatttggcctgtgtgaaaaactggtgggtagacaatgccatgctgttctaratgggctcattgctataggaatagatagtcactgaatttacttgcataggggatggggtataaaatgkttccttatagctccttaacatggaattmagmacccctytccccatmagccttagctctctctgaatcccaagggatatgtgttataaaaatagctgccatcataaatgagaaaaccatcaggacctggtaaaacttggcttcccaaacagtcaggggtctgggcatggcagccgactgagaacctttctatctagtacaaggtaaacaagatttgccaagacttgatcaactgatccagctccctatctccaaacagaacctcatctgaatgctcacaggctgtgccccagaagtgtagaagtgtcatgttccctgggcaggctgctgggcagcctctctgttgacaatagaccacacttttgctgacctaggactcatgttgctctttaagactgcttccttggccaggcatgatggctcacacctgtaatcctggcactttgagaggcccaggcaggaggatctcttgaggccagatgttcaagaccagcctggtcaacatagtaagaccccatatctaccaaaaatagctgggcatggtggtgcacacctatactcccagctacttaggagactgaggtgggaggattgctacatcccaggagttcaaggctgtagtgagctatgatcatgccactgcactccagcctgggcaacagagcgagatcctgtctcaaacaaacagtttccttctgtttgattcttgctgaaaaattgagcatgccagagctagcaaggctcttagaggtggtctggtccaatgctttaatttcatacatcaagaaactgaagcagagcagagtgacctgcccagggtctctcagccattcatgctcagaaatgtatgggctcctgtgaaacatgtggctcttaaaagcactatcatatatttgaaggcagaaaataggctaaaccttcagccttcagacttttcctctccagagaaaatgaccccagtttcctcactatggttgctgggagctagattcctggggatctggcagtgtggaccacctagtggtggctagaggagcaaataatatcccgcattccattttccactcaccaatccctgaggggcagcctgctgggttatgagcccacagggggagaaccccaacgaattcagagatgcatcatggaccagtttctcttaaggggcctgggtctactattttcagttctacttcgagagaagtggcctgcaatatcctgcagatttcccctccagggagaaaagcattgtgcrgtgcaaggagcacaggctttgtggaaagaggcatctggggttgagatcctggctcttttgcttccttgaacaagttaaccaaatctctgggcctctgctggttaatttataccatggggatcatcatttctccagtggggttgtgaagagaatgtggtgggatcttgtgtgtggagcatgacacttagcaggcatccgggaatggcagcctcctccctttctaaactggggctttctgagggtgacttcagattccacaatgtcaacagcacaatggcatcctcataaggaaagtttgggttggggctcctcaagcaattctctactctcatttggtacaaagaaaaaaattaagcctcacaattttcttggcaccagactgaacctcaaacccagtcttcacttttactaaaaagccataaacagagaccaggagggtaaaaactaccagaagatacactggatttagaaaacagtaagctggatgtgaagccaaaagagagggagaaagcaacataaaagaatgtcagattgaagaagaaatggattctggccacctaaagaagaagggaagtatagaaaagggaagctgattggaaacaatgggtaatgatgagtgtccctcccctaaaaagttaaaaaataaatgagcaggcatgagaaaaggaagtaggccagaggaagtagaccaggatcagccacggatgtgagtggggaattttacaaatttctacttgggtgtgaaacatgtgtacactcaaagctctgtctaggttcaccgaaactctcccagctcaaggccatttagtaaaaccttggcttaactgaatagtgggtaaggaggcctgaggatggcccagagaaggtttaaattcttactggctgctgcactaagttgtaaagtgcagccttagttgatgatgcctttattagtgcaacatcccagaatgcatgcgtcttacaacccttgtggatatgaaacccagctgggtagacactgcaaagtcttctcatttgattcttccacttggtttctagtgtccctcagggacaaaggaaagccatggtccagtctaagatgaaaaccaattagacctctggcaggcctttgaccaccctgagggccacccccaaggcacggccacactcgcatctgctgccaggaggccctatcttaggctcmgctcccaaaccttgaacatcttggaggatccacaaataggaggtacactcagctcaggctcagtcttccttaaaaagygccttgctaaagctatcaagttcactggaatacttctgcgaaggacacagcttcagcgatgtcagattttttatgtaaatggtgccttcacatgctctggggcatttggctaccaagggcggtttgaactagctccagcacacagaatacaagtctcttcagaaccaggcaaaaccctatgttgcccaatgactcstgctgtttcttgagatttgcacagaagacagagctgcaattacccacgctgatatctatttcatgaccacatatgttcaaaagccacatgtgagaggtatggttgaaatgagaggttgtgtttgccaagttgtcttctgactgtggagagctggtgagcctcttctcatctcctgrggctccatattatagagctgacgaatctcttttcttgctccttgaagtctttcattcacttatttattaattcatttaacacatcaggcacctactaacttctcagagttcaaggcttcctagcctatgatcagaaaggacacctgtgtgctcatgagcacccctgggatcagggtgactgatagggtgctgtcatcactactagatgaaactctttggaacaaaggtctaggatataatatttatccttctgcaaatattcatatggcattcgctgtgtaccaggccttctgttgaacattggcctgcagagctgaagaggacgtgggtcttctcttaggaactcctagtcttgggaaaaaggaatggggaagggctgtaatgtgaagttaaaaaaaagtgctgaggccgaacacatctgggccctcactgcagccctattgcacacacactgcatcacctcgaacaagttattcaccctctctgaattcatctatttgcccataaaaatagagatgatccttttatatgttggctaccacttattatgtgcagcatgcttgttattgtactaagttactcattttttagtttttcatataactcatatttttgttgatttttattttaaaattccaaacgaattaattaaactattttccaaaatacgtagtatgtgtacatggtaaaaaacatttccaaaagtttaccataaaaactgtctcctttcccatatcctcaatccttcagaatccctctccagggataattaccaccaccagtgtattccttaagagatatttaaactttatacaaaatacgcacacatcattcttttccacaaatgacagcatactatgtacatggtacctcacctagcttttttcacttaccagwatatcttagagattgttgcatgacagaatatacagatctgcctgtttttgttgtttttcccaagtttccaagagctagaaactgtttggtttttaagcagctgcttggtattccattaattggacttatcgtgctttgatctgtccctagtgatggacattggggttgtttcccttcatttatatttgaagcttgttgcagtgacagtgtacacacttgcttgagcatgtgtgtgtctacgataaatcccaataagcaatttaaagtaatttaattcttatgctctcaacaaacctaagaggttatttttttagaggaggaagctaaggctgttgttttgatgcctttttaccactggacttgggactcaactgtttratagtcatygagtccttgactcttctcccctgccaggatttggcccctaagcccagggcccgagtctcctccatcttcaaggsagagtgggaacagcacaggccttggcctcagtcctgctccccctgcttctagctgtgggatgggccaggtgcttcacccagctgtgcctcctgtgaggcacagtgtgtgcaaaatggaaatgtgaacatgaagatcaaaaatgtccctcaatgaccagtgctgttcctcagagtcacgtgggaactcatagaaagcgatattggtactgctctttcctctgtagcatggtccagatggctcatagcagggaccatgatatgctgggtgagcacccactgcatgcacccactgtgccagcactgagagactcctgtgggagccacagcaattctagggtcttcactggggactctgagacagcagggagctaggatgagggctgcagagtgttcgtctgccctcactgagcagaccccctggatggcagggagcagtcccaagccagatggatgcccataaccagccatttggctctcaatacataatatcaccacgtatcaggcaaaaccatcctgcccagagcattatctgaatttgcatcccatctgcagaagatacattcacccacttcttccattctgtcttaatcaaagtctttatgtgaattttccccattgagaagacaagccccttcctggcttagactgtacctgactgatcttttcatgagctccttgccaagccagaccacccccagcttatatggagacttggtgcaaattagagatgcccctgtgcacgtggcagccctgagcccaagcacccagtaaggcaaagggcctgatttgggacccctctgccactccaccaggcaatcagttgcttatttctaactttcccttccttctccacatttgtcccattccttcctctcatcatgaatatccccagaggcattcagcagtgcagtgaattaaatatagaactttttttttttcagaattgcagaayggattagatcaatattaatccaaacagagcaatgagcctgacagtttagtaaaagctcaataaagggtggcttacctcccccaaaataatctgaaaagaaagcatgtcttatttcagggggaaaaaaaaataaagtgacctttaaagaccaaattcccaggatacccagggtggaggtggaacatgggagtccacaggcagcctggatgtttccaaagatccaaagggcttttgcttcctcacataatgcaggaaacaaattgaacatgtattaagtgcttgctgtatgtgacacactgtgccaggtgctccccttaaaacagttctgtgggcaggcatgagaatgaatcccgatcttacagrcaaggaatgttaggctcagaggtttcaagctcacccatcactcagccagagaggacagatgcaggattcaatctcgggagtgcccgagtccacagaagttcctgtgctgaaggaccgaccacaggcacataaagagatgcgagacaatttttactggatttggccacctctcgaggtcggctttgccagctcttctcactgggggaaggggagggagaaagtagctagctccagggtccctaacatagaaccaccaaggacttgactatttttactcatacagcagcttgtctgggaagatcatgctctgtgacaagctgcaggcactaagtagcaatttctgtttcccacatattagcttgagtcatataaaactgacatggatgtggctcaaaaatagctgtatgtcagccattttataccatttgacttaaatgttattaattaacgtcacagccagagattattctctgagaaaagggcattgtagcctgaagcagagaaagcatacacgttccctggggttgagaactcatcacagcctgagacagcttaggttgtaaagccccggcccacttatcccaggagagtctgggtgagatgcaggccccaaagcagaggctgggaagcgagaagtgacacaccctggctgggtgggccctcatcttggtgagacaccacctgggtaaaaccatcatggaaagggtgtagtggggcgtggaaactccctcggttaaagcgtgagctttgctgtaagttgtggtaaggagggaggcagtgacaaccaggaggcctgttttgagggtttctgagggacccatctgtggtatcacgaggagacscccagaggagccgtgtgaaagggctgcctcccagccggctctggagtgaatgagcagcaagtcctggctgcgaaaagaaggggagtgcagcctgcaraagtgtcttcttttttcaattcctgctcagaaggaaacaggagataagaatagtggggaagtccaaaccaaagtgaactatagggctggtaatcgtagggggaattagtcacccggagactagcccagcagactaacggagccccatcctccatcttgaatcagtcagcccctctatgactgcagagtcctgaatgatggcaacaccttctcttcacttagsgttgtaggatgaccaacagtcctgatttgcctgggactgaggggttcccaatagatgggactttcagggctaaaaccaggaaagtcctgggcagcccaaaacaaggtagtcactctagagtgtatgactctgtctgatacctgctaagaaagagaaggacttgttgattataaggagaagaggaggtgaaatggttctcaaaaaacaaagatgagggcttccgggtgctgttctgcccaaggctctgggtctgaggcttctctctccaggcctagcttcatggaaaagtaaggggccagagggtggaaaaggtggaaacaaaggaagaggatggagaattgctttggggaagtttggactggaagtgtgaattacagctgcacccccaattcaccccatctcacccccctccccctcctgctcatggttctccctttctcatccacacattggtcaaactagctagcttttggagagattttgggcagtaaaagtaaaacagatctgtctcaagcttcaaaaagcctaragctggctgggcgctgtggctcacgcctgtaatcctagcattttgggaggctgaggcggaaggataatctgaggtcaggagtttgagaccagcctggctaacatgatgaaaccccatctctactaaaaatacaaaaattagccaggcgtggtagtgcacgcctataatcccagctatttgggaggctgaggcaggagaatcgcttgaaccccaggggacagaggttgcagtgagctgagatcgcaccactgcactccagcctgggtgacacagcgagactccattwaaaaaaaaaaaaatgcctagagccaaatgctcacagagccatttactgcatggctttgggcaagtcaaaggagtccgcctctcctgtcagaagagtctgttgcagtcttcatcacaagactgttgtggggattaaacaagatggcaagtgggaagttgggaaatgtagtgtgcacccaaccaatatttgtttcttcctgcctgcctacatatgaggccacacagaattccaactttgtttctctgataactaacacagttacttgtttttctttctgatccaggccttcaccatggatcagttccctgaatcagtgacagaaaactttgagtacgatgatttggctgaggcctgttatattggggacatcgtggtctttgggactgtgttcctgtccatattctactccgtcatctttgccattggcctggtgggaaatttgttggtagtgtttgccctcaccaacagcaagaagcccaagagtgtcaccgacatttacctcctgaacctggccttgtctgatctgctgtttgtagccactttgcccttctggactcactatttgataaatgaaaagggcctccacaatgccatgtgcaaattcactaccgccttcttcttcatcggcttttttggaagcatattcttcatcaccgtcatcagcattgataggtacctggccatcgtcctggccgccaactccatgaacaaccggaccgtgcagcatggcrtcaccatcagcctaggcgtctgggcagcagccattttggtggcagcaccccagttcatgttcacaaagcagaaagaaaatgaatgccttggtgactaccccgaggtcctccaggaaatctggcccgtgctccgcaatgtggaaacaaattttcttggcttcctactccccctgctcattatgagttattgctacttcagartcatccagacgctgttytcctgcaagaaccacaagaaagccaaagccattaaactgatccttctggtggtcatcgtgtttttcctcttctggacaccctacaacrttatgattttcctggagacgcttaagctctatgacttctttcccagttgtgacatgaggaaggatctgaggctggccctcagtgtgactgagayggttgcatttagccattgttgcctgaatcctctcatctatgcatttgctggggagaagttcagaagatacctttaccacctgtatgggaaatgcctggctgtcctgtgtgggcgctcagtccacgttgatttctcctcatctgaatcacaaaggagcaggcatggaagtgttctgagcagcaattttacttaccacacgagtgatggagatgcaytgctccttctctgaagggaatcccaaagccttgtgtctacagagaacctggagttcctgaacctgatgctgactagtgaggaaagatttttgttgttatttcttacaggcacaaaatgatggacccaatgcacacaaaacaaccctagagtgttgttgagaaytgtgctcaaaatttgaagaatgaacaaattgaactctttgaatgacaaagagtagacatttctcttactgcaaatgtcatcagaactttttggtttgcagatgacaaaaattcaactcagactagtttagttaaatgagggtggtgaatattgttcatattgtggcacaagcaaaaggrtgtctgagccctcaaagtgaggggaaaccagggcctgagccaagctagaattccctctctctgactctcaaatcttttagtcattatagatcccccagactttacatgacacagctttatcaccagagagggactgacacccatgtttctctggccccaagggcaaaattcccagggaagtgctctgataggccaagtttgtatcaggtgcccatccctggaaggtgctgttatccatggggaagggatatataagatggaagcttccagtccaatctcatggagaagcagaaatacatatttccaagaagttggatgggtgggtactattctgattacacaaaacaaatgccacacatcacccttaccatgtgcctgatccagcytctcccctgattacaccagcctcgtcttcattaagccctcttccatcatgtccccaaacctgcaagggctccccactgcctactgcatcgagtcaaaactcaaatgcttggcttctcatacgtccaccatggggtcctaccaatagattccccattgcctcctccttcccaaaggactccacccatcctatcagcctgtctcttccatatgacctcatgcatctccacctgctcccaggccagtaagggaaatagaaaaaccctgcccccaaataagaagggatggattccaaccccaactccagtagcttgggacaaatcaagcttcagtttcctggtctgtagaagagggataaggtacctttcacatagagatcatcctttccagcatgaggaactagccaccaactcttgcaggtctcaacccttttgtctgcctcttagacttctgctttccacacctggcactgctgtgctgtgcccaagttgtggtgctgacaaagcttggaagagcctgcaggtgctgctgcgtggcatagcccagacacagaagaggctggttcttacgatggcacccagtgagcactcccaagtctacagagtgatagccttccgtaacccaactctcctggactgccttgaatatcccctcccagtcaccttgtggcaagcccctgcccatctgggaaaataccccatcattcatgctactgccaacctggggagccagggctatgggagcagcttttttttcccccctagaaacgtttggaacaatctaaaastttaaagctcgaaaacaattgtaataatgctaaagaaaaagtcatccaatctaaccacatcaatattgtcattcctgtattcacccgtccagaccttgttcacactctcacatgtttagagttgcaatcgtaatgtacagatggttttataatctgatttgttttcctcttaacgttagaccacaaatagtgctcgctttctatgtagtttggtaattatcattttagaagactctaccagactgtgtattcattgaagtcagatgtggtaactgttaaattgctgtgtatctgatagctctttggcagtctatatgtttgtataatgaatgagagaataagtcatgttccttcaagatcatgtaccccaatttacttgccattactcaattgataaacatttaacttgtttccaatgtttagcaaatacatattttatagaacttccatctgtgtaatcttctttctcctattcaattatttcctgtggttaaattcattgccatggggaaaactgagtcaaagggcatgggaacacattatctttgcatacacacatatgaaagtcatatattacacaacctttactgagtcgtattatatacaaaacatgaaygcagatccagagctattccaaagrcaatgagaccaagcctcttccctcaataatttaaatgcagaagagaagtgaaggaataatcacgctttgcattaggtggtagcagaggagtactacgtgacttctgacctgcgtctttaagggacaggggttctccaggtaaagaaagaggtggcattccaggctgaggaaacagcatgtataaaggaagtrtgtgagagccacaatgtgagaaaactctgtgcgaatattaaaaggcgttagargcggagtgggtggtaggaactttctgagctgagctgttagctgtgggctgagctaaaacaaccaatggagggggtgctggttctyctcagggtgtttacggggtttcttcgttattacctgatcctcattccaactgttgaaccataagacttttaattaaagtttaacctattcctggacttctaagaaggaggaaataattattttggcttgagaaataaaagaagagaaataaacactttcatttctagaagaaaattaaatttgtaacattaggaacctatatttattcattcattttgctgaataggacagaatagggagaaaataaggaagctcattgaaaaatccaaaatagcaaggatgttggtgtctaaataaaggaaggcatttttggaaaggacagctggccctcagagcacacctgaatcagacccactcctgcttctgaggtctgggcttcccaagagcagagggatctgcctgtgatgaatcccgacatattaactctctgcttcggcaggttgcttaacatctctgaggctcaatctcctcatcagaaaaataaagataaaagtagttcccacctggtagggttggagcagaggattcagtaagattacccctgcaaagatcacagtgcagaactggcaaagcaagctcgagtgaatggtggtgattatttttatacttattatttttaatattagactgagctttccccagcaactaaacacatgctatcttgtacttgccttttgcttttcttagtagcagaatcacagactcttgggtggttggagataactgggtccaaatccacatttcgtgggtaagaaaatggaggctcagagagggccagcaggtgccccaagatgccacagtgaattactgggagaggtagatccttgattcacagtctaccatctccttcctcatcttgataaaaatacagatcaatctgacctctaagagcagagaacacagaaggaaggtctgcaggcagataatgaggcagggaaaagcagcccacaagatagctgaagagtttaacagaatcaatctgcacatggacaggtgtgtgctgtgtggcacagcctttggcaattgccttttggagacatctgtatctgcaatgatagatggtgtcaactgagactcatcagcaaaggctgcagaattcccagaggcaaatgctatcagtggcttccaagaggatctgggtgggtgggtcaagacttagacagacaggccactgtggagggacagccacacccaggggctgcccagtgcttgggtaaaatgctgaatcccttccacataattccactcacttcatgcttattctatggtcatttaatgacattctaagagaatgtctccttcccagggaccttgccrtcaagaaagatggagcatataggctttcggttactaagaagagctatcaacccttgtaatccattgcacctagagtgtgtacagggtctcatggtttttccattcacctctctctgagatgctgtccctgagcatccagggagagagttcacccaacaactacacctgggagcataagagcctgattgagaggtccaccttgggtagtacccgggcccaagatgatgcccatttgtgccttcaaaattggagcagtttgtcctaactcagcagctaattttttctccacctgcaccgtactcactggcccatggggaccacttcagtttcaacatgatttgtaatattgtttgcttaacttgctgagttggcaacaaaattttgggctactcaaaagtagtgtgatctgagagcaagtgagaaaagcgagtcttagcaaatttagaaatatccagtttctcttcaatatactcttcatccacaggagggccaagggccaagtcgttttctgagggatgtgtggcatcrtgcttctatttccgttacattacagcagttgttaggcaacagggagtgttcctccagacacacccggggcagcgctggcaaccgcaaaacatgctcagcaggaagattactcttttactccatatttccttatttactgagatagaaacaaaaataacattttaatttgcatttctttgaatactaggtaagattgttcatttttcaaggcgtttgttttaaattatttgtacatttttctgattctaaaagaaagatactcaktatagaaaacatgaaaaatatacaatttaaaattaaaaatgtttaattacacaatattcaacctcccagagataactgtggtttaacactgaagttattttctgctatgaccatattttaaaaaaaatacataagaatagacatttttcaaaagaagacacacgaatggccaacaggtaagtggaaaaatgttcaacatttctaattattaggaaaatgcaaattaaaatcacaatgagatatatctcagatttgtcagaatggcttttatcaaaaagacaaaagataataaatgtcagcaagaacgtggcagaaggggaactgttgtgaactgttggtagaaatatgaattagtacaaccattatggacaacattttagaggtgtctccaaaactaaaaatagaattactatatgatccagcaataccacttctgagtatttacccaaaagatgtgaaatctgtttgttaaagagatgcctgcacccccatgttcattgcagcactattcacaatagccaagttatagaatcaacctaagtgtccatcaacagaggagtgaataagggaaatatggcatatatacacaatagaatacaattcagcctttaagaagaaggaaactctgttatctgcgacaacatggatggaattggagaacatgatgctaagtgaagtaagacaggcacagaaaggcaaatactgcatgttctcacttatgtgtggaatctaaagcaatgaaactcatagaagcagagtagaatggtggttacagatggtagggggtggggagagagcagagagctgatggtcagagggtacaaaatttcagctagataggaggaatatgttgcttttttctttttcggagttttattacacagtgtggtgaatctagttaagaatagagtattgcacatttcaaaattgctaagagagtaaatttcagatggtctcaccacaaaatatgttaagtatttgagatgatgagtatgttaattagcttgatttaattatttcacattgtattcataaatcataacagtgctttttaccccatagttctatataattataaattgtccatttacaattttaaaaactgaacaaaacctaaaagcacttgaatttcatcaataagaaaatggtccaataaatttcaatttagccatacaataaaatacagtataatttaaaagaatgagtcaattctataaatatgaccctaaagggatgtccataatatatccttaagtcaaaaagacaaatttcagagttaagcacatttttatttttaaatataaactatatatatatgtttatatatataaaataagcacatttttattttttaaaaatttgagatgagaacatatatacagttttatatcttcttttttcaattagcattatagtatgatcattttcccatctattatattcaaacatgattttgaatgattgcaaaggactcaataatagactttatccatccaagccctactgacagacatgggtgttactcccatgcttttctctatgaggagtgacagtatgatgaacataaatctttgcacatatctttgattgtatgaaaggaattagtagactaagagatttcagcatttgtaaatctcttgctagctactggaaatttacttttcagagagatgacactgtgttgctggctctctaagactcccaatccctgaccttagcaccacctaccttcctagtctttgaggtcaggatattgtgggcttttgttattgggtgacaaaccagctactgactttaagaggcagaaagaaaagacttcygttcttaaaaggagatggtaaggctgccctttagaagagagaaaagaagagggatgaggggatttttaaaacaggacccataacatcccaaaacagttattttaagggaacagagaccacttagcacctgggctaaggggacacaggacaagccatcagagccatacagcatcaggcaagagcaggaggtggagagacttgttctgaggataatggggtttcctagcaggagaagaagaaatagaggtgagcagagcaaccataaagcccttgtgcagtttcaatgttcaaaatatccacttctatacaaaacttaaacaacctgcaaaaggcaacagagagaactgattcaagatttagcacagttgattggactttcaacgtatccaccgtcattctggatatacttgtacatagccatctcagcataatgtagagctcwcacctgtaaaataaaagaaagaacaaaatcaaacattagcaactttatttaaatattttgtaaattatctctcggttgcatttcacaaattatctatacgttacatggaagtaaaatttattaaaagttcaaaccatagtgactttatgcatactttataccttgggctttgctggcagcagtgatgctccaatcagccagggaaatccatgagttccagctttaagaaccccttggcatatcccggtactcttgctttggggaggaggatgcccagctgccagactgggaaacctaatatcaaaaggctcatttacacttccagcactactatatgagtttccctttgaaagcgcattatttcactgaggaaatagaaccagaaaagaacttccatggcctaccccaaccacatcttcccatcttyctgcagctgtgccagtgcactctgcagtccctcctcgtatcatggaagaatcgtccctgcgcttatctaaagccaaacctgccacctgaacgatgcatcccagcccctttaaccttcccctcctgcatttatcccctctcctgcattatctgtctctcccctctgctggataattggtatgcaagcaggccagaatacttctcatttttaggagcctccccttgataccacatctcccccagctcctgtccatgcagaggcactcaaaagagttctctccagacagctccctatgagcttgccccatgtgtaacccttctatagcccgcaacccaatgtccctggcctgtctttccccttgaggtgagctcattcttgaattttcttctcaaccctcccccagacacactcttgtcaaagtcaccagcgttctctgtgttgctaaatcccatggtccataatcaggcctccccttacttgacccattagcagaattaggcaaagtttcttgaagcagcttytccattcagctttggagatgccactctctcggttctccaacaacttcactggatgctcctctgcagtctccttctctggttccttcttgcctccctaacctctgtgcatcaagggcttcaggctcagtctccagacttatctgctcctctttccttc

SEQ ID NO: 13240 - DNA, 43436 bp, Homo sapiens
tgttgggtttcctaaactctgctttcacctttgtccacattcactttgttaaacattcatccaataatccagtttaagcctgttgcatgcttcctgccaggacctggaccaataaagtaggaattcaacaagctaaggggatgccatgacatgaagtccagaatggttgagcataaagtgagctgaatatgggagacgtaaatgaaaaggagcttgaggccagatcctggaaggacacaaatgccatgtcaggatgtctagattttatctgtacctgtgtccagtgggaaacactggcagtttctgaatgggaaagtagactgaattaaagtccatccctcacttttggagaggtaattttgccataagaatgtaaaatgtattcaggggtaaaggatacccatggaggtrgaagaaygagttagaagacaaaaatatgcatatactctaactcagaaaattcatttctgggtatttctcacacataattaaaaacatgcacaaagatttaattgcaatgacagtcaccgaagtaccttttcaaaaattaaaaattatgaacaacccaaattttcactaacaagaaaataaatatttagcctttcaaaccaatgccgtagatgtggatttgttgacttggtaaaatttagtattatatggctgaatgaaaatagagcctaatataaatggccaataattccagtatatatatttgtttatgtggaaaaagcttaaatggatatatatttaattagtaataagcacattttttaatgagcatgtataatttgtgtaaacaaaagaaacattttgtaattgtcaaggttagaccttttgagggccttgattagcatgaaaacagtaggaactatgcaagtagataaaggatgtgagtgactgaatcacagtgccaactgagagaaacttgggagtttggatttagcacaatgcttcctatatcttgattaaggtgagtaagggtgttatcaatgactggggtaaggaaaaatgccctggagaccaacttggcaggccagatggtagaatccagttactgaatgcacacaaacaaacccattgtgacatccacagttctcaagtccttaagtgaaccacgtccacaaaagatatcaaggcattgccaatgaggaatgaaggcttagcctggcattggataataagtttttgaattggctaaaatatcaaataaaagataaattttttctacttcaaaaacttagcggcatagttatcatcattggactattggatctcaaattctattcttagatcgtgatattctaccttctcacttctgtcactctgtcttgtggtaggttcttccaacccacacaaaccaccagtatcttccaggtcttcctagttattcacatacctattcatatatgtatgaattgtctttctcatatgtatatttatgtgagatatggcaagatttctcttcaaacagcctgctcatcttcttattctctaattctaaattaccacccctctttcttctccttttcttctttctgattttactatatgcccaggcatgccacagccccagctcacatttatttccttatttgggaatggactggcgggcgctctagtcctctgtagatgaccccttcctcctcttccctctctcccatcataagcccaccttatctaagaaagtttaaatatttagccaatcgagtctagtttagattgtgcagtctgactccagccgatggggaaaggacacaggggcaggagtcatcttaggaataaaagcttctactctcctttgttcggtgtgctctcgtggcaatcagccctacgagaagcacccttctgcacygaagtaaatttgctttgctaaaaaatcctttgtttgctcacttttctttaagactccgagytttatttctaacaatttacatatctctagatgcatatatatctatatacatactaataggtaacatctatgaagtgctcactctgcttgtcaaacactrttccaagcactttacatgcattattccttatcatcctcactacaacccagtgatgtagttgcaggtattatttccattttacagattaggaaactgaggggttagaaggctacataatttgcccaagaccgtagaaggagtacaggtagaggtggattccaggctttgtctgactctgctctcttaataaccacaatcacatcttaataaagcatctagaaggtatgtaccaaattgttaaataattaccaaatgaagttggggttacagggcaacctgaacttcctatttttttctgttttgtttagatgtctagcaatatcaatattacatcttaactggaaaaatgttttcaaattaccatcgattatgtcattttcttatgacataattgatcatgttgtgatgtactactattgccatgtgctagactttgtactggatgcaagaataaaaatgatgtggttcctgtcctcaaggtgctcactgtccaaactctattacattatccagaggacttttttagtaaccccagccctcctttcattcttatcttctggtttgtcctatccatatgcctaatgctcttgacatgatggagaacttgacattcctaagatgtattattcacttctaggcccctgagcctttgctcatgaatttccatattctgtagaatgagtaggagttcatctggaagaactcctactcatgcttgaaagctactgccatggtgaagtcttttcacaaagttctaatcttgaaaagttttaaatatgtatttcatacaatcatgagcatagttcaaataagtagcactgaagtayaaaaaagaaaagcaagagtccccacctcagcccaccccaaccccaacgtcaacctcagtctcaatctcattgccattctccaaattcttaatggtttctgcttttagatttctggtggtgatctccatgtttccaaaataacatgctatcttattatttcctggtatatcatcttaggccctatgtacctaatttttcctaagagaaatgaagatttaactcacatacacactggtcttacctcctccctgacctcctaatagagatacgtctctatattcagccctgcattgctctctcctctgtacacccagaccatttygtcctgtcaactacagacagtatcttttgactgtcacttcctaaaatgagaaccttagtaccccacccttcwctccaccttactcctgctcctacccctttttacctattgacgtttaccctgtgcattaaaaaaattaatcatatttacattatcttttagagtcatagttattctttgacttgcctataaggtgaatctaaaagcagaaaaccaatatgcagcatttctgcgactatgtgaatattgttccctgtaatctagtggagggcttgaytatgcttcctgctctgggtcatttggagaacattcagatttcagatttaaatgggatctcctgtttgagacaccactaatagctcaaaatcaatccattttaggtacatcacacttgcgtcaggcctttcctggacattttctcccttgaagatcctagttttaatttcaactttatattttagatggaaataatttaaccataattttttttctttgcattctgtcaccttctaacaacctcgagggcttccaagttcctagtcatgctttcaattgtattgaaccctatttttccctccagacttcctactgcaatcaggatgggttgcttcctagcctccacactgctgccattctgggacctctcctgcttatctcggttggagccacttttctttgggtcccagacagtgaggtgtccttgactcccacatctttctcaggataattaaataactcaccttgctgaactcccacagtcctctgtatttgcctaatagggtagcactttttgttgttatttccttatcctccagggaaggactgtgtcttattcatccttgaaatggtacctgacatacagctggccctcacctcagtaaacactattcaaatttaaaaaaaaacgttgagcgcatggcaaggcacagtggctcacacctgtaaccctggcactttgagaggctgaggcaggaagatcgcttgagcctaggagttcaagaccaacctgggcaacatagtgagacactgtctctacaaaaaataaaaataaaaaatttagccaggtgtggtgatatgtgtctgtgatcctagctacttgggaagctgaggtaggaggattgcttgagcctgggaggtaaaggcggcagtgagctgtgatcatgccactgcacttcagcctgagtgacagagtgagaccatatctccagaaaagaaaaaaaaaagaaagaaagaaaagaaaagaaaaagaaattgagcacattattacaatttaatatcttgattgaagggaagaggtgagacatcagtttcattcatattaaagaggaaataggtactgttatgtcaatgggaaatgagaggaggaattaaatgtaggaaacagaataacaaagaaccaactcataaaaaactaaaacaacccatatcagacacaccttataatctgtatgtctgtgttgacttatcctcttggaatgtgaggaatattctttattaattttacttactgggttgccagatataatacaggaagcccagttaaatctgaatttcagataaacaacaaataactttttagtatatgtcccaaatattgcatggggcatatttatactaaaaaactatttattgtttatctgacattcaaatttcaccagatgttctgcatttttatttgctaaatctgggcactcttcactgggcatcttctcagggcactaacctgccaaatgccaactgctgtggggctgctcagagaatatgacctaatgacaatggragatgacatgttgctggcaatgaragaagtgaataaaatgttgcatacttgttttcaggagctgttctcaaagcttaccacctttttagtgtgggattaggtcttcaacttcaactttgtcttcacctttgtcttaaggtcaaaagaagayrttagagatgtctttggtagggcataatgtatccttttagattgatatttgtgggccatttgttttacagggggttagtccaggaagtacaagacaatgtcattaggcggatagagttccatttaaattaaaaataaaatctattgttaggtttaaatgagtcactgcttcattaagctatcaatattagataacacatattgaatgaatgtttcccataggccaagctctgtcccaagcatttcacatgtatttgcatttcgtgctcacaaactgcctctgactgactgattttgattttcttgattttatggatgaggagaccgagaagcagagatgatgaacttccccaaggtcacaccactcataartgggagaaacaagctaaaattcaggccatcttactgcagaatactcaaaatcaaaataagcaaaatttcatctccagttctggcacctcaccaaaaaccaaaacacgatttaaaaatataaaattttaataacaccacacataaatttcaaactactttccctaagtttctagctgaagttttaaatgagtgtgtttttaatttattagaaagtggattgaagagaaaacattggaagatgaaggaaggcgtttcagttaaaccccaaataactctgtgttacactgagctatgaaacggctccttctagctccatttctcctcagacctaagtgctattcctgattgtccttcattgtcatttccagggagaaatgacaccagcacagtggcaggccttccaatctggagcacggtccacacaacttscgaattggtgttcagtgtaaagtgtaycggagtgcggaaaatgcgcagggcattgccaactatagatgctcggagtaattcagtgtattcagagaacacggtgaaacaaggaaaaccggcctgactggggggtgaattcagcagggagtaaatctgatcggcatcaggtctgcggaaaggagctggtgagcacgacaccacccaggcattgcctggctctstccgcggcgggctaagttaaccgcgggtccaggtgcgggccatggtcttggggagggtgctgggtgcgctcgagcaggctagcgtcgggagccgcckctgctagtgagaggccggggccacacacgctmctcyccggtacctcctccagcwtcaccaggggaggagagggtcggggccacaaggccgcgctaggcggacccaggacacagcccgcgcgcagcccacccgcccgccgcctgccagagctgctcggcccgcagccagggggacagcggctggtcggaggctcgcagtgctgtcggcgagaagcagtcgggtttggagcgcttgggtcgcgttggtgcgcggtggaacgcgcccagggaccccagttcccgcgagcagctccgcgccgcgcctgagtgaggaggggccccgggggcgaggcgggagtgggaggaagggcacggtcgccgcgctggaggtcgggaccccggagcggcgaccggccggggtgggctcgctgagycgcacccgctctgctggccggtcctgggctcacagtccctgcagccctcggaaacagcgctaggatccttgcggggagagggagaggatgacggtattagacaccagttcttccaaaccttttcccgaaaggaagcaaccctaagagctcagagctggggggagaatcaggacaggcagggaacacatggagttttcttttcttttttytctctctctctctctttctttcgttccttctttctttcttttgaggcggagtctcattttgtcgccaggctggagtgcagaggcgcgatctcgactcactgcaacctctgtctcccgggttcaagcaattctcctgcctcaacttcccgagtagctgggactgctggcgtgccgtatcacgctcggctaatttttttgaatttttagtagagacggggtttcgctgtgttcgccacaatggtctcgatctccygacctcgtgattcgcccgcctccgcctcccaaaatgctgggattacaggcakgagccaccgcgcccgccccggagttttcttatctgtagatctcctacagggacaatctctctctccgtctctctctctctctctctctctctctctctctctctcwcacacacacacacacacaccactacacacctctcactctgcctcctctctctctctccctccgctctctctctcacacacccttctccctctctccctctctctcactctccctttgaggagtattgcgtttttggagcccagttatgcgtggctgctgtaagaacaaaacaaagcactctttgtcctacctggagcatccccctgccggccagataagatcacagctgtgtcaccaagtcaagggagaggctcatttttaaaaaattaagcaaaatcagaaaacagagaacactgtcttcctcatcatctcctggagcttgtaagagaaatttctgtcaccaaaaacgaaaagttcgggcttttattcatgcctgtggttcttgggattactgcagtggtgatgaggaaggagaggtgcgtatrgctcataaatggcagcttgccacctttaaaaggcacacggattcagatttgggatgtgttaacaaatcaggcttgcacaaattacttttgatccaaatgagaatgctgagctgggagactggtatatgggtaggagctggaaaatgtatcccctgaggtgttggcaatcccaagaggctcagcacgaaaccttgagcttacattgaattcagagatctgagcattaagcactggcctgatcaagaagaagcagatggccttctggtcacgaggcactggtgagcctccatcacccaggcagattccctcacagaggaattctgctggccctgcagaaagtggtgagacagcgcaccaccttggcattttccagcaggcctacttcagctccttgcacttgggcactgaaagtgctttcccctccccagatatttgtgcaccagaagctgctgctggccatgtggtgatgtctcaatgtctttcttcattgaactgggcccttcatacccaaggctggcaccatagtctgtgactgcctactgtacagccagcaagactgaaggagttgcagcattaggagtgttgtgaatctggttcagccactcattttacagttgagaaatcccttctgaggtgtggaagggcttgcttagcaccgcaggacttttccctcagacagaacctgggacagctggktcctcatttcctctccattgtgtctctgtcccctttgcacttttgttgtgaggaacatacatgggcctaaacacattccctcactctcacctttgcacatgaatatgacttaccacactctttgaagctctgtcagcacagaacattaagaaaagtgctaactgggtacctgagcagctggagtgggagcccctgggaaagtcagtttaggagtcccctttatcttccttttcctgatacccaagaagatggctatttcctggaaaggaaggtggatattggattatttacactctgattcctcttaagcctaattttttttcaagattcrtgataataagcctgactgacgtctcaagatgttgagaaatttccataaaataaaagcattgaagagaaagtactgagtgaagggaaattgaagagaaacattcagttctaaaattgtattgtttcagaatatgattctgggttcttactgactttcttcatgacgccagccacctgttagacacattatgtgccctcactgtcattttgctcaattttatgggcgtgactcaacactaacagaaacaggctaatacatacaaacatgtaggtttttggtttttaaagaaacttagcagttgaggagaaataaaaagtctattgtaagagtagatgctcattgaattaagtgggctagttgattcctagtagaacttgtattcattcattcattcacttcaaaaaatatttattgatcagatcctaagtgccaggtactgagtacagcacagttagtaagatagatatgctctctgctctcacagtgctcacattctagaattgagggatgaacagggtgaattcatataatgagaagaaaagcaagcagattgctgcagtatagtggtgtgtgtgtgtgtgtgtgtgtgtgtgtgtatgtgtgtgttggatatatgggaggggcctagcttcttggattggattgtgaggagagacttctctgcaagaaggcctggagatgaaacctcaggaagatgggcagacgtccctgcagagggaaccacaagcacaaatgtcctgctcctgggaacaggtgtgatgtgttggaggcacagttggaatgccagtgtggctggagttaggtgagggagaaggagagttggaggagtgagctttaggggcaggagccaggtcaggaagaccctcataggccaagggaaacatttggattttactctttacaatgagagaagccaaaagagagtttgaagcagagatgtgacataattgatttactttataragagatgactctgggtgctatgtggagaatggattacaggggaaggagaggggacagaagaaggccagaagcgagtttactgatggggggtggtagcagtagatgggcgtaggctattttttggagttacagtgggaagttaatgtttctctgtctcgaatttcccatctacaaaatgggaatgagattgctatacctggtccacttgtaaaaactaataaacaaatgaatatgccctgaagcataatgtaagacattattaccattattatttgctcatattgtattactttgaattccctgtgctttatcttaaaatttattttaataaatttgatgtcttattatattattttcagtaaacctaatttattatacataaaagtatctttctctgttcggagaactggaaactcttaactaagagttaccaataaaaacaagtcrtcacaaaatgcagggaaattattgctaaaataatagctggcttaatttcaaaagttgaatatggtcagataaaaattcaaaaatagaataattaaagctgggaatgggaaaaaaatattttggacagatttgcctttgtcctggctgtggtcatgcagatatctgtgagtgcaaagatttgtagataactgaaaatatctatatggcagcagaatttctggagaagtctgtggaccagagttgggtagggttgtttcccttagtgaagcattctctctcagaggaagctcttgaattttctctcgtttatcactaagttttagagtgtcaggaagttttaaagttgtttaccaactaggatagtgacgttcttcgcagagacaggacaagtaactgccacaataaggcaactctatttctctttcctgactcactctgatgtgcaagttactagaaggagatatgcctgcttagaggaaaaaaagctcttcctcatttgtattgtgggcagcagaaatgtcagctcgtgacttaatagtccctaggtcatgttaacttgccagatccccttaattatttattggtcagtgtgtctgaatttcagcttgaagtggctagtctggtgattcaaattgcagacaaaatgtgatagtaattctgggatctgtatgatttatctcttgccatatcaaccaccatatttttcttagggctggagagtgggggtgtttgggtatcttaaagggagaggttacatctctccttgaagccagaaatctatttgtttcactcacgttttgaaaggttgaattagttgctcctttaaaaatcagtggatattacatacaaatgtaattttccagtttttcttggaagcaatcagatgatctagtgacatggagctgccattcctacatggaagcaattaactggaatagagtggtagttgccttctttggatggtccagtttgcaccatccaaatagaataaggacagttcacgccagtccttattctattgcatgaacctgtttgattcatttaaattacctgtctggcccttgtagacttttgatttttaacttcaggtttagggcaatcaagtgtaacctgtctgttatactttcaccttcatgtaatgcaggaatctatattccagtatccctgctggtagtccccaaacctgtactttaactgctcctctgataaagaagataatgctaattgttgaaaagctactgttgatggagctgtacagtctgggcctacatagaacatgtttaggaactttgcacaggactgtggctgtcacatgcaacctaggttttccacattaaaagtaaacattcctcattccttcaacagctcctcatgtgacttgctgccttgttccctcatcattctggttatttttgggttactgtcccttgtcctgaacctttatttgttaaaatccttaaatccccaccaattcaataagatgtggtctaactggtgcagaatgcagtgggagggtggcctccctttctctatgatgtcatacttttgtcatgcaactgaagatgtctttagatttttcctggcctatccattgtgtttttaaatttactttcagggcttattttccagttagattgttcctgagagtttacaggagaactgctcaatgtacagcttgagagcaatggttttcagctgaggatgatttatgcccccactccaggggacatctggcaatgtctggagacgtaatatttagttgccacaactggggtgtgctattggcatctagtgggtagaggccagggatgttgctaaacaccctgcaatgcacaggacagcccccacagccaagacttatcagcccctagtgtcagcagtgctgagcttaagaattcctactttagggtcmgggtctaggttcagatcctggtttagctacttcctatccttgtgaacttgggcacgttatttaacctctttgtcttcattatctcaactgtatgtcaaagaactctgaggactaaatgagttcatttatatgaaatgcttagaagggtaactgtatgtacaaacactatcttatttttctaccatattttattcattttggtgtgtacatatgacatcagataagtgggtgggtaaagtttgagggatagcacttcatttctaatcttgcctatgggatgggcactagtgcatttggatgttttagggagctaacagcttttctcagaaatgccttctctctatggtccccattatcatttttccggcttcttttagtattttcctccatattggggcatatatgtcagtttaatactgcatcctcctggagaatatggacactgagttcctttagcgggagagcatctgtgcctgttgcttgtacatcccatttccggtgtgccccaggctcctccacaccccagtcaccgtggcttrcacctgcacaacagattcctggggctgtgtagcaattggtagactttggataataataatagcatttctccaagggctcacatccccataagaaccccattatcagggttcctctttgacagatgaggagagaaaagcagaaagtaggtaagaacttaactgaagtcaccaaactagtaagtagcagattcaagattcaaaccttggcagccagaaactggagctaaatttctaaaccactttattaytctgatacaggtaagttttctcaagaagtatacccatgaccttaacctaaccatcatgtagccatttatgcatacaacactcaacmgatccagttactcttactcttactattgtgagtaatatagttgggggactgagtctgagagtaagatcaggaacttacagtatagcagcaggctgcccattgatcttagacaacttttaccttttatgacctttaagccatatagaacaccaaacatttggacawttgcacatgggatgcagattaattcccatttccaaaattgtgagtagaatcaactaattatatgttacttgcaggttttgcatctcatgcatctgcctccctagaatgaaataaatatttcttccttattaaacaaggatagagttgccccagcattttcttagaccagggtttctcaacctcagcattattgacattttgagattcctctatgttgtagggctgtcctgtgcactacaggatgcttaacagcatccctgactgctactcactagatgccagtagcagccccctcctggttgtggcaaccaaaaatatctccagacattaataagtgtcttcttgggggscaaaaatgccttagttgagagacactgctgtagagtgatgttctagctgcattctccagccttcatcctattgtaaaatayccaaagaagattttatcttcttcagcaatcatttggtgtggtaatgggtcagttttgaggtatttaagccactttctttgactttagttgaaactgaattgggctattatttgctttttgtctcattcagttactttatatgctccatattagttttctattgctgctgtaaaaattttctacaaatttagtcacttaaagcaacataatttattatctcatggttctgaaagtcagaagtctgacatggccttactaggctaaaataacaggttcagtgaaccttcagaggtcagctagtctgtgttgctttcctgaggctctagagagaatctgtctccttacctttccaagattctagaggccatccacatgttatagctcatgcccgcttccttcattttcaaaaccagccatggtgggttgagttctcacatcacatcattcagatctcttcttctgccatcctcttatacttttaaggactcttgtgattacattgggtcagataatccatgataatctccctattttaaggtcaactgattaacattaattccatttgcatcttaattcttttttgccatggaacattacatattcacatgttctggggtttagaatatggacatttgggtgggagtgcattattcaacctgccacatgcccccattccaaaggtcaatcaggaagaatttggaaagagagtactgatacttaacaaatgagcattttcttttctgactctttactaataacacaagagctaaggcccacctgccctaatctcttgccaggactgggttttacttggatggtttatctgtcagcttttcacagagatttcaaactcgagattggacattttatctattgttttgggttgtcttttgtttcgaaaagggaaatgatgcctgatgagaatttaacagtgacaaataggggaaatcgggatttgtggcagttatggttgtgtatggagactacaactgagatctgaagaacaggtagggcactgtggtttcagtgggagaaatgaagtctgcaggagagaggcagaaaggtagaatccgtttaaatggaatgtattatctgagtgctcattgaaagtcttcttgattgccaggatgatattttatctagtggtcaaggggccaaattgaagatagttattttcaggccttactatttgaagaaaatcattgatttttaaagtgaacattcccattgatttagaatgttggtggctcatgcctgtaatcccagcactttgagaggtagaggtgagcggatcacatgaggtcaggagttcataagcagcctggccaacatggagaaaccttgtctctactaaaaatacaaaaattagccaggcattatggtgggtgcctgtaatcccagctactcagaaggctgaggcaggagaatcacttgaacctggaaggcggaggttgcagtgagctgaggtggtgctattgcattcctaggtgacagagtgagactccatctccaaaaaaaaaaagtttgtgtttttgtattgaccagtgattggggttatggtaatagattttcatacaatatgatgatgaagacggctgtatcaagggttttagtgtagtcctgttggattctctagttctaagagaatgtctaaagttaccattaagtttttcagggtcctagttcttaaatataaatacatttctagctaactcatatcccatggttgagaaaaaggcacttatctgtgtaaagagaactttaaaagttaaaagacttcttatgaattattcctgtgtgttcatattcagaagcctctgtggtcattgtgattattacatgttaatatggttcctggctcataactcccgttgcccttgctacagtctttggttataatattggagtgctttagaccccagaagcaggtctcagaaagcagaatctttctctctgaccttttcctgccttcctttcacctgcccaaggcaggactctaatctgattgtaggttataagacccttattcagggaagggtcctcttaccttggaaaaaggaatgctgcacagacagaccaagaagaatctgaatagacagggcttgctgggttgcccctctgagtctattagcattagagcttacccttactgtccagtcatatttctacacagctgttcatactttgttgaacctatgcataaaaatagacagtttcccctgtatctttgggtcttcattctgaaggctccttgtgaatacacattaaataaataatctgccttttacaagttgatttttcagtgacccttcagaggtccaaggggaatgccacccgtggcccccttggccccttcagtgtgcatgtattcgagcctagaaatgcctctggaaaaaaatctgttagcaagtcattatttgcgaagagataactcaatttacctttttctgttatgtttggatttttgaaatcatgtattaactttataatataaytaaatrtaatactgaaataagatcaaataaaatcaaccaaaattataaataatcttaaagagttgcacatatataccttttttttctgatcaaaagaaagatgttgaataaggaaatacagtccctctgcaagtagtttaagaagttttggctggacacggcggctgatgactgtaatcccagcactttgggaggccaaggwgggcagatcatgaggtcaggagatcaagaccatcctggccaacatggtgaaaccccatctctactaaaaatacaaaaattagccgggcatggaggtgggcacctatagtcccagctactcgagaggctgaggcaggagaattgcctgaacccaggaggcagaggttgcaatgagccgagatcacactactgcattccagcctgggtgacagagtaaaactctgtcaaagaaaaaaaaaaatttagagctccagcaacacatttaccagctgcctatctgggtctttctagcctgtacaataggagctgcccttacacgaaagccccatctctttgaaatctttctgtctacattcctgttgctctcagaacttgtaccatatcatctaagaattataaaatgcccctgtaatttgctttcttcctgtattatattgttaatatatgctagtcttgtctctgaaacacaattgtaaactctctgagagtagggattgtgtcaaattctctggtacttaccacagttgttgccataggagagggcatatagtatttgcttaagaaataccctttgattgaatgactgcagatctgataatcaggataggccatgctgtgctccattaaggcaataacagcttcacctggaaatttcagtggcttaacacagcaaaggtttatttcccatttgtgaaaggtcatttgaattggcaggggctcttctctgttcagtgactaggtatccaggcgtctttcacttcaagactgcactacatcagcacatgatttctaagtttgctgtgtcagggaaaggaaggcatgaaggagatacagtgactctgttgcagacgacttctgttcaaatttttgtttctcaggaattagccccatgggcccagcccaaccacaggggcggctaagaaatgtagggaagcacatagatgttcaggagcactcattgtctgtgccacacatctatattacatcttcccgcaaaatagctatactaacgagtgcttcattagtgtcagtgggacaccggatcattaaacttggctcggtttgtattagtaaccagatgtgctagatttattcactcagcaggcatttactgagtgcctstgtacaccaggcactattctaggtcttgggaatacagcagggggaaaaaccatcaaaaatccttacactcacagaactaagtttttagtggaaggtgataaacaactaacaaataacatacaaggtacgttagttggtgataaatattggagaaaaataaagtagggagggaaatagggaatgtattggtgtgaagaaggaggttagattgcaattttaaatagattgaaccgggaaagtgtcactgagaaagtatcactggagcaaaaacccggaggtgagaggaccagtcatttgggtgtcagagcaaagagcattcccataaaagggaacacattcaaagccctcaaagtggggatggaaggtgggtgtggagtacttggcatgtttggtgaatggcaaagaagcaagtgtgattgcagcaggtgtccaagaggggctaggggaaggattgggagtgtgttgagtaaaggttatgtagatcattataagctattttgggtgaatggcttctcccccgtaacatataacaccatttgggggttttgtgcagaagggtgacacaatcactctggctgctgtgttggggatagattttagggtcaagggcaaaagcagggagactcgttagaggtgatggcaaattttaggtaagagatgatggtggcttggaccttttctatcccccacaaaagttgaagggccaaattttaggggggaaaatggatgcacaaatgcaagatagtttttgctaataagatgttagcatacagactaattataatttattattaccacacatctcatattctcttgtttcatttactgattcaacaagcatctatgcaatactacttcttccaggccctctattaggcactgagacaacaaataagacctgacttctgctttttggaaacttatatcatagtaggattatagaaattagcaagaatataacatcatattaacaccmaaaacaaccacagcagcagaaatatagtcactatataattaaatgatggaaatagccaaaatttatgaattatttactatgtgctagacatacctatggatattattatratgatgacagatggttgttatatttgttatattttgttggctatttttatagctgaccatactgttataaagttagaaaactagtgaccaaaaacttaatctaactgtctgaaagtattatttctctgctctacaatccaatgtaatccttagtaatgtaggtaatggtaatcctacattaccaaggattttaccattgtagtaccaatctaaaacccagcacagaaaatacatgttttattttttccaagtgttactagtacctcagcctttcttgatttgtcagcttatttaaggcctcttcattgcatacttcttttttcttttaatcatctgcttcgaaggagactaagctgaaactgctgctyagctcccaagatggtgccacccaaattgcatgtgcttttctgcctstgcggctgcctggctgtggtttatccttttgactggcaatacataaatcctgttgcccatatgaaatcatcaggtaagaggtgtatttgttcaaggtcttgagcaactgatctgtcgccatacttcaagtgggccccaagaagttgcacatctgcacatctaaacaagtcctatttaaaggcttatggagatcctgtattctcctggagtaggggagaggttctcactttttcctcatttcaactgaaattgaagaagcacttgtgttcttcagtatcaggactgcaggacagaaccaggatgggacattttaagatatactggacgctcagcttgcaatcaccacggagaacctccttaatgccaccccttctctctctgactgccctaacgcatgcccacacaagcatagtaatgcaactggtctggagtccactccaagacagcctcaaaacctgcttccatgaggtgaaaaagaagcaggtgtcttgttcaacaggcatactcctggttaatagtggaaagtcatgtgagataacaatttcagktcttgggatccaaaaggaaacaatctttcctacctgataatagagagaagtagggacaagtaggtgctagggagttccagatgagaatggatgtgatcactcattctttcttgccttgtggtaagtggggaaagaaagaggtggaaggcatagactaacccaggaggagtggccaaaacgggacagccatctttagayggctacatttaatgtcactaagagagaccttaattggaaaaagattgtttctggagctttgcaaattcctgctcatcccagaggrttgtgatgcataaacttctctttccagtctcctatggagagcagtgtaggtggcttctgaatggtgtcatactgactatacctacagagctgtgcacctggatagttgtgggtcactctggatctaattgttcaagcttgatgggtgactccttacgatagcatttgcaaaagagctttcataattcagtaccttaaattttgccctactacataagcaggaaaatgaatgcrttaggagaggttttatatcttatatctacatttgcataggaaatagaataatatctcacaggtccattcatcctataacgcatcaggaagttaagtcatcaaggatacactggtgactaagacaataaatgtgtagtcaaattcaagggtcctgcatcctagatgacattaagttcatttttcctactacctttttcatggattgagaacaggtaatatcttagatggtgggaaaatcatcattcgggaaacatttatatccttcacttttaattggtacagggtaaaaatttaaacatttttaaaatccctttgtctttaaaaataattggaaggctgttgctggactgacagaaacttgaggacagggacgttgctttatctttatagtcccagcattgagcccaatgcaatgcccattctaaatgttcaaaaatgaatgcaggccgggcatggtggctcgtgcctgtaatctgagcactttgggaggccgaggtgggtggatcacttgaggtcaggagttcgagaccagcctggccaacatggtgaaaccccgtctatattaaaaaaaaaaatacataaaattagctgggtgtggtggtgcacacctgtagtcctagctacttgggagactgaggcaggagaattgcttgaacccagaagaaggaggttgcagtaagctgagattgcaccactgcactccagcctgggctacagagcgagactctgtctcaaaacaaacaaaaaaagaatgcatatatattggtttaaagtattagaaacagtttattaaataagaytaaaataataggtgattctttataatttcttactaaatgaatacacagaaaatatggctatgcaggttaaaaggtttgtaggaatgggctagagatatcctctttactaatggaggacataaagccatataagagtgtaattgtcctagcatgtatacagttcatctccaaacccaagactgaacatcaggaatatttgacaaatgaaaaccaccaaaaatatgtaataaaattaatagcatgccataggttccaatcctcctattaaaataaagttgaagaaaactaagaagagacatttataaattctgaaccacaaaactgtgtgagtggtcatttgatctgatgagtctcctccttccacttccttaatgatgactcctgacagatggttagagaatgggaaatccaggcccataaccgggtcagctgtaggctatggagcctgttccacagccacccccaggcaccctggcactggtgcataggaccccatagacctataccaaaacctggatcagcctgatgattcctgaggtcttctcagaggtcaggtgtcctggaacaggcagacctcaccttgacctgaatgctcctgaatgctgagtgaggaaacttcccagggagaacaggtgttggacaaccagggcactcctaacttattggaaaatgttcccctgtcctttggaattgagatctcacaagcggaggcttgtgttgggtgaaaccctcccatgcctccagaactgagcctccaattctagaggtagtgtctccaacagcagctgtggccctggrgctccttagcragttgtgtgagccagaggtctccctgcagcaagccctgcacaggcacaccatgcctgcctaggggtggggttgcagtagcaccaggctgcttaccacagaagaagaagcaggtgtccctaccttaaggwcctcctccttgggacttcacatctccctgttacaccagaagcatggctcagtagatactcttttaatggaagaagagccttttgtaattcaaaatagaccctgaaagttcaccttgcaggtaaagtttaaaaaaaaagtttctggggtttgaatctacctggggagaggttagacctgctaaaacttccctaaggactcagcacagatttacctagcaagagtaaatggactctggggaaggagtaaacagcattatttgtctaccccttatgtgtcatgttttgtactaagaacttgacctacattctcacctcatctttacaactgtactgtgggctggtcaagtgcttttatgtcattttacgaatgtrgatcagagaggggagcaactaggccagaggattatagcttgtaagaggtacacctgaaatctgaaatagaaccatgtccctccaattcacagggtttgttcatctccatcccctctccccttgcctttcttgaaactacctcctaccatttgaccatggattgctgacctgtgtgtcaggcaggtggtctggaacttcagcccagtgtctcttaaactttaatgggcactccttttctgattgagtggaattgtggtgaagtccaggagcctgcatttccaagctccagctggtgccagtgatgctggtccatggatcagctttgagtagctgagccttatgtattgaaaggcttcatcatgggcaggtgtttcacacatgagtcaccagtgtggaggctgtaaattggtttcttcccatgactcaaaacttttctgggcaatgttccatggtattgatgcagacgctttatctaacatagctcttgatagctggctagcagagagtaatcaactcccaccatccaatggaaggaatgggtggacaagctgaatatgtcaagaaaagtgagagtctgaatacactgatattttgtaattaaatatggatttgattgaggtttagaaaggagaacggatgaagctgctggtgtgtggaagattgcaccagagagagaaaagtagttttaggagtggatgagtaaaatactgcatgtgataaagggtttaaaggaaaacaagagagaccagtggccattcaagttaactgagcttattttcacaagtatttgttgagcattgactatgtgccagacactgtgttaagaggatgcaaagacatggatatggctctgaagaaagagcctagtgtagcatgcagacacataagtttaatatgtgacaggaagaatgattacatgtgtgtatacacacatgcacatagaatctatgtaatattgaggatgaaatgattaagtctgtctgggaaatcagggaaggtttcagagaagacaggacatctgaccaaggtattaaagtgtgaatgggagtttgctaaggggatttaagcataggcagtagcatttacaaaggtgcagtggcatcaaccagcccagtgtgttgctcaggagtactgtagcacaaggaaggggtataacttaaggggaagaagaagaggaagagtatgaggcaatgggcctccagtggagggtttctttgcagtgcccagaaacttgggatttaacttgtgcacctgtgaacctcagtatgtttcaaccccagagcactggaaggataggccacatttttgcaagtagcagagtattggcttaggaaagcatgtgtagatttaaattcctcctacaaactgccttccaaaaagattacaatacattcctccttcaaggaaagaacacttgctgatagggaggcattgaaggattttaagaattgtctggtgtgatttgtgctttaaatccctccaggagctgtgtaaaggatgcatttgaaggggtcaagatccaacgtgggtagaacagttaggagagagagcaacagtctggtcaagagacagtgagggcataaatgagacagttgagctagagggtcagcgatatattgtggagatcattctaagctaaaaactaatgttagcaatagaggtttggggctgggcgtggtggytcacgcctgtaaacccagcactttgggaggctgaggtgggcggatcacgaggtcaggagatcaagaccattctggccaacgtggtgaaaccccgtctctactaaaaatacaaaaattagctgggcatggtggcacatgcctacacctgtaatcccagctactcaggaggctgaggcaggagaatcacttgaaccagggagtcggaggttgcagtgagccaagattgcaccactgcactccagcctggcaacacggtgagactctgtctcaaaaaaaaaaaaaaaaaagaaaaaagaaagaaaatagaggctccgttgaatgtagggtggttggtgagaaagaggtaggagaataggatgattcccaggtttctggcttgtggtgcaggagatgaggagttcttgagttgcmggctgtgtggttggaaagtgagaagggagagttgaargatgatcatttagtttcattttggaaactagtttcattttgacattcttatgggaaggacatcaggtagagatgctcaaggagaagttataggcacaaatctgaaatgtgaaataaagttcatgtttaggaaaaacagatttgtgaagtcatctttaatttactctggatagaagtagaatgagagggcaaggctgcaaacattaggaggtaacagtccaaggcagcttgagagaaaggctatgtctactttcatctctttaccctccaaaacccctacacagtgtttcaaacagagcagaccctcaataattgcatatcttacttgttaggttgagaaagaaagaaggccagaaactatgggaagtaacttgattccgttggaattcttttgcataataaaatctgatatgtaatggatgacaaatgagataatatttacctgtttttcagcatgggtcaacaaaatacaagtactgatggctgctgcaagctttggccaaactaaaatcccccggggaaatgggccttattccgttggttgtacagacttaatgtttgatcacactaataaggtaatgctttgatttatacaacttatcctgatactctaatattgtctgtcgctatggaccactagaaggtgttcaaatgtgaccttgccctcacctgagaatgactcattttgcaatttgtattgtttcatatgaaggcttttactagtttggccattcctcaattctttgttattgtctgattaatttctctataaaccttatttttcacttccttaatacctgaagccaggctgcttgtattttcctttcactgagatagaatattgtttttctgtttctctttcatgactatcttcaatcaccacagcagcctaaaaagttctttagacctttttgtgaacacagaggtatttgagtccccactaattaaatatgcaaaatagctgctggaatatgtttgagacacaacttctctaaaagtgcattaatttctttcttaacagggcaccttcttgcgtttatattatccatcccaagataatgatcrccttgacaccctttggatcccaaataaagaatatttttggggtcttagcaaatttcttggaacacactggcttatgggcaacattttgaggttactctttggtaagatttctgttgatccttctttgtaggctcttgcatgtatgaaaaccttgaaaacaacaagaacttcaagtagttaagaccaaagtagatttttcttcagtccaaatagctcctaaaatgataaggaaagtatttctttaaagcccaggcaactacgacagaatcaaggttctcattttgtccattctgagttggatgggagtggccgagagtatcagactgactctgacatctttctgtggctgctctttagttttcatctgacataccatggagaaggcaataccgtggtgagaatagcaggttatttggtgtggccactatcccgcatgctctgtgctaaagttagacaaaaagagaaagaaagtagaagccatcaaactctccagatccaaaacaaaggagtcaaagctaatgcctttcttgtcatacatgaagagactctactctcattcccatcacctacccccatcgmtaagacaatctgatgtgtattcttcacttactgtctacattctgctaatatagacttttccttccttatctgtttgactagacactactgttggactgatgttaactgtgtcttcacatttacccctcaaaacgatctacaaattttgggattcatcttaaacatcggcttttaattttcttaaaaaccacttataacagacatgaaaatagcataactctgcatatttatgttgcaaaataatttataaatcacttccatagcaatcatcacattcagtctttatgactgcatctgcattttatagatgagaaaatgaaacacaaatgattgctgataataatggtgacaataaaaattgagaagtgaaagaagacaatatttccattttttgagccccttactatgtgatggattgcaccactgctttacatatattacctaattaaataaaattctcacaaaaaccctatgaaagagatatcattttctgaagtttacagaagaggaatctgaagtacagaaagtttaaggaacttgcccaagatccatagttaggaagtggcagagctgcatccatgactcagtatgaagtcagtggtttctctaccttttcctgcatgattatgaccaaatcataatgaacagagtctctgtttcttagattctggctcttagtgtaatgtatccaaggttttatgggtagtttggtttcagaacattccctttaaaatttttccaaaacctgggaatggcagtaagtagcagcctttatgaatacacctataagtgggaaaatctctcaccttaagtccagagctgtcagtaagaactcatcgttaatgatcctatggtctgaggaaagaacttacgccrggtgcggtggctcacgcctgtaatcccagcactttgggaggctgaggcaggtggatcacctgaggtcgggagttcacgaccagcctgaccaacatggagaaaccccatctctactaaaaatataaaattagccaggcgtggtggcgcatgcttgtaatctcagctaatcgggaggctgaggcaggagaatcgcttgaacccgggaggcagagtttgcagtgagccgagattgtgccattgcactccagcctgggcaacaagagcaaaactccatctcaaaaaaaaaaaaaaaacttacagttcagctctttggttggtgggtatctagtagcagtctttttaatgaatctactattcatccataaaaaagtagatataaatcagatgggtctgcattttatgctaatgagatatgaattaaattcactagcaacactcagagaaaaccttaactataaccttccattgttgtctaggttcaatgacaactcctgcaaactggaattcccctctgaggcctggtgaaaaatatccacttgttgttttttctcatggtcttggggcattcaggtaatgtttgagaggttgaacaattttggcttccaggaataaatgacaatttttttattcaagaaagaaatagcagagtttggaatgtcatgcaggcccttgtctggaggagttgggkttcctcaataattggctgtgggtctattgatcagtcctagacctgtctggtcaagtagttttttccctactatcagctcattgggattagcctcacagcagagaagaaagggtgttgcattttctatagttgtccttcattattgtaatatttacactcttaaaattatcctctgtaamgtttagaacttttgagaaaccaattttagattagctgggaaagactgttattaagagaaatatctgtgaaggcaagagaaggagcaggaaaagatggggagaacctttggaccatgacacaggttggacacctgaaarggtgatggggaagggagaaggattggataagaagagcttcagaatgaagcatggttctaagaaatattgagccaggccaatggaaggagtgctggactatatttgcttatcaagagtcctgtatctcataggaatgggctaatgttagtacccatgctgtgccaagtctctgggagcagctcactggatgcttagcttccacttgaccatggtgatggatacagaggggcaggagctggatagggtctttagtaagctatgcagtctgtagcatgatagctgagtggcacattttcataacaacaaccaccctcttcactttcttccaccactttctcacctgtcacccctcttctacytcaagggattgtaaaactcagaaaataagagagatggcttttagctgggaagaagttgggtagcacttgcaataaagaattctcttcagcactgtaaatgtagttcagctagctatttgatttctcctacattagtgactggcaaattagaacccaagggccaaatccagcccactgcctatttctataaagttttattagaacacagccacacccattcatttttgtacactgtctatggctacttttgtcctacaacagcagagttcagtagtggtgacaaagactatggcccacaaacctggaaatatttactctctggccttcaacagaaaaagtttgctaatccctgtgctatatcattcccccctcttgaaaaggtcctgtatcttcagcaataaataaatagtttctagctacctcctttttattctctgtggacatttcctattgaatgcatggtatgaggaaaaggttgtgcaaatgaagctgtggaagagggcataaatgcagtgcttagcacatgatttttcaactatttcacccagtccaatcatttaartaatagctaacatgtgttaagtatttacctgtttctaatataagtactgaaaatgtattaattcaattgatcctcactgatgaggtagcatactattatagtgtcaccattttatagataaggaaccaaggcagcaaaaatattgtgacttattaaaggtacacagctaacaagtggtagaaccagggttcaaactcagtggtcagactgcaggtctcattcttgtaactacaatactgtactgctttcctatatacattatcttagcaaaaccttacaactaccctaaaacaaatgctttactcttaggcccattttacaggtgaggacaaaaatgcagtaattacctaaaatcatatagctgggaagtggcagagccaagattaaaaacccaaaactctcaaaggcaatatttataatcactgccctgggttttctcaactttagtagtcttgacattttggaccagataatctcttgttgtgaagggttgccctgtgcattgtaggatgcttgacagcatccctttacccactagacaccagaaataccctcgcccacattcatgataatgaaaatacctccagacattgtcaaatatcccctaaggaacaaaatcaccctcctttaagaaccgtagctctccactccaccccagggcactactacaggggtgtaatggcctccatgttcccagttttattagtggactcagccttgtaatcatgactggtagttgtaattcttccctctttttgttttgaaggacactttattctgctattggcattgacctggcatctcatgggtttatagttgctgctgtagaacacaggtatgttacctgatataattgggctctttggccaactacagggaatgtcaatgctcataactatgtttctaattttcataaaagtttatttaaaatgttgatggaactttcaagtatggtaacatcatgagcaaaaaaggagattgagtttatcgacttaaaagacttaaaagcacctaacatttctagagtgtttattgcctgccatgtcctatgcgaaatgtttttaatacgccatttcaytcagtcttcataacaatcctatgagatggttattattattattgttgttgttttaaggaagaggaatatagaggtgataaagggtaatttgcccaaagtcacacaactagtaagtggcagtgccgggatttgattcctgagactgagtttcaacatggctaacattgcctcccagaattaggaagatagaatggattgagtttacctgcaacttgatgatagacaataaggtttttttcctggaactcttttacagtcttctttaatttaagagaaaatatagagtggaagaagaaagggaagtcaaaagatcagaggaagttgagtcaaggatggaactgagaaacatgggtcagatgaggaagggaaggagcatgcataaataataattttgcttgtattatagagatagatctgcatctgcaacttactatttcaaggaccaatctgctgcagaaayaggggacaagtcttggctctaccttagaaccctgaaacaagaggaggagacacatatacgaaatgagcaggtacattgcagtgaaaggagaggtggttggtgacctaaaagcatgtacaaaaggatgacatttgttaatttaattttacacctggcaagttatgctcctagctctcctatttcccattcccaaaagatctgtcaatagattcctggagcagtaaaattcccttaatggaatatctagttcatagtaaaaacaaaggcaaatacaaaaatttgggagatgacagtgaatattcagaattcccttgaattaaaacttctaattttagaatctaaaaagtgctagaaaataaattaatagattcttcctcacagacaatataaaaagactacttttcagagaggcagtatacaatagaattaagagtatgggccttagaacccaactttctatgtttgaatcctggctccaccacttaattttgttatagaataatgaatagaaacattatttgtcttacagagctattagggcagttaagttaagtgaagcatattggcttcctctttatagtgggtgttttacatgtgttattatgtttgagtccacccacatttcctttaggtaggaattattatacaatcaatggaaactcagagaggttaagtaaatcgtctgaagtcacatagtaggtaagcaacagagccaggatttggactaagctatacctatgtgcaaagctggggcctgtgtcattatggtagcaagtaatagtcactaatcagatttccagtttataactgaccaacsatttttcccaaatacagcttctacctaaactttaaaataagtgttataactttttactttgtcatttccttcttctaataattatattaggtacggcaaagagcaaaagaatgttcccaagctctcagtctgattcttgacattgatcatggaaagccagtgaagaatgcattagatttaaagtttgatatggaacaactgaaggtaagctataaaaagtaatttttctcttgtcctacagttctttattgttttttgtcatttaattttctgctatattgcaaggtacaatatgataaagggctgcaaccagccccctccccaatgcrcacacacagacacacaaagcagtacaggtaaagtattgcagcaatgaagaatgcattatcttggactagatatgaaattgccaaaagttagtcagttttgatctacaaaaacagcaatgtcatatggttcaactcaactcctgtggaagtattattatttcatggacagctcctgcatgtttttaagcttgatcttgaaaacttgacacaagtttgggagcgggtggaaaaatatcagacagagtgggcagcatgaacaaagactcaaaagtgtgtgtggcatgtgaagtgcagggattagggggaactagagaataagatgatggtctgttctccagatacaatgaagaaatttgttatccctcaagcagccactctcttctgtatccttgcctttgtacatgttgtccccttggcctgacacacccttccccttgcctaactcctacctaatttcaagactccagttgagcatcacctcctctaagaagctttcttggaccccaatacccacttctggactgggctcgctgtctgtcatgtgtgctcctttgtaccactgtactgtattgcatcatgcctctgtataactttcttccctgatggactgcaaactcactgaaatgagactgcagtacctggcacagagtaggtactcaataaatactcatggaatgaacaaacaaataaacatggggtgaggagaggcagaagtcagaactgatgttgaagtttccagtgtgggtgactacaaagaacattaagtttactttcaaacctttacatatgttatatatatgtgtaaatgtgttttatatgtgtatatagatgtatatgtgtgtatggtatgtataaatgtatgtgtgtatatgtatattctattttataagaaatcaatgtatttaaccatccccatgaaatgaacaattatatgattgacaaaatcatttcttctaacaccacgaaatagctataaatttatatcatgctttttcaaataggactctattgatagggaaaaaatagcagtaattggacattcttttggtggagcaacggttattcagactcttagtgaagatcagagattcaggtaagaaaataagatagtaaagcaagagaatagtaaattattggaagaaattatattgtgagatataattttttattcaaattcttagtgaagaagggatctcttggagtttataaggctattcttttgcccccataaaatactctatatacattttcctaggctaaaacatctacctctcctgctattaaaatctccccctactcccataagttttccctcattattcttgtttacccaaggggttaacacttttcactgaaaaatttatctttatatawttttttgtgacataatgattgtgataataatattgtcatcttaacagtattgccagacttctccagtgggcaggacattttttaattaggtttttcccccttccacctttaagatggagctggatctaaaattacaattatttgggtaagagttgggacaagaccccagttttctagcttgcaggaacattttctttcttaaaccttcattccagactgatgagatcacatagaaccaaccgtacagagagtgggcaggatcatttttgaaacttcacctcaaatttcttaaaagtccatttcagtgtaagaattctcttctttgatccatttaccaaaagatcaggaaacataggataaacttacttttaaaaaggaagttagtttcatcttcaaatgatatgctccatatgtttttcttcaaccctcagacagtttttcagctgaagtgcctctaaatataaagtaatgggcccaattgttactctaataaagctataataaatacactacaaggtgcataaaagctctgaaaacaaaggtgtatttattatactttttcagatactccacagtgttgaagaaattattatgtattctaaaatttattttgaataaaaagttttaaggatatatcactcaaatggttgcaattcctaaaggcatataaagaaaatgattatataaaattccaggtctgctactttacaaagttaatcatatccctttcccacattgaagtatgatacctctttattccaatsagataacccataataaactggtatggtgcgtgtccaccaatcctagcattattaggatgtcctcaatgttggctagtatgtaaccagtttaatttcatcattgtcaacaaatatctacagatgtggtattgccctggatgcatggatgtttccactgggtgatgaagtatattccagaattcctcagcccctcttttttatcaactctgaatatttccaatatcctgctaatatcataaaaatgaaaaaatgctactcacctgataaagaaagaaagatgattacaatcaggtaagtattagtgacttatttcattatgtgaaacaaacttgaagcttgggtaaatatcaatcgatatcatttggtaactattaaagaattgctgaattggttgtttagactttcaataaggagagaattagataatctcagtttctaagtacatttagtcttactctttttaaaatgggaatgttaacgtatatagtatatatactggttatattagtctgttcttgcattgctatatggaaatacctgagactgggtaatttataaagaaaagaggtttcattggctcacagttctgcagcctgtacaggaagcatgatgctggcatctgctcggcttctggggaggcctcaggaaacttacaattatggtggaaggcaaccggggcatgagcacttcacatggccagagccggaggaagagagggatgggtgaaggtactacacacttttaaataaccaggtctcacaagaattcactgtcacaatgacagcaccaagggggatggtgtgaaaccatgagaaactgctcccatgatccaatcacctcccaccagtccctgcctctgacactggggattccaatttgacatgtgatttggtggggacacagatccaaactatatcactggtaattaaaattagcattatactacatgctacttcaatctaaacaccagaatatgcctacagatttttggggktagagctagggggaagtattccatcattaggctggggtaggaactctttaaagaaaaagtcagattatcgactgagacctgcaatatactaacctgttgagaaagaatatgagtttataaattccccaaagctataatggggtaccatgacgtgttggcaattcttgtatcctggaggtgaaaaagaactcctgataaggttttgaactctcgatgagatattacaaagcaaagatggacctgaactcacccctttcctatctgaaatctggtttatttaggagaagagaagaggcaggaaggaaatatatggagtataggcaataaacactatgggctcagagaatagaggggtctcttccaacagaaaaggattcatagatgacactaaaattggattttgtaagatcaagagagtttagatagtaaggaagggtttaggtatttcaggcaaggacttcatttagcttatgtgtatgtgcaactctttctaattctaaaacggaaataatacagaacacctaaccttccctcaaccctatttccttactaagctctcacctttgcttttgtcccttctctgctagaaaccttcaaagaatagccaatattagtcattgcatgtgcttacttctattcactctttgactcttgtggtctagcttcctgggcccccacgggcatgccaaaacaaagacactaaaggcctgctgcctgccacaccagcagcctcttcagagtctcaaccttgctctctgcatctgttcaacattgctgaccacccctcttcctgctcccttggctactatgacccacctctttgctgcttctcctgtcatttataccactccttccatttcttctcctctggcagttctctacagtcagatcatccaagcttctgctcgcaattctcttgtattcctgctgtttatcttctttatgtttctgacattcaagtttcctactacaatgtggggaagagtgagagggagttaagtggccctgttttgagcttagatgactaaaagaatgatgggttgcttataagaaccagcagagtcaagaggcagagcagctttgggcaggactgggaagatgtcttttaacttcacaatttcttagcttgagaactgaggaatctgtacacagatgtctggccacacattggatgattacataatttacatgataacacagatgaaacatttgaagtagaagagattgcaaagtgagaaaagagttggtctgccagtagaatcctaaggaatgcctacattcagccaatgggaaatgggtgaagagccagtgaagaacatagagtggttagcgtcagaagggaaggtgcaatgttaaggaaacgtaaagaaaaaaagtgcaagaaggccatcaagtgtcaaatgtcccagtggtggtagaaaacgaggacttaaaaaaggccattctatttgacgttaggctattgatgaatttacagagcagtgcaaatgatatttataaagtgcttacagtttaatactgggaaaagtggtgtttgaaatctgtttcctctaaggcttaaatctaaagtgatttaaatttaaagtgactagcatcaaatacataccacgttcagtggtgagggcaggtascaggctctggctctgagttcagggacccttcaatacagaacacattccagtattcaaactggaagtattccaattcactaaaaagcaagaatcatttcttctaaaatcaagataccaagcaagaacaagattctttgagttgtatttctagagggaagaagaatatactctgggatccctaaacaaacagcctgtgacccttgaaacacatctaagtagatcaaattacaagttttatttcttctttggttttcagtaaacagaccaacaagaccagtacctttcttacactctaactaaaaaaataataattttatcaaacaatgtgacttttaaatgtcttgttctcttttaggggttcagtccaccagaattttgctgacttcacttttgcaactggcaaaataattggacacatgctcaaattaaagggagacatagattcaaatgyagctattgatcttagcaacaaagcttcatyagcattcttacaaaagcatttaggtaagaaactatttttttcatgacctaaaccagatgaatctcaggacaaagctgtctatcttaatacagctttagtactatttaaactatttccagttggtttacaatggaacaaagcagtatatcaatttgaaaacagaaatttgagaaagtcaattttgctgctttacatcctctatatcatagaaagcaaatccaactgttaaaggtaatattctttgtatgaagcctagagtggacttccatgttgaggatactgacagcaggttgcctcactcctatcccgtttgcattcagctgctaaagcagccatgaggcagctgatacagagcacatcgtctctaccatcctaacggaacttgtgtaatttgtaaatctttattgccacctaggggcaccaaactgtttaatgctctcaaaagtttaatatgttgattaacactttatattttataggacttcataaagattttgatcagtgggactgcttgattgaaggagatgatgagaatcttattccagggaccaacattaacacaaccaatcaacacatcatgttacagaactcttcaggaatagagaaatacaattaggattaaaataggttttttaaaagtcttgtttcaaaactgtctaaaattatgtgtgtgtgtgtgtgtgwgtgtgwgwgagwgagagagagagagagagagagagaattttaatgtattttcccaaaggactcatattttaaaatgtaggctatactgtaatcgtgattgaagcttggactaagaattttttccctttagatgtaaagaaagaatacagtatacaatattcatatcagcctaaattttaattttaaagatgattccttttcagtgtcgaagttaaaaactgtttttacattactttgacagacaagtagattaaaacaggcaaaatcccagtgaaaacctgttgcaatgatacaagactccctaaacatagagtaaaaaacaatttcttgccttttattatctactatgggcagtggagtttaattatagcaacatgatattctaggtagaatttggcagctcttctctttgacttttggtcacggtaagaaaaattagaacaagcaaaagccattgtttcagcacaggattggtggtactacacaatttcaaatgatgactaaaaggagtagagaagggttaagaatattagagatgaggcaaaggcagtggattaaattggtaattttttgacactttctttaattctttaaggcattctacttgctaaagaaaggttccacaggtattacagcatatagcagggattccagttagaatacattagttactcacacaaaggctgtgaaggataataaaacattcagaattacatttagcttcttcatattccagttaattttatttaatgttttcaattctatatgtagtagtaaaacagaataacacgattaaatggaggtaaaaatatagcttaagaatttatacttataaatatgggaatcatggaaaatgattttatttcccaggggacataaaaatttataccactcatttggtaccctagtcctatcttagtggtgtcaggtgcaaagtcactcmttctgagaaattttacttctgtagccattcagattaaattttttaaaatagggagttaaactcagcttgaaattgaaggcttcctataatctgatcctaatgcatcttctctgagctttgcttctggcaattcacattatattatctatatgagtaagccaaacttgtctattcattattccaggaataagtaatatactcatctacctcaattacttttaatgcaaacctctctcccttctacttacggaaattataatgggtttttaaggttcataattctatttccattaggcttcagagtctgataatgcttcacagagatacacctttaccccagtctcatttagcaaaccttttccctattcattttagaaataagcattccaactgtatggatgtcccattcaacacttttttgtttgtttgttttttacagtcttttgttgrtggcgcatgctgatgctgaaaggagaaaataactattgaaaatatctaataagttaaggttaaaaagaaataacctaacatagtgcacactgagtatttttcagggtaaagaaagacacatttatcaaatgcctactccttttcagggactttatatcaattatttctcatcttaaaaaaacactgcaagaaaggttttattatcaccactttacagatgaagatcaaagttcaaaatattacataatttgcccatgtcacatatctgttaagcagcatatagctcagatctgtttctaaaagctaagatctatgctttgcaaaatcatgtttaaaaagtcatgggcttcaaagttaggtaggtctgggtttgatcaagcctctgagactcatcagctatctgaccttaggcaagttatttaacctctttatgaagcttcaattttctcacctataaaatatggataatattgatatgcacttcaaagttgatgaataaagtgaaaaaatgcatttaaagtataagctaagtgactaatacataagagctaacatttaatattactatgctttccccaatcctccattacagaggagagatggaaccaagtatatttaagagttctatttcctttttaataaaatgagaccatcatattaaggataaactttatttaaggataaactttattcaaatcttgtattagaatacttccaaattcaaacagaatgttagtcaaatgtttagacaaacaggcaaagattcaaagtcaagacaaaaattctgaaggagatcctgctaaaaagctatcctaagtagaatcaaataatgtacttgtcatgagcccttatttttctattttaatttaaacactgtatttgaaakgtaccaaaatagtttttgaaatgtaatgtgttagtaaactgtttagcaaaataaatcctcccaactaattagaaacgtaagacaataaagacgaaagatcccagatctgtatatataacaggatcactataaacacaccccaccatcaacctgagacctaatttgttttccacctatatagaagtttttgaaaatgacaacttcttgtggttacatgttttcaattttctcaaatactctgttggtctgcgtaagatgccacttgttcaagggcagcttctgactgattggccacagctatagatccacggttaaatctccatcacctccaaaccccttttctgaaacaaaaagagaaaaacttcaaactgagaaagaaacatacaaacaaaaaaatttatttccatgggtgttaccatgacaaatgtaatgttctctaaaagggagaggggacagatgagtattctaattactatagggcattatttctatagaaacaatgttttattttcttattaatattttggttctcacactgtaccatcaaatcaagtttctctaaaaattatgaaattggcatattttatattttgctagagaatggtgtgaacaaggctgataatcaattagttmtttttcctttttgattagtatatatttttcacatgatattaaagctaccattagctgattttattctcaatgtgcctcaattctaagaaccactgcattatttatgaacaagaatgtgcaataccaagaaccagccaataatttgaatcttatataaactaaagattcagaaattccaagagattatttaacaaatatcatttgaacatatgagctaattaacagagaaaattctttaaaatgtgaatttatcacattcataatttaactttcaagattaattcaattaataaatttcctatatttcaagaaatcctcatcttgggttatttatctccataagtatatttaaatttttttacctaaagtggtttttcttccctgctacctatgtccaaagaaattgataaaccatttttgtttgagggattcagcataacaatatttttaagaaattgtaattctgggtgataaaagtattttgttttaaaaacacaagttacctttaatagtggtatcacccactgacatgaagtaaagatctttccctactctttgggatacagcctaacaaaaggaacctttgaattgctattgattctttatcacgagtacaaaataattcaaatcagaaatggaaccacagataagccagaaaagatgtraacaacaaaatgyatttctatcaaaattatgacaatctgattttataatgaggaatcatgtcaagtactttttctattcttcaaatactcatttctctagaacatatccctggagcactctacacagggagtaaagtacccttttccaatgtttagctctcaaatccccaacaactctggtaattggtgaaggagggagggacatcattgttcaaggggctgttattcaaacacagtatccatgtagagccacagatgctttattaaggacaatgaaaagggaaatatttctcctatattccttttaacaaccaatagcatcatgtgcatgcattatgtgatacagtaactaacaaaatactcttatggtaaaataaaataactcagataagaaaccatttttttaaaaaaagtaattagattcctagatcatagtgacttgatgtatcattaaaaaaaagtcatgcataatacaacactcactttgtaaggaaagctagctcatttgtagacaggtatccagagttaagagcttcctcgaatttgagggaaggatatttaaatctcattagtaaccaaatcaaaatttttagagtcttactcataagtagtttctatatgtctgctaactggcctagtcaaagccagaggtagttatctatttacttatctagatatataattttatgtctactttaaatagttcttttctatgtagcaggcatagagaactttatccaaactgaatcttgtatgtacatatgtatgcatttggctgtggattcttcataattaatggatggagacaacccaaatgtaaaaagttttagtaaatactgatgcaaaaagtgtagtaggctggtatttttgacctaagcaaaaaagtaattaacataaagagagatattcattgattttttatagtaaaaatttcaaatgacctaaatatccaacactatgggaaatggtttaatacattatggctcactagtgtcatgcagcattatttagctattaaatattgtttatggccttctgggtgcagccaagatggaataagctgactataacctctttcgctgattacaatgaaaaattctagacagaatataaaaagcaactactcaaagactcaaaagtgaacagaaataggtagattaagaattaaagtaaaaacgtgaataatgactcacaacaggagtgagtttcataggccttttcttttctttttttttacttctttgtctcctgattttgatctgagggtgggccaaatcaaaactgcctagctagcrtagacagcaaaactctgagagaaatttcttatttatagccagtggactagggataaaggaaccctgaatgctagagagtaagaaataggtaggaaatctctttgctgtattgtggtgttatgtttatttctatttttttttctggccctgccctgagggtggctaaccccagttactkcctggtgacagctatggcaacataggcacctacaaatgtgagagatgacccgtctctctagccagtggaaccaggaaaagagctttctgtcatctgaagaatagtaataggagattgtttttgttmtctctttatctgcttcgctcttacgggcaaacagaactgtgtggtggagcagaggctgagagaaaaatactgtctggctaggtgaccagaaaaaggggccattggaggctggataagagaggatcctgggagccagaaaatgtggaggacatctcagagaggaaaggagttgaaaatgtttaactcctaatgctacatgtgaactctaagtctcaggattgcccytgagctatgcacatgcagaacagagccaaataagcacagcaaagtctttgacacttaactactatataaaccactgaccaaagtccctgactaccctgggtggcttatgtacctggaagacctgaacaacaaaggctttgaaaactaaactgacaggacaatcaccaaccacagaaggagaaagagaacatgtaggatgaattgaaaccagctgatcatctgctgtaacaaaaacttcaacattctccagattttaacaggacccaatgtcttaaaacataatatgcaaaatgttcaggatataatccaaaattactcaacatacaaagaaccaagaaaagctgaccatttctctagggaaaagaaaatcaacagctacaaaccccaagatgaccagatattaaaactatcagacaaagattgtgaagtgagaagttcaagaagtccaaccaaccccaaacaggataaactcaaatgcccagacacatcataatgtcatggcaaattgcccaccatatagtcttaaatgaagaaaaacagaatataaaactatacataggatgaaatcaattgtgtctaaaatatgtagatgaaatacttatattacatataaacagaaaaattataaaagaaaaccaaactggtcaacctatttgtctctggatgggtatattatcggtgattgttactttctcatttttaatattgttatatttctcaggttttctgcatctaatatgtattttattagagtcatgaagaccaaaacattttctaatcaaggagtaaaacattaataactagttttctcagaagaatacttggcataaggactaaaatcactgattttgttattgctgtttttaactat

SEQ ID NO: 13241 - DNA, 28277 bp, Homo sapiens
  misc_feature (1)...(28277): n = A,T,C or G, or insertion/deletion polymorphism (see Tables 1-2)
atttggtatcagtcatctcatctggagtgtttgagggagatgttacaggctcacagagcctcagagcttagggagtggaacctcatgctttacccaggagaagcctgaggtccagcaaggggagctgactcggccaaggtcacacagcatgcaacagactctggaaatttttttttttttttagacggagtctcgctttgtcgcccaggctggagtgcagtggtgccatcttggcttacttgcctcctgggtttaagtgattctcctgcctcagcctcccaagtagttggtactataggcatgcacaaccacgcctggctaacttttgtatttttagtagagacagggtttcaccatgttggccaggctgatcttgaactcctgacctcaggtgatctgcccatctcggcctcccaaagtgctgagattacagacgtgagccaccacacccagccagactcaggacttttttgcccagtgctgtttcgaagtcgccacatgcctgtgacaggtagacaggagggctctgggtaccaggtaatgaagtgagggattaaagctggaggaaatgtatctttctgctttatgccttggcccagctgagtggccctgtgctcgtcacaggctggtgtcctctgctctcctcccctcactcctggggcaagcaacagtggtgttccatgtgtgagctggacctaccactagtgttggcttgtttaaattctctgacagagacaractgtcccggggggcggggaaggcagtgtggagctcaccccctgagggagcagcattgtctctgtgggctttggctgggaatgtttctgaagacgccctaatcccttgccctgcctagcctcaaagtctctatcactcagaggagtactgggagggctcagtgtgagccatcagaaccttccagggtatcttcccttgcttgttctctttgcgcagtccacttggtttgctaaactcctgctcttccatcaagacccaactcaaggccaggcacggtggctcacgcctgtaatcccagcactctgggaggcagaggtgggccgatcacttgaggtcaggagttcgagaccagcctgggcaacatggtgaaacaccatctctactaaaaacacaaaaattarccaggtgtggtggcaggcacctgcagtcccagctactccggaggctgaggcaggagaattgctcgaacctgggaggcaggggttgcagtgagccgacatggcgccactgcactccagtctgggcgacagagtgagaccctatctcaaaaaaaaaaaaaaaaaaaaaagacccaactcaagtatcatctccaggaagccttcccctactcccagcaattaaatgctcctcagagaattcccatttttggtttactctttggtttacctccagacaggaagcccccactgacactgttgtagtcccagggtgcaacacaaagcagagatcacaagctgagtttaataattgcttgtggaatacatgtcccaagccacctcctgcaggaagcccttccagatgcccattctagccagtctggctctttgcttccataccttcacaacacttgtgcctcccccagggcctctttctcatcttgctttctggggcagctgtgtgcacatttgtctgtgtgcagcaactctctaaggcagggatttttactcctatttttgatgaggggagctgtggctcagagaggttgaataacctaaggccacacagtgagtggcagagccaggaatgtgacttgggtccatttgaatccaaagtccctgtactttccactgccctacctagatgtccctgtacctcstataaaatcagcatggagcctggtgcctggtagtccctacaaatattcacaaattggagcttagctcagctctcaggcaaggcccaggtcaaaagggcagatacagctttgggaccttagttgccaccacatgccayaccttcttcccagcagaaggactccctccaagacagggtaggggtggaggatgtgaacaggggcagaaatgggcatgttttggggtcagacttggaggaatagcagagattggagtgtcagaaggtgagcatgcctgggggtgttggggagatgcaattcatcagggacagcttaktgtcaggggattagactgsggcccatgaaggagaggcagaggctgatgggcctaggggtggtgtgggtaggtgagcttccccagacagtgactctgccctgccctctctccagctaggtcctcttccccattccttccccctttcctgactggatcctcttgggagagttaccctccttggcttcctctgctccaatctttttatcagttggccatcattacttatcattacctcaagtcaaacctccagatccacatggggctaggacattggcactggaccaaagaggccctttcctttgctttctctttgtctttttaatgctttgttgcaaagacctaggcggggagagagagagagagagagagacagagattgacccacagtcagggtcagggaattgaggggaaccaacccaattctctctccttcaattcaccaggtttgtatcctgcccttcctgcagatcagtgtcctgctagtcacctgggggtcaggggatggagtgaaggacaagacctccttcyattgcagtgaagccacttggagaaatgtgtggaaaacagcaagacccagtgactctctcctcaccttctttccaatctcaggagagattttgtcccttcatccaccggcttctagattaaccacccacacccacacaggcgagagtttccctgaatattggaggtgacaggacatcaggacaaagtacaacyattgtgccttggcccaatcactactttctttgtctggggccgccgctggctcctggctgcctttcgcacttttctccacccccacccctttctccccttccccctcacctggaacaccttccccttcctccttggctccttctgaactgccttcagagccacagactgtggggagtggccactgcgctcccaaggtgaggccctccaagcggggcygagtttgcccctcaactgggagccagcatgacctctgtgtgggctgctctctgcttcactgccccttcccccaatctgctaggtgaccctgggcccctttgtgccctctctgggccttcggaggattctttgggkagacagtctgctctgacgccccttcccctgcagcaagcagcctggggagggaggtgaggataagtgaagtcaagttgttcagggggctaagcccatggaagggaagatgccacagagatacatgtggtcttgtgattgttgttttgtgctttttccccttttttgaaagctcaggtgactaggtgacttgagcttttaatttggtgacaatgtgggcactggctgagtccttaagagtacattgttgtaaatgccggtgacaacacactggggcatgggatccagagttaacccctccaggtcacagccaggttatatctccacaatgaaggggggaggtgggccatactttctcgccctaatgaaggtagctcaaaaacccctaggccaggttgtaatcctagccttatataaaaggaattstgtgccctcactcccctggatccctgggcaaagccccagagggaaacacaaacaggttgttgtaacacaccttgctgggtaccaccatggaggacagttggcttatgggggtggggggtgcctggggccacggagtgactggtgatggctatccctccttggaacccctccagcctcctcttagcttcagatttgtttatttgttttttactaagacctgctctttcaggtctgttggctcttttaggggctgaagaaggccgagttgagaagggatgcaagggagggggccagaatgagcccttagggctcagagcctccatcctgccccaagatgtctacagcttgtgctcctggggtgctagaggcgcacaaggaggaaagttagtggcttcccttccatatccygttcatcagcctagagcatggagcccaggtgaggaggcctgcctgggagggggccctgagccaggaaataaacatttactaactgtacaaagaccttgtccctgctgctggggagcctgccaagtggtggagacaggactagtgcacgaatgatggaaagggagggttggggtgggtgggagccagcccttttcctcataagggccttaggacaccataccgatggaactgggggtactggggaggtaacctagcacctccaccaaaccacagcaacatgtgctgaggatggggctgactaggtaagctccctggagcgttttggttaaattgagggaaattgctgcattcccattctcagtccatgcctccacagaggctatgccagctgtakgccagaccctggcamgatctgggtggataatcanactgaytggcctcagagccccaactttgttccctggggcagcctggaaatagccaggtcagaaaccagcyaggaatttttccaagctgcttcctatatgcaagaatgggatggggcctttgggagcacttagggaagatgtggagagttggaggaaaagggggcttggaggtaagggaggggactgggggaaggataggggagaagctgtgagcctggagaagtagccaagggatcctgagggaatgggggagctgagacgaaacccccatttctattcagaagatgagctatgagtctgggcttgggctgatagaagccttggcccctggcctggtgggagctctgggcagstggcctacagacgttccttagtgctggcgggtaggtttgaatcatcacgmaggccctggcctccacccgcccccaccagccccctggcctcagttccctggcaacatctggggttgggggggcagcaggaacaagggcctctgtctgcccagctgcctccccctttgggttttgccagactccacagtgcatacgtgggctccaacaggtcctcttccctcccagtcactgactaaccccggaaccacacagcttcccgttctcagctccacaaacttggtgccaaattcttctcccctgggaagcatccctggacacttcccaaaggaccccagtcactccagcctgttggctgcygctcactttgatgtctgcaggccagatgagggctccagatggcacattgtcagagggacacactgtggcccctgtgcccagccytgggctctctgtacatgaagcaactccagtcccaaatatgtagctgtttgggaggtcagaaatagggggtmcaggagcaaactccccccaccccctttccaaagcccattccctctttagccagagccggggtgtgcagacggcagtcactagggggcgctcggccaccacagggaagctgggtgaatggagcgagcagcgtcytcgagagtgaggacgtgtgtgtctgtgtgggtgagtgagtgtgtgcgtgtggggttgagggygttggagcggggagaaggccaggggtcactccaggattccaayagatctgtgtgtccctctccccacccgtccctgtccggctctccgccttcccctgcccccttcaatattcctagcaaagagggaacggctctcaggccctgtccgcacgtaacctcactttcctgctccctcctcgccaatgccccgcgggcgcgtgtctctggacagagtttccgggggcggatgggtaattttcaggctgtgaaccttggtgggggtcgagcttccccttcattgcggcgggctgcgggccaggcttcactgrgcgtccgcagagcccgggcccgagccgcgtgtggargggctgaggctcgcctgtccccgccccccggggcgggccgggggcggggtcccggcggggcggagccatgcgccccccccttttttttttaaaagtcggctggtagcggggaggatcgcggaggcttggggcagccgggtagctcggaggtcgtggcgctgggggctagcaccagcgctctgtcgggaggcgcagcggttaggtggaccggtcagcggacycaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagsgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctcygaaaccatgaactttctgctgtcttgggtgcattggagccttgccttgctgctctacctccaccatgccaaggtaagcggtcgtgccctgctggcgccgcgggccgctgcgagcgcctctcccggctggggacgtgcgtgcgagcgcgcgcgtgggggctccgtgccccacgcgggtccatgggcaccaggcgtgcggcgtccccctctgtcgtcttaggtgcagggggagggggcgcgcgcgctaggtgggagggtacccggagagaggctcaccgcccacgcgggccctgcccacccaccggagtcaccgcacgtacgatctgggccgaccagccgagggcgggagccggaggaggaggccgagggggctgggcttgcgttgccgctgccggctgaagtttgctcccggccgctggtcccggacgaactggaagtctgagcagcgggggcgggagccagagaccagtgggcagggggtgctcggaccttggaccgcgggagggcagagagcgtggagggggcagggcgcaggagggagaggggccttgctgtcactgccactcggtctcttcagccctcgccgcgagtttgggaaaagttttggggtggattgctgcggggaccccccctccctgctgggccacctgcgccgcgccaaccccgcccgtccccgctcgcgtcccgctcggtgcccgccctcccccgcccggccgggtgcgcgcggcgcggagccgattacatcagcccgggcctggccggccgcgtgttcccggagcctcggctgcccgaatggggagcccagagtggcgagcggcacccctccccccgccagccctccgcgggaaggtgacctctcgaggtagccccagcccggggatccagagaaccatccctaccccttcctactgtctccagaccctacctctgcccagtgctaggaggaatttcctgacgccccttctcttcacccatttcctttttagcctggagagaagcccctgtcaccccgyttattttcatttctctctgcggagaagatccatctaacccctttctggccccagagtccagggaaaggatgatcactgtcagaagtcgtggcgcgggagcccacygggcgctttgtcacattccaccgaaagtcccgacttggtgacagtgtgcttcccttccctcgccaacagttccgagtgagctgtgctttagctctcgtgggggtgggtcaagggaggatttgaagagtcattgccccactttacccttttggagaaatggcttgaaatttgctgtgacacgggcagcatgggaatagtccttcctgaaccctggaaaggagctcctgccagccttgcacacactttgtcctggtgaaaggcagccctggagcaggtgtttttttggaactccaaacctgcccacccaacttgcttctgaaagggactctaaagggtccctttccgctcctctctgasgccttccctcagccagaattcccttggagaggaggcaagaggaaagccatggacaggggtcgctgctaacaccgcaagttcctcagaccctggcacaaaggccttggctacaggcctccaagtagggaggagggggaggagtggctgcctggccacagtgtgaccttcagaggcccccagagaaggacacctggcccctgcctgcctagaaccgcccctcctgtgcyccctggccttggaaggggtatgaaatttccgtcccctttcctccttggggcccaggaggagtggagggtcccgggagaatattgtcagggggaaggcagggggtgtcatgggaatgggtgagggggctgaggtgcagaatccagggggtccctgcaggagcygcagtggtaagctgtccagctggaagcctggtaactgttgttttctcttgagaggggcttcctgtgaccttggctgtctctgggagcagggctggggtacctgagtggggtgcatttggggtgtgtgggaaggagagggaaagaaagatggacagtgggactctcccctagcagggtctggtgttccgtaggctagagtgcccctctgctctgcgagtgctgggcgggaggggagttggtgagagctggagacccccaggaagggctggcagaagcctttccttttgggtgctgtcaggtccgcatgtcttggcgtgttgaccttcacagcttctggcgaggggaggaatgatctgatgcrggtggggagggttagaggaggcctcaggcctaaggtggtgcagggggccccctaggggctgggcagtgccaaggcataaaagccttccctggtccctggtggcatttgaaggtgcccaggtgagaggggcttggcacctcctcaccctgggagggagaagaaaccagggaacaggtaggagtgggagacaggtsaggctttggaaatctattgrggctctggagagatttgtgtagagaggaaaatgtgkttctcccccagggtctcctcctgggtttttaccctctaagcaacctgtgggcatgctgggttattcctaaggactagaagagcttggatgggggagggtggttggtgcccttcggtcctcggcacccccctccgtctccaacaccagctcaccctggtatttgtcatgtcagcaggagaaggtcaccatgttgtttttctcgcccctagtcyttccttcctgccccagtccaaatttgtcctcctatttgaccttaatacttaccatggctttggaccagggaactagggggatagtgagagcagggagagggaagtgtggggaaggtacaggggacctcgacagtgaagcattctggggttttcctcctgcatttcgagctccccagcccccaacatctggttagtctttaacttcctcgggttcataaccatagcagtccaggagtggtgggcatattctgtgcccgtggggacccccggttgtgtcctgttcgactcagaagacytggagaagccagaggctgttggtgggagggaagtgaggagggaggaggggctgggtggctgggcctgtgcaccccagcccctgcccatgcccatgccttgctctctttctgtcctcagtggtcccaggctgcacccatggcagaaggaggagggcagaatcatcacgaaggtgagtccccctggctgttggatggggttccctgtcctctcaggggatgggtggatggcctaattcctttttcttcagaactgtggggaggaaggggaaggggcacaggaatataaggatcaagaaagaaagagctgggcaccacgaggttcaccctcagtttcgtgaggactctccgctgttcaggtctctgctagaagtaggacttgttgcctttttcttctgctctttccagtaaaattttatttggagaaggagtcgtgcgcacagagcaggaagacagtgttcabggatcctaggtgttgggggaagtgtcccttgtttcccctagctcccaggggagagtggacatttagtgtcatttcctatatagacatgtcccatttgtgggaactgtracccttcctgtgtgagctggaggcacagagggctcagcctaatgggatctcycctcccttccctggtttgcattcctttgggggtggagaaaaccccayttgactatgttcgggtgctgtgaacttccctcccaggccagcagagggctggctgtagctcccaggcgccccgcccccctgcccaaccccgagtccgcctgccttttgttccgttgtggtttggatcctyccatttctctggggacaccctggctctccccaccactgactgtggcctgtgctctccacctctggggagggaaggccctggggtcttccttcccgcgagtttccctgacctaaatctggcgtggctgggtagtggccagcagtggtgatgcccagcctgttctgcctcctccttccccaccccaggagccctttccttggcctaggacctggcttctcagccactgaccggccccctgcttccagtgcgccacttaccccttccagcttcccagtggtstctggtctgggagaggcaggacaaatggtctttgtttgctggagaaaaggttgtctgcgataaataaggaaaaccacgaaagcctggttgttggagtgtacgtgtgtgctcccccaggcagtggaggccagccctccttggaggggcggctgcctgatgaaggatgcgggtgaggttccccgcctccacctcccatgggacttgggkattcattccaaggggaagctttttgggggaattcctaccccaggtcttttkaccctcagttrccaaccccttgcccaggccagaccttcctgctatcccctcctgggccacaagcctggccctcctctgtcccaattgtgatgaaggggcagttcaaaacttcttgattagtcatcttctcccctatcgacttggctttaaaaaatgaccttttcagacttctagtctcgttcactctttttgatgatgctttgccgtaacccttygtgggtagagaaggattctgtgcccattggtggtctggataaaagaaatagagacctcacaggaagcagtggactggcctgtttccccactgttctttctgttttcacacctgtggccttctccccaccttcttcccaatcaacctattgtgtacatagcccccctcattgtcctttattcttctggaaagcagaccttggagggaggagtgagggggaggctcagctgtggtctctggggggtgggggttgggagctggggtggaagtccacgaagcatacacttaagatgctttggtgaagttctaaacttcatattacccaggctgaaaaaagagcacttgttcctagggctggaaatggaagccaaaacaccacctttttcagcctgtttcagcatctttagagatcagcccaacccacttacacagttgagcagagttggaggcctagagaggggagggactggcccaaggtcataccaactcatggccagagcctgggcctcctcactggccaggtgttatttcttccctctgggtagggaacctatttcagggacaggattgctatgtggtagtggtggtggggtgcgataggcgtggcagrctgggccacaatttggagtagtcatgccagagtcctgcatttatttattctcaagggcccygcctctgtggcccagaattaccccttcatgctccagtgcaccccaggcttcgtggccagcctgggaaacygtctctaccctggtctcccttcagatcagcttctagaaatgtttcgtggctacagtggcagcactgttttttccatgatgcaagcagtttgccctcttgggcggggttatcagtggctggcagggctggcacagcgtgtccgcccactgccacctgtgggttccaggagggcccagcccctgtgctgatgcccaccaccttctcagctcatgtctggggaagaggactggcagggggaaaggtgcctcctcctgaaaggtgcctcctctgtttttgcctaatataggcttgggaacactttgatgtcagctaattctgactcctttacttactagctgtgcggccttggggcaacttacttagcctctttgagyctcctgttccccatctgtaaaatggaatctcaatagtgtctaatagtaccatgtggagaaacttgtgtgaaatgatagctgtggactactgtacacagtactcaggatgtagtaagtgctcaataaacagctgttggtatggttgacgttatggtagtggttgtggggaggacgtaggaaactggagactagcttggcaaagctggctcttcctccttttagggaaagcttagagcatccccatggggtatacccatactcagactgtcctctggcatcgaggttggcccaggattcagttcagctgtcacagtgaggtggcgggatcagatgtggcaggccatgtcccttggaacttgagtacatcgtgtgatctctggaatgaaaacaggccttcaccagtgttgatggtggaaagcttagggaagtgcttcaaacacagtaggagggacttacgttagattttggaaggamttgcctgattcrgaagctccaaagagtggcattacagagytgggtggagagaggggctagccatcttttgtgtcgcccaccgggctcatgtgtcatcgcctctcatgcagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcaggtgggcatctttgggaagtggggcaagggggggatagggaggggggtaasactttgggaacaggtggtcccaggtcgtttcctggctagatttgccttgtctggctcctgcccctgagttgcacaggggaggtatggtggggtcttgccttctgtggagaagatgcttcattccyagcccaggttcccagcaagccccaaccatctccttctccctgatggttgcccatgggctcaggaggggacagatggatgcctgtgtcaggagcccctctctccctctcttggagagagtcctgagtgcccccccttcttgggggctttgtttgggaagctggatgagcctggtccatggagagtttaaaaagtcttttggtgttacctggtaatggggcacatctcagcccagatagggtgggagggagctgtgaaacacagggagggggttgctttcgggtatctactaggagtcarggtgaagcctagagaggatgaaagaaggggaggggatggggagtggtaagaacctaggatttgaattcccagcctggccaacccttgcagccatgtcttggcctcaagtggaacaagggctccttgaggccagcagggttgggggagttggggtgggcctgagcctctttcctgctagagctcttggtcctccctgcctccaccacccatccctgctctgcagaacccctgggtgctgagtggcaggagccccagggttgtcccatctgggtatggctggctgggtcactaacytctgtgatctgcttccttcctttccagattatgcggatcaaacctcaccaaggccagcacataggagagatgagcttcctacagcacaacaaatgtgaatgcaggtgaggatgtagtcayggattcattatcagcaagtggctgcagggtgcctgatctrtgccagggttaagcatgctgtactttttggccccygtccagcttcccgctatgtgacctttggcattttacttcaatgtgyctcagtttctacrtctgtaaaatgggcacaatagtagtatacttcatagcattgttataakgattaaacaagttatatrtgaaaagattaaaacagtgttgctccataataaatgctgtttttactgtgattattattgttgttatccctatcattatcatcaccatcttaacccttccctgttttgctcttttctctctccctacccattgcagaccaaagaaagatagagcaagacaagaaaagtaagtggccctgactttagcacttctccctctccatggccggttgtcttggtttggggctcttggctacctctgttgggggctcccatagcctccctgggtcagggacttggtcttgtgggggacttgtggtggcagcaacaatgggatggagccaactccaggatgatggctctagggctagtgagaaaacatagccaggagcctggcacttcctttggaagggacaatgccttctgggtctccagatcattcctgaccaggacttgctgtttcggtgtgtcagggggcactgtggacactggctcactggcttgctctaggacacccacagtggggagagggagtgggtggcagagaggccagcttttgtgtgtcagaggaaatggcctcttttggtggctgctgtgacggtgcagttggatgcgaggccggctggagggtggtttctcagtgcatgccctcctgtaggyggcaggcggcagacacacagccctcttggccagggagaaaaagttgaatgttggtcattttcagaggcttgtgagtgctccgtgttaaggggcaggtaggatggggtgggggacaaggtytggcggcagtaacccttcaagacagggtgggcggctggcatcagcaagagcttgcagggaaagagagactgagagagagcacctgtgccctgccctttcccccacaccatcttgtctgcctcyagtgctrtgcggacattgaagcccccaccaggcctcaaccccttgcctcttccctcagctcccagcttccagagcgarrggatgcggaaaccttccttccaccctttggtgctttctcctaagggggacagacttgccctctctggtcccttctccccctcctttcttccctgtgacagacatcctgaggtgtkytctcttgggcytggcaggcatggagagctctggttctcttgaaggggacaggctacwgcctgccccccttcctgtttccccaaatgactgctctgccatggggagagtagggggctcgcctgggctcggaagagtgtctggtgagatggtgtagcaggctttgacaggctggggagagaactccctgccaagtaccgcccaagcctctcctccccagacctccttaactcccaccccatcctgctgcctgcccagggctccaggacacccagccctgcctcccagtccaggtcgtgctgagcaggctggtgttgctcttggttccgtgccagctcccaaggtagccgcttcccccacaccgggattcccagaggttctgtcgcagttgcaaatgarggcacaaggcctgatacacagccctccctcccactcctgctccccatccaggcaggtctctgaccttctccccaaagtctggcctaccttttatcacccccggaccttcagggtcagacttggacagggctgctgggcaaagagccttccctcaggctttgccccctgccggggactgggagccactgtgagtgtggagacctttgggtcctgtgccctccacccagtctcggcttcccaccaaagccttgtcaggggctgggtttgccatcccatggtgggcagcgtgaggagaagaaagagccatcgagtgcttgctgcccagacacgcctgtgtgcgcccgcgcatgcctccccagagaccacctgcctcctgacacttcctscrggaagyrgccctgtgtggctttgctttggtcgttcccccatccctgcccaccttaccacttcttttactccccccaccgccccygctckctctctgtctctgtttttttattttccagaaaatcagttcgaggaaagggaaaggggcaaaaacgaaagcgcaagaaatcccggtataagtcctggagcgtgtacgttggtgcccgctgctgtctaatgccctggagcctccctggcccccagtacaacctccgcctgccattccctgtaaccctgcctccctcccctggtccytccctggctctcatcctcctggcccgtgtctctctctcactctctcactccactaattggcaccaacgggtagatttggtggtggcattgctggtccagggttggggtgaatgggggtgccgacttggcctggaggattaagggaggggacbctggcttggctgggcaccgattttctctcacccactgggcactggtggcgggcccatgttggcacaggtgcctgctcacccaactggtttccattgctctaggcttctgcactcgtctggaagctgagggtggtggggagggcagacatggcccaagaagggctgtgaatgactggaggcagcttgctgartgactccttggctgaaggaggagcttgggtgggatcagacaccatgtggcggcctcccttcatctggtggaagtgccctggctcctcacggaggtggggcctctggaggggagccccctattcyggcccaacccatggcacccacagaggcctccttgcagggcagcctcttcctcygggtcggaggctgtggtgggccctgccctgggccctctggccaccagcggcctggcctggggacacygcctccgggcttagcctcccatcacaccctactttagcccaccttggtggaagggcctggacatgagccttgcacggggagaaggtggcccctgattgccatccccagcaggtgaagagtcaaggcgtgctccgatgggggcaacagcagttgggtccctgtggcctgagactcacccttgtctcccagagacacagcattgccccttatggcagcctctccctgcactctctgcccgtctgtgcccgcctcttcctgcrgcaggtgtcctagccagtgctgyctctttccgccgctctctctgtcttttgctgtagcgctcvgatccttccagggcctgggggctgaccrgctgggtgggggtgcagctgcggacatgttagggggtgttgcatggtgattttttttctctctctctgctgatgctctagcttagatgtctttccttttgcctttttgcagtccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcaggttggttcccagagggcaagcaagtcagagaggggcatcacacagagatggggagagagagagagaaagagagtgagcgagcgagcgagcgggagagcgcctgagaggggccagctgcttgctcagtttctagctgcctgcctggtgactgctgccttctctgcttttaaggcccctgtggtgggctgcaggcactggtccagcctggcggggcctgttccgaggttgccctggttgcctgagtggtaggctggtgtggcttagtgtagtggtgtggacgcaagctgtgtgttgtgtcctgtggtccttctgctcatagtggctgttggtcctgatgttattactacctctggtagtaatgctgagaagctgaaagccgattccaggtgtggacaatgtcaacaaagcacagatgctctcgctggggccttgcctcggccctttgaagtctgcatggctgggcttctcactcactcagtgtttcttgctgggggaaggaattgagtctcccacttcagactgggcctccctgaggaaagggttgtgtctccccactcagactgaggttccctgagggtagggctgtgtctctcccctccgacctgggctccctgatagggctgtctccccgctcagactgaggctccctcaggccagggctatgtcwscctcctcagactggggctctgagggcaaggggtctggctgttcgtttaggatggggcasttttrcctacacactgaaggagctgtagcatccaasaatactagatacctttaatcctccaccagtcatggtgacaaccccaagcagcccacacattttcaagtgcccccaggatgcgtggagggaggggtctgtgcccattctmctgacattagcctgtgagctccgtaagcccgggcctcgtttacgtacctttgtgagccccgggcatctgtacctctttcctttgcccatactggggaccaaggaagtgtcaagtgcatgagtgaatgtgtgactcagttcagagggtgaggtcaggagcacagggtcgggacaggtggctggcatcttttaatgccttagcttatgttctttataccaacttggcctgtgctcagagtgagggaggccctgggggtcagggtaagcgtcagtcagggaggcaagactttgtggggatttcctagacagggccaaggcacccccagctcaccccgaggctgygttagggaagtccttggagtgtctcccctcccccagcratgttcttgtggcttgtgtgtgctcaggggatgctgggaaccaggcctgggtagttggtgtggggtgctgtctgtcttggccctatgtgaaaccaagagggcgtatattagtgctkgggtgggggctctgcctaacttcagggctggatgaggggagtctcagttccccaggggtccttgggaaagataagggacttgacattttagggtttttaggtgattattctgctgatgggggtttgtgtgaagtgacctgggagctaactgaagttactctaacctcycaatacctttacccaacccccaagctggctgtatctgggaatatcagtttccaaaattggaggcttaggactccgtttcggggctccccagaagggtagggcctgttctgcctccttctcacaatcacccaggggcaggggcatgctgagaaagttcttggaggccccctttgcttcagctggagtagtgaagccgccgaattgtctctccccatcctaagtgaagcagcatatttgaaaggaaagacaacctgttacctgggcctgcaacctccaggcagctcaagagagatgaggcctacagccacastgggaggggacatggggaatggagatggtccctcaccttcctggggcctcctgctctacgctaccccctcgggagcctcctgtccccagggcaggcccttgccattgttggtcacccggccaagcctctctgcctcaggcgttctcccagaagatctgcccactctcttccccacaccagcccctagagactgaactgaaaaccctcctcagcagggagcctcttctgattaacttcatccagctctggtcacccatcrgctcttaaaatgtcaagtggggactgttctttggtatccgttcatttgttgctttgtaaagtgttcccatgtccttgtcttgtctcaagtagattgcaagctcaggagggtagactgggagcccctgagtggagctgctgctcargccggggctycctgagggcagggctggggctgttctcatactggggctttctgccccaggaccacaccttcctgtcctctctgctcttatggtgccggaggctgcagtgacccaggggcccccaggaatggggaggccgcctgcctcatcrccaggcctcctcacttggccctaaccccagcctttgttttccatttccctcagatgtgacaagccgaggcggtgagccgggcaggaggaaggagcctccctcagggtttcgggaaccagatctctcaccaggaaagactgatacagaacgatcgatacagaaaccacgcygccgccaccacaccatcaccatcgacagaacagtccttaatccagaaacctgaaatgaaggaagaggagactctgcgcagagcactttgggtccggagggcgagactccggcggaagcattcccgggcgggtgacccagcayggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacacyggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagrccactggcagatgtcccggcgaagagaagagacayattgttggaagaagcagcccatgacagctccccttcctgggactcgccctcatcctcttcctgctccccttcctgggrtgcagcctaaaaggacctatgtcctcacaccattgaaaccactagttctgtccccccaggagacctggttgtgtgtgtgtgagtggttgaccttcctccatcccctggtccttccyttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccratcccctggctccccagcacacattcctttgaaataaggtttcaatatacatctacatactatatatatatttggcaacttgtatttgtgtgtatatatatatatayatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaagctcctcttggtttctccttctccattgaatccttgctctagacttcctcccgccccctttccctcttcctctggggaacatggcatttgtcttgggtctgggaaaggtacgtctaatgtgtaggatatggggtgacccaccttgttgtgctgggggcaaagtccttccattttggctgagctggtcctgggggaacccatccatcctgtcttgatatagaaggtgggaagctctgggaatgggtggagggggagaaacagcttaggagccaagggcccttgcaattggtagtgctgccttcaggaattagatgatccaggcccctgtcccttagccagggaaagaactggccatgtctccaagcttgctgcccaggagacaggagagagctgtttttgtctgtgggggtcttgttggctgcaacaggctgggagtgggagggggatgctgctggagggctgtgactccagggtgtaacttaattttacatagttttacaccctggagttccttgagcctctggaagatggacccataggtttggtcaccactgatgggacactccctgccccagcttgccataagctcttctctcacgtcctgctcctgggtaaggtggcacctatccaggtctttgacactgaagggcagtgcttccaaattcacttcctctagcctctcatttattcttgcaaaccatagatatggcttgaataaatattgagccagtcattgtgctgctatgaataagacacaattccacccctcaaggatctggtgaggatgggtgggtggggagacccaaaactataaatccatgagcagaaaaatacataaaatgtgctgggggcatctgatctagcttgggagtgggagttgtattgggggtggtggctggggggtggtgtcttatgacattatctctaggctgccacttaaagtatggtttgaagacagggagaacrgggcggcggagtgaaagggttgaggacatcccaggcagaagggatagtgtgagcaaggcatgaaggtggcacttgggcaggggcagggagtgggtgggcagggtggaggctggagacacgggcaagggttagctccaagggagcctgcagcaccatgccaagagcctagggcctgtcagggatgagcagcagccgaggggttttaaacactgagcggcycagtcagatagacttttccataggtgcctggcaacagtatgggaggcagagaggccggtagaggctgttgtggtcttccaggaggaattgtgctggtggtggggaagcacctttggtgactggcagtgcmggccattgcaaggtctcagcctcaggcagcttttggtctagtaagtgctcctttcccaatcactgaccacgtgccgacccctacattggttaacactgaatctgcacagcagccctgggaggtaggtgcttttttttttttttttttttttttgagatggagtcttgctctgtcacccaggctggagtacaatggtgcgatctcgggtcactgcaacctccgcctcccaggttcaagggattctccctcctcagcctccygagtagctgggattacaggcacgcaccatcatgcccgactaatttttgtgttttcgtagagacggggtttcaccatgttggccaggctggcctcaaacccttgacctcaggtgatctgcccgccttggcctcccaaagtgctggcattacagatgtgagccaccgcgcccggcaggtaggggcttttttcatcccatctggatttttgctggagcctttaaattggccgcctggcttctcctctggccttcckttagttgaatctcacacaactgccagagtgagcctgttaaaatgtgagttaagttttggcaccttttgactcaaaaccttccagagatagttttactcggagaaaaacccaaatggycttaaaaggcctgcaccatttgggctgcctccctgactactcaatgacttcgggccccgccttggccacgtggcttcagccatgctggtttcactgttcctcagatgcagtgggcatgctcctgccacagggcctttgcactggctgtcctctcttcctggagcactctttcctacacatgacccatgttgttggatccctcactttcaagtcttgttaccttctcagtgaggcttaccctgaccactgcatttacgattgaccccccttcccactccacacttgggtacctccttttcaccatcccttctttttccgcttagyacmtgtagccacctgacagactctagaacagtgctacccaacagaaatatagtgtgagccacttatggagtttaaaattttccaggcaccagagttcgaaagctataaaaaggtaaaattaattttaataatttattttagctccaacatatctagaatatcacttcaggatctaatcaatggaaacattattaatgagtttttttttttttttttttttttttttttttttttkagatggagtcttgctctgtcacccaggctggaatgcagtggtgcaatcttagctcactgcaagctctgcctcctgggttcaagtgattctcctgcctgaaccttccgagtagctgggactatgggcgcacacmaacacgtctggctaatttttgtatttttagtagaaatgggggtttcaccatattggtcaggctggtcttgaactcctgacctaagatgatccacctgcctcggcctcccaaagtgctgggattacaggcatgagccactgcgcccagcctattaatgagaaattgtatactcttttggtactaagtctttgcgtctgtccaagggcagaaattgggtgwaaagaaaaaataaatctttgaatctggtgggtgttttatatttatcgcatgtctcaattagttgtagccacgtttcgagtgcttaatatacacatggctagtggctaccatttcagacagaatagctttaaaatgtactcccccctttgtttgtctcccccaactagaatgcaagctccatgaaggaagagatttttgtctgttttgttcaatgtatctccagctcctggaacacagtacatgctcaataaacatttgttaaatgactgacattgttgaaactgaggcctggacctgaaggtttcatcccaagactacggaggtgagtacaggatttctacagaggtgccaggagttgttggtgagggttagctggacaggtggggacttaagtggggattgtctagaagaagtgaactcaaagtcagctggtagggattacagcagaggcctctttgtcagtgccagtaccgtctcctcttagccaccctggggatggggctcattattattgcttggcagatgagaagcaggaggctcagagaaggtaaataacttgcccgaatttacacgcagccagtaaatggccaagccagaatttaaaccagcttttctgactccaaatctagtgctctttttaccacaccacagctgcctcaggctagggcaggacatcaacaaataaaaatgaatcgtctagactcaatacaaacagggaagaagaaaagtgggacagggggaggatgtagtgctggccaaacccagggctgaaatccagacttccccaagtgtggtaaggcaaggcaaggcaagmaagagatgtctccaggggctggggctcgtcagtggaagatcggaaacctaagcatgcaagagattgcaacacacggccttagatgagagaaacagccttgaaacagaccacggagaaaagaaggagaacatgaaaatgccacctcccccagttgtataagacctgcccagatacccccctggagccattcccaaggatctctccagacctaagcaagtcccagggcctaccctgccttcccagatcatctcctctctgtgggactcacaccgcctggtctagccactgtttcctctggagctacccagtgctccttctcctctgtctagcctgagactctcccttctccaaggagctgcccatcctgctcccggccctgaaaggcctttagagagcctgctggcccactctcctccctcccacaagamctgaaaggctgacgggtggatccatacaaaacttggtgattctggatcaatttcgtgtgttaggatcattgtggtggccagtgtgcaaacatggctgtcaacagttctttccatccctgtgcccacgtgctttgccccccaagaagtagagtctatttttyctctttttgaatctgggccggctttatgacttgctttgaataaaaatgcaacacaagagagatattctgggactttcaggtctaggcattgtagtgtcaatttttgtcctcttgtaaggcagctgccaggctataactgtccaaatactctactggagagagagactgtggagagacagagagagataggggaagagaaacagagagatagaggaagagagagacagagatggagagagagagagaggctcagccaactcccagctgttccaaccacctgaagctgaggcaccagacatgtgagtgaagtcactttggattccctagcgccaggtgagccactctagccaacaacacataaagtagagagaagccatccctgccccartttagtgagttgtaagcaaatgtatgcactgtgttgtttaaagctactaagttttggggtggttattattcctcaataataactgagccatctaacaaaacagtcatttccttggcattagggtgtttgtcccttcccatccataaggtttaactggtattcatgaagtggatggagggatgttcaaggaaagaagggtgtgtttataagggaatcagagaccaggcatctgccatggtggtaagtttggtgagaagtcagggtaagggctgacccaggcaggacaaaatattgtcctaatttctagagtgaggaragtgacttggttgtactggagtcttaccaagagaaagtgggcctcacctacagcatgggggatagaggatagaggatgagaagaactgccagagagcacagcatgagggatttggaggaaaagactgtggaatccttttcttcccttcttccttccatcctccagcgtttatggaataccagccatatgtactatgccctggtgcagggatggtctctcatttactaggaggggctttagcatgagccagcctagaggtgggggatggatgggctgacccttggaaggctccatcaggttggcttcagagttgctgggagagagataattcagctacatccgcaggacattgtccattaggacatgggactaggggagggcagggaaggaatcagtaaatatttataatctgcctagaaaaggaaaatgcaaggcaaagacagggcttgactgagcatctgctgagaaggaacagaaggggtgacgtggaaggggaagagctagaacccagggagcagtgagtcagaggaaagggcccactaggcacaggtgcctatggtgcaaggctgggcttgagtctcccaggayaagagggggccrggatctgacaaagattttcaaaggctgcgtttgcctttggggagttagtctctctatgagggaagtgcaagtactgctcccagggagctcccagtctcaaggaggattgacatggccctggccctcaggatgctcccrgtccttacagagtatctaatctgagggaggagacagagcttctgccatcagacatttctttggatactagtttcgggaaggcaccaccctgccaccatttggctgttgcactgttcggagtcaccggatgctggtaccccatccttccctccactctcggtgcgcattcacaatgctcacagggcttctcttgtgtttgtcatcagccatgcgtggctcaccagcctgggccctgattttctccacacatcccctgacggtccctgggtctggctccaagtggagcagatgctagcacat

SEQ ID NO: 13242 - DNA, 21608 bp, Homo sapiens
atcattatcaatctgtctttcaagaagacataggtagtgagaataaaagtgagaactcccactaatgagtgagattctcaaagggggtgaataagtgaggcgaccacccctcatattgtcttatgcccaatttytgcctccaaagaaagaaaaagtaaaagctaaaaggcagaaatgaaatccacaggcagacagcctggtgttgcaccctgggtctggttaaagattgacccccgacctaaccggttatgttatctatagattccagacattgtrtggaaaaacactgtgaaaatccctgttctgttctgattactggtgcatgcagctgccagtcacatacccccacttgctcagtcgatcatgaccctctcacacagacccccttagagttgcaagcccttaaaagggacaggaattgctcactcagggagctcggtttttggagatgtgagtcttgccaaagctcccagctgaataaagcccttccttctttaactcagtgtctgaggggttttgtctgtagcttgtcctsctacaaaaataagtgttaaacatgagttttatattacctcataggtggaagaagacaggccaaaaaagctgttttaacaacaacaaaatgcacaaatatttatactaacaagacagatatccattgcagtatgacacgagaaacaaataaatgagacaagcagtcaattcagacattttaggaagtgatttttacagaacatagtgacaattgctgagatctggtagccttgcaagattcctttgttataataaaaataacattggcaaagaccattttatgatgcagacttctgcttttttaaagtttggggggaaggggaaacatttttattctataatgctgaaatttcatttttcttttctcttttttaagaccaagtcttgctctctcaccaaggctagagtgcagtggcgtgatctcagttcactgcaacctccacctcccgggttcaagcaattctcctgcctcagcctcctgagtagctgggactacaggcaccatgcccggctaggataacattttttgtttttagtagagatggggtttcaccatgttggccagagtagtctagaactcctgacctcaagtgatctgcccgcctcatcctcccgaagtgctgagattacaggtgtgaggtacagcatctggcctcatgctgagatttctttcattaccagttcaaacacctttcacttttcaaggcacaaggagaggaattccatgygttgacrctgggaggaagggtacagacctacttaaaagattcaaaacttctatgacagtaaaagaaatgtatatcaagttccttagggctgccgtaacaaagtactatcaactgggtggcttagaacaaaagaaatttattctctcacagttacgtaggccagttgagatcaaggtattatcagggccaagatccctctgtagcctctggggaaggattctttcttgcctgtttccacttctagcagcttcctgtgtttggtttgtggcagcataactccaatctctgcctccatctctacctggccatcatccctctgtgtctgtgaggaccccagtcattggttggaggactcaccctattccactataatctcttcttaaccagtgaactcaccgtattccagataaggtcaggttcacagstactgagggttaggacagagtatcttttggggagatgcaattcatcccataagtgggtggaaaaggatgattaacaagtggtatgtggggatgtattgttttgcatctacgtagctctcaccccatttctttccacaacacacatttgtcactctattctttattaggtttacagagaaaagtagatcttcaaccactttcctgggatgtggatacagctctttttttggagacagggtctcattctgtcacctagactggtgtgcagtagcactatcatggctgactacagcctcaatgtcccaggcttaagtgatcttcccaacctcctgagtggctgggaccacaagtgtgtgccaccacacctgactaattttatttttyaattgttttgtgaagacagcatctccctatgtttcccaggctggtcttgaattcctgggctcaagccatcctcctgcctcggcctcccaaagtgctgggattacaggcaagagcctccatgcctggccttcaactcttgaccttatgaacacagccctataccagttcccttcatgcatgtgcctataagctaaaccctttcccaagtgtacatgaaaatctgaaccccaacaaatatggcctaattctaaatctgactttcccaggagtaatttttgtcatttccagcttaccagcctttgtgagtgttgaatttcagcatttctgtttgcttgcagcagaaggtggagcmaggatagggtggctcaagattagagtttcttcyttaacagttcagtcaactttttaatcttggatttatagcttcctacctgctctcttaaaggtgaaatgatctattcaccttcagaccatttgccctcggggtctcactgagcaatctatggcttaagtcttctaagtctcttaatggccaaatacaatggacaattttcaggtatatctgacaccatttctctgcagcctttggcacctataaccactccatggcttccacaatgtgattggtcatttcttttttgtttatatgacaagtttttattcttcttctgcctgttaaatgcgcctgacccccagtrttctgattttcactatttttcttaaaaaaaaaagtttaaatgaaaaaagtttcttatgaaaatattaaaacatatacaaaaatagaatagacattgataatagatcctaaaattcctagggaaattcagcagactgagaatagctaatatagtcttccaaaaaaagatcaaatttgaagttgagaaacttcttgaattcaatttactaaaaagctatagtaatcaagacagtgtagtcctgacataaagataggattatagtctgggtgtggtggctcatgcctgtaatcccagcactttgggaggctgaggkgggcaratcacctgaggtcaggagttccagaccagcctgaccaacatggtgaaaccccgtctctactaaaaatacaaaaattaaccaggcatggtggcaggtacctgtaatcccagctgcttgggaggctgaggcaggagaattgcttgaacctgggaggaggagccagtggccgggattgggccactgcactccaacctgggcaatagagtgaggctctgtcaaaaaaaaaaaaagataggattatagattatagcataatgggataaaattgagactccagaaataaactctcacatttatggtagattgatttttgataagggtgccaaaacacttcaatgaaaaaagagtcttctcaacaagtgatggtggaacaactgaataaccacatttttgttctatctggggccctgattcaaaaacccaggcaaagatggagagaaatcagaactctcatacactgctgataggaggataaaatgcttactttggaaaagaatgtggcaattcctcaaaaggttaaacagtgttaccatatgacccagcaaacccacttctagatatataaccaaaagaaatcaaaacataagtctacaaaaaaacttgtacataaatgtttataacagcactattcccaatagccataaagtagaaacaaaccaatgtccatcggctgatgaatgaataaataaaatatgttgtggtatgtccttataatagatattattggtccatgaaaaacatacataaaaacattatgctaaatgaaagaagccagtcacggcaaagcaatatattatatgcctctatgtatactaaatgttccaaatagaaagaaagtagattaaagattgtctagggcygggaggggaggaggaggagaatggaggaatctgggaggcgatgaattaagggtactgaattaggggaacatggtttctttttggggagatagaaatgtaaaattttggtaatggttgcacatctctgtaaatatactaaaatccattaatttttgcattttattttatttattttatttttgagacggagtttcgctcttgttgcccaggctggagtgcaatggcatgatctcggctcaccacaacctccgcctcccaggttcaagcgattctcctgtctcagcttcccgagtagctggaattacaggtgcatgccaccacacccagctaattttttttttttgagatgaagtcttgctcttgtctcccatgctggagtgygatggcacgatcttagctcactgcaacctmcgcctcccgggttcaagcgattctcctgcctcagcctctaatgtagctgggattacagttgcctgctatcacgcccggctaatttttgtatttttagtaaagacggggtttcaccatgttggccaggctggtctcgaacccctgatctcaggtgatctgccttcctcggccgcccaaagtgctgggattacaagcgtgagccactgagcygggccaatttttgcattttacatagatgaattatatggtatgctaattatatcttaccaaaaattgaaaaaaaggaatagtactatcagccccaatgtgcccatcatcaatattctacatgtttccaatgttattgtatctgtttgcctacagtcgaggccctgatatcctgtttgattttcttgaattgccaaaatttgcatacatgcttacaaaaataatgcctgttgaatttgctagatatgtaaaggtttggagcaaatcaggtgtattaaatttattaatattgtttgaaatgtctaaggcaataattcccaaacttcgttgagggagaaggaaagcttttaaaatcccattgcccaggtggcatcccatactgttactgggaattatgcattgggatggatcctttaaccgaggagattattatagccggagctctgaascagcaatctcagttcttgtgatagtgagcaaagaactacaaactaacaccaaaatgcaagcttaaagcaaagtttattgaagcacaataatacactctgagggacagcgggcttatttctgcgaagtgaactcagcacttctttacagagctcaaggtgcttttatggggtttgtggggaggagttgaggtttgggctgtatctgagtgacaggatgatgttatttgattgaagtktatagctatacaatctaaaattaaactgtgcatggtcttacctataatttgttaagaaaagcctcccagggatgggggggcaaaactgtatgtaaattctattataatgatggcatgatgaacttggggtgaacttgaagacaggcttttgtgttgttgggcatgtgccaccttagggaatttccacctgtaccctcctttctctttctccaggatattttggccacagactttatcataaactccatcccttagggtggcattagggtagtcttgggcctgaatttaggtgggccagtggctgtcttagtgacagcctttccgctctcttctgtcatcccctcccaactgctaatgtctaactacctaacaattacccattaaatcagtgtgtctggggttaggagcaggcctcaatatgtttaatcattctccagataatcccaatactgtaaagtttgtgaaacacttgtcagataattcaattatgaaggctgtggaasgtgtttcagtaggatctaattggttaatgttatgacttaattaatttgaatcaaaaaacaaaatgaaaaagctttatatttctaagtcaaataagacataagttggtctaaggttgagataaaatttttaaatgtatgattgaattttgaaaatcataaatatttaaatatctaaagttcagatcagaacattgcgaagctactttccccaatcaacaacaccccttcaggatttaaaaaccaagggggacactggatcacctagtgtttcacaagcaggtaccttctgctgtaggagagagagaactaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccagsccggcgcttctcctcctgatgcttttgcagaccgcggtcctgcaggggcgcttgctgcgtgagtccgagggctgcgggcgaactaggggcgcggcgggggtggaaaaatcgaaactagctttttctttgcgcttgggagtttgctaactttggaggacctgctcaacccwatccgcaagcccctctccctactttctgcgtccagaccccgtgagggagtgcctaccactgaactgcagataggggtccctcgccccaggacctgccccctcccccggctgtcccggctctgcggagtgacttttggaaccgcccactcccttcccccaactagaatgcttttaaataaatctcgtagttcctcacttgagctgagctaagcctggggctccttgaacctggaactcgggtttatttccaatgtcagctgtgcagttttttccccagtcatctccaaacaggaagttcttccctgagtgcttgccgagaaggctgagcaaacccacagcaggatccgcacggggtttccacctcagaacgaatgcgttgggcggtgggggcgcgaaagagtggcgttggggatctgaattcttcaccattccwcccacttttggtgagacctggggtggaggtctctagggtgggaggctcctgagagaggcctacctcgggcctttccccactcttggcaattgttcttttgcctggaaaattaagtatrtgttagttttgaacgtttgaactgaacaattctcttttcggctaggctttattgatttgcaatgtgctgtgtaattaagaggcctctctacaaagtactgataatgaacatgtaagcaatgcactcacttctaagttacattcatatctgatcttatttgattttcactaggcatagggaggtaggagctaataatacgtttattttactagaagttaactggaattcagattatataactcttttcaggttacaaagaacataaataatctggttttctgatgttatttcaagtactacagctgcttctaatcttagttgacagtgattttgccctgtagtgtagcacagtgttctgtgggtcacacgccggcctcagcacagcactttgagttttggtactacgtgtatccacattttacacatgacaagaatgaggcatggcacggcctgcttcctggcaaatttattcaatggtacackgggctttggtggcagagctcatgtctccacttcatagctatgattcttaaacatcacactgcattagaggttgaataataaaatttcatgttgagcagaaatattcattgtttacaagtgtaaatgagtcccagccatgtgttgcactgttcaagccccaagggagagagcagggaaacaagtctttaccctttgatattttgcattytagtgggagagatgacaataagcaaatgagcagaaagatatacaacatcaggaaatcatgggtgttgtgagaagcagagaagtcagggcaagtcactctggggctgacacttgagcagagacatgaaggaaataagaatgatattgactgggagcagtatttcccaggcaaactgagtgggcctggcaagttggattaaaaagcgggttttctcagcactactcatgtgtgtgtgtgkggsggggggggcggcgtgggggtgggaagggggactaccatctgcatgtaggatgtctagcagtatcctgtcctccctactcactaggtgctaggagcactcccccagtcttgacaaccaaaaatgtctctaaactttgccacatgtcacctagtagacaaactcctggttaagaagctcgggttgaaaaaaataaacaagtagtgctggggagtagaggccaagaagtaggtaatgggctcagaagaggagccacaaacaaggttgtgcaggcgcctgtaggctgtggtgtgaattctagccaaggagtaacagtgatctgtcacaggcttttaaaagattgctctggctgctatgtggaaagcagaatgaagggagcaacagtaaaagcagggagcccagccaggaagctgttacacagtccaggcaagaggtagtggagtgggctgggtgggaacagaaaagggagtgacaaaccattgtctcctgaatatattctgaaggaagttgctgaaggattctatgttgtgtgagagaaagagaagaattggctgggtgtagtagctcatgccaaggaggaggccaaggagagcagattcctgagctcaggagttcaagaccagcctgggcaacacagcaaaaccccttctctacaaaaaatacaaaaattagctgggtgtggtggcatgcacctgtgatcctagctactcgggaggctgaggtggagggtattgcttgagcccaggaagttgaggctgcagtgagccatgactgtgccactgtacttcagcctaggtgacagagcaagaccctgtctcccctgaccccctgaaaaagagaagagttaaagttgactttgttctttattttaattttattggcctgagcagtggggtaattggcaatgccatttctgagatggtgaaggcagakgaaagagcagtttggggtaaatcaaggatctgcatttggacatgttaagtttgagattccagtcaggcttccaagtggtgaggccacataggcagttcagtgtaagaattcaggaccaaggcwgggcacggtggctcacttctgtaatcccagcactttggtggctgaggcaggtagatcayttgaggtcaggagtttgagacaagcttggccaacatggtgaaaccccatgtctactaaaaatacaaaaattagcctggtgtggtggcgcacgcctatagtcccaggttttcaggaggcttaggtaggagaatcccttgaacccaggaggtgcaggttgcagtgagctgagattgtgccactgcactccagcctgggtgatagagtgagactctgtctcaaaaaaaaaaaaaaaaaaaaaaaaaaaaactgaaggaattattcctcaggatttgggtctaatttgccctgagcaccaactcctgagttcaactaccatggctagacacaccttaacattttctagaatccaccagctttagtggagtctgtctaatcatgagtattggaataggatctgggggcagtgagggggtggcagccacgtgtggcagagaaaagcacacaaggaaagagcacccaggactgtcatatggaagaaagacaggactgcaactcacccttcacaaaatgaggaccagacacagctgatggtatgagttgatgcaggtgygtggagcctcaacatcctgctcccctcctactacacatggttaaggcctgttgctctgtctccaggttcacactctctgcactacctcttcaygggtgcctcagagcaggaccttggtctttccttgtttgaagctttgggctacrtggatgaccagctgttcrtgttctatgatsaygagwgtygccgtgtggagcccygaactccatgggtttccagtagaatttcaagccagatgtggctgcagctgagtcagagtctgaaasggtgggatcacatgttcactgttgacttctggactattatggaaaatcacaaccacagcaagggtaygtggagagggggcctcaccttcctgaggttgtcagagcttttcatcttttcatgcatcttgaaggaaacagctggaagtctgaggtcttgtgggagcagggaagagggaaggaatttgcttcctgagatcatttggtccttggggatggtggaaatagggacctattcctttggttgcagttaacaaggctggggatttttccagagtcccacaccctgcaggtcatcctgggctgtgaaatgcaagaagacaacagtaccgagggctactggaagtacgggtatgatgggcaggaccaccttgaattctgccctgacacactggattggagagcagcagaacccagggcctggcccaccaagctgbagtrggaaaggcacaagattcgggccaggcagaacagggcctacctggagagggactgccctgcacagctgcagcagttgctggagctggggagaggtgttttggaccaacaaggtatggtggaaacacacttctgcccctataytctagtggcagagtggaggaggttgcagggcacggaatccctggttggagtttcagaggtggctgaggctgtgtgcctctccaaattctgggaagggactttctcaatcctagagtctctaccttataattgagatgtatgagacagccacaagtcatgggtttaatttcttttctccatgcatatggctcaaagggaagtgtctatggcccttgctttttatttaaccaataatcttttgtatatttatacctgttaaaaattcagaaatgtcaaggccgggcacggtggctcacccytgtaatcccagcactttgggagkccgaggcgggtggtcacaaggtcaggagtttgagaccagcctgaccaacatggtgaaacccgtctctaaaaaaatacaaaaattagctggtcacagtcatgcgcacctgtagtcccagctaattggaaggctgaggcaggagcatcgcttgaacctgggaagcggaagttgcactgagccaagatcgcgccactgcactccagcctaggcagcagagtgagactccatcttaaaaaaaaaaaaaaaaaaaaaagagaattcagagatctcagctatcatatgaataccaggacaaaatatcaagtgaggccacttatcagagtagaagaatcctttaggttaaaagtttctttcatagaacatagcaataatcactgaagctacctatcttacaagtccgcttcttataacaatgcctcctaggttgacccaggtgaaactgaccatctgtattcaatcattttcaatgcacataaagggcaattttatctatcagaacaaagaacatgggtaacagatatgtatatttacatgtgaggagaacaagctgatctgactgctctccaagtgacactgtgttagagtccaatcttaggacacaaaatggtgtctctcctgtagcttgttttyttctgaaaagggtatttccttcctccaacctatagaaggaagtgaaagttccagtcttcctggsaagggtaaacagatcccctctcctcatccttcctctttcctgtcaagtgcctcctttggtgaaggtgacacatcatgtgayctcttcagtgaccactctacrgtgtcgggccttgaactactacccccagaacatcaccatgaagtggctgaaggataagcagccaatggatgccaaggagttcgaacctaaagacgtattgcccaatggggatgggacctaccagggctggataaccttggctktaccccctggggaaragcagagatatacgtvccmggtggagcacccaggcctggatcagcccctcattgygatctggggtatgtgactgatgagagccaggagctgagaaaatctattgggggttragaggagtgcctgaggaggtaattatggcagtgagatgaggatctgctctttgttaggggrtgggcygagggtggcaatcaaaggctttaacttgctttttctgttttagagccctcaccgtctggcaccctagtcattggagtcatcagtggaattgctgtttttgtcgtcatcttgttcattggaattttgttcataatattaakgaagaggcagggttcaagtgagtaggaacaagggggaagtctcttagtacctctgccccagggcacagtgggaagaggggcagaggggatctggcatccatgggaagcatttttctcatttatattctttggggacaccagcagctccctgggagacagaaaataatggttctccccagaatgaaagtctctaattcaacaaacatcttcagagcacctactattttgcaagagctgtttaaggtagtacaggggctttgaggttgagaagtcactgtggctattctcagaacccaaatctggtagggaatgaaattgatagcaagtaaatgtagttaaagaagaccccatgaggtcctaaagcaggcaggaagcaaatgcttagggtgtcaaaggaaagaatgatcacattcagctggggatcaagatagccttctggatcttgaaggagaagctggattccattaggtgaggttgaagatgatgggaggtctacacagacggagcaaccatgccaagtaggagagtataaggcatactgggagattagaaataattactgtaccttaaccctgagtttgcktagctatcactcaccaattatgcatttctaccccctgaacatctgtggtgtagggaaaagagaatcagaaagaagccagctcatacagagtccaagggtctttygggatattgggttatgatcactggggtgtcattgaaggatcctaagaaaggaggaccacgatctcccttatatggtgaatgtgttgttaagaagttagatgagaggtgaggagaccagttagaaagccaataagcatttccagatgagagataatggttcttgaaatccaatagtgcccaggtctaaattgagatgggtgaatgaggaaaataaggaagagagaagaggcaagatgrtgcctaggtttgtgatgcctctttcctgggtctcttgtctccacaggaggagccatggggcactaygtcttagctgaacgtgagtgacacgcagcctgcagactcactgtgggaaggagacaaaactagagactcaaagagggagtgcatttatgagctcttcatgtttcaggagagagttgaacctaaacatagaaattgcctgacgaactccttgattttagccttctctgttcatttcctcaaaaagatttccccatttaggtttctgagttcctgcatgccggtgatccctagctgtgacctctcccctggaactgtctctcatgaacctcaagctgcatctagaggcttccttcatttcctccgtcacctcagagacatacacctatgtcatttcatttcctatttttggaagaggactccttaaatttgggggacttacatgattcattttaacatctgagaaaagctttgaaccctgggacgtggctagtcataaccttaccagatttttacacatgtatctatgcattttctggacccgttcaacttttcctttgaatcctctctctgtgttacccagtaactcatctgtcacyaagccttggggattcttccatctgattgtgatgtgagttgcacagctatgaaggctgtrcactgcacgaatggaagaggcacctgtcccagaaaaagcatcatggctatctgtgggtagtatgatgggtgtttttagcaggtaggaggcaaatatcttgaaaggggttgtgaagaggtgttttttctaattggcatgaaggtgtcatacagatttgcaaagtttaatggtgccttcatttgggatgctactctagtattccagacctgaagaatcacaataattttctacctggtctctccttgttctgataatgaaaattatgataaggatgataaaagcacttacttcgtgtccgactcttctgagcacctacttacatgcattactgcatgcacttcttacaataattctatgagataggtactattatccccatttcttttttaaatgaagaaagtgaagtaggccgggcacggtggctcacgcctgtaatcccagcactttgggaggccaaagcgggtggatcacgaggtcaggagatcgagaccatcctggctaacatggtgaaaccccatctctaataaaaatacaaaaaattagctgggcgtggtggcagacgcctgtagtcccagctactcggaaggctgaggcaggagaatggcatgaacccargaggcagagcttgcagtgagccgagtttgcgccactgcactccagcctaggtgacagagtgagactccatctcaaaaaaataaaaataaaaataaaaaaatgaaaaaaaaaagaaagtgaagtatagagtatctcatagtttgtcagtgatagaaacaggtttcaaactcagtcaatctgaccgtttgatacatctcagacaccactacattcagtagtttagatgcctagaataaatagagaaggaaggagatggctcttctcttgtctcattgtgtttcttctgartgagcttgaatcacatgaaggggaacagcagaaaacaaccaactgatcctcagctgtcatgtttcctttaaaagtccctgaaggaaggtcctggaatgtgactcccttgctcctctgttgctctctttggcattcatttctttggaccctacgcaaggactgtaattggtggggacagctagtggccctgctgggcttcacacacggtgtcctccctaggccagtgcctctggagtcagaactctggtggtatttccctcaatgaagtggagtaagctctctcattttgagatggtataatggaagccaccaagtggcttagaggatgcccaggtccttccatggagccactggggttccggtgcacattaaaaaaaaaatctaaccaggacattcaggaattgctagattctgggaaatcagttcaccatgttcaaaagagtcttttttttttttttgagactctattgcccaggctggagtgcaatggcatgatctcggctcactgtaacctctgcctcccaggttcaagcgattctcctgtctcagcctcccaagtagctgggattacaggcgtgcaccaccatgcccggctaatttttgtatttttagtagagacagggtttcaccatgttggccaggctggtctcgaactctcctgacctcgtgatccgcctgcctcggcctcccaaagtgctgagattacaggtgtgagccaccctgcccagccgtcaaaagagtcttaatatatatatccagatggcatgtgtttactttatgttactacatgcacttggctgcataaatgtggtacaascattctgtcttgaagggcaggtgcttcaggataccatatacagctcagaagtttcttctttaggcattaaattttagcaaagatatctcatctcttcttttaaaccattttctttttttgtggttagaaaagttatgtagaaaaaagtaaatgtgatttacgctcattgtagaaaagctataaaatgaatacaattaaagctgttatttaattagccagtgaaaaactattaacaacttgtctattacctgttagtattattgttgcattaaaaatgcatatactttaataaatgtayattgtattgtatactgcatgattttattgaagttcttgttcatcttgtgtatatacttaatcgctttgtcattttggagacatttattttgcttctaatttctttacattttgtcttacggaatattttcattcaactgtggtagccgaattaatcgtgtttcttcactctagggacattgtcgtctaagttgtaagacattggttattttaccagcaaaccattctgaaagcatatgacaaattatttctctcttaatatcttactatactgaaagcagactgctataaggcttcacttactcttctacctcataaggaatatgttacaattaattyattaggtaagcatttgttttatattggttttatttcacctgggctgagatttcaagaaacaccccagtcttcacagtaacacatttcactaacacatttactaaacatcagcaactgtggcctgttaatttttttaatagaaattttaagtcctcattttctttcggtgttttttaagcttaatttttctggctttattcataaattcttaaggtcaactacatttgaaaaatcaaagacctgcattttaaattcttattcacctctggcaaaaccattcacaaaccatggtagtaaagagaagggtgacacctggtggccataggtaaatgtaccacggtggtccggtgaccagagatgcagcgctgagggttttcctgaaggtaaaggaataaagaatgggtggaggggcgtgcactggaaatcacttgtagagaaaagcccctgaaaatttgagaaaacaaacaagaaactacttaccagctatttgaattgctggaatcacaggccattgctgagctgcctgaactgggaacacaacagaaggaaaacaaaccactctgataatcattgagtcaagtacagcaggtgattgaggactgctgagaggtacaggccaaaattcttatgttgtattataataatgtcatcttataatactgtcagtattttataaaacattcttcacaaactcacacacatttaaaaacaaaacactgtctctaaaatccccaaatttttcataaactcagttttaaactaactttttttcaaaccacaatctgatttaacaatgactatcatttaaatatttctgactttcaaattaaagattttcacatgcaggctgatatttgtaattgtgattctctctgtaggctttgggtataatgtgttcttttccttttttgcatcagcgattaacttctacactctaacatgtagaatgttactacaatattaaagtattttgtatgacaattttatttgaaagcctaggatgcgttgacatcctgcatgcatttattacttgatatgcatgcattctggtatctcaagcattctatttctgagtaattgtttaaggtgtagaagagatagatatggtggatttggagttgatacttatatattttctatttcttggatggatgaatttgtacattaaaagttttccatggcagaaatcttttcaaaaactttttttttccgggatggattgaaggccctgatttcaccacaatgcaatatattaatgtagcaaaattgtacttgtaccccatgaatatatataatcttaagaaaatttttttagccaattattattacttactagatattaggctgtgttctgaatcttaatttaattcytccaaagaatcttatgaggtaggtaggagctattgctgctattctgttatgcttatgttgctgttatgaaaccaaggcacagagaggttagttaacttgctgaagaaaatgatgtgctggatttttattctagctattctggaataacaactacacaaccttatgtctgagccaaggaaacatacggtgtggcaacagttaccatgtttttaggaacagcagcactcctaatgtttgctgcagggaaaaaggaatctcagaatttgcctgatccctataatttttttcctaaatattttgaaatatctttcagatgtattttaaaatttaaggatattttgttcagttcatacagaatttttttttttttctcgagatggagtctcactctatcacccaggctggaatgcagtggcatgatctcggctcactgcaacctctgcctcctgggttcaagcaattttcctgcctcagcctcccaagtggctgagactacaggcgcatgccaccatgcacggctaakkttttttgtatttttagtagagatggagtttcaccatgttggccaggctggtctcgaactcctgacctcaaatgatccgccctttttggcctcccaaagtgctgggattacaggcgtgagctaccgcgcccagccaaatttctaacttgttttgttgttgttgagacagggtctcagtctgacaccaaggctgrtgtgcagtactgcgatcacggctcactgcagtctcgacctcctgagctcaagtgatcctcccacctcagcctactgagtagctgggaccaccacgcctggctcatttttttctattatttattgaaacgggttctggctatgttgcccaggttggtcttgaactccggagctcatgcgatccacccacctcagcgtccgaaaggattatcaggagtgagccaccgtgcccggccaaatttctaacttttgaattgacatattcatttattctctttatcattcagggagaaatttggggatggatagccttgaagcatcatccaccaagttattttatacaccagatttagatacaaagtatttttttattatttaaaaaaatcaaattctagcttttactctgaagattctaaaaagaattttggagtctttaaytcatacttcaggggcaggggaataagtaccaatattcgtataactttcagtgcaagtcacgttagctaactgtagtctattgagttaaatatccttgatttattccttaaaactragtcactatgacggcacttttttgtttttttttttcgagacggagctcgccctgtctcccaggctggagtgcggtggtgcgatctcggctcactgcaatctccgcctcccaggttcaagcgattctcctgccccagcctcctgagtagctgggactacaggcacacaccaccacrcccagctaatgtttgtatttttagtagagacagggtttcatcattttggtcaggctggtcttgaactcctgacctcgtgatcagcctgcctcgacctcccaaagtgctgggattacagtcatgagccactgcacccggctgaatggcactttcataaaacagtaaataaccaacttcactactgcccccaagagttttactatgtatatgagggcatctgttttaagtatgggtataatgttacgggtttttctttgtgtaagtttgggttcacaatttcatcattaaaacaaatgtaaaatactttgtgctttctgtgtgctattaagaaagtattcaagggaattttgaaaatcaaatttaattactctcatgtttgtaaaatttttgaaacaaatgtttaagagaggataatgttagaaattatctttccagccagacctggtggctcacgccagtaatcctagcattttgggaggacaaggtgggcagatcacttaagcccaggaattcaagaccagcctggacaacacagggaaagcccatctctacaaaatatacaaaattagtggccgagcgtggtggctcacgcctgtaatcccagcactttgggaggccgaggcgggcagatcacctgaggtcaggagttccagaccagcctcaacatggagaaaccccgtctctactaaaaatacaaaattagctgggcgtggtgatgcatgcctgtaatcccagctactcgggaggctgaggcaggagaattgcttgaacctgggaggtagaggttgcggtgagccgagatcccgccattgcactccagcctgggcaacaagagcgaaactccatctcaaaaaacaaaacaaacaaataaacaaaattagtcaggtgtggttgtgcacacctgtagtcccagctacttgggaggctgaggtgggaggatcacttgagcccggggaagtgtaggctaccatgagccatcatggtgccactgtactccagtctaggaaaaaaataaacattaaaaattttaaaatcttaaaaaaagaaaagaaattttctgtccagatatctttatttttaacaaatcgaagtgtattaatagtgtttatgggagcgtgcccacacaaggacagcaagcctaggaagtgcaagtcaagaaaactttttgtgaaataatttaaactgaaaagaaaaagcagagatttttttctagaaaagtaaggagtggaggtaaaaaaaaamcacagcagagacacaggtatgctacggaaccaaaggtgtgccaatggtactgacagtttaattcagaaaaaaatgaatcagaaaatggatatttttaaataagttaggttgctgaaaaagagaaatgcagtgaagccttagatgggagtgagataaatcagccattggctagaggagtttcttgcccaagaccagtggtgatgtccccaaatgcctggaaacaactgttgtgacattataaagcccccatagtctaagttgggtgagactatacttatgcattttctcacctgtaatatagcttaaaagtatttctactctgggatttctttacattttactaaagcgcaattatatacttaaaactgatagtgtatgctgggctgctagtcattctcaaccctggccaattatcagaattgtttgttgaatatataggtgccatatataggtgcatacacacacacacacacacacatacacacacacacacacacacacacaccatatttcattcctcatatcgaatattctgagagagttagtttgtggagggtagttctggacaatttatattttcataacacctctggttatttttttttaagtagagatgaagacttgctatgttgcccaaaatggtcttgaactcctgagctcaagcgattctcccaactcagcctcctgaagtgctgggattacagccgtgagccactgcattaacctctgattaatatcatagattaacctctgattaatatcatagatttatttgtttgaatgcttcatgtatcctctcaaccacaacttgtttgcagagttttaatctgaagggcttaggtctcttgttcaatgaatgagtttgatctgatgggtgagaggaaggtgaaatggaaagcgaacgagaagccatacagattaggcgagtgagcctaatctctccctaaccataagattgagtatgcctgaattcttcscagagtggaagaatccattttaaatatatatatctacatgtacagatcctttaaatatttgttctgacattcattgtttttgagtcactgtcattgagaaaagtttagaaaggagatattaggagcaggaaatagaaagtaaataaaatatcaaaataaaaatggggttttataaatgatataataggcaaaataaaggaaaggcatcctagacctctggttaaaatgaagatggcacttggcgagatgtgttccagggtagttcacatgatgtatgttttcagagaattrtcatattgcatatgctgctatattttttattttcatgaattaaaaggcatgttgagatttcagagttttacttatgatctcagactctgcattttttctctgtaatgtttgacatttcttcctagctaagtctctagttataaggtctgtgttgtggcatgtggacagtgagtggaagaacctaagaactcaatttggggcagaagaatgtaatcaattatttcagaagtgatacaaacaatatgacatgtagagcattctggcctttcctgggtcttttttctccattcctggatttcttctcttcatgtgagcaagtctgaggttactatataatgtctctcacaggc

SEQ ID NO: 13243 - DNA, 53328 bp, Homo sapiens
acatgggacaattgataaaaagctaaattgtaaacagtccttgccccagaggacccatggtcttagggcagatgtttacatatatgacagtaatgtaatgtagaatgtgaagagtaccatgacagagttttggagaacaatgtgctgtagaaattcagaaaagggacagctcatttctagttggtgaaagccttcatgaaagtggcaaagttgaacctgagaggcatatttagagggcaaagattgaggtgagggcattctagccagaagtgctagggaactttaattgagcayatactctgtgccaagaactgtaccaagaactttacacatacatgactcatttaatcttcataactctgtaaggtaggtactgtcatcccgatttaccagtgtggaaaatgaggctctagagcagtgcccggtagacttttcacaacgatggaaatgctcaaatatctgcactgtccaatacagttgtgactagccacttgtggccmctgagtgctgaaatgtggctaatgtgactgaggaactaaatttttgattttatttaattaattagaatttaaatttaaatagccatacctggctaatggttaccccactrgatagcaggctgtagagagcttaggtagcttgtcctagtcacacagtggtaggttcaaacccaggcctgttggacctcaaaacttgaggtcttaacctcagtgttctacagtatggtaaaggcctagaggaggcttcagttctgttcctcgtatcaggcaaaacatgactgcaaaaccatagagggagtaacataacttaagcaaagattgaagatgggaagttgctggcaagaagatacagtttgaaggggagtggaaaatgtgtagaacrgagtatctgatgctggtgtctgtgatttgcagctgttttttctcccctagttaaaaatgggctttgagtgagccttgaacctgtcttggactaattcagaaagcctccaagagattgcccccttagataagtccagtaaatgtagttgtctacatttttcaaaaagataaatgggaacaagtgtgctacgagattcagacatctgacgtgatgttttcgttgttgcctcagcaacagatgcggttatgaacattgacaacataagcacacgattgcagatacacataggcgtataaagcacacaaaaagaagattctctgaatggttttgtgcttatgatgtattttcaatattgagtaattatcaagatactaatttatagttatatagcattttatagttaacaaaatatttgaaatggcatatttttttcagctgtacaagaaaggtagttctattttccttttatatttgaaataggctcaaagtttgcccagggagcttaggttctttgacttatagagaattcatgatttgtttctaactcttctatttactgtaacttcaaagtggaaaatgaaccatataaatgtgtaatagaattatttctaatatatcaaaataagtaaaaataaaaatataaagcaatggcgattagaaggcagcttgtgtgtgagtgtgtctgtatgtagttattctttagtcctaagagccaagatagttgttttgttgacattgggcttgtgctgctgttacgtgggcctgagtyccctagaaggagaggcagaggaattttaaatcagagtgggtatgactaggctcctgactctgcaaactcatgtctagttgaggtgacaaaactacagtttaaggcaggttgtaatcacagctaatatggcactttgactgtgttatctctgtacctcacaaaaaccctgtatggtgggtgttcttatttgcatttcataggtgaggaaatcaagactcagagatgaaatcatctgtctagatcatagatagcaagtggcaaagctggaaatgggatccagtctctgatctttctcacaccagggcctgccctttttctatgtggtgttgcttctctaagtaccaataatatagttccaagttttttaagagagggagaagcaagtggggtttgaaggatcaggaaatatatagtacctgagctggtcatttaaaacgggtatgattttgatcaatagtatggcagagatggcactcagggcaggagagcaaagtcagagaaatttgcatacctcctttgggtgatgttgaggagagctcaggctgatagtttccattttgacttctttgtgctatttctgcagggaggtcctggccagtgaagccatccttaatgttcctgataagtctgactggaggcagtgtcagatcagcaaggaagacgaggagaccctggctcrccgcttccrgaaagactttgagccctatgactttactctggatgactaaaacaaagggaagaactttttatgaactccacaggaagtagtaargcttttttttttttttaattaaaagaattttttttgagacrragtctcgctctgtcacccaagcaggattgcagtggcataactgtggctcactgtagcctcaacctcctgggctctagagttcctcccacctcrgcctcatgagtagctgggaccacaggcgcawgctaccatgcctggcaaacttttttgattttttatagagacaggagggtctccctgtgttgcccaggctggtctgtaatgcctaggctcaagggatcctctgccttggcttcttaacctgctgggattacaagcatgagacaccattcctggcctagaagcctatttttaaagaaactacaatctcccatggggactgtttccctgcctcttttgtgcagtcccatggaacttgcctacagcaagaggcctaagattgaatctttttggggaaaagtcattctaggatgaaaatcctatgttaaggccgggcgcagtggctcacgcctgtaatcccagtactttgggaagccgaggcaggtggatcacctgaggtgaggagtttgagaccagcctggccaacatggtgaaaccccgtctttactaaagctacaaaaattagctgggcgtggtgccaggcrcttgtartcccrgctrctcaggaggctgaggcrggagaattgcttgagcctgggaggtggaggttgcagtgagccaagatcgctccattgcactccagcctgggtgacagtgaaactccatctcaaaaataaaagaataaaagtatgtctgtcatccagctcctatgtctgttatccagctccaagtacagcttgtgtatatcaacattttcaaaaacctttaaactaccaaatgaaatccagatgtttttccatggttgagaagtgtcttgtgttcatgttgcctgtgaccgttgaaatgaagtagtatgtgtaatagcaggggctagagctttaggcccagctgttactccaaaatcacacagggcagtttctccctgaacaacccaaagtggaaaagggatccaaggcttttgctatttttctcttaaagcattcatcttattcatagataagagcccatttagtccttcggatatttaactcctatgtgccaggcatttttctaagctccaggaccatagtcatgtcccaatatggtccctgttgtcccagagattacagtttaatggggaatagaagggacagatttaagaaaaaaaagataattctcctttggatattgttttaggtgcttgatatatctaatatgtgtctgttgtgctgctgggcagttctaaactcatcagtacctgggttggttacagggctttggggatcatcagggtataggccataggtgaaattaagatagggtaaatacagtsctgagctgaagatgattacctgagaaatatcagtatttaaggagtgcttgaaaatagtgatctaacatttacatagagaaggagcaaagagaatgctacatattaggcgcaaaaagaaaaatatttttacctttatattgggcacttatggtccagacactgtttcatttaatcttcacaaaatctctgtgaggtaggtattacctctattttactcatgaaaaaaaaactgagactcggaaaattgaagattgtggagcctggggtcaacaggcttaggctttttaaaaaacaggccaggtggctcatgcctgtgattgcagcactttgggaggctgaggcaggcagatgacctgagatcaggagttwgagaccagcctagccaacacggtgaaaccccgtctctactaaaaatgcaaaaaattagctgggcgtggttgcatgcgcctgtaatgccagctactcgggaggctgaggcagtagaattgcttgaaccctggaggtggaggttgcagtgagctgagatcacaccattgcactccagcctgggtgacaagagtgaaactccatctcaaacaataacaacaacaacaacaaaaaacaactcaaattactcatggccctgggaatgggggcatttaaaaagttaaccaagggaaccaacctggtttccacaaagatggccacttctgggtcagcccaatcatcagtatccctgggtcctcagcatcccttcctacctcttttgactgggaattacgagattacagccccacctacggaaattgagcacattagcactggccatgctgtacatacagcaaatgagaggkcttcatactgttacaacaatctgtaccacaattctctgtgcggtctgcccagctctaaatgacatgtcctcagaggcatcatcatctccaagtccatggaaaccatgcacttacagaaaccagaacctcccataccacatgttactaatgacctacaacatcgacttcgtctgtatcatgcagtgctcaacattctggttgcagcatcacatttatcaataatttgattccatgctgattcctttacttggagtattgagatcccccaggtacagtgaargtatgaccctcttaaatggaagaccaggagttgtttcccctatgctatggcaatccgccacccggaagcacttgctgcaccaacagcattcccaaagcttgcctctgcagccctgtagcacccattagaaacacttctcacaatgaactactgtgctggcaaacccataactggactgccggacagcaagctctgtgaggcatctaggaaaaaagctcgcgaaatcccgagaaacactcttcactccggaatagcgtcacattcttgagtcatttgggatgacaggggatatcctggagcaggtgtattgggaagtcagtgaacaagaaggctaattcattagtgggcctgctagcgtagtattttaacgatttcgcagcctttaaatcattggtggtctttagcgtgccggatcagctggtggtggagttggaggatagatggcagggatctgaagaaaggtgaagtgtagataggagtagagacaatatgaagtttagaaaagactaattgctggacgcggtggctcatgtstataatcccagcactctgggatgccraggtgggaggactacttgagaccaggagttcgggaccagcctgggcaacgtagcaagaccatgtctctacaaaaaataaaaaattagccaagcgaggtggtgcgcgcctgcaatcccagctactcgggaggtgagaagatcgcttaattccgggaggtcgaggctgcagtgagccgtgatcgtgccattgcactccagcctgggcaacggagcgagaccccatcttaattaaaaagaaaaaaatacaggagagactgggctgctttgaaaagtggatttgasgggaatgtggggtttggagagatcttatgttttccaagactagaaaaacattgtggttccgttcagccctcccggaaaatacrtaggggacttaaagagcggaccgagtacctgtttgtttccccatcccttagccggcagggmtctggcagcgccctgggagaacttagggaagggccttctcgcagcggttaccggaagtgacgcattcattctcgcgagaacaaagacgcgcgagcatcggcggcccggaaccggccttggaacaactgtggaacctgaggccgcttgccctcccgccccatggagcggcccccggggctgcggccgggcgcgggcgggccctgggagatgcgggagcggctgggcaccggcggcttcgggaacgtctgtctgtaccagcatcgggtgaggcggggcrtgagagggagcggcggtgggttggagcggcggtgggtttgagcgtctgtggaacacagggctgacagtgtgggatagatggttggtgggaccttgggcagtatttgggggccagtgggcttgtgtgtgtgtattagagagaaagatactatgcctgygtgtccaaagttgtatttgaggtactgggcatagatagagctgttgcggggaacttgggtatgactgtcaggctgtgaccaggtgtttagtgagtgtgacagtgcgtgtgtgtctctgtgaatgtggagtgtcagggtgtgtgaggcagatgcacgtcacagtgtgtatgtaggagcacgaatgtgtgagaagagggctgaaggggactgcctttgggaatgtgtgcgtccgtgtgtgtgtgtgtgtgtgtgtgtgtgtgtgtgygcgcgcgcgcgcgcgcttggaggccatatgatatcagtggggactggagtagacaaggaaggcttcatgatgggtccagagttaagcctttggaagcatggatgggctttggaattggggatgtattccaggtcgggacagtatgagggtgagttggtgcagagcatggcttcaaacgaaaggctatattagtagatggagatggggggcgctctagtaggtggaggacagttaacatcagactcaagaattttactttgatttaatagagaatgtttaaccattgtagtagcagttaaaaaatcatatttgggtcttgtttgtttgtttttgtttttgagacggagtctcactctgtcgcccaggctggaatgcagggcgcgatctcggctcactgcagcctcctcctcccgagttcaagcgattctcctgccacagcctcctgagtagctgggattacaggcgcccgccaccgtgcctggctaatttttttgtatttttagtagagacggggtttcaccatgttggccaggctggtctcgaactcctgacctcaggcgatccacctgtctcaggctcccaaagtgcagagattataggcgtgagccacggcaccaggcctgggacatgtattttttgatataccgataaaagctgtgaaccctttccccagaaaaatgcacagatgcacattcacacaaccatgcattgccatttgagaggttcgtgccttcctaaaggacattttaggtaaatagaccctggactaataattcctgtaatataggctttgttttgttgcctgtaaagtaagtatagtataataattacatgcatcatggatttgagagttaaataaaatagtaatgtgtgtaaagctaaatacggtacctgacccatgaaagccctcaactgttagcacctgctgctactttgttgttgttgctgctatgatcataatgctcctcattaattggccttaaggaaatgtcaagataaaaagtgttgttctaggaaaatggttttgtaaaggataaatttgagtggaacaacatatgggacaagatgaacaggtaagatcttactaaaatgcctgggcttggcttgtgaatagagaagttaattcaagaggaaaagtaataatttgttatctaaaggaacatgggtgtagtgagaaagctcgtaatttggggtgggagaaaggggagataggagtctaccttgggaaaataggcatatttagggtaattagaatgacaactgaaactgttagaactgaggaagttttgtgaaccaggtttctagatagggcataggagaaaatcttggagaaagagaatggaaggtgaaggactaaggcattaagtcctgtgatagcaggataagtagtaaatttaataattctcaccatcagagggaacataacacactaaaaaaaaaaaaaagtgggagccaagtgcttccagtggcatgttgcctgtgttacctaagcctgcctatccgcctggtcataaggaaaaaggatgcatgctggcagcttttgtgacttcttttcttggtccctgggtggggatggatgaattaatcactttttgttttattatggtaaagtatacatmacacaacatttatcactttatttttaagtgtacagttaggtggcattaagtacattgacgttgttgtacarccatmaccctatctccagaatattccgacttttttgttgttgttgtacatctataaacttcccatagaatattctttgtgaaaaggtagaatttcacagagttgatgaaatataaattaaggagttgaaggatcttacaaagtgggatttttgaaatagataacttattgctccattaacatgagcattcagggctcagtgttgttcatggttgtgcctgattctcatttccatggtggtaaaggcctgcatgggacatagatataactggtcacctgctcataacaaaaggaagattgaagggagtgagaacygtgggtaggctagcatgcagtctatcctagtttccttcttctctatgcaccaggtatcatcttatctctagcttcttttttcctctcaccctccaattcacactaccctatccaagctatgtcttscttccccacctataatatattttttctgtcctggcccctgggctcttctctctgtattcatacacagcctttattacaactctggtttgtgtcagagattacatatgttggaaattcttttgaactctccttgtgatatcagaaacatagtgtagcctgtttagccctgactgctatttctgagctgcattattaatgttgccagaatatgatggggtctggctatttcctgtaatatgcatcagaatgggtttaatttcagtcagaattggctaaattactagtcacaggcaagagatgttaggttcattatgtagctatggaagcagaagtacactcattggtaggattttttttcttcatgtcatttgaaatgcatacattaggattggagttttttgctttaggcttggttatattaaaactttctcttgctgtttggagtccaggaagccctgaattaccttcttcattttagttatgctagaagctggggcacatattagttgtcttgattaagctctgaaaggggtttgctgaggagacaggatctttttttttctaacattatatatgagagagagttctgaaaagacctgttataaaatcagtttcaggcacttttcccttgtatgctgttgtgtgtttgaaggtcagttttaaagcatkggtgtaatagtctcatggtttatctttttaaaaagcattgcctcaagagagctgtggataaatatatttaattagtaaagctaaaaagttttgttgtcttaagttatttctttggtagcaaataaatcttcacaagaacctaattttttttttctgttgattttctattttggcaggaacttgatctcaaaatagcaattaagtcttgtcgcctagagctaagtaccaaaaacagagaacgatggtgccatgaaatccagattatgaagaagtaagtgtattccttgacttacatttccctggttctacagcccaaccagatgtcatcatggggaaagaggccaggaatccactcttctcaggatctttttgggaacatatatttttttctctcattaaatatattctatttcaaataataatatcacattaagattaagaaggtttagttaaaatcagctaggacacttacacactgttggtgggaatgtaaaattgtgcaactgttacggaaaacagtacggtgattcctaaaaaattaaaaatagaattaccatatgatccagcaattccatttctgggtatatacaaaaatgaattgaaagcagggacttaaagagtaatttgtacactcatattcataacattattattcacaatagctgaaaggtaaaagcaacccagtatctaccagcagagacatgtataaacaaaatgtggtatattcatgaaacggaatatcatgcagccttaaaaaggaatgaaactctgacacatgccacagcatggatgaatcttgtggacattatgctaaatgaaataagccagtcacaaaaagacaaatactgtgtcattccacttatrtgtggtacctagagtagtcaaactcacagtgaaagaaagtagaatggtgtttgccagagggtgaagggaccagcaaatagagaataatttttaataggtgcggagtttcagctttgcagaattaaacagttttgtgcagtatagtgatagtagcaaaacattgtgaaagtatttgatgccaggctgggcatgttggctcacactgtaattccaacactttgagaggctgaggtgggtggattgcttgagctcaggagttcgagaccagcctgggcaacatggcaaaaccccatctctacaaaaaatataaaaactagctatgtgtggtggtgcatgcccgtagtcccagttacttgggaggctgaggtgggaagattgcttgagcccaggaggtcaaggctacagtgagctgagatcataccactgtactccagcctgggtgacaagagcaagaccctgtctgaaaaaaaaggaaagcatcttgatgccactaaactgtacacttaaaaatggttaaggtggtaaattttatgctatgtgtrttttaccacaatcaaaaaactatttcatttcagttaacaaaagtcagctagggccgggygtggtggctcacacctataatcccagcactttgggaggccaaggcggatggattacctgaggtcaggagtttgagaccagcccggtcaacatggcaaaaccccatctctactaaaaatacaaaaattagccaggtgtggtggcgggtgcctgtaatcccagctacttgggaggccgarggaggagaattgcttgaacccgggaggcggaggttgcggtaagctgagatcataccactgcactccagcctgggcgactccgtctctaaataaataaataaataataaaaaataaattaccccaacatttagtggcttaaaatagcaaacatttagtatcttatagtttctgtgacttaggaatttgggagtggcttagctgggtgattctagcttagagtctttcctgagacatctcaggatattggtcggagctgcagtaatccaaaggcttgactggggctggagtatctgcttccatgctcacttatatgaatgttggccaaaagcatcagttcttcgccatgtgggcctcttcatggggaagcttgaatgttttcatgacatggaagctagctttccccagaaagatcttttcctcagaaagagtgagtgatctragagagagagagagagagagagagtgaacgagcgagcaagatgaaaaccgaygtatcttttatgatctttacttggaagtgagactccatccttttccaccacattctgtttgttacagtgagtcactaagtacagcctacattcaaggggaggagagttaagctcttaaaaagagaagtagacatattttaaaacttccacaggtagtgtgctaagtactttacagatcattcttccagttatcacagcaatcttatatttaggtattattttgcaaatgaggaagttgaagcttatagaatcacatagctggtggttggtraagtgtggatttgaaataaatactttctgactctaatatctgtgcttaattccattttgattctcaaacttggttatgtggcagaatcaccaggaaagcttaatagtataaattatcaggtcctacatgtacatggaaattctgtttgcttctttttctttttttctttttttttttaaaagagatgtggtcttgctatgttacccaggcttgacttgaactcctgggctcaagcagtcctcccacctcagcctctggagtagctgggactataggcatgcgccaccacacccggctaatttttaattttttgtagagatgaggtctcactgtgttacccatgctgatctcgaactcctggcctcaagcaatcctcccacctcagcctcccaaattgttgggattacagttacaactacacccagcctagaacgccagatttgacttactcactgtgtgatcttgttacttagccaatttgtgcttcaattttctcctgtgtggtgaaagtattaataaatctacctataataggattattgtgacaagtaactgagttaatatatttaaaatgtttactgcttggcacttagaaatgtaatagtagtaatagtgatggtatttttatgtgtgttttcttttaaaaaattactaatttttaattatacaaatcagaaattagaatattataaataatactgatctttccccctctgttcatccacccacaattaagtagcatttcaaatccagtccctttttattggaaataattttttttattgtaatgtttttctttcttattaggttgaaccatgccaatgttgtaaaggcctgtgatgttcctgaagaattgaatattttgattcatgatgtgcctcttctagcaatggaatactgttctggaggagatctccgaaaggtagtgtggatgttttgagatgagagagagtamatcacaaactttagcaatgtttgaatcatgttaaatataataaactagaataagaatcggaaaaactatggtctgcttcctgttttgtaaatmaagttttattggaacacagccacattcatttctttacacattgtctatggctgctttcttatggctgcagaagtgagtagttttaacagagactatgtgacttgcaaaacctaaagtatttaccatatggttccttacagaaaatgttgactcctgatttagaaaatgcatttttgttgttgctgtttgatgggactatagcaatggtgttagatgaaaatttcagtggttaaggtgcttataaaaagttgttttctgtattgcaatcttttttttctacctaattttaaatgtgcccatatgaccatttttatatatatccatgagatttgtcagccttttccagtttcaaatgctttttgcctctttttacttttatgagccttatcatgaaatttacatgccctcagtatggatttggwaattttattcccttgyattttattatgacttattttctcatttgaatattcttttagagtatartaattaatgtgtggtcactattgcagcccagcaatttgcagaacagatttttagatttctttctttttttagctgctcaacaaaccagaaaattgttgtggacttaaagaaagccagatactttctttactaagtgatataggtacgtatcagtattaaaataccattgtaatgtaatgtccctttggcccataaaagatctttttgggaattcaggagaattgttgatacactatacaaagtctatagaatttcaacatctataagaagttataaaaatctattactattgatgctaaattaaaactaggatattttggctaggtgcggtggctcacgcctgtaatcccagcactttgggaggccaaggtaggcggatcacaaggtcaggagttcaagaccagcctggccaacatagtgaaaccccatctctactaaaaatacaaaaattagctgggcacaatgccgcatgcctgtagtcccagctactcgggaggctgaggcaggagaatcrcttgaacccaggagatagaggttgcagtgagccgagattgcaccactgcactccagcttggacaacagagtgagactttgtcacacacacacaaaaagaaactaggatattttattatttatttgtggctaagagtcctttttttgtctaatagatgttccaatagctgacaaaaaaatcatgtgaaatgaccttactcaatttctctccccccctaccattkacatagtaattttgtttacagtggaattacatctccttgagggatgggtcctcaagtcaactcttttttgtttgtttgttttgagacggagtctagctctgttgcccaggctggagtgcagtggtgcgatctcrgcttactgtaacctctgcctcccaggttcaagcgattctcctgcctcagcctcccgagtagctgggaytacaggtgcccgccatcacacctggctaatttttgtatttttaacagagacggggtttcactgtgttggccaggctggtctcaaactcctgacctcgtgatctgcccgcctcggcctcccaaagtgctgggattacaagcgtgagccaccgcacccakccaagtcaactcttcagggtgaaaaatctctgcttaatcagaatgactccagaaaaattcctaaaataaccagtacctaaccttttggaggaacctcaaaaaccaaaaatttgtttccccatagattttggttttgcctcttttccaaggtcatgagggctaaagtccaattgaaatgagtgatttaggtgrgagaaagaggcttakaagagtttcagggattttcccaattgcttgttgcatttctatttggtgttaattctaatgagttaaatgaacatatagtataattttgtagtatttgtttaatgttacttttttttctgtgaagaaaacctggacactgtagtattagttgtgtagttacgatgatccatataaacttgagcatcagagtagatttgtacaaaatgtgaggtgaatttttcttttaactcaatgatttctgttacttyaaagtatattttaaactttatttaggrtctgggattcgatatttgcatgaaaacaaaattatacatcgagatctaaaacctgaaaacatagttcttcaggatgttggtggaaaggtaggtgaaacctgaagtaatgtttcatgcctattgaatatagtctctctgatatagttagtccttgagctttggtgtctttgctgtatgcccataacagtcttactttttccatttcagacctcaccacactgaactgtagttttgtgtttagtttttttgtcccttctgctaaacagtggttccatcagagaaggaacagcacctgctttttttttctttttcttttttttcatttttcatacttaacccagctcctagacttcacctgtcttgttcaagtctgtttttccatcatagtatctagcaaagatacaggctgtgaatacataatatgttaacacttattattttattcttatgaagcacatccaaaacacatacatgcacatcctgggtccactttaagaaaaaaaagaaagtrtatatatttttaaaacttattttccttcccccaatttaaatgagtcatctggagaagaaccagaaattgtgaattgactcttaaaatgttcatttcattggtaacttaagcagttttcttgtttccagcatccaaatttcattccaataaagacttaaaggccaagagtctgaaccttgtgttgagttgtgtgtgccgtctctttagttagtgaaaatagttgttggcctcttggaggtgttggaaccttggtgatgcctcttctcttaggaacctttcacgtatgyttggcaccaaatatctctgctttttttttttttaatccaaagacttcaggacattcctgaagttagatctaagtatttactcacatttaatctactataaggaggtatgatgcttcttcaagtttggaagtcacccttgcctttactttccrgtttaatggattgagcttattttgaatatagtaaaataaaaattaatagcccacctgtattcartttttaccatgtaccaagcactgtgttaccttctttactttcgttatttcattggatcctaataacaattctgtgaagcagggactgttagtcatccaattagattactgagagaggttaaataacttggtagatcacatgcctagttaagtggtggcactcagacttgaaatatttttgtgttattacagagcccaaggtcctcaccactaccctgtctacagcctcgtaaggatattgttgtctttcctttttaaatttctctaccatttaatacttaatctgtcttattattttgcagataatacataaaataattgatctgggatatgccaaagatgttgatcaaggaagtctgtgtacatcttttgtgggaacactgcagtatctggtgagacctgttttgtttctttgaatttaagtgtgtataggattctcttatttctgaagatcatgaatatagtaggtcaaaaataaagtagcttttcccatacagtgttggtgtttaaagcattttctcttttgaaggccccagagctctttgagaataagccttacacagccactgttgattattggagctttgggaccatggtatttgaatgtattgctggatataggccttttttgcatcatctgcagccatttacctggtaagaaatggatgagaacttgggcatgcttaatgggaatggaaattttttcatttgtctttttttttctttctttaaktgtttaattgcctttgaaatatacaattaaatataattaaatggcaagaaatcttaatttgtgagaatcactttgtcaactgaggtagcttttgattttataggcatgagaagattaagaagaaggatccaaagtgtatatttgcatgtgaagagatgtcaggagaagttcggtttagtagccatttacctcaaccaaatagcctttgtaggtaagtatattttagttaaggaagtttgcctcagtttctccagagttgtaaaggagcaggagagtagttgtctgtttcaagttgcattatccagtagaactttytgtgatgatgtagaaaccttctatatttctgttggccacatgaggttattgactacttgacatgtagctagtttggctagagaacgaattttgaataaatagtaaatataaatagccacttgggactagtggctaccattttggacagcacaggtctggtggaaacaasaactgccatttaactgtttgacatatgtcctaagaaggctcttaggataatgaagtaaatgggttatttgcagaatggatttggactcatccrtcagagttgtcagtaactaacatatgtggagttttgagtagtttttgatggaaaaaagtttgtcccctgtcatttcatgaatttgaaagtaatttatgaaatggtacagacaagtgatgtgggaaagaaaatggacaacctgcaaaattacctttctaacagtataaagggaaattggaacataatgatttgattttcaccctattttgtatgttttctagtttartagtagaacccatggaaaactggctacagttgatgttgaattgggaccctcagcagagaggaggacctgttgaccttactttgaagcagccaagatgttttgtattaatggatcacattttgaatttgaaggttagtcttaatgggtctactgcataagaccagcattgaaagtaacaagtttatttggaaaattagcataaatacagtttaataatcttttcctgttgcttatttatttatttattttgagacagggtctcactctgtcacctaggctggagtgcagtggcatgtttttggctcactgcmacctgcgcctcccaggttcaagcgattctcttgcctcagcctcccgagtagttgggactaaaggtgtgcaccaccatgcccagctaatttttgtatttttagtagaggtagggtttcgctatgttgtccaggctggtctcgcactcctgacctcaggtgatctgcccgcctccacctcccaaagtgggattacaggcgtgagccattgcrtccagccctgatgcttatttgaaaaagaaaattatattcttagagctgattttttaaaaagtttatttagcaagctgtctcagtttgcttctctgtggtctttgttaattactcctttgaagcaacttttttatttaccttttcccatgttgttgccattatcctcgattcatttatgtctagtcatactggatttgatttggtaaggaaggttcctatctgcctttcatggctctgcacttactccttaacctatagttcattcaatatgtactacctatctcatcttctgaaaatgcttttttattcttctgcccaagaaactaacatagttctttttttttttttttttaacaagtcaagtgtaaactgatctgcttggttttttgggggggctttccctaaccaagttttgccttgtacctgcttctcttaacctttacctcatacaagaccagcttgtcactgctccttatgcctcaaacccgttatctacctttgtgctttgacagatgctatccttctgcctggdtatccatttctgtgtatcttctcacctacactggcatatctttaagagcttttctttaaatggtctctgccacaaaatttgtcatttaaaggctatattctctttctcgtcttccattcatgcatcttcatatagactgttgtcttcttcaatgttgggattgttttacttcttttattaacaatcacccaccctacccttcctaaccatggcattctgtacagagcagggcatgtatcaggttcttagtaaattatttattgatatgaatgagagctatagatagttctattatgcagtgtacccagaaacaactctcatcaatagtstttacatttgtattgattgtttgtagtatacaggtttctaaaattgaaatgagaaattataatcatgtaatgttggagtacatggcgagatagctcactttagtctgcaacccctgagctcaagtgattctcctgcttcagcctccagagtaaatgggactacaggtgtgcgccacctctcctgcctaatttttaaatttttggtagaaatggggtctcactgtgttgagcaggttggttttgaactcctggcctcaagtaatcctcctacctcgacttcccaaagtgctgagattacagatgtgggctactgtgcccgaccttggcatactttattaaatagaaacttgaggccatgtggatgtcattcttggctaacactgaaaagatacctggcttcttcttgatttggtttccttctaatgtgccaaagaataaattatccctcagtgtgttaggaaagcagggctttagttctgtgttgcctctgaaacatttcagctgtgaatgaaccacatctcgcatttgtttcatacttgtcataggaatcatagcatagtttctgctctgaagggcatctgtgagcctcttgttatagggcacggggaaagagtmcacattatggagtttatagtttacagactttaattcagtttgcagcaccactatttacctatctgtgaacctgagcaaatgtctctctatctcaaggacagtaatatcttcctcaaagcatcaatattattatgaggttatgcagaataaggtatgtataaggtactagttatagtagttcaagaagcttcaaggatgcttgttagacatgataataggactgaattttgaagaatgagagtttttagggaaagggtgagggcgggagagatttataggcagcagagcatcatgagcaaaagtacagaagcatgaactgcaaaacagcttggtgttactgtaggacattttcccaaaatgtttatatatattgtacaagaaaggaatgatgtctgtttgattttcacttaaaaaaggaagcaacaaaacagttactgaaatatttcccttttgaaaaaatagcttagcaagtctgattgtatgcatattttccaaytgtttattatgaayatctttagatatgtagaagagttgaaagaagtgtactgaacctaccactaaaaataatgatgaaacagtagcatttaattattatttttttttgcctcctctttcaygcccctaaatgtaactatattctgagtctcttcttggttctctctttttccattacatttcctttcttttattaggcagcctcttcaactgtatagctttacttataaactacatatggctaactcctaaagttatttatctctgtagctgtgactcttctgccaaggacttataactgctgtataactgtataactacctggctgttccactggcacttacaacttaatttattaaaaactgaacatatttgttctatccattaaatctacttcttttttttttttttttttttttgatatggagcctcactctgtctcacgatctcaactcactgcaacctacacctcctgggttcaagtgattctcgtgcctcagcctcccgagtagctgggattacaggtgcctgccaccgtgtccagctaatttttatatttttggtagaaatggggtttcaccatgttggccaggctggtcttgacaccctgacctcaggtgatctgctcacctcggccttccaaagtgctgggattacaggcatgagccactgcacctggcccattaaatctacctctatagatttcctacacttcttatttgcactgtcacctttccagttacccaggtgggaaactttggatgtgttgactcttcctttctcttcaatcgatatatccaattattttatcaaatttatcttttgaatatcttaacaattttgagcttgccaggttctcaatttagaaaggcttgcatagttttctttcacttattgaataaagtccagascctttcattggtactcaaaacctatcttggtttcatatcaacttacactcctggacttatctcttactaatgccctgagaggccatcattttaggtacatttgaactggattaattgtattctctgattatgcccatccctttctacttttctgcttctgctcaccttgttttctgcctaaaggaactcttttcagtcttttcccatttcagtctttcatttcaaagtttagctcaagtagtgcctcctttatgaagtgcctgcttcctactgccaagtgtatgatactttacactgattataacacctatcacattttgcctggtaccttagttctcttagtatatcttaatatcttctgtttgactataactgtatggaaggcaaggatcataaggtactcagtttgtatacccactactaccaccacaacacacttaatagtatgtaccaatagtatgtacctaccaatagtaggtactcattaaatattatagtgagcaaaaagataaatttaggttgtatttcctcttctttcttttgcttccttctggcctggagctttggtagtgagatgccatgatgacatactctaatatcctgtgtaaaagtagatgtccattataggattttctattgctataagtggcagctgtcatagtgtgaaatctgcctaaattgggaaggcatggaaagtctcargtagtataattgtattgcaaatccgtatcagttttgaagatttccctactccccttttaaacataaagatttatattaaagaaaagtctcttaataagagaaatactggcaattgtgttatgacatttggaattcacatgaaaaggatcagcttcaggttataaaaacagtttggtatttcttttttaaaattttgttgatacaggtgtggtggctcatgcctgtaatcccagcactttgggaggtggaggcaggcagatcacttgaggtctggagttcgagaccagcctggccaacatggtgaaaccccatctstactaakaatacaaaaattarccagggatggkggtgcatgcctgtagtcccagctacacgggaggctgaggcagaagagttgcttgaacctgggaggtggaggctgcattgaaccaagatcgcaccactgcactccagcctgggtgacagagagagactctgtctcaaaaacaaacaaacaaaattgttaatacgcttttaatttttttttttttttttgagataagagtcttgttctatcacccaggctagagtaccatggtgcaatctccactcactgcaactttcacctcccagactcaagtgattctctcgtgcctcagcctcccgcgtagttggaattacaggtgtgcgccatcatggccaactaattttttgtgtgtttttagtagagacagggttttgccatgttggccaggatgttctcaaactcctgtcctcaagtgatctacctgtcttggcctcccaaagggctgggattacaggtgtgagccaccgcgcccagcctaattttttaaattgacaaataattatacaaattaatggggtaaatagtgatgtttcaatacatgcactgtgtagtgatcagattarggtaattarcatatccatcagctaaaacataatttctctrtgttgggaatattcagtatccctttcttttttctttttttttctttttcttctttctttttttttttttttgagacaaagtctcactctgtcgcctggagtgcagtggcgcgatcttggctcactgcagccttgatctcccaggttcaggcgattctcctgcctcagccttctgagtagctgggattataggcgttgtgccaccaagcccagctaatttttgtgtttttagtagagacaaggtttcaccatgttggccaggctggtcttgaactcctgaccttaagtgatctacttgtcttgtaatcccaaagtgctgggattacaggcgtgagccaccacgcccagcctcagtttagtatttctgtagcaccacttatttgggcatctgtgttaggatttgtaagtggaaataatagtgggccttcaaactaaaaagtgtacagtagaaraaataatcaacaaaacgaaaaagcaacccaacccatggattgggaaaagatatttgcataccatacatccaataagaaattaatatcctraatttataagaaactcatgcaactcaataccaaaaatgtaaataacccaatttaaaaatgtgcaaaggacctgaattagacacttctcaaaagaagaaattcagatggtcaacaaacatatgaaaaggtgctcaacaactcttagcatcagggcgatgcaaatcaaaaccacactaagatatcaccccccacctgttgggatggctattatccaaaagaaaaaagataagcgttagtgaggatgtgggagaaaagaaatcccttgtacactgttggtgggaatgtaaattattacagctattgtgggaaacagtacaaaggttcctcaaaattaaaaatagaactactggccgggcatggtggctcatgcctgtaatcccagcactttgggaggytgagacaggtggatcacatgaggccaggagttcgagaccagactgggcaacatgcagaaaccccatctcaactaaaattacaaaaattagctgggcatggtggtgcacatctgtaatcccagctactccgtaggctgaggcaggataattgcttgaattcaggaggtggaagttgtagtgagctgagagatcatgccactgcacatcagcctgcgtgacacagcaagactctgtctcaaaagaaaaaaaaaaaaaatagaactgtaagattcaacaatgtcatttcttggtatatatccaaaggattttaaagcaggcttgtgaagagatatttgcactcccatgttcattgcagcattattcacaatagtcaagatctggaaatagcctaaatgtcctttgacagatgaatggatagggaaaaagtggtatatatacacagtggaatagtattcaaccttaagaaaaagaaggaaattctgccatttaggacaatgtggatgaacctggaggacatgttaagtaaaataagcaagtcacagaaagagaaatactgcgtgatctcacttacatgtggaatctataatagttaaatttaatagaagcagaccatagcatcatagttgccaggggctgcagggatgcgggtgcgggggtgtatgtagagatgtttatcaaaaggtccaaaaattacggcagcaaaagaaaaaaaaggtacaaaaatgacaactatgaagaggtgacagatatattaattagctgaaatgtgataatttcacaacgtatatcaaaacatcaagttgtataactcaaatatataacatttttatatgtcaaattaaattgtcacaaaataaaatatgtaaaagataaagcaataaatcaggagrgggggytatgatagatgaaacaagataggctctatgtaaatgatggttgaaactaggtgaggcattcacagggttgggagggggcttattgtactgttgtctatagttttgtgtctttgaaaacatcaattcagatttgtgttttaaagggaaaaaaataatagtggacttggattaatgccttacctttgtagtaaggattttcagcagagagaattttaatcatttgcatatactagtcaatgtaaggcatggagaatgtaggcattaatttcgtatggcttttctaaggatactggaaggaagagaatttaaaatcatgttcttttcaaaagactgaagtccaactctgtggctgtccgcgctgacaggtggggacagagccccacctgactcagcctcacactcacttggcatgtatcaggctacttttactggggctttaggtgagagtgataaaacggttcttacttgatttggggcccttaagcaggttgctgctctgggattaggttgtcttataaaaaggtaactcaccacscataacaatgctttttcctgtttaaagagagacctagttcttctatcagatgatttcttaaggcagcatgaagtagccagacacaaaaagagttaagatccaagctctaccagttattagctgtgtgatccctaacaagttatttaacttagaactctggtttctttctctgtttaaaatggagattaaaagatctaattattggggatgttatgtgaaagtggtttatgcctgtggttgtcttctgttaggcacttcatgaattggaatgtttccttttcggtctatgataatgtttttttcaaaataaataacttaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaawaaaaaaaaaaawaaawaaataaataaataaataaataaataaataacttgttctttyaaattgggatttttcttaattttgaaaatttcttaactttgaaattttattgttggaactaacatctattgtagaaaaggaaattgttcagttttcagaatgtcattttataattataaaaggagatctcactttggagaatgagtgagccttgtttaatktagaaataatgccttttgcccatattcaccttttagtatctggcagcgaatcttttatgtaacaaataatcaataactttacctttttttcttatttatacagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttgtaagaaaattaattataatatccctagagtatgtgaaatctagagggattgcgtgccytgcaatttttatgcatacttggaattccttgggaggccgcacattttgttttggttttgtccttctcccaactcttatcattgctttgcaaggtgaacaggatagaaatgaaacatttgttgttttgaactttgcaagactttttctttggtgccagttttctgctcctgttcccagaccaaactgagggtcaggctgcttactctcgcggcccaataacgagatgcagatgaattgggagagatgggagtttttatttctgtaaccagttacaggtagaaggcctggaaattaccgccagaccaactcaaaattacaaagtttttccgtagtttrtttatcttctaagctatatgtctatgtgtaagtttgcattcatctaaagacataagtgattaacttcttttaatctgtagctgaggtctgagtcttgaagacattcctctggagcctcagtaaatttacttactctaaatgggtccaggtgctggggtgattacccttatcttgtctcctattaaatcacagaggtttaaggagttccttcagacccccaataaacttgtttgtggaggcctggggtttcttcagacccccaataaaacttatttaattctgaacgggtcctgttaagaattcctttgttattttgcttttaggcctgggaaaggcctgggcagaactcttggtaggctttggctacatttcagcctttgtgtaagggcactggctcttccagttttttttttttttagacagtcttgctctgttgcccaggctgaagtgcaatggcacaatctcagctcactgcaacctccgcctcctgggttcaagtgattctccctgccacagcctcccaagtagctgggattataggtgcccaccaccatgcctagctaattttttgtatctttagtagagacggggttttgccactcctgaccgacctcaggcgatctgcctacctyggcctcctgaagtgttgggattacaggcgtgagccactgcacccggccactctttcagcttttaatatttaacttcaccactcagtcgtgctgaaacagttgttatttaggcctgcattagtgagacctggcctgccacactcccagttaatattccttcttggcttggtgcagtggcccatgcctgtaatcccgggactttgggaacccaaggtgggtggattgctgagttcaagagttcgagacctgcctgagcaacatgttgaagccctgtctctacaaaaactacaaaaattagcggggtttggtggtgcacccctgtagtcctagctacttgggagattgaggtgggagaatcacttgagcccagggaggttgaggctgcaatgagccatgatcacgcsgctgcactccagcatgggtgacagagcaagaccctgtctcaaaaaaaaaaatttctttttgtatttgaagcccagtactctgaaactactgtgagaacagcagtctcataggtcctgccaaaggataaatgggtggtaaaatatgactgtggtcatgactttttcccccatttttctttttatgactttattgaggcatattatcatgttagttcccatttaaggtgtacaatatagtgattttttatttcttttttattaacttgtcactgacttgatgctcaattacagtgatttttttttaaagtaaatttaccaaattttgcagctgtcaccataaatcagcttaaaaacatttccattaacagtccattaactgttaatctccattctgtccaccccaggaaaccaggaatctattttttatctccacaagtttgccttttctgaacattccatataaatggaattatgtaatatatagtcttgtgtctgactttttttacttgcyttgtatttttgaagccygtgcatgttgtagcatgtatcagtacttcattcgttttgattaccgattagttttttcactgtatatatctttttgcatttgttctttgggttttggtgattgttcactttagcccatacaaaagtttgggtcttttttcctcaacaaaagtttggactctgttatctgtaagagatatgstaatacacattgattttgttcatttgcatttcaragtaggaaatctggtgcataagtatttagaaaacctaggattttcaaagatccttgaacaggattttaactgtttgtttctttttcagagaggctgtgatagctatatggtttatttgtttgataaaagtaaaactgtatatgaagggccatttgcttccagaagtttatctgattgtgtaaattatattggtaagtccagtccatttagtggctgagctttaaacatgaattaatataactttgactctcagtatgattagtagaaatggacttttggtgttgtgttctgtatctcatacttgaagtttctatatggagttatatgagaactctgaaaaatggatttatatartttggaaggtgaaaaggtagatattaaatctccatgagatcattcaagagaagatttactttcttgaggatagggctctcacaggagaatgaaacttcactattagttgaacctgctttttaattgtctcttcatagtctaagcatgttcaagtatttatttcatttttcctgtgaatactgcttgatgttcaaatgttttaatttatcctgtgaaaattattcttttcttttgaacaagttaagtgtttgatcactgtatatctgtccaaataaagtaaagcacaaaattgtaaaatcaagaacaaaattgagcagaggggctaaaatgtatrtaatcttacttttttaaaagtctttttattagttttcttttgaatttttcttttaaattgaggcagtttacatagagtgaaattcacagatcatatagtttgataacttttgacaaatttagatacttgtgtaatccacaccacagtcatcatgtagaacatttctttcaccttagaaagttccctcatgtctcttttcagtcaactccccttgccccagactttattactattttactaatggactttttttttttaagaatggttttagatttgccaaaaaattgggcagatagtacagagttctcatataactcccctcactcacgcatgtagtttttcctattgttaacattttacctgggaggcggaggttgcagtgagccaatgtcacaccactgcacttcagcctgggcaacagagtgagacctttctcaaaaaaataaataaaaaacataaaatatttaaaaatattaaaaagtaaaaaaaaatctattttacattagtatgatgtatttgttacatttaatgaacccatttattattaattgaagcccatactttattcacatttccttcatttttacctaatatcctttttctgttctaagatctcatcttagaacacattacatttggttgtcatgtctctttagctcctctttgctgtgacattttgtcagacttcaaatagtccttgtttttgatgaccttgacaatgacctgaggaatactagtcaagtattttgtaagatgtccctctgctgaaatttgtctttttgtttttgtttttgttttgtttttgagatggagtttcactcttgtcgcccaggctggagtgcaatggcacaatcttggctcactgcaacccccacctcccgggtacaagcgattctcctgtctcagtctcccgagtagctgggattataggygcacaccaccacgcccagctaatttttgcatttttagtagagacagggtttcaccgtgttggccaggctgctcttgaactcctgacctcaagggatctgcccgccttggcttcccaaagtgctgggattacaggcgtgagccatcacacctggctcttgtgtgtattcttaaacctggattgttggtccagaatatgaaatttattattcagaggtaggaaagactcagaggagatgggacttgatttagaacttgaaagaaataatttggattagcagagagaaaaagagtattccaggttgcagaaaagcaagcaaaaaagacagatacaggaataatctcaagctctgtgagtgtagcgattgtgtcatttttatttccccccttgtatgtggagcggggcttaagtattgcaggtgctctgtaaatgtatattgaactgaattaaatggaaacaagtggttcttttagcatcagtttctagcatctatgggaatcctgtttgtgtggacaggaaatcacaaagaatgataaatcaactctaaaatcctcaaaagtaactaacctcccttgccctttttctcatcttcttgtatatagtacaggacagcaaaatacagcttccaattatacagctgcgtaaagtgtgggctgaagcagtgcactatgtgtctggactaaaagaagactatagcaggctctttcagggrcaaagggcagcaatgtaagtggattctgttgtttataagcacaatgcaatgtgcatcatatactcaagaattaatcttgccggttttcactaatcaatattgcatgtaatagtaacatactgggccaatttgaagtgtaatgttctgataaacttgtagaattcttactaatggactgagaccattctattgtaatggcttgagggtaataattcccatacggtcctagtataaaaagattgtttatcacaaaatattataggcaggaagtctttagagatcagattctagagctcagttatttctcatagattgataatagaaacttaggctttggccttgtggcagtttatgtttttacattattgttcaatgtttctgaatgctgataatatcttttttctttttcttttttttcttgctgtggtttaggttaagtcttcttagatataatgctaacttaacaaaaatgaagaacactttgatctcagcatcacaacaactgaaagctaaattggagttttttcacaaaagcattcagcttgacttggagagatacagcgagcagatgacgtatggratatgtaagtgtctgtgtaatgtatttgaaaggagcatctggtttcttgaagccatctgttattttgccttcttaactcagccagttgttttacttaccttcacattagaacaagagacaggacaacttaaattaacataaaccatgtttgttttgaatgttacctctttttttaaatttgcttagttgagcaatttagcttcacaattgggctaaaattatttagctctaaaaaaatacaggtgcgatttaataatcttgaatttcaaacctgattttaaaataaatacaaaatctggacttcttagccagtgctgtggactgaatgtatcccccccaaaatacatatgttgaaattctgaccctgaaggtgaaggtgttggtaggtggagcctttgggaagtgattaggtcatgagagtagagccttcctgtttgggattaatgctcttacaaaagagacctgaatgagatccctcatcccttctgcatgtgaggacagagcaagaagatggtcatctaggaaccagaaagcaggccctcaaatctrccttgttcttggacttcccagcctccagaactataagaaataaatttctgttgtttttatggcacttagtctatggtattttgttatagtagtccaaatggactaagacaaccaggggagtcttaaactgcttacttttctgtaaataatgacacaaatattctaaggctatgtttttttcaaaccatctactgtggagtcctactattttttagtgtacacagtctccaaattttccatatttgactccaagcttatctccttcagatgtactaaggaagtgtaaaaaaacagagttaaaatatgagtaaattgaaggagtcatactaccagcatttctgttttcttttataaaacaaatcctttttaggaaacaaatacttgtttcctaaaaacatatacttgtcctgagcaaactmtgtgtatctcagagtaaacaatcaatagtgtccagttgggtgaatgartttactctccagaactggttttattaatattattgatattttatttctatttatatattattgatattttatttctatttgtatattattgacattctggtgagtgataaaacattataattatttcattaaaatatcttagacttgtcaaaggcttattatacaattgttaaagaaaaatgaggtagatctatatgtgcttttattaaaagatcacctaagtctttagttgacagttttaaattgtgggaaaaaataaagagtatacagatgttttcacttgtgagggagcaggctatgtgtctatgtaacagataatcatagtaaggtcccttgaggtggatggtagaggggtagaagagagagtcttttctgtttatatccttttatagtatttaatttttaaaaatcatattcaagtattaaatttcttttctggccaggtggtgactcacgcctgtaatcccaacactttgggaggccaaagcaggtggatcccttgagctcaggaattcaagactaacctgggcaacatggggtagaacgccatctctacaaaaaatgtaaaaattagccgggcrtggtggtgcacacctcagctattcaggaggctaaggtgggaggatcgcttgagccctggagatagaggttgcggtgagctgagatcatgccactgcactccagcctgggtgacagagtgagactctacctcaaaaaaaaawtttttttgttgttttttcctttatccacccatctgcacactggtataaatatatatatttttaagaaaaaagtcatctgtattcatttcctaagggttccataacaaaatcccataaactgagtggcttaagcaatggaaacttactgtctcacagccctggaggctaaaagtccaaaattgaggtgttggcagggccatgttttctctgaaatctgtagagaagaatctttccttgtttctctctagcttcttatggtctgctagccatcattggcattccttggcttacagctgcagcacctyaatctgtctccattgtcacagagcattctcccctgtgtatctgtatcctgtgtctcttctaagtacactggtcgtactggactaagggcccagaccattccagtatgagtattaatttatctgattacttctgtaatgaccttatttccaaataggtcacattctgaggtattaggggttaggaattccacatatcttttgggggaccacaattcaactcataacacatctttgatgttgatatggcaaggaggcaggcagccagtaattaaagatatggctatttctgagataaccaatttagacttttcttttagcttcagaaaaaatgytaaaagcatggaaagaaatggaagaaaaggccatccactatgctgaggtaaaatcattgacgtcattctgtatacttattaattcttgatgtctccattagaaactatctttggttttgatatataaagagcatttttcatgtcattcctgaaattcagacaaaattctagtagatgctttgtatataaagagggatgtatcatagtgattaaaaacaagggctttgggaaaattacctagtgcctcactgagcttcagtttcctttatttatttattttttgaaacagggtctcactctgttgcccaggttggagtgtagtggcatgatcaaagctcactgcagcctcgacttcccaggctcaagcagtcctcccatcttascctcctgtgtagctgggacaagaggtgcaccaccatgcctggctaacttttacattttttgtagagamggggtctcactatgttgtccaggcttgtatcaaactcctgggcttaagcaatcctcccacctcagcctcccatagagctgggattataggcatgagccaccacatccagctagtttccatattatagggacaatttcttttctagtagggttatgaagattaaatgggagtcagtaatggtagttgtcactattatttttgtgactggtttagataggatggctgcacatcctggtttacctgggactgtcccagtttatacttaatgtcttgccataattatcagtagtagtccctttcactctcaaaattatgccggtttggacaataaattatatggtgtccctaggtatagctcattctctaggtggcagattttttccccttatcctgtacatttgtccacggtcctaagttattacactccttaatgtcagtacttaccctgaggatgtgggtggggatacccatggtrtcctggggtgggaaatccaagttctttatctttttgtgtccctattcaaggtagtggggaccagggggcagtcaaaatcatagagccaagatacaagtaataccaatggttttggtggtcctttttctttcttgttagttgatacctgttgtagctttttgcttctccggaggtaaaagcaaatactagtagtttactgttgtcaggagagaaaagagagaagactaagactaagtatgttcttatgtgaaagattaagtgtcagaatctgaagaatagaaaggctttaacaaaatcagtgtttcgtattatattatttagttctctaatgaagcagcaagtcattctgtatccttaagatctgaattttgtttcctatgatgtagtggtaagcctttcatttcctttgtattttcatcatattttaggttggtgtcattggatacctggaggatcagattatgtctttgcatgctgaaatcatggagctacagaagagcccctatggaagacgtcagggagacttgatggaatctctgtaaggatgcacttgtgttgttggtcttgacatctgtaatattttgtattctttctgcttacatctggcaaattaaacctctagtggttcttttctatagttttcctttccccaaatatattggcattatatttaaaatggaagctttttctcagtcacaggaaacttcggaaataattctttgggttggccttttttggtttttaataaaagcatttatttcataggagtgttaagaattttccaagtataactaagttacaaactatttccctactcattatayctctggtccaaggtattgactcttaaatgccctaaaacttgaaattttttctgaattaaagttctggattaaaaacttcagatattttctcgaattataggtcataatttttgtctttttaagtgtctgtggtgcagagatgtccccatgatagatcagaatagatatgaactatattaaactttgcattttaagaacttgtatagttcttattactcaatacaatgctctgtgaaatacttgttggcaatatgaacttgctttaaaatgggttcattattcaaataaaatattgtttcaagttgtagattaytgaagtcattaaattaccttcacttatcagagcgtgttttctcttttatagggaacagcgtgccattgatctatataagcagttaaaacacagaccttcaggtaagacacttctaccacagtgcttgaaggcattttaggtaactatcactagcctaacaaatgtgggggatctaatatttttaagttaaaaattttcttaaagctgcagaataaattccagttttggtattgccattgagacatggtataataagctttaagattgtgagaatttaggagatgataaagagaaagtaacagagaacgtgaggtagaaaaattttagaaggggacgtgaaaagaaagaatggaagacagaaaaaaggaactcagagaggaaaaagcagcaagaaaatgtttagaaagatggaaaaaataagtgttgcttaagattagagaggttgggccagttgtggtggctcatgcctgtaatcccagcactttgggaggccaaggtgggtggatcacctgaggtcaggagttcaaaaccagcttggccaacatggtgaaaccccatctctactaaaaatagaaaagttagctgggcatgttggyatgtgcctgtaatcccagctacttgggaggatgaggcaggagaatcgcttgaacctgggaagaggaggttgcagtgagccaagatcacaccactgcactccagcctgggtgacagagcgagattctgtctcaaaacaaaacaaaaaaatattatagaggttggaaagaatttgaggcagtgggttcaggtatggaatggttagagggaaggcctgtgctgttctaggccaaagcagattgctttgaaaataatgccttcatctgcactggtcactgatgacttgttttgttggcaaaataattccagttgaacatctgctaaatactgagcaaggtctgctggaaagagtactggatggggaatcagaggcttgaattctagattgagtaatttactgaccgttacctcaggcaaatctgcgtttcccatttcctycttctgcaaaatggggttgaaacctarctttcctactcagtgagtatattgtgacagtgtatttaagaggatgtttgtgaaaatgctttgaaaactataaactattatgtacttgcaagatattatcatttagttaaaaatttgttttgaagggtaacagaagaaataaagtctgtgccctaatgtgcattatacttaaatgcatgttaaaaaaagatatacttttacactttaaaatttgtagacacatagcaacacatgcaaattaatayacatgtgaaattgtatttcatatactattttcacatttaaaaaataacattatctcctcttatactgcttttattttactgaaatgtattcagtttagtctgaccagcagttctcaaaatgtggcatatggacctgtgagaatccttgaaactttgtcagagagtctgtgaggttagaaccattttcataataagatgttatttgcatttttcaccatgttgacattttcattgatggtgcaacataaaatggctttcaccttagtatgaatcaaggcactagcgccaaactrtgctagtagccgttatattttttaccaccatgcagtcacagtttttaaaaaatgacagtttcacttacaaatgtccttgataaagcagtaaaaatattattttatttaaatctcaacgcttgagtatgggtttttaatattttgtgtgatgaaatgggaagtactcataaagtgtttcttctatacagtgaagtatgatggttgtcttaaggaaaaccacttcagtaattgtttacgttgctagttgtctggcctctttcagggaagataccatttttacttggaagagcaactgtcaggcaaactatgattattcagatttgcatacgtgagataatttctaagaaattaaatgaaaataaaaagtatagcacacttattactttaagggaaaaaagcagtatttgttgtcaatgataaaattccatgtttcaagcaaaaagaattttagaaaacttgtatttaccagctggaatgacagcttctcagtacttaaaaacttttctgatgagattagtggtgatatcagaaaggtttgcaaaaatgtaaaacagtgcaagtgttctcactcaaatttttttgttttagaaaatatcgttttttggtttttgtttttagaggtgggctcttgctatgttgaccaggctggccttggactccctgggttcaagtgatccttccacttcaggcttccaagtatctcaagtagcagtaaccagtgaaaggaggtggctctcgtagatatgagtatactgtgtagacacatgtatgtatagcacttagcatgtctgaggaaatgcagtatgactggagtgtagagtttcaggagagagaraacctaaatataggagagagagaaaacstaaatataggtttttttgtttgtttttaataaaaacatgttaatgggcaataggtttgttatttttaaatgaattaagacacgagtatttttaaatttctgtttaattcctgaaaaaccctttggggttctcaagaattttctagtgtaaaggkgtcctgagaycaaaaagtttgagaactgcttatctagactattctcagaagcttggctgctcaggaaagaagagaggtgggtgagtagctaaaagttgatgtagagtcaagggaggtcacttctcagaaggaagacttaaacatgaggtgccacatgatgatgttttggttaacaacaaattgtgtatactayggtagtcccataagattatactactrtatttttactatgtattttctatgtttacatgcacaaatacttaccattgtgttacagttgcctacagtattcagtacagtcacttgctgaacaggtatgtagcctattgtcaaaaggctataccatacagcttaagtgtatagcaggctgtaccatcagggtttgtataagtattcacacagtgacgaaagtgcccaatgatgcacttctcagaacatatgctcagggccaaaaaagcctgtggagagggaggtccctgaacaagttgagagattggctccaaagaacagtaggagggattagccttgatactattgatattggaaagagaatgagtgtggatacagatacttttttgggagtagaggttggaagatcagggtcttactgccttatggcctcttatcctgcagtggtaagtgaggttaactgaaatggaagaggtgacgacctcatagatttgaatagagtgctaaagacttctaaaagccactgtgtgcagtggaagatgttgttgacccaaaacattcattaagaatccaggccaggtggctcatacctgtgatactagcgctttgggaggctgagacaggaggatcgtttgaggccaacagtttgagaccagtctgggcaacatagtgagaccctgtctctacaaaaaaataaatcaataaaatttttaaaaagctgggtgtggtagtgtatgcctgtagtcccagctactcaggaggctgaagtagcaggatcgcttgaggcccaggaggtcgaggctgcagtgagccaagattacactactgcacttcagcctgggttgacagagcaagactttcttaaaaaaaaaaaaaaaaaaaacccagagcagaaatgaaaaacctgtgaattagcagtgacaaatagtgaacagtaatattaattttttgttgataatttagtagcttggatacaggaactgatagagcagatggttggattaatccaaggttaggattttgctgatggaataagaggataaaaaggttgaagatgttaacaaatagtgatttaagtgatagaagttgtagctagagtaaaatattaaaatctaagatttcaaatrgagcaagtccaattctttttctttaatcaatatttctgggccaggcgtcgtggcacatgcctgtaatcccagccactttggaggctgaggcaggagaattgcttgaaccagggaggcagaggttgcagtgaaccaagactgtgccactgcactctagcctgggtgacagagctagactccatttcaaaaaaaaaattctgactcccagttttctggctaatgaatcagataccacagatacacagtgatagcatttgtttaggttatattttttaaaactttgaggyagccctgtcaacataccatgaagctcagaaataaactgctacccaggtagcttctttgagtgtcaccttgagtgacaaactgtaacaagattgtgtctgtcattggggcctattatataatcacacttgatttgtggcctctattgtcttttctagcttagagttgacttgaatctcttgttcatctgaaatggttaaaaccagctttcttcattatcctggagaaggctaaagttctgagggctttcactgtcttaaggagctagttatatgagaaagctcttggcttggtccatggtatttaggaaggaatgctgtttggagaagaacctttttggagccttgcatttgattgttggtgagraggagacaacagagatgtgtggggaataaagttgggctatgggggawgtatttggagtgatagataacaaaggacacaacgttttttaaacctcctttgatgctcatcatttcctttttggtaaaatgggggtaacaaaagtagtcttctcacatgactgctgtgaggattaaatgggaaaattataagcagagagtagcaaatattattattattgcatttaggcttaattattgtccaaagaawataccagcatgatgcataagcaactttcaactcctttagccattttstgaaatataacaattaatgatttttttttwaaatcgaggtcacattttaaactgtagaacccattgtgaccaacagccatcccatttgagggtatctggctgctgccagttggctttaagatgtcatactgccctcaaatggaactttcaggatgtctacaggtccctttactagttggtttcaatgagcttttttcaaagtttttctgggttgtaaacagacggataaacatgaaattccaagcaacctagttcaagggcctccttcctttaggtaatgaaagtttgatgaattgtcctactgtttctaaatatgtggttartcatccaagaaaaattgttcccttggccagaggctgcatttgtgtctagggcttgggttagtatgggttaaagatagccaagactattgttctcaagcacaggcaactaaggtctcttactgataaatttatatatacattatacacctgcaaactttattttttatatataactagattttatttataggtaatctttatatcttttatcttaacccaatttttaatttaaatggagatgtttattaattaaaattagtttcagagtttcagggatttttgagraattttttgttyggaggctgatatgttacagaagaaaggttatatccactgactgatgtcttttatagatcactcctacagtgacagcacagagatggtgaaaatcattgtgcacactgtgcagagtcaggaccgtgtgctcaaggagctgtttggtcatttgaggtaggaaaattgcttcatttcctactgaaaaaccaggatacgtttatcttgttcctctcaaagtacaaaagccctctttggtaaagtatacttacccaggaagaattctgaaggtaccttgggtagcttggccatagctatctgcatttatgtgtccttttgtatgcattactttggagataagtcattaaatctgatgctgattgtggttcatttcctcmgctgggttttgggaatatggtgtacagtcttggggcatgtgaaagtgtctgacactgatttaatctctccagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtgtaagtaattattaatgaattatttaatgtgacatkgagttgctattattccttgcaaaggggatttttatcagcatgaggtgggccctcttgaagacatgtatattttgcattgggatgacatccatgttccttgcttggtgtccagactagcaattgagatgcaggacttattatcatctctcctttccaatttctctgttgttatactcctcttagcccttgactactgtggtattccaacctaacttggggatagatgtacctgcctagataatgaaattgaccatctattcaactgggttttttttttctttcttcaactaaaatggtataagatgagtggatatatttggttttagtcaatgaagaaagggtccaaggacaggttactaatggtgtgtaaaggtgggaatagttttgtactgaaatactctggttgtgcatataagtagtaacrgaaatgtaagtcttaggaatatgataagaaattgtgtgaatcaacagagatgcttgcctgtaatcttttgatgtttttttcttttccttcagacacagagttctgcccggtcccttgtaggatccagtctagaaggtgcagtaacccctcagacatcagcatggctgcccccgacttcagcagaacatgatcattctctgtcatgtgtggtaactcctcaagatgggtgggtttactttgtaacaatagatagctgtgttttcatagcagtggtataggaatgaggcagtagttgttaaggtagtcttctgtgccttcagaccagggttgagtcctgactatccctttgtaataatcttaggcaacttacttgacttttttgatgttcatatttcctcacctgtaaaacaggaatgtctcatagaactkctgtggaaatttgattagacaatgtatataaagtgcttgggaaataaatgttcagcaaatgttgcgtattattagctcaaatgttgcttattattagctaagtccaagttctaagtcctttcttttattggcttattactttcttttactcaaaccttactccttcattaacagtttatgagaaattatgctatcattttgcatttatcattttggggatccttgattacccttctaataaatttttgagatctattttataactttgtatttctaagattagacttttttcagtgttttaaatcagttttgcaagaactcagattccaagccctrtattttattaattcctactcttttgctaaaagctgaatgactatccatttctgttattttctcagcttaagatgtgccgtatccaaagccagtggctctttgctagcttgtgtattgtcgcttttctcacaactcatggagacctctacagcaccagcatttcctggaagctctgcccataattagttttgcagaagtgcagccatgttacatcactgctcaggaggtcatgcagttgcacattctgtactctacttttatgagagaaaagcacatggcaggaaggcaagctgatatcaggtattttatttttttaaagaaagcaagttccagggtatatatcttggggtcattatacatgtggcccaatgcagtacacctacaactgtagcacaggctataattaaatatatagactttacaaaatactccagtaatcagagttgaaggaagtaaaatttaatactttacttacttttttgcctttattaaaggcatttaagttttttagcggatgttaatgtttacaratgtcaccacaatacaggtaatttccaatttgaagtgtagttgcttgcaaaagtatatctgacagacattttcaatgtattttctagaaggaacacattatattttgttttgagacggagtctcattctgtcgcccaggctggagtgcagtggcacagtcttggctcattgcaacctccgcctcccagattcaagcagttctcctgcttcagcttcccgagtagctgggatttcaggtgcgtgccaccatacctggctaatttttgtattttagtaaagacggagtttcaccatgttggccaggctggtctcgaactcctgacctcaagtaatccacctgcctcggcctccaaaagtgctggaattacaggcatgagccaccatgtccagccagaatacattgtataagaaaattgatttcaattataatgtacctgtggtacttaactaccaaggattgggaacygtttgaccataatttttccatctgttggataagagctgaatcagaatgtcattctaagctaatagtggctatcatccatgacctaaaacggactcttgttaggggactgaagattggcaaagggagaagctagaggccatatagaagaggaaagcatgaaggtagaaaccacaatcaggactgccttcaaatatgaacttccagggatacttcttggttctgggtagctcccccaccacactgttttcttttgctgtcctcaggaatcagcttgcttgtttcgtttcattgctatcatctgtagtttctaatgagtttttcactttctgtgatctctacagaacagattttacttttctctcttctcccctacatttgtgtctgtgaagtatgcatgctggtgtttttactacttttaaggaaagagaagtatttagaaacaaaaacgtatttcatctgtctttgccacaaggattttttcctccctagttacattttcacgggaaaaacaagttgtacataagtgcatcttacatttcagaggaaagtcagactggagttatagtggacttcttatcattagttaggtagaggtagaggcagcagcctggtcttaacaggactctgcctctgtagggagggatgaggaaactaaagactacaggagtcaactgcactggggtactgggttacaggaaggctagtgatcttgctaacctagaagactagaaagtagaggaaattcatatgcccttttcctgagtttgaaaaggctttgttctttcatctcacagggagacttcagcacaaatgatagaagaaaatttgaactgccttggccatttaagcactattattcatgaggcaaatgaggaacagggcaatagtatgatggtaagttttgtgtggatatgggtgcctgctttggctatgttgggtgcaaaaggtttaactttccatgctagccttatctggcatttgggatgcatatgggaaatagaagaactcaagaggaaagagcatttggggaatatcctcaaccttaaatccttatctgccgttactcagggatatactaggattatgtcatcaattatcttcaataatagcatttttggtcaaattaaatgagtggtaagcttcttcacaatgtgaccattgaaattgaatggtttgttctgtacctttttgcttcagcaatcaattttctccattaagatgggacttgtactttaattcagatatggtacctcccgaatagaaaataaattatgttaatatagttgtaataataagtgtgtgttaagatttggttactataaactactgatttgttaaaacttgaggaaattaccataaaatgtctactgaatcaatttttcctgcatttagtcttaatgtcaattctgtayatttcctctttcattaagaaaaatagcagtggccaggcatggtggctcacgcctgtaatcctagcactttgggaggccaaggcaggtggattgcttgagcccaggagtttgagactagcctggccaacatgggaaaccctgtctttataaaaaatataaaaattggccaggtgtggtggcacacacctgtggtcccagctacttgggaggctgaggcaggaagatcgcttgagttcaagagtttcaggctgcagtgagccgtaatcctgccattgcactccagcctgtgacagagtgagactttgtytcggggaaaaaaaaaaaaaaaaaggataatggtggccagccatatgacatgtacctgtagtccgagttactagggaggctgaggcagaaggattgcatgagcccaggagttcaaggctgcagtgcattatgattggacttgtgaatagccactgtactccagcttggcaacatarcaagatcctgctctcttaagaaaaaaaaaaaaaaagaaaagaaaaggaaagaataattgtttacttcaaatatttatgaaaaaaactctgaaatttttttaaatcaggaaataaggtaaatgaaatgatttttcaacttttgattatgaaatgtccaaacagaaaacttgcaaaaatgaacacccatatacttataacttatagtcaacatctaattgtaactttttcatgcctggttttagaatcttgattggagttggttaacagaatgagttgtcacttgttcactgtccccaaacctatggaagttgttgctatacatgttggaaatgtgtttttcccccatgaaaccattcttcagacatcagtcaatggaagaaatggctatgaacagaaactacatttctactatgatcagaagaacatgattttacaagtataacagttttgagtaattcaagcctctaaacagacaggaatttagaaaaagtcaatgtacttgtttgaatatttgttttaataccacagctatttagaagcatcatcacgacacatttgccttcagtcttggtaaaacattacttatttaactgattaaaaataccttctatgtattagtgtcaacttttaacttttgggcgtaagaccaaatgtagttttgtatacagagaagaaaacctcaagtaataggcattttaagtaaaagtctacctgtgtttttttctaaaaaggctgctcacaagttctatttcttgaagaataaattctacctccttgtgttgcactgaacaggttctcttcctggcatcataaggagttggtgtaatcattttaaattccactgaaaatttaacagtatccccttctcatcgaagggattgtgtatctgtgcttctaatmttagttggctttcataaatcatgttgktgtgtgtrtatgtatttaagatgtacatttaataatatcaaagagaagatgcctgttaatttataatgtatttgaaaattacatgttttttcatttgtaaaaatgagtcatttgtttaaacaatctttcatgtcttgtcatacaaatttataaaggtctgcactcctttatctgtaattgtaattccaaaatccaaaaagctctgaaaacaaggtttccataagcttggtgacaaaattcatttgcttgcaatctaatctgaactgaccttgaatctttttatcccatttagtgtgaatattcctttattttgctgcttgatgatgagagggagggctgctgccacakactgtggtgagggctggttaatgtagtatggtatatgcacaaaactacttttctaaaatctaaaatttcataattctgaaacaacttgccccaagggtttcagagaaaggactgtggacctctatcatctgctaagtaatttagaagatattatttgtcttaaaaaatgtgaaatgcttttatattctaatagtttttcactttgtgtattaaatggtttttaaattactttcttgatctctattcattataaaaatcagattataataaaacagttgaatatggcttaggaaaatatgaaggttccatgaagtggaattaagagcatagaataactgtactttccttaggaataataggacttatggtaaaggtagtattgggcaacttctttaagagtgttttcctctgaratgtcctatcaccactatctacatctaaaaaacatgctcgattcttgccctataaactgatgtcacagccccaccatccccatttttgctagtggtatcattttcctagtcaaccaaattttttagtcatcacatatcactgttcgtcatctattataataggcagtctctctcttgtttccctggttttagaagattttartaataaacatttattgggtacctgttacttggagggtattaagctagatggcaagatctgaaacaacataggcagtatagtaaaagtgcttatctgggagtctgaacattacaagccatccaagcattgcaattattgttaaggattattttcaatggtcatgcattttctaatattttaataattggttaaagatttgttatagcgtgggggccgctgctggtgtgtggctggggttatgtcagggcagcctgatctatataatttgggcagatggtgtgagtcagaacagactattatagtgggatccccaaacttgcttttgatgcatgagttggaccactattttttggtgggtaacaacttttcagaggggaatggcagttgtgaattgtatacatttcattctttaagcaatattatgaaaaacttcagagaatgtctacagaaaacagggtatggagcaagttattttccattctttttgctttttggaagttaaaatagctaagctctgcaaatatcatttatttggaacagataaggtcccagacattcctagataataaaaatcaaatgaatgatacaggtaagtgtatttattgaagggtgtgggtagagtggtctgggaagtcttgctttaatgaagacggattgattctatttacctcttcttacttccactactaagtaaccctgggcctgcagtttcctaaccacttgacttccttgccaacagtctgtctccactttcagccgttttatagattcattggccctaaagcactgctttcccatacttccctacccaagagggcaggggtccccaagccctgggccgcggaccggaaccagacagtggcctgttaggaaccaagccggatagcaggaggtgagcggcgggcgagtgagcattatcgccttgagctctgcctgctgtcagattagcgagtggcatcagattctcataggcacgcgaaccctattgtgaactgcacatgtgaggtttgccggctccctgtgagaatctaatgcctgatgatctgaagtggaacagtttcatccccaacccacacacacccccaccccgtccgctgggttagaggactttacaaccctagtccaccttgtccagttatagttccacctctagcctttcaaggcttaaaccattaatgtccttaatttctcttgtattcatctatctcccaactatacctttttccttcccttttttatttttggcaatatgtgcccatggttttttaatttaaaacgaacagaatatgtartgacgcctaccatagcactccttcccatcacacaagccttcaaggaaactgaagtacttactttggtctccctggaggattccctccgcctcccgccccatgtgcttagcaattctgttcctgtagtctggatggccttcataaagccctcactggaccagcattctggcacataataggaacacttaaaaaacgagagaatgatgccgttatatctaatatcttcctcttctgaactttcacagcactttatttgcaacaagtttagttgctcctgaagggcaggatctctgccggaagcaagtgcgtgccacacagtggggctccgcatacactgcaaaaggacaaataaaccgaacagctaccgtttgagagtgagcgagtgggttctctgcacaagaacaaaccaaccagtcccttgtccgaaaggscgtctccttttctctgcttcgctgctcactccagactgcgggctgtcctcttccgaagcagttaaccagcagtgtacagaaagcgacttgcctccaaaggagcctgcgcggcccgcggctaggagaattttgtcccatgcgctccccgtctcactagccgcgggccggggctacgccgtgtgcgtccccgcgcagccgcagtgctgggcgagtgggcggggccggctgttggcggcggttggctcggcgcgggagtcggctgcacgtgcgggcgggggcgatgcgtcactgatcggtgaggcgcggccgaggggtcggctttcctcgcgagcctgcggctgggcttcttctcagttagtgccttccacccgggagcgacccttgggagagggagtttcaggaagctcaccgagcaggggcggcccactggcctccgggggcggaggagttggcaaggggtcagcgggctcagccagaagggaagaatgaggggacaggkgtactggactccccggctcagcctgcgagagagcgccaagtttccggagggagagggtagaaactggagggggtggacctgtcactcacgggactgagggtccttttctcccgctcccaggaggaacgagaatgaatatgactcaagcccgggttctggtggctgcagtggtggggttggtggctgtcctgctctacgcctccatccacaagattgaggagggccatctggctgtgtactacakgtgagcggcatgtgcagtcagttagggctctagagcagattaaaagggtactccagagtggagtctgggaagttgttccctctgcaacgttcgggggcgcatgtcccatctctagggagagcacgggggtcgaagcgggcttttgcggagcaccctccagatgttggacagttttagtgctatgttcgttttgttgcagagattaagtctccctacggttattcctatacacagcaaactcaattatttgtagaaaaatgaagaaggaagaaaggaagtagtcactctacctctaactgaagagatggataaattatagttcgttcaactgtacaggctttagtttgccgctgtagatgctgtatgtttatggttgtttcttagactttttcatttaaaagcttccagtgtctggttacgtcttgtaacaccatgatgactgtgatggtgcttatgtccctggacctccagggacataagcacaacactgatgggccatgctcctccctccttactgttgctgttcaagttggggacaggagtggtgtgggagctgttgctctcttgttgagctcgcttagcttttccttcagcctaattaccacaagttccttttgatacagactagtaagagaggccagtttgtggagaaattgggataatggtgtattcaaaaagagcgtcaactttttgcttgtttccactatccctcaaaactgatatttctactttcaaatccatcctgaatcctagaaaaagagcaattttaatggtatatcttagcagatggagctctacataagaaattacagattagtccagatttccttccagtttaaaagcattgtctttctgacagtaaaaccagagaaaggacatttcaargaatgactcaaagaattagtaatgaacctcaaacagttcatctttccttgttattatgacyttgcaaatgtgtttatattttcaagaccggtagctaagttctatgaatttacaaggtgcaaaataggactttgttttctttgctccccaaatgyctcctttttataatttccagggcttgctttcatagttttcacattccaggatttggttaacaagcccttatgctatttatttgtatagtcttgtcacccttcatcttttcatgctaattttttgtttttatatagaaattttatgttcccagtattttaattaccttgtagatagatcgaaagaattataagcctcagaaattttctctttacttcaaagtttgcattgtctttttttcaacctggtgattaaatgtattatatattttgatttggctcttgttatgtactattaatgtacctctactgaaagccattagaattttttaaacaaatatttctcagaaggttaaagaccgaggagaatcctttgaaccttagagcagtgctggagacccagaggtacggttggttgagcttatgaaacaaggtgtaacattggcagtttaatttgatctttttccctttttaggtgtggaggtattttaagcagttgttcattatgagcaattcatattagtgaggctttagtaggtcagcagcatgagcaagagtgagtatttattatagcattttagatttggaaagataatttttctttttataattttgtcaaattgaaacatctttttgcaggggaggagctttactaactagccccagtggaccaggctatcatatcatgttgcctttcattactacgttcagatctgtgcaggtgagtgattcctaggggaagcctccataccagatagacaggcatgacaggagttaccacacttgtgggtggagatagatttccttattgcttaagcagatggtggtatttacttaaatgcagaagttaacgttcagagtacagttgttacaacacaagttatgatgttaaaccacctcacttacttgaaatgaattaaaggtatgaaccaggaagcttggaaggactgacttctaccatctatatcgtggtatatagcaaattttctgttgctgctgtcacaataaaagtaagaattagaaacacaactagacatacaaaccagtgattatgtggtttagaacagtgtttagtttccatagaggcaggctcctgggctactgttaacatggaggatcaaaatttttatacacagcctttctgcctcatgtttttttgcctggtatattaagcacaattttatgtggaaccttagtgaatgttatattttgatggcatcccgggatatttgaaataagtgtctaatcctcgaaaagtgtcttggccatgggagacaataaaataagtatctttcaatgtaacaagatgacaaaaccaggattaggctgtgaccactttcgcaagcccagtgtgatcataaatctttggattcagaagtttgtctgccatctgctgctaatttttcaggactcaggaaaattctgtgttatttaatcttgtaatcttatgtctaggcttcctgctaagtgagagtttaattataaattcttaaatcccctaggttttcttcctgtccccttttasatggcttagggaaagaattgtgtctactgaagtgaaatgtattcttcccctaatcagactgatttccatatgttgttccatatttattttacccattctttccttagttcatgccatcacttctttatctgccatctcactctccattccttytctcctgtctaaatcttgccaggcttttaaaggctcatcccagattcttcctcttctgatctatagctcttaaagtctatattgtaaattttggccctttgtcttattttctttaatattgttgtcttgcattgtttgctaagtttttttatgtgttttctttccagaaaggctccagttttcttaaaggcaggagttgtaacacatttatatttctggctttctatttatggtggaagttgttaaattgagctgatttctcaggaagcaatgtggtgtaatgaacatggggacccagcgttaccgccagttggtggcatgactttggaaaaattgcttaactgtcatagacttcagttagtcttctgtgaaaggaggaattttaattacataacctcatcaacagccgaaacaatctataataatgttagcaatggcagcattagacccttaaaaatcaagactctaaggcccggcgcagtggctcatgcctgtaatccgagcact

SEQ ID NO: 13244 - DNA, 222094 bp, Homo sapiens
gcatgagccacaatgcccagctgtaattttccttcgtcttttcatgccttgatagctcatttgtttttagcactgaataatattccattgttatgtatccattcacctactgagggacatcttggctgcttccaagttttggcgatagtgagtaaagctgttataaacttcatgtgcgtgcagggttttgtatggacagaagttttcaactcttttgggcaaatcctaagaagaattttctggattatatggtaagagcgtgtttgtttttgtttctgtttgtttgtttgtttttgtttttttattgagacggagtttcacttttgtcgcccaggctagagtgcaatggcatgatcttggctcactgcaacctctgcctctcaggttcaagcgattctcccacctcagcctcctgagtagctgggattacaggcgcccgccaccatgcctggctaatttttgtgcttttagtacagatggggtttcaccatgttggccaggctggtctcgaactcctgacctcaggagatccacctgcctcagcctcccaaagtgctgggattacaggcgtgagcaaccgtgccctgtgtgtttcatttttaaaaaactgtagaactacttttattgagagttttaggacccttcctgatagacatagagaatctatcaggaatgtcatgaaccaaatcgtgacatcagaattggaaactgatgatgaaggaaagagcattgcaggttactatgcaatgcagtctagtatcgggagaagtgtgaggtccatcatgggggccaccatgagtgaaacaaaagtgcttttgtgcaagagttggagcatggccctgcttgtggtcaggaacgatgttcctttattcacagatcttgggccagatctacctgactctatatgagtcaagtagatcaaggctgataacactttaaaattattaaatcttcttttttttttttttgagatggagcctctctctctagcctaggctagagtgcaatggtgtgatcttggctcactgcaacctccacctcccaggttcaagggattctcctgtctcagcctcccaagtagctgggactacaggcgtgcacaaccacacccgactagtttttgtatttttagtagtgatagggttttaccatgttggccaggctggtctcgaactcctgacctcaagtgttccctccaccttggcctcccaaagtgctgggattacaggtgtgagccactgtgcccggccaaaaaatattaaatcttgaggcacatgcaggagtaagccatgctcagacccaatcttcgatgttactaaaaattggaggggatcacacttcatggttttgttttgttttgtttttttgagacagggtcttgctctgttgcccaggctggagtgcactggtacgatcacagttcactgcagcctcaaactctggggctcaaacaatcctcctacttcactctctagttgggactacaggcacacactgctgtgctcgactaattattattattattattattattatyhttattattattattattattttgtagagacagggatcttgctatgttacctaggctgttcttgaactcctgggctcaagcgatccttccgctgcagcctctcaaagtgctaggattacaggcatgcccagccactttggggcttttttaagccaacagcaaaaaaagactataagagagaratttccccttggctgtcttgtttcatggattcgtggaaactccyattaaacagccggtcacagaaaaagatatgccaaggaaaattacttgacagcactcagtcaaagtgacattttaaaaagagactattgcctcctccatcttaaaagaactgaccttttgagccatgagaaatgaaacagaggcatctgatcgaatgataacaatgcacttctgaagattcaaacatcggaacttcatgcattggacacatatctattgaatgactcttaagtgaacatactgtccctgcctgcttccagagggtactagagaggtcggagatggttcataaaggccttcacatgtgctgtcatatttaacaatcagaaaggtacttgaggcaaagaatctgatcatctttgtttttccttgagaaaatgcgctcagagaggtttactgacaatcccaaaggtgcttggttggtgcttaagagatctgggtttaaaacctcagactgctgtctactatggcctgtgtcagaaagactggggttggaattcctgttccaccactgctgtgttatttaacccctccaaacctagattctcaacaataaaatgggggtagggagggaattaaagtatgtaccttattttttagagacaacatcttgctctgtcgcccaggctagagtgcagtggtgcaatcatagttcactgtagtctcaaccttccaagctcaagagatcctcctacctcagcctccctagtagctggaacttcaggctacactacgcccagctgctatttattatttatttatttattgagattgcatctcaccatgttgcccaggctggctacttaaaaaaaattttttttttcaagacagggtctcactctgccacccaggctggagtacrgtgacagagtctcagctcactgcaacctctgcctcccaggctcaagtgatcttcccacctcagcctcccaaggagctgggattacaggtacccaccacyacacatggctaactttttattttttgtagagacagggtcttgctatgttgcccaggctggtctcaaactyctgagctcaagcaatcctcctgctttggcctcccaaagtgctaggattacagttgtgagccaccatgcctggccttggccactttagttttgctttttttttttttttttgagttggagtcttgctctgtcatccaggctcccaggctggagtgcagtgacacaatctcagctcactgcaacctctgcctcctgggttcaagcaattatcctgcctcagcctcccaagtagctgggaccacaggtgtgcaccaccatgcccagctaatttttatatttttagtagaaatgggggtttcaccatgttggctaggctggtcttgaacttctgacttcaagtgatccgcctactttggcctcccaaagtgctgggattacaggcaagagccaccgtgcccggctgcctactttaatttttaataaagggttgttatataaggggtaggtgagagaatgaagtaaaattgagtgttacagtctccagttgttaatcacattataattattctcttttaaaagttaccaacaagttatttaaagaatcgaatggaaccctttggaaatacagtgttcatgcctctagtattaatgccagtttttacttcgaggccagcaagctagattccgatggccttccctttccaggatgggaagcggatgattgacttcaattttcccccttccgttacttctctgctccacatcatttctgtgctgatgcagggacgatttccactccttttacagcgtagatgttaaaagcctgtgcggagcagctcattcatcattttccgcagagctttacccctcacttccccagccagctaaatgcaggctgttcttgactctctgatctaggcccattgcagggtgagggccaggctcaggagtttccagggtgaaaaccaggtaagcttgatgttggaaggatgaagaaggacccaaaagggtctgagatgcagagctctccagatgggcctgggagcctgcaggggaagaggcctctctttatatcccggaggcctggtgcaactctagttggtttcatgtttgttgcgagtaacagcagctcacatgaagcggtgcaccatgttcattttacatggatcatctcaaggactgcttacaaaaaggccaggaagtagctgatgttcttcccatcttacaggtagggaaattgaggcatggagaggcaaagttacttgcccatggtcatataggtagaaagcagcactggcagattcaaagccagacatctactctcagatacacgccctgggcctcaaggccagtttgcctgggcatttccctttaatgtctcctctctggaagtgaatggtgtcatcagaaaggttccagtgccagcaccaatcaatgactgtcccagtgagagcttggtcaaatccctttacccctgcagggactcaattttctcacctgcaaaatgggggtattaataaagccaccccccgcacccccggcccccagcccctccacctggttgcaagaggagtggttgtagactaagggcctgcgtcaagtacagaacccaggaggggtctgcccaactttaaccctctctccaaatcctctagcctgaagcagcagaaacccacgtgggactgggggctgcccccttccgggccttccccaagcagaggggtccccatctagccccgcggggcaacggcggccggtggctgcgtgaagggccccctcccccgacgccggggagcaggaaggccactcggcaccatatttagtcagggggagccggcagcccagagctggtatgcggcgctgggaattcctgcaggaaggagtccgcgcctgccctttttgggttgtctcccgcccgccgctcccgccgctcccggggagggggaccggcccggcccggcccggcccgggaacctcggaggagctggtgccgcgcggggagcggarcgcccgggctgcccgcgggtccccggcctggcgcggggccagcccaccgcctcgacttccttttatggcctgtgtgtgcgtgcgtggacaggagcggggagggagggacggggagaagacggagagcctggggaagagagagagagaaagcgcagagataggagtgagacacgcgggagagatggagagcaagagacacagagaccagagacaaagtgagacaggagggagagacagatacatcgacagatctagagaagcgagagggacagagacaaaagatagagcgagagacagcaatgatcagagtgacagacatgcagagacagtggcagagacagagcgagagagcctgtgatggagagagacagggaatgcaattttaggcgaggaatccttggggaagggaagttgttgaagggaactcgcagactctgggggcacacccactttctccttggatcttgacacttgcatcttgtaaataacgtaattatcaccgccaccgccttcccccattttgtagctatggacaccaagtctcagagaagtgaagtgacttgcccaaggtcacgcagctggcgagtggcgcacaggggagggggacagctgaaataatcacagtgggcttatttttaatttttatttgtattttggtcgtggtgatgtgggtggaggtggagatggcaagttgggaaaagtaaaaacttccccttcctgcacggttcccagcaagggtgggggcctcctgtcttgcactttgcaaagttcaagaaatcccctttccctacccttcacgctgcacagccggccctctttccagacagtgcgatgccaataaaatgggaagtggggtgggagatgtcaagtcagatccaccacagccccgacacggggaggaagaggttaaagcctttgcggccggaaccgactcagggaagacsttctcaagcatcccgcacagacactgcctgctcgaccccctttctctagggatccggagcgtctgcgaccgcctsgggccggggctgagactcccgtccctgtgcgcacctgttccgtgcgcccttgtgcggtgcgcacctgttccgtgcacccttgtcccgagcgccccagctccttgcgctcccgccgggggtgcgccctgcagggggcgcggcgagggggccgcgagggaccctccccaactccaccccttcggcctcctcccctttcccagccgcgggcagctccgggtctataaagagaggcgtccgaggacgcgcagggagatttggacgctccggcctgggaggtgcgtcagatccgagctcgccatccagtttcctctccactagtccccccagttggagatctgtaagtagtagttgtcattctgggggcagattgcagggsaggggggtgttaaaagtcctatagggtattctataggggctggggtgcacttaggggtccctgttgtcaacctcgtaagggccatggtgggggcagagttgtgatttggatytctctctgccttatcgtcttagattatcctagactttccccaaacagcatttctyaagattgccagtgagaagtaccattttgggggtgcttattaacgatatcaatgcctggacccaactccatttcccaactctagaatccccagaaaaactgccttaaaaaaaaaaaaattagtcccgagtgattcttgttaagaggctaatccaggagatatgctcccttggaaatctcagaggtccggtgcagacaatcaaggcatctcacttttattctaggcaccaaaaaatttacagctgaacttcactgaaaagtcacttgctatcacacagaagggcaaagtgaggctccttgtggatttgaccgtattgcacagttgtgttgataatgcattaaatcagttaaaaacacatgggcataggcttagcagaaaggagtgttgttgttttttttttttaatcagtttaggggaggttcttctatgttgagaacccctgggagataaggctggttgtgatctagtttgttacagcccactttttcctcttctccaaattaaaaaaaaaaaaaacaactcacccaggttgaccccaaagggcccccagatacccaggtgggctccaaagtctccatttgcttccrcgatctgcaggtgcrttaggtaagattacactagaatttcccgcagagccacctgtgtcaatgccactctcgtgcccaaccaaatgggtaaaacgagagaaagtgtggctactgcctgttgtaagttttcttccagcacagggtctggtagggattttgccacttgagaaaaggtaccatccaaagccatgcttgtcaagaagtaaaagaaaatatttagaaacccaaggygggagtgtttagttgcagtatgaagaactgagagattaaatggtgaactgtccgtccggggtttggcaaaaagaatgcaggctattaataaactgctttgcatagttttttgtttctttgatttactyaacgatactattttagaattgttcagagacggaacttgacgctgaactgaaagtcattaggtggcagggtgtgaaataagatagrgaattttgtttgaaggaaattgatgttttccctttgagatagctaccgttgatggaacacttcagtgccacatgctgttgcaacatttaacttaatttatctcatttaatctttgcaacaacttcataagaaaggctttatgatgcctgtttagtatacaaggcagctgaggctcagagaggtaaagtgtcacacagccagcaagtggtagaacccattcccgggtcagtttgagtccaagttcatacccttgaccccactatctttcttctttaccatggacacaaacttgttggggtcaggtttctggtgggactaaatgcttccaacaaagtaaatgtttatcaccgtgtcctttgaagaaaacataaactgactttttgcacatttaaaataaaaggcactgtttgtcccctgattgagggggtgacctagctgaaaccagtgaccctaggtgggctgccatgccgagagtccagaacgtgaactagctgggtcttttccgagaagccgccaggcttgccttgtaaacaccatgtttttttattatcatgtccgaaatagatgtgttattccgtacaaggtatctgttatggatttgttatcattacttttccgtgggagggcagagattgaggcaaacatgcccatttatggaagygttttccatgaggccatccccggccccctcgtcagttacccagccttgcaccgcagcccggttggtcctggccctggggatttgtctaccatgtccctcacccattgaagaactagtggagaaaccctaaggmgaagagatttgggaggaaagtgggattcttttttcctaccccctcttattcagaggtttgatttttttgggtggggggtgggagggaattgtctcctttccacaggtcttgaatccaaacaggtgggtcttccacrttaggcacaagcgtgtaattccaagagcagatatatagtagatttttcttgaaaaccaagttcaatwttcaatccagtagaatcatagaaggycataagcaaatttaaaaatcatctcccgcacctccccaaacctcactttctcatccgggaaatggggctaatgagaataactcatgttttttgggcacttttgcctggcgagatgctaaacsctttgtggacattatcttacgtcttcataacaaccctttagagtagatactgttattmtaactggctttattttacacatatggagtctgaataacttgcttaagatagctcagctaaccagtaaggaaaasaagattctacaaatctaggtctttctaactccagagtttcacagattaccctcatgggaggatttgatgagctaatgtgtatgaagggtttagcacagtgcctggcccctggtaagcttyagtgatggttatttatagcaaacacaaccagagagttcaagatgtttgctcagtatggcatggctcatctttggcagaaccgggaagcctaaactatgtggccgttaaaggagaagcttctcttaattttcttccctttgatctcataaacctcgtttctatttgggctgaaagtggtgattagaatctttaatatattaagctaccattccttacctggattgggaatgttacaaattccarttacatttgtttagggttttgtttgtttgtttttgagacagagtcttgctctgtcgcccaggctggagtgcagtggtgcratcttggctcactgcaacctccgcctcctaggttcaggcacttctccagcctcagcctcctgagtagagagtagctgggtttataggcgcccaccaccatgcctggctaattttttgtatttttagtagagatggggtttcaccatattggccaggctggtctcgaacygctgacctcaagtgattcgcctggcttggtctcccaaagtgctcagattacaggcgtgagccaccgcgcctggcttatttagggtcttgatggcatactttaagggatggcctttttgctctctaggtcttctccttccactcctgacctttcaacttttaaccctggccacacaatggaggaaagactgaatttagagaaaggcaggcaagaatttgaaagaaaccttgtatgtgatccaaggacagaggaagaagctgctcacagtggctgaaaggggaggtcggacatctgtgacttgtatcagggtttcaggggctaaggaggaacaacctcatcaaagttgctaggaaagggccatagaggccaggtatggcaggtcatacctgtaatcccagcaatttgggaggctgaggtggggggatggcttgaagtcaggagtttgagaccagagtgggcaacatagcgaggcaccatctctacaaaaaaatttttaaaatgagctgggcatggtggcatgcatctgtagtcctagttattcaggaggttgagtgaggcaggaggattgcttgagcccaggagttcaaggctgccgtgggccctgattgcatcactgttctctagcctgggcaacagagtgagactctgtctcaaaaaaaaggtgaggggcatagaactttactgtaccaggctgaaaaatacaaggcccagagagggcaagtgacttgcctagcatcacccagcgagttttgggcagagctgagacttgtaactcgaagacctaaggatcttccacaggctaatgaatagcttgtttgtgctcaagggatgaagcagtgagttgttaggacaggactgtgaatagggctgacatattcagatgtgtcaaacatcrctaatgccatctctgagtaaattaggcttcaaacagatcgggattctaatcctggytccccaacttttgcaagggagggccttgcatttacctttcaagaccccgataggcttagcaggaaaatgggaataatagataatgccactctttcatccttggactttttgtctaattatatgaatttatctgtaggataaattcccagaaatgcgcttgmtgagttaaagggcatgcgtatctaaaattaatagatattgcaaatgactggctaaagacattgcagaccaggygcagtggctcacgcctgtaatcccagcactttgggaggccgcagcaggtgggtcacctgaggtcaggagttcaagaccagcctggccaacatggtctctgctaaaccctatctctactaaaartacaaaaattatctgggcatggtcgtgggcacctgtaatcccagctactcgggaggctgwggcacgagaatcgcttgagcctcagaggcagaggttgcattgagccgagatcacaccactgcactccagcctgggcaaagagtgagactyggtctcaaaaaaaaaaaaaaaaaaggcattgcaaattgcaacttgttgcagtcacatatgacagcagtccccatcctcttggcaccagagactggtttcgtggaagacaatattttccagggtggagtggggaggatggttttgggatgaaactgtcccacctcatcatcaggcattggttagattctcataaggaacgtacaacctakatcccttgcaggtggagttggcaatagggtttgtgcttctgtgaaaatctaatgctgcttatctgacaggaggcggagcttaggcagtgatggtcactcacccaccgtcccctcctgctatgtggcctggttcctaacaggccattgactgatactgcagcacaagggttggggacccctgacataggagactatacatttattttaagctgtggtatgccagaattgtaaaatataaaacacagtggggcttttagggccagaaataatcagttcttgctcgcttccagaagcatccttcacaggggctaccgtaactcttgccaaccaagttctcttggttgggaggaaaaaatagtgttatgcattaagagaacttctttctggagttacttgaaaccattggtattcagatgattaggcagatgtcacaaggcaataagaatgtgacaggttcaccattcactttttttcctgtaaaagtgaagtagggctttcttgggaacaagcccttgggaggtggggggatgtgaatggtgaggggagggtagaaatggtggagtagggtcaggggcaagaaagggactttctgctaagaattaatcgggtgtccatttactcttagcagaaaactaggattagattctggattgtactcctgactccaaattttacaagtgggggtcttgcatttaccttccaggacctcggtcatcttagcaggaaaatagcaatagcaggtgatgccaccttacagagcgcttaggagacagtgagatggtctatataggaagctgtctggcctgatacctgatgaatacaaggggcccaataaatacagtggctgttatgaataatagatctaaactgcctttttggtactactggggacctgccaagcaggtgcatttagagtgcccagtgcctctccctgcgacacatttgatgcctccctacacctggaccaggccttgagcraggatttccactgcagaggtccttccagctggcgaattgtgttgcagatcaggttcagagaacttctgttttgcctgtgtggcattcattcattcgtttatttgaaatagagatgggatctcactgtgctgcccaggctagtctagagctcctaattcaagcaatcctcttggcttggcctcccatagttcttggattacaggtgtgaaccactgtatccagccctttatgacatttagaatatgagcaatttttcttttttcttttttttctttttgagatggagtctcactctgtcacccaggctagagtgcagtggcatgatcttggctcactgcaacctctacctcccaggctcaagcgatcttcccacctcagcctcccgagtagctgggactaccggcatgtgctgccatgcctggctaatttttgtattttctgtagagatggggtttcaccatgttgcgcaggctggtgtcaaactcctaagctcaagcgaactgcctgccttggcctcccagtgttgggattacagacgtgagccacagtgctgaaccctgcatggtatttagaatataagcaatactctaacatctggtctgggtcactctgtattacttacctgatctccaaaaacatttgggtttttgtctctggtccaaaatctttagccaatggcttggcagtaaaatcctragggaagctgttgaccaggtgaggtgatgtgcaaatcctatactctctgggctctgggatatttaatttactatttatttatttattttcaagacagagttttgctcttgtcgcccaggctggagtgcagtgatgggatctcagctcactgcaccctccacctcctgggttcaagcgattctccttcctcagcctcctgagtagctggtattacaggcgcccaccaccacacctggctattttttgtatttttagtagagacggggtttcaccatgttggccaggctggtcttgaactactgacctcaggttatccgcctgcctcggcctcccgaagtactgggattacaggcatcagccaccatgcccggcctaatttactttttattaatgctgaagcagagagggcaagatcttttgcccctgagttcttctgggaaaaatgaaactgatggtaaaacaaactaaagcaacctgacattctcagttggtccagtttcagccctttgactgggagtcacagacgggtcccataaaatggtagagctgggccagcctaccattgatttattttccctaaatgaaaaatacaaggcccagagagggcaagtgacttgtccagagtcacccagcaggtttggggcaaagctgagactcgttacttgacatcctaaggtcttccagaggctaatgattagcttgtttgtgctcaaaaaatgaagcagcctgggcgcggtggctcatgcttgtaatcctagcactttgggaggctgaggcaggcagatcgcttgagctcaggagtttgagaccagcctgggccacaaagtgagacccctgtctctacaaaaaaatgcaagaattaaaaaattagctgggtgttctggtgcgtgcctgtgatcccagctacttgggaggctgaggtgggagaatggcttgagcctgggaggcagagtttgcagaaagcagagatcgcgccacttcactctagcctgggcaacagagccagaccctgtctcaaaaaaaaagaatgaagcagttgttggtcaggacaggactgtaaacaaggctgacacactcagatgtgtcaaacatcgctaatgccaaaggtgacagagtcatttgttttcatccaaacattcgagaaagttggacgaggtgactcacgcctgtcatcctagagctttgggaagccaaggcaggaggatcatttgagatcaggagtttgagaccagcctaggcaaaatagcaagacccccatctctacaaaaaataagccgggcatagtggcccacacctgaggtgsgaggatcccttgagcccatgagtttgagcctgcagtaagctatgattgcaccactgcactccaccctgggcatatagtgagacccttcccccaaccaaaaacattgagagcagctcttgatgagtgaactgtacttcgtggtcagcagttctgggtagtaatttcagagatgtcctttcagcccttggagctgatgcaggaccttaaacatgagcgatggtggaggagggagggttgggaaggtgcatcaaggtagatgaagagtgtccctggggttgggccaactggcggtccgtctctggtccagtgtgttcaccttgcccccgtctgatcttctgcagttggtattccgagttgagtttgactaagtgagagctgctctcagctttaactgcctttcccaagacagcccttgtttttattctaaagctgtggttctcaactggaagcagttttgccaccccaggggacatctagcagtgtctggagacatttttgattgtcatgagtggaggaaggggtgctactggcatcaggtgggcagagaccagggatgctgcggaacatcccacaatgcacggaagagctcccctcacgacacagaatgacgcagcccaagagtcacagtgcagagtttgtggccagctgcggtggctcacgcctgtaatcccagcactttggggggccaaggtgggaggattgcttgaggcctggagttcaagaccagcctggccaatatggtgaaacctcatctctactaaaaatacaaaaattagccaggcatggtagcgcatgcctgtagtcccagctacttgggaggctgaggcacgagaatcacttgaacccagaaacgtggaggttgcagtgagctgagattgcrtcactgcactccagcctgggtaacagagcgagactctgtgtcaaaaaaaaaaaaaaaaaaagacttagcaactattattactagtattagtattattaatttgtcaggctcactgaattttctcaaaaatttggcaaatttttaggaaaacattctcaaaacatttggcaaatctgtggctaaatgttgttttggggacccaaggctcgtaggagcaaaacagctttcaggtttccggatctgccagagactcaagtgtcctgttgtgtgttttgtgtctcaatgagggaaaggggaatatgtagcaccttccagatggatttgaccttgactgcgccactgtttgaagagcttctcaacctccgcagctccaccccagcccagatatttcagggaattagggttccaaggggcatgctatggaaaacaccattctagcatgagtcgaagcttctcatcccccatcttgctgtcttttgaccaaagcagattttgcacgtcgtaactgtcagagacatcaaagccagagggaatccagcctgctccaagctctccttttttgkacagagactgaatctttgcacttgatcttgtttgtgtttttaagtctgaggttagacagggtcccakgcaatggaggcgtgcgtgtccttttatttttctgttgtagcttttgctattttttctgacttttaaggcaactcatccacatggcaattaggaagagcccacttagggctgggcrcagcggctcatgcctgtaatcccagcactttgggagaccgaggcaggcagatcacttgaggtcaggagttcaagacctcagcctggrcaacatggtgaaaccccrtctctacmaagaatacaggaaaatagctgggcatggtggcaggtgcctgtggtcccaactatttgggaggctggggtgggaggatcacttgagcctgggaggcggaggttgccgtgagctgaggtcatgccactgcactccagcctgggcgacagagcaagaccctgtctcagaaaaaaaaaaaaaaaaaaaagaagtccactttacttgtcatagtgcttagaacaaatgaaacactctcctagccctcttgggatgtaattggctaccayctgcacaaactcttcattattgcacaagaatatcaatatacttaatgctactgaactgtgtttaagtggccgaggtggtgaatgttagctgtattttaccacaattaaagataagagggaaggaaaatgaagtgtactttacaaccaaaaaagtacgcttgatgtgcaaaaaagtgtgcagcttgatgaattttcaagaggatatattttttatagatgggggtctcactctgtcacccaggctgcagtgcagtggcatgatcatggctcactgcatccccgacctcctgagcttaartgatcctcccacctcagcctcctgagtagctgggactgcaggtgcacactatcacaaccggttaatttttgtatgtttgctagagacaaggtttcaccatgttgaccaggccggtctcagcctcctgggctcaggttatcctcctacctcagtcttccacacaggtaattaaaaaacattttttcttagagatgggtcttgctgtgttggccaggctggtctcaaactcctgggctcaagtggtcctcccatcttggcttctcaaagtgctgggattacaggcgtgagccatgtcacctggcccaacagtttgatgaattttcagaaagtgaacactcatagggctggcattcagatgaagatctagaggtcaaccctcacaagcccccctcacgttctgtccttgcaatcattgcacaccsgagactcattcattccttatctgagttctatcaccgtagattaattctgcctggttttggacctcagttcaatagtcacagaacctgtgctttttgtgaccaccttcttttgctcaaggatgtgttgtgagatgtccttttttgtggtgtggagctgtagtttacttcacctgattcgagtcctattttgggtgtttgtaatgtgtcaggtactgtgccaggtgccttacaggattgattcctttatgggcatctgacaagcccacccaccttatgtgaaaggcagaaccaaatagactccagaatgagacccaggtttgggtcccagctctgacacttctttttttttgagatggaggctgactctgtygccaaggctggagtgtagtggtatgatgtcggcttacggcaacctccacctcccgggttcaagtgattctcctgactcagcctcccaagtagctggggctacaggcacgtaccaccaatcctggctaatttttaatttttgtatttttagtagagacagggtttcacaatgttggccaagctggtctcaaactcctgacctcaagttatcctcccacctcagcctcccaaagttctgggattataggcatgagccatcacrctcggcctacttgtgatcaatcttacttcatcttcacaccctcccatttctcttacgcatcctccagtttctctctctctctctccttctttttctctctctctctctcacacacacacacacgatctgctgcgacaccttaagaaacaagagattatcagggaatgattgaatattttgccgcatttcctattttgctgcctgtttaaactaaccttggttatactattaaaagaagacgcgtcgtatcaagccacttctgtgactatggctgtccagaaataaacataattaaaacatccaacagtagtaaatgctattggttaggaatgagcgaagtggcttagagtcaccggaagtgagaaagggtatagaaacagaaggtacttggtgtagatcaggggtgtcctatcttttggcttccctgggccaccccagaaaaagaagaattgtcttgggccacacgtaaaatacactagcactaatgatagctgatgagctaaaaaaaaaaaaaaaaaatcgcgaaaaaatatcatactgttttaagaaagtttatgaatttgtatcgggccacattcaaagccgtcctgggccccatgcagcctgtgggctgcaggttagacaagcttggtgtagagagtttcatctaaacttcatggcagctctgcagggcacccgttaggtccccagtattaatatacagtaaatctgagtctcagatctacgtaagtcacccagaagcacgcattctgcagtggcagagtcacgtttgaattagcatctgattgcaaagtctgggtgtctttacatgactacaggttatcttacctctcaagaggaggcaaccaatcaaatgttgccagcaccaatgaacttgtactttatttaggctcagaaagatcttttaggctaatgaaaatgccctrtatttatgaaatgttctcgttctctgtggctttctcttttttgagacagggtctcaccctgacacccaggctggagtgcagtgatgtaatcatagctcactgcagcctcaaactcctgggctcaagcaaccctcctgcctcagcctcctagtagctgggactacaagcacgcatcatcatgcctggctgatattttktttaagggatggggtcttgctataatgcccagtctggtctcgaactcctgggctcaagcaatcctcctgccttggcctcccaaaatatgggattatacatgtgggctactgccagcctcttttctttcaattattttttaatctatgggttcccctcctttttgtttgtattttatttgttaaagaaagagagtactggccgagcgtggtggctcacacctgtaatgtcagcactttgagaggccaaggccggtagatcacctgaggtcaggagtttgagaccagcctggacaatatggtgaaaccccgtctctactaaaaatacaaaaatcagccaggcgtggtggcatgcacctgtaatcctagctcctcgggaggctgaggcaggagaatcacttgaacctaggaggtggaggttgcagtgagccaagatcccgccattgcactctagctgggcgacagagcatagtctctcacctttgggagtttactgcattgtttagcatgctctcctgtgccttgcattttccatagacaggcgtcagatctggaggcttcatcaccttcatcccccatctccatccccttttcttttgagcaagaatatgtcattagtggtaacggcacttcctgtagtggcccatctgcaggcatgtaatgtttataatgtctagtcagctctctctttttgtgatgttagggttaattagtagatttaggtgatggcaggcggacccatcccttaaaaattccacaagagctcttcatctgatatagtcagtcttgtggtggggaccctagaccagcatcatcatcatcacccggaagctggttaggaatgcatattcttgggccccatcccagtcctactgactcagaagctaatgcaccaggaaatgtgagccccattggcctaatggttttagcaattactggtagaacttgccaacttgccaagaccctttctttcttcctttctttctttttttttttttgagacggagtctcactctgtcgyccaggctggagtgcagcggcgcatctccactcacccactcactgcaagctccgcctcccaggttcacaccattctcctgcctcagcctccagagtagctgggactacacgcggccgccaccacgcccggctaatttttttttttttttttagtagagacagggttttgccgtgttagccaggatggtctcgatctcttgacttcgtgatctgcccgcctcagcctcccaaagtgctgggattacaggtgtgagccactgtgcccggcctcttccttcctttcttctttctttccttccttccttccttggcaaagtcttgctctgttgtccaggctggagtacagtggcatgatctcggctcattgcaacctccacctttggagttcaagtaattctcctgcctcagcctcctgagtagctggaattacaggcacatgccactatgcccagctaatttttgtattttttagtagagacagggttttcccatgttgaccaggctggcctcaaactcttgacctcaggtggtccgcccacctgggcctctcaaagtgctgggattacaggtgtgaaccaccgtgcccagcttgagacccactattagctttataaacagttacatcctagttttattgttctgcatgtattcgctggaattcttccatgtagaagggagtcttttttaagatagggtaactggagtcaggggcaggacactgttggtcttactatgagctaagccaaattcaataacaattttaaaatgcagaaaggaggattgttaaacttaggacaatacatgttgtctaccagatctttatttctctttcyggatatctgaagtgattattcagatttagatgggatttcctcatttctctgcccttttttttttttttttttttttttttttggatgaagtcttgctctgttgcctgggccagagtgcagtggcaccatctcagctcactgcaacctctgcttcctgggttcaagcaattctcgtgcctcagcctcccgagtagctaggattacaggtgcctgccaccaagcccagctaatatttttgtgtttttagtagagatcaggtttcgccacgttggccagctggtcttgaactccggacctcaagcaatcctcctacctcagccccaacaaagtgctaggattacaggtgtgagccaccgcacctagccgccacttttttttcatcagctacgatatcaggtctcccagcagaaaatctctgagcaaatcaacttccaggtttgtttttcgtttttttgagactgagtttcgctcttactgcccaggctggagtgcggtgagaggcacaatcttggctcactgcaacctccacctcccgggttcaagtgattctcctgcctcagcctcccgagtagctgggattgtaggcgcatgctaccacgcccagcaacttttcgtatttttagtagagatggggtttcacatgttggccaggctggtctcgaactcctgacctcaggtgttccaccggccttggcctcccaaagtgctgggattacaggcatgagccactgcacccagcagcaggttcttaaaattagttttttaattattattttcagccctgaaaggaaaaaaataggtattggaatatctgccactcccattctgtcttgcaaaatctgcatcacccaaaaggttgggtttcaggagttggctgctcagctctagggatccaggagtgggacatgggtctttattctgtcgctgtgggatttggggcccaagcgtggggattatcagtgaattcaaaggagttgtgaattccctgctgaaggagggatgtcaaccacgcatagatcctggtggccatatgtcctcacttagccagcaactcagttctttggagcccagcagcaagaggtagaagggrctgtaagccagtgtttccaggacagcccctgcagctatggtcagagagtcaggaacggggggccggacaggcctatagagtgtgttgtctctgtccctctcctcataaacacatctggataacgacagataacgtgaatctaccatccatgggcttcccatgtagacaggacatttaatgacctaatcttccatcaagagagacttccccttcttaatttagttaccctaaggaacaatttgtatagaaaacgcagaatcaagattttcacatttccaccccactttctgtacccatttaaaaaatmatgcatttggggctgggcacagtggctcatgcctgtaatcccwtcactttgagagcccgaggctggtggatcacttgaggtcaggagtttgagaccagcctggccaacttggcgaagccccgtctctactaaaaatacaaaaattagctgggtgtgatggtgcaygcctgtaatcctagttactcgggaagctaaggcaggagaatcgcttgaacccagaggcagaggttgcagtgagccaagattgcaccactgcmctccagcatagacaacagagcaagactccatctcaaacaacaacaacaaaaatcattttgaacaaatgcatttaaatatatttgtctttcmaccctttttggggtgttagggtgatggacatataattatttttcttattgatattcacactgtctcgtatttgaccagatagaaccctagtataatattttggtatgcagttttctagacttttagaaatgtacacacaaacatataaaatgaagacaaatactttatgacaaatattttaatcagctttattgaggtataatctatataaagtaaaactcaccgatttaaaacaaattcaagtttttttaagtgtacagcttgagtgagttttttcaacttaaaaaatttatttcttaattgacaaataatcatacatgttcatgggktccataatgatttttttagttgtttggttggatggttttgagacagggtctcgctctgtggcccaggctggagtgcagtggcatgattacaactcactgcagccttgacctcctgggctctagccatcttcccgtcttagcctcctgagtagctggaaccgtaggcatgcaccaccrtgccaggctaatttttaatttttttacagagacaggggcttcttatgttgcccaggttggtcttgaactcctggcctcaagggatcctcctgtctcagcttcccacagtgctgggattacaggtgtgagccactgagtccagctcttagtaatgttttgatattaatacatataatgtgtggggagataagatcaggataattagcatatccatcatctcaagcatttgccattacttttattttgctacttcctatataatgacatttatcatctctttgtgytgggaacattcaatgtccttcttctagctcttggaaacgatgtaatattttattgttcactttactcatcctatagtggatagaacattcttaatgagttttgacaaatgtatacagtcttgtaagcaccaccatgaccacagggaatacttttatcaccccgaaaggtggtgcctcttacctcttatgtacctcttctgtgcctcttactaatccattcctttccttgccactggcaactcttttttttaatttttttgagacagcgtctcactctgtcactcaggctggagtgcaatggtgcagtctcggctcactgcagcctctgcctcccaggttcaagtgattctcctgcctcagctttttgagtaactgggattacaggtgtgcaccaccatgcccggctaatttttgtatttttagtagagatggggttttaccacattgggcaggctggtttcaaactcctgacctcaagtgatcccccctgccttggcctcccaaagtgctgggattacaggtgtgagccaccgtgcatggcctcctctggcaactcttgattgcctgtcaccatagatatgccttttctattttgccattactttttttttttttckagacagagtctcgctctgtcgccgaggctggagtgcagtggcgcgatctcagctcactgcaacctccgcctcctgggttcaagcaatcctcttgcctcagcctcctgagtagctgggactacaggtgtgtgccaccacactccattaatatttgtatttttagtagagacaggggtctcaccatgttgcccaggctggtcttgaactcctgacctcaggtgatccactcacctcagcctcccaaggtgctgagattacaggcgtgagccaccgcrcccggccgccattaccttctatctcaataaccacacttacgtttgcaccagcctaatagtttttcgtattgaaggagtaatagagcgtgtggcctttctgrtttgtttcactgagcatgatgcttttgagactcatttattttattgcataatttctttccttttactgagtttccagttatataccttgggttgtttgtttgtttttaaggcagagtctcactctgtcacccaggctggagtgcagtggcttgatcttggctcactgcaatcttgacctcccaggctcaggtgattctcccacctcagcctcccaagtagctgagactacaggtgtgcgctaccatgcctggctaattttttgtattttttgtagagacaaggttttgccatgttgcttaggctggtctccaactcctgggctcaaggaatctgggtaattctatgtttaatcgtatgaggactcttattttgcagcgcacagttagacttgaccatcttcccatattagcacgtgtacacttacttccggcttcttcttctttttttttttttttttttgagatggagtctggctctgtcacccaggctggagtgcagtggcactatcttggctcactgcaacctctgcctccygggtttgagcaattctgcctgagcctcccaagtggctgggattacaggtgcacaccaycacacctggctaatttttgtattttcagtagagacggggtttcaccatgttggccaggctggtcttgaactcctggcctcaagtgwtttgcccacctcggcctcccacagtgttgggtttacaggtgtgagccaccttgtccagccctacttcctgcctcctgagcactgggtagtatttcacagtgtggaaatagcatggcttatrtatccagctgtatgttggtggacatttgggttgtctgacttttggtattttaggcgatgacacacatccctttctgaagggcctttgggtggtctctgttctttgaccacatacacaatactgcaggtctttgtacttggtgggatgtctctgcagaccgagttcctagacagggcaaggtgagtggttggtctgtcttccgggcttggttgtggtctgattctgaccctgttaccttattccacaggggaccaacaaggcaccatggcgcagaagggccaactcagtgacgatgagaagttcctctttgtggacaaaaacttcatcaacagcccagtggcccaggctgactgggccgccaagagactcgtctgggtcccctcggagaagcagggcttygaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatgtgagtattgcaggcagccaggtacctactcctggcctcataaggaaagtaggcattagaaatgtgttgggagggctgggcacagtggctcatgcctgtactcccagcactttgggaggccgaggtgggcagatcacctgaggtcagaagttcragaccacgctggccaacatgatgaaatgccgtctctactaaaaatacaaaaagtagccaagggtggtggtgcgcatctgtaatcccagctactggggaggctggggcagaggaattgcttgaatccaggaggtggaggtgcagtgagccaagactgtaccactgcactccagcctgggtgacagaataagactctgtctcaaaaaaaaaaaaaaaaaggaaatgggaggctgaaggtttgatmgagggagattgcaagatgaggtggaatcattccaaggtgggttcacatctcagcccttgaagaggttatttcctctctcgaagccttggttttcctatccgtaaaatgggaataatcaccctcattacagacaggaggtgtgacaatcccatgtcatcacatgtgccaagtgccaagacgtatgataaactctcaacagatttcattggcatcgttctctgtccttccttcctcttgaaagtaaagaagagctcataaccactttggaaaggctggtttgtcttggcagccaggtgggtaggagacatgaggatgtggctaggttttagggaggccttccttgtcacagaggggaatgttcaggttggtcgtaggactattttaggtagacttgcagaacagagtggactagagatggcacaatatggtagccactggccactcgtggctaactaaatttagatttaaattaattaaaagaaacattagaccaggtttggcgactcatgcctgtaatcccagcacgctgggaggccaaggcgggtagatcacttgaggtcaggagtttgagaccagcctggccaacgtgatgaaaccctgtctctactaaaaatgccaaaattagccaggcatggtagtgcacatctgtaatcccagctacttgagaggctgaggcaggagaattgcttgaacccgggaggcagaggttgcagtgagccgagatggtgccgttgcactccagcctgggcaataagagcgaaactccatctcaaaaaaaaaaaaaaaaaraaaagaaacattaaaaaatttattagctgggtgcgtgggctcacayctgtaatyccagcactttgggaggccaaggtgggtggatcacctgaggtcaggagttctagacmagcctggccaacatggtaaaaccccrtctctactaaaaatacaaaaattagctgggcatgrtggtgtgcgcctgtaatcccagctacttgggaggccgaggcaggagaatcgcttgaaccygggagatggaggttgcagtgagccaaaatcgcgttattgtactccagcttgggcaataagagcaaaacttcatctctaaataaatacataagtaaaagamaataaaaaataacaaatttatttcttttgttgtgttggccctaggtcaagtagtcaatagccacctgtggctagtggctggtgtactgggtagcataagtgcagaatgttcccattatcatagaaagttctgttggactgcttggactagatgattggggcttggagtgtgatgttgtggggcacgggtcgccagactgatgygcagaggtcacccaacccggcctatgtctatgtcttctctctgaaaggccttgctcaccctcgagcaggttacctcatgcctctgaagctttgtttccttttctgtaaaatggatgcaagaatagtgccagcctcttgggagccgggcatagtggctcatgcctgtaatcccarcactttgagaaactgaggcaggtggctcacttgagcccaggagtttgagaccagcctgggcaacacaacgagaccccatctctgcaaaaataaattagccaggtgcagtggtgcgtactcataatcccagctactcagggaggctgaggcaggaggatcacttgagcccaggagttcaaggctgcagtgagctatgattgtgccactgcactctagcctgggtgacagagcaagaccttgtctgtttcaaaaaaaaaaaaaaaaaaaaatagtaccagcttcatggagtgggttactctaaatagaaagcacttaatacacttcctgctacatgttaagtgcaggcactgaaaatgttaagtgttactagattggtttttgctgtggtcatgatcacttttgattttactagtaagatgttcttcttccatcacttggcatccttgtgtctctttggttctggtctgtacattttgccaaatgaaaattacaaaaagccccttgtcatctctaaaaatgtcctgcacatttttttcctaattaggaaactaagacacgttcactatggaacacttggagagttcagaaagcatagtgaacacaaaacagaaaaattagtccttaaccagagatgcggtgcattctttgtctctttgtgagcatggtatctgtttacatatttaaaagcctattgggcacacagtttagtgacttgctcttttttccatttggaaatgctcagtgttgacttgtgtaatatatctcaggaagccccaaagataccccttgtaaggggtagtatagaatctgtcatggggataggccatttttccactgttcttatagatatttcagaaggagttagagtggctttttaaagagccaaatggtaagagtgagcaacttagcarctcataacttttttttttttttttgagatgggggcttactctgtctttgaggctggagtgcagtggttctatcgtagctcagtacagcttccaagtcctggattcaarcgatcctctcacctcagcctcctgagtagctgtggaccacaggtgtgcaccaccacacctggctaattaaaaaaaaaaaaaaaaayttctgtagagactgggatctcactatattgcccaggctggtctcaaactcctggcctcaagccatctcctgccttgacttttcacggcgctgggattacgggtgtgagccactgtgcctggccrtaactattaaatatgtcctccaatccaagtgctgtacrttgacacattgtattttatttaacacagcatcccctgagttaaaaatgtttgccccttttagggaaggaagctgaggtgcartgttgcaaaatgtatctttactttcttaagtaggggaagtctcttgtctgtggcactgtttgtatggaaaaattattgatctggggctgtttgtatggtggacattttctttttctttctttcttcttttttttttttttgagatggaatttcacttttgttgctcaggctggagtgaagtggagcgatcttggctcattgcaacctccacctccsrggttgaagtgattctcctgcttcagcctcccgagtagctgggattgcagggatgtgccaccatgcctggctgatttttgtatttttagtagagacgggtttcaccatgttggctaggctggtctccaactcctgacctcaggtgatccacttgcctcggcctcccaaagtgctrggatcacaggcctgaaccaccacgcccagccagtatgttggatatttctaaagaggcccgtctgtagggagctagagggaaaattggactctttggggcccaggtcttycatytaagacgtatcatcaccatctagggagtttcaggacagkcctgtgtattcatctcacctgctgtcctcaaatagaaatcagaaaaaaaaagggcrtatgaaggtcctgagacccaaaatatcttctgacagcagattaaaaataaatgaatcaaagcttcaaattcctgctatgcttctctggacagattagattaaaatcctttcagccttgtgatgatggtcccgctcttctcttgttcctttctggtcagtttaattgcttaatagaaaccgtcgtccatgacggagaagataaagaaggaaaggggttggggtgggggagcacagtaacttactctcccagcccataatagcagcatgcatgagtcttgttaataggcgggtagtgaggtgatrccaggtccgtggtctggcatgcatgactttkccctctgtgatgaagataaactttctcctccgttctgcaaggctcgcctcaaacgatgtgcccttgagaaggttctggcagacctcttgtgctcttggatctagaagagtctatagaagccagaggagctttcctcctaatcttagagatgcaggttctgggctcagcaatgtccagcagtctacctaaactgctgaagaccgtttgtggcatacctggcggggagcatggctttgaygcctggtcctaagggtcccttggtcttctgaatgctgtcttttggctgagttcgtctgcctcgagttagttmgttcgttcctcccttccttccttccttccttccttcctccctccctccctccctctmtctttcttcctttctttctctgtctttctgtcttcttttttctttcttcttttttctttttctttcttttgagatggggtcttactctgttgcccaggctggagtacagtggcatgatctcagctcactgcaacctctgcctcctggaactcaagggatcctatctcagtctccttagtagctgggactacaggcatgtagcacgatgcccrgctaatttttttgtgtttttggtagaggtggggtcacaccgtattgcccaaacagatctcgaactcctgagctcaagcaatcttcaccacttcggcctcccaaagtgttaggattacaggcatgatattgtgccactgcactccagcctgggtgacagagtgagactacatctcaaaaaaaaaaaaaaaaaaaaaaaaaaaagatgaggttgctgaagctcagatgtgcttagtcccaccactggaaggtgggcagagctgggattcagacaaggtctgtgtgagtccagggccagggtgactacctrtgattagtagcaaagggctcttggggtaataggcttagagcaggaggtgatggtcgtgggctggagcaggaggggacagtgccagaggccttgttagctttgaggtagacaagctttaagtgcagagcaagaaggaattgaaccttttattatgattccttgagcacctaactaggtgctagactaatgattacaacctgctaacacagaggagtgatttttgtttttaaattgagttaacttaatatatcaaaaaaagaaatctgtttctggcattgctcgaaaaagcagaggacctgacactgcagaatgcagagtgcgagtagcagtccctgtgagatgggctttttgctctgcttttccgcagacctcaccactccctgtcgtctcccaggccatggtaaccattgaccgtggcacctcttttgttcactcacacacgccctgcttcactcatgccttacctgctttgtctctgtagacagtgggaccctccaccctataccaaacctctggggttgggaaaatcatgatccagagccaaggtggatgggcccccctgctcattggaactccaagcccaagtcccygaaccatgaaccccaaaggacatttttccagttctggttctgcttctggaatgcccagggggtcaggagaagccctccttccaaactttagcaggtgacaatttttccgccttagagacctggcccagcaatcttagcctactctggaagcagtgtccacccggggacacaaggaacaagcagattgtgaacagaggcctcctgggtgccagccactgcactggtccctagagggtagaaagacactgtaactggaagctgccctttgtcaagccccaagcattagcccttctgatctttttttttttttaacatggagtctcgctctgtcacgcaggctggagagcagtggtgtgatcctggctcactgcaacctccatttcctgagttcaagcgattcttgtgcctcagcctcccagtagctgggattacaggcacatgccaccacgcccagctaatttttgtatttttagtagagaagtggtttcaccatgttggccaggttggtcttgaactcctgaactcagatgatcctcccacctccgcctcccaacgtgctgggattacaggcatgagccactgcacccagccttctgatctttcaagtcattattgcttcaaagaacctcctccagtaatacaaggataatctatgcaaagacctcaggagaatatttaaaaataagtatgtatcacaaaaagcagccctcttccctggaggcaaacatgattcacaggttcaygtatgtacacacacacacacacacacacacacacacacacaccccaaacatamgaaaaagtcactccttgtatgttttgcagtatgattttttttccacttaaccctaccttatagttttttctgtctgttcataactatctagtcagacttmaaatatgtttttgaataggtaagacatgcaaatatgaaataaaatagtgtataagggaatatagaacttcccccttcgttcctatttctcgcccttccagttccccttcttagagacactgtggttgctggttacatatgtagccctccagtcatgttatttatttatttatattatttttcgagatggagtctcactctctcacccagactggagtgaagtggcatgatcttggctcactgcaacagccccctcccaggttcaagcaattctcctccctcagcctcccaagtagctgagactacaggcgtgtactaccacacccagctgatttttgtatttttagtagagagggggttttgccatgttggccaggctggtctcgatctcctgacctcaggtgatccacctgcctcggcctgccaaggtgctgggattacaggcttaagccactgtgcccagcctattgctttttttgtgataaagtctcactctgtcacccaggctggagtgcaatggtgcgatctcggctcctgcaacctatgccttctggattcaagcgatcatcccgccccagcctcctgagtagctgggattacaggtgtgcatcaccacacccagataatttttgtattttttgtaaagatgggtttttgccatgttagccaggctggtcttgaactcctgacctcaagtgatccacccacctcagcctcccaaagtgctacaattacaggtgtgagctgctccatccagcctccagtgatgttttatacacatgcagccacatagagagcccctcctgcacccctccaaaatggcagcacaggccccggctgttgtgcgtctcaatctttgcatctaactgtgtattttggccattcatccatggtagtagagagagggccactgcacagtcttctgctatagggatgaaccataatgattaagcctgtctgctattgacaggtatttaggttgtttctagtctttttgctcttaaaagcaaggctgcagcaaaagcacgtgcttggtggaccacgtctgtctctaggttgggtatttagaaagccgtgatattgcactgcagcttcataaagaagccgtgattatccatcactttactgaggaagctcaggggtaggtctgtatgcacaagtcaggcaggtgataaggcaaagccaacactctgcccaggcctgtgtgtcttttttttttttgagaccaagtctcgctgtatcacccaggctggagtggagtggcacaatctcagctcactgcaacctctgccacctgagttcaagcagttctcctgcctcagcttcccgagtagctgggattacaggcrcgcgccaccacaccttgctaatttttgtatttttagtagagatgaggtttcactgtgttggccgggctggtctcgaactcttgacctcaggtgatccacccaccttggcctcccaaagtgccgggattacaggtgtgagccactgcrcccggccatccctgtgtgtctgaaagccagtgttccttccacttccctcccttccctccctgttcctcatttctgctgcaggccccgggagcaccccctgctcagggctctgtggctgaccatataaagcgtcagagaaaaactggagctgcttcctaatacggtcacaagagggaaatcctgggcctgcagctgggacttgctggtggcacagggcccatgagatgccggctgggacacaggaggctgggatgttgaaacctctgaatttaaccagctggagaggggctcgtggggccagagaggcagaaacacagccaactatggttgggctgggtcgaggtgaaggagaagtggctgaataatgtgggaggaagagccmgatgctgaagccccacgaccctgccgtgagatgtgcggctgcctgcaccagtcttaccttcactccatcgtcataccctggcttgcttagaaagcttttacagaactsagcagagattcagatctacctggaagtatggattaagtgcttgttgtgtgcacggcactgggagagatgtcccaaacaaagaggatggaagtcatattcctctttcagaagctagtgatggagttgaaaaggcagtgtggtccttccttctttttaaaaattcattttattctttttttttttttctttgagacagtctcactttgtcacccaggctggagtgtggtggcatgatctcggctcacataacctctgcctccttggttcaggtgactctcctgcctcagactcctgagtagctgggattacaggcatgcgccaccacacccagctaatttttgtatttttagtaaagacggggttttgccatgttagccaggctgttctcaaactcctgacctcaagtgatctgacctcctcgatttcccaaagtgctggcattaaaggtgtgagccaccatgcccggcctcttccttctttttaaaaattccttttattcttttcttttctctatctctcatctctctttcttcctttctttcttactttccttccttccttccttcttttttttttttttttagagtctcactctgttgcccaggctggagtgcagcaccatgatctcagctcactataacctccacctcctgggttcaagtgattctcctacctcggcctcccgactagctgggattacaggcgcctgccatcatgcctggctaatttttgtatttttagtagagacggggttttgccatgttggccaggctggtctcgaactcctgacstcaagtgatctgacctccttggccacccgaagtgctgggattacagctgactgagtgtctaccctgtccctggcactgtgcggggtgcaggagatacagtagtgtgtgggtcacagtccaggaggtaacatttaggcagagctctaaaagaggagagggaaccakctgtgggaagatgaggggaaaagtgttccaagtggagagaacagcatattgaaggctctaaggtggcaagacttccctctcgtgaaatgaagggagcatagtaagagtcactaaataacattgattgagcacctactacataccagccgccatgctaaatgcttttcgagcattatctcgcagcacatctatgaagggcttgttcgtatgcctccctgttttgtagatgaggataagtgagactcagagaggttaagggacttgcccagggtcacacagcgaagaagtagcaaagtgaaggttcaaattcaaktaccccatacccagttctgagcccttagccactgccctttactgcctccaggtcaagggcttgagtgaggacaggttgggctgtaaatgatacctacattcaaaaggggcgtggcagtggacatggccccagaggagctggagatggagtcgaggcctgaaggagggtggggcttgattgacctttgttcaggtgaccacagactgggctcttctctttgggaggcttgtcctggggacaggggacactgattgaacaggaaatagcccctggcctggctcartgtagtccwctgagtacctactgccgccgtgcaaggcccccaggtcacggaggtgaagtcaggctgtccctgctcccaggaagctgtatcattaatttattcccctggcatgcatttagcaagcatttagttagcacctattctataccaaggcctgtgctgggactgaagaggagaaagggggttccccggactcaaggcacttgcagctggtgtttgcaggatgggtgggagggtcctgggtgatggaatggggaagaggggtgtccaggcaggcagccccccactcccagccccaccaggctggatgttgctcctgggccccgcttacctctaacccttgctttgcttctccatttcggtccgatggagccgcttataccaagctgcttatagttcacccccacggaccccgtgtcctgtttttctgcccatgtccctgctttgtcttragctggttaacaccttgttgtcctttaagactcagtgcagggaatacctccccacctggaggtttccctgaccacccccaatgtgggttagggccttcccttccttgttcctatcattctctgttcttacgacgtgttttaatgtacttgtctccccctctgatttaagttctttaagggcaggagctatcattgatttctttatctccagcctctgacacagatgtggtatatagtaggtgctcagtaaatggttgatggctatttagacaggcatatgttgactcattcattctccttttaggggatggtgagaacctccgtctccatcaatcctgtttccttttttttttttttttttttgagatgggttctccctctgtcacccaggctggagtgcaatggcaccaccttggctcactacaacctccctccacctcccaggttcaagtgattctcctgcctcagcctgccgagtagctgggactacaggcatgtgccaccatgccctgctaattttttgtatttttggtaraaacagggtctcactgtgttgcctaggttggtcttgaactcctgagtgtgagcaatctgccctccttggtctcccaaagtrctgggatcataggtgtgaaccactgcgcccaacaatcctgtaccttcaaagaatattcctctgcagcacccccagacattacataccattgtccctgartggactgagccctggaaggaccttcccactctctctttttcyttctttttytttctttttcttttttgagacaaggtctcaccgtgtcacacaggctggagtgcatggcacaatcacrgcttactgcaacctcaacctcccaggcttaagcaaacctcccacctcagcctcccaagtggctgggactacaggtgaatgccaccatgcccagctaatttttaaatttcttatagagatgggggtctcactgtgctgcccaagctggtctcagacttctgggctcaagcaatcttcctgccttgacctcccaaagtgctgggattacagttgtgagccaccacacccagccagactttcccactctctaattggctccagcccttgactaaaaggcccttgagggctgggatcctgtgtttttttaatgttctaatgtagtcccagcaccttttgcatggcatctgggacgtacagaatgaatgaatgaatgaatgaatgaatgaatgaaygaacgaacgatcagtagtttctgtttctgttggatgggcctaggctggatagcataatggaccatgctcatacctgggggcgggccaggctgggcttggtgctgccaggatcttctttggtgacctcggtcaagtcacttaaccctctgttgcttggttcaccctagctgtaactgagagatggatctgtggttctccctaagtcacttgcagggaagaggatacgctttatggccatcagagtcttgggcagtactgatgtttatcgtttggggaaagcagttcctgtgagacgggttggagcctgtctcctgaactgtgacctcaaccatgggaaaatctagtatccagtaaggaaaaatcatgacaatagtgccttaccacrtacagcatggcgggactcgccttgtgccttgactcctccgtccctgatctgattattttcagatgctcctattcacccagtagragaggactgctattttttaaatggtaaagtgcatatgacataaaatttaccattttaaacattttaaagaaaacagtgccattaagtgcattcacaatgttgtacagctatcaatttcaagacagggtcttgctctgtcacccaggggctagagtgcaatggtacaatcatagctcactatwaccttgagctcctgggatcaagcaatcctcctgactcagcctcccaaktagctgggactacaggtgatcaccaccatggccagctattttttttttttttttttttttgtagagagggggtcyggctgttgttgcctgagctggtctcaaacacttagcctgaagcaatcctcccaccttggcctcccaaagtgctgggattacaggcatgagccactacacttggccccagagcatttttatagcctcaaaaggaaaccttatacccatgagcagttcctcctcatttcccacctctttccagcctctgggaaccacaagtctgttttctgtctccatggctttgcctactctagacacttcacataaatgagatgatagagtacgtgacytttcgtgcctggcttctttcactaggcatattttcaagcttcatccacattggagagctcatgtcagtgttggtctctgttttgcagatggggaaggtattaatgatcaggagcaggcgctgtggggtaaacaggagttctagttcccaacttccctccagctgtgtaacctggtgacaacctcaccatgcctcactttgccctcctgtcaaacaggcggtggggaaatcactgttactgagtagttgtgaagatgccaygmggagatgcctctgccatcttctagagactgagtcactggggtttcttcttagatatggacattgggaggtcccagaaagagatcagagggtggtgggaggagagagagcttggaggattattaccttttcctccctccctcctggaccacagttttggcagctgtgtttctgtatgactgcggatccctctggacagcccctttttaggggtgtgtggctttctatgcctccaatgttcagttaacgacattccctctctggctgagtgcggtggttcccacctgtaatcccagcactttgggaggctgagactggcgcatcacctcagctcaggagttcgagaccagcctgggcaatatggtgaaaccctgtctctacaaaaaacaaaataaaaattacctgggcatggttgtgcacacctgtggtaccacctacttgggaggctgaggcgagaggatcacttaagcccagaaactcaaggttgtagtgagccaagatcaccccactacactgcagcctgggygacagagcaagaccctgtctcaaaaaaaaaaaaaagtaaacaacattctcttctgttcttgctcttcagacttaactrcycccgtcactggttgggtttctttaattctgcacacatatctgtaaacactttctttattaaatgttcctgagttaatatcttaagcacactgttcattttctgtgccacctgttaaatgatgagcatttaatatgattgtcagcatccaaaaaagatcctgcgtagtgcttagttcggtgcccaacacatagtaagtgctcaatgaacggtggctgttatttaagccagtgaggtccggggaggtaaagtggcagstcggaggagtggagctgagatttgaacccagagctcttcaaaactccacagtttggccaggtgcaatggctcacaactataatcccagtgctttgggaggctgaaatgagagaaytgcttgagcccaggaatttgagaccagcctgagcaacacagtgaaacccatgtctctacagaaaatataaacatcagccaggcctggtggcgcccgcctgyagtcctggctactcaggaggctgaggtaggaggatcacctgagtccagaaaggtcaaggtttcagtgagtcaygttcacaccaccgcactccagcctaggtgacagagtgagaccccatctcaaaacaaacacaaaaccccccacagttgcaaaataaaacataggcagcttggaaacccactctcgccctttctcctcttcccacgtacctggaatatcagtgaggcccagggtttccactaagactccaagctccagtttccccatctctaacatgagaatattgagtgcttctgtgcratctgtctaccctggaggaggtctggaagtaagctgggttctctgtctgcagacgtactctggcctcttctgcgtggtggtcaacccctataaacacctgcccatctactcggagaagatcgtygacatgtacaagggcaagaagaggcacgagatgccrcctcacatctacgccatcgcagacacggcctaccggagcatgcttcaaggtgagtgaactcagggctgcacggggccagctccagggagcccctcctgtcctgcttgtctgcagttcttgccaggaatgtggagtttggcaggcactgygagggaccaggagttactgtggctgaaaaagggaaaaagcaaaaggaacatctgtgtttgcagcctgggagggtgagggagagccaagagcttgggcaaatacgggcatgggcccgctccagctccagctccggggctcgctgcccaaggkccccgtcgggccagctgtctgcaaaggatggaaagagggtggggaacagccctggggctgagccattgtggtctgtgttgacacctacctgtccctcaacccctgtgggactgtgggtaaatatcttttcctcttcagcctcagtttcctcatttgtcaaaaggggtgatagtctctatcttgtagcttcttgtgaagattgttaatgctggtttttccaaacttaagacttgtgcctattactttcatgtttatacgttattatttttactattgttttattatttttgagacagggtctcactttctcgcccaggctgaagtgcagtggtgccatctcggctccctgcaacctccgcctcctgggctcaagcaattctcctgcctcagcctcccaagtagctgggactataggtgtgractgtcatgtcaagctaattttaaaaaggtgggtttttttgttytgtttttgttttgttttgttttgtttttggaagtgacaggatcttgctatactggttggtctcaaactcttggcctcaggcgatcctcccactttggcctcccaaagttctgggattataggcatgagccactgcacccaggccttctcaccttctatttagaacactttggagcccctgaaatagccacccccaagtcaaacagagggactaggcagttaatgcaaacaagtgtaccaggtcaggcgaagagtacaagaaactcgaaarctcacaccccctctgaaagggcaccaacaggtgggaacccagggatctgagttgggagttgagaggagcccaattctggaagttyttgaggcmggaatccaggtgtgcctgagagatgccacgaccccgcccccaagrtagagggactcaggtataagtgccccaactttctgacagtkagccagactccacaggtaggaccagaaycttggcccttctaggcagggcctgccattacctccaaagaccagcaggtggagccttgcaarggcaatcttggagctgtaatctcaggttgtaaagtgayggctcctggagtcaggtatctgtctttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcataagccaccatacccagcaattcctggttcttttctggagctgaggtcccactaagcacattttaatctaaataccaaaaagaaagaaaattctgttagcaaaggagaaggagggggagcgacagatgggtaagcatttctacagtgctctgaaaaaatttatttgtaacttgaaaaagtctttaatattgtatattcattctagaaaaacttaaacatatatttaagtaaaagagaacttgctggcacctatgattctatcatccaaaactcatcaccattaacattttgttacgtgacctttcattacactaactgaactaaatggcatgaaatgaaggaaatttttactatctgaagataattcgttccagaaaaagatcacttaaaacagagaccaaagtttcactgtagatagtatgtgtgtggaggagggaaagagagtgggcaaaatatttgactgagcttgaaaaatgacattgcaggccaggcacagtggctcacgcctgtaatyctggcactttgggaagcccagatgggtggattgctcgaggtcatgagttcgagaccagcctgggcaatatggcgaaaccctgtctctacaaaaaatacaaaaattactttggtrtggtagcacatacctgtagtcccacttcttgggaggctgaggtgggaggatcgcttgagaccaggaagtggaggttgcagtgagccgagatcmcgccactgcattccagcctgggtgagagagccagaccttgtctcaaaagaaaagaaaagaaaaccaacattgcaaattataaaaataggttaatttcagcttacatgtaataagaattttattttaattacaagtaggtgctaatttgtagattcagtataaaatgaattaagagtgggtgtggggtttttttctgtaactttttctgggctgagggatgaaatcatgtgagcataaaacgacatcttcatgtcatgcttgacttctgcagcccgagctaaaaaggatcattcttacagatttatttgatgggtcaccagttttcctaagggcttcttttacttctttagtgtttaagtctctcaaagcccctgtggtcttagcgttcattcagctgtgaattgccctgaatctttttctttcttttgtctttctttctttctttttttttttttttttccggatggagtttccctcttggtgcccaggttggagtgcaatggtgtgatctcagctcactgcaacctccacctcctgggttcaagcrattctactgcctcagcctcccawgtaactgggattataggcatgtgccaccacacccggctaattttgtatttttagtagagatggggtttcaccatgttacccaggatggtctcgatctcctgacattgtgatctgcccgcctcrgcctcccatagtgctgggattacaggcatgcaccatcacaccaggctaattttgtatttttagtagagatggggctttaccatgttggtcagactggtcttgaactcctggcctcaggtgatcctcccacctcggcctcccaaagtggtgggattacaggtgtgcaccaccacacttggcccctgaatcttttttttggcctttccaaggccactgactttgccagtcactgcaccttgttttccagaactgccactttgttttgtgttcatatcatgatggtggctattgatacccaataattggcaaggtgaagccactgaatcgtcggagaaggaggtttcggtggagtttgatcgctcttgtagtcattgaaraatacttttgtgttgtggggacttttgctttcctagaccagcagtccccaacctttttgacaccagggaccagtttcatagaagtcagtttttccatggaccgcaggggagagatggttcgggatgattcgagcgcattacatttattgtgcactttatttctatgattacattgtcatatataatgaaatcattatacaactcaccatcatgtagaatcagtgggagccctgagcttgttttcctgcaactagacggtcccatctgggggtgatgggagacagtgacagatcatcaggcattagattctcataaggagcacacagcctggatccctcttatgtgcagttcacagtagggttggtggttctataagagtctaatgccgcctctgatctgagaggaagcagagctcaggcagtaattggagtgatagggagtggctgtaaatacagatgaagcccactactcacctcctgctgtgcagtaccagtcggtggtttgagatgcctgygctagaccacctcttaactgtgaggcaatgttgtaattgacaaggacaccctgtgttcatatatttgattcctcatggtctctaggttttaacacaaaattgcatagtcagctctcttgaaactacttagaaatgctcacttgacacatagtaagctccaataggaaatgactatcatgattgagcacagcagcatgtcttcagtcctagcactttgggaggccraggcaggaggatcacttgaggccaggagttagagaccagcctggccaacatagtgagctcttgtctctacaaaaaaataattagctggccacagtgygtgagtctgtagtcctagctactctggaggctgaggcaggaggatggcttgagcccaggacttcaagaatgyagtgtgctatgatcgtgctatggtactccagccttggcaacagagtaagaccctgtcacgaaagaaagaaagaaaatgaaaaccgtgaatatgcacatccataaaagataaactctttacttaatttaaatgttaaccaacacctgctatgccctcgtctattttggcatgacctggtgctttctggcaaatcattgatggcggactccaaaaataaaaagaatcgggcacggtggctaacgcctgtaatcccagcactttgggaggccraggtggggggatcatgagatcaggagatcgagaccatcctggctaacgtggtgaatctccgtctctactaaaaatacaaaaaaaactagccaggcacagtggyaggcgcctgtagtcccagctactcagggggtgctgaggcaggagaatggtgtgaacccaagaggcggagcttgcagtgagccgagatcacgccactgcactctagcctgggcaacaaagcgagactccatctcaaaataaataaataaataaaaaataaaaagaatgtcaaaaataatggagaaaaatttaagcttgggaagaattccgttcacctgcttaattttttctccattcccaagtaggaaattggtttttgtgaagaaacacgtaggcccagtgtgttgactccattgataaatggcacgatctcattctgttaagtcactgggctgcgatccacactaagcttaccatgaaggtggagagagaaagctagcacatgtggcttcttccttgagttcttcatggaaaagatggggtgtgaaaaggcgggattgaggagggatgggtaacacacatgcactgaatataagatgaagcattgcagttgtgtcacatagacagtaagttcctgaggacctataaactccatccttcttgcatgtgcatcattgtatctccagcacattttctggtgmctggcacatagtagctgctcagtatttgttgaatcaatgaattattagagttatttatagaaaagaacctaccagggtcaggatggatggggtgggttatttgagagaggtggggctttataagcctcgaagaatggtttgctaaggtgagagaagggggcagggatggctttctagccaagaataataaaagcataaatgtaggggtgagaatgggtatgatgagtgtggcaggagctggtttagaggggttgactagtatactgtggcagggagctcagagccagagctcagccctttgctgcctcacaggagttgggaaaatgggagggactttctaagagatacttcacaacatggcaccctcccaagtggaagccaagccccttgagggtatgggaagagaagctgatatttaaaatatgtatcttatatctgcatatgcataaattatgtcatgtttattttttaaattctccccccctttttttttgaggcagagtctcgccctgccacccaggctggagtgcagcagcacgatctcagctcagtggtatgatttctgctcactgcaacctctgtctcctgggttcaagcaattcttgtgcctcagcctcctgagtagctgggactacaggcacacaccaccatgcctggctaatttttgtrtttttagtagagatggggttttgccatgttggccaggctggtttcaaactcctgacctcaggtgatctgcccgcctcaacctcccaaagtgctgagattacaggcatgagccactgcgcccggccgtggtttgtttttggaaagatgttacatacaaattcaaaaggtgaacttctcccttcaacccttgtgcattagacccttagcttccctcccaagagacaattatggtttctagtgtatgaggttttctcctagagatatttttgcaagtataagcaaataggtatctattttcttccctaagatttccctacaaatactagcattccatatatatacagtcctatattttgccagaggatgttacatatcagtgcatgtaggaattccttgttcccttttttaaaaaattggtttttatttttgttaaaagtattcatgcagayggcttagagtcaagtaatttttgaaggcttattaagaaaaatagccatcctctgctacttctcaactcctttaattgattttttttttttttggtatttaccaccatatctctgaaaacaacacttgatcattgtgctgctatcttaattttgttttcaattttaggtatcatctattgactttcctccatgaaagatgaaatktagctcattcacccyctggatttgmccctatttcctcgttccaacacacatgcctcatatcagartcccagtataattttatcttagttttgacaaactcagtgttcagagtttccattattatgactatgtaatgctatctagagtttacattattatgattatgtagatgttattcmaagctgagctttgcaytgctttgtgactatttttcttctttctgtatgacttttctttttcctggagttagcaattgccttttttttccccaatcttgttttccatgtayttaaccaccaattctgccccaaaatctctttctaaatgtgttaatctccttttaatatgtccagacatgtattggatatcatattgatatcatctccttgaatgtgatctctactatagccttctgatctgccctggctttctctatagctagtaactgtcatataggatctttttcaccatccttgaaattccccttagtgctttcatagtggattccttgtttcccagttttcatgtcttcctctttcttgctttactctcctgcttaaatcaagcactttgtccagtagcttcccaagaaagaatgtacgtgatcktgaggcattgagaacttccatatctgagaggcttgatgcttctctaacacttaaaggatagtttagttgggtttaaaatttcaggcaagaaagttgttttcagaaagttataaataactttttttgcctgagctttttaaggcatttgtgttgttgccttctagtttcagttttgagaagatgaaacccaatctgattcgtatgtgtgtatgtttgtgagtgtgtgtgtgtgtgattatattcaccttcctggctgggaatattcttgatcctttgtacatgaccagtttttgtttttcctccttctctagaagcttttagactgtctttgtacccctattcaggatgatgggacttgctatgagtccatttttatttgttatcctggacacttagtggcccaattaatctataaacktgtgtccacaaattctgggaaatgttgcaaattatttcattgatgctgtctttctccctgtgttctctgtttctttttcttagaagtctttttatttccataatggaattcctagaccaatcctataatttaaatctctttcttttgtcattttcatcactttaatgtttttaatggtattttctgggcacttacctcaacttttttccctaacccttccattgcgttttaaatttctggtatatattttattaaattccaaaaattctattttatttttaaatgtttctttcatatgayattctttttctgtggttgcaatatcctgtttctcagaggatatttaatgcagagtctatttcctccaagatacatattttcctaattgttttaacttctgtctgtcatattagtggatttcttcagatgtcttgggattcttggctatccattcatcttggatgctttagtacacaggataccaaattgttgatggaagctcagtgcttataggatgggcttgctgatgtgcttggctataatatgaaagcactgggctaccccattaggacacttctgtttcgtctttcagtcttttgttcatgggctaatctgattcttcagagaaggtttgtagaaaaatcttctgcctggaggttaaagatttgtctagcatcattttgagggtctagttgaaaagaagctgagggtttcaaaatgtgcagtgaaatttgtacattataccttccttctttcagtatggttcctggtgtccccccaggacggagaccctctgtttaaccctcaccagagactaaacccaccaccttctgtggggtgtgagaagggcagtcacttggcttcagggagtgtagaagatatgggaggggtctaacagtgccttatatttgacccagtccttatgtttttgtctcctccttgatcttttcttccagaggcccctggcattgccagtttctgaggtttggggcagaaatggggaattcggtgttgaaattaggtcgtttctcacctttcctcactgctcacctagacttttttcttggtacctttttttttttttttttttttttttgagatggagtttcactctcgttgtccaggctggagtgcaatggcatgatcttggctcactgcaacctccacctcccgggttcaagtgattctcctgcctcagcctcccaagtagctgggattacaggcatccgccaccacacccggctaatttttgtattttaaatagagatggggttcaaccatgttggtcaggctggtcttgaactcccgaccttaggtgatccacccaactcggcctcccaaagtgctgggattacaggcgtgagccacggtgtctggmctttttcttggtacttttcaacgcttatcccattttctgtcttccaagatggctttgctgttctcccctctctagttctttttaaactgcctcatgtatttttacactttttggtttgtttktttttttttkggggatggagtttccctcttgtcgcgcaagctggagtgcaygatctctgctcactgcagcctccacctcccaggatcaagcgattctgcagcctcagcctcctgagtagctgggattacaggtgcatgccaccatgcccagctaatttctgtatttttagtagagacgggttggccaggctcgtctcgagctcctgacctcaggtgatccactcacctcagcctcccaaagtgctgggattacaggcgtgaaccaccacgcccggcctttttacacttttttttttttgccttttccyccytcttttgtgtggagaatggggtcttgttatattttccaggcaggtcttgaactcctgggctccagctttcctcatgcctgtgccttcctaagagctgggattccaggcatgagccaccatgcccggctaaactggttcatgtatttttggaaagtcttttacagttattttagtaaggtttaggaaggaagagagctaaatgcatgcactcagcctaccatcttctcatgggaattctctcatgccttcttttacaaagaagtgataataataatcatggatttttattatatgcttcctataaagctcagggctttacagaaatattctcagttaatctttaccacaaacctacaaggtggacaggaccagattaggaattttaaaattaagccctgaaactattaaggtgcaggcatatgtcataaaaaaaaattaaattataaagtaaagaaggctgacaaaattgtttttgtttttgctttttttagagacagggtcttgctctgttgcccaggctggagtgtaatggtgcgattgtaactcactgcagcctcaaactcctgggttcagcaatcctgcctcagcttcccaagtagctgagactacagagatgtaccamcatgctcagctaattaaaaaaaaacaactgttttttgtttgtttgttttgagacagagtttcacccctgtcacccaggytggagtgcaatggcaygatctcagctcactgcaacctccacctcctgggttcaagtgattctcctgcctcagcctcctgagtagctgggattacaggcacatgccaccatgcccagctaatttttgtacttttagtagagatggtgtttcaccgtgttgaccagactggtcttgaactcctgacctcaggtgatccacccaccttggccttccaaagtgctgggattacaggcatgagccaccgtgcccagtcttttttatttttgagacaggttctcactttgtcacccaggctagagtgcagtggcacaaacacggctcactgcaggcttgacctcctaggctccagtgatcttctcacctcagctccccaagtagctgggactgcagccatgcaccaccacacccggctaatttttgtattttttgtggagacgggatttcaccatgttgcccaggctggtcttgaactcctgagctcaagtgatccacctgcctaggcttctcaaagtgctgggattacaggtgtgagcccactgtgcctagtgaaaaaacttttttttttttttttttttttttttagagataagatcttactgtgttgcccaggctggtctctcattcctggcctcaagtgatcctcctgccttgacctcccaaagtgctgggattatgggtatgagccaccgtgcccagcctaaagttgctatttttcccatgatgtttatcttcgtggtgcttatgaaatggcaactatggcattcttccttctcgtgcatgcctgtgtgggtgtgccctcagcatatgcttacaaggtttattgggtgatccaacgctagccgcaagagctattattagcycccttttacagctgggaaaacagactcagaggagtggagaacttgctgcagatttgttaagtgtcagagccaaatatacacttggattatcctgactccaaagccggagccctgctggtcagtcggtgacaccgggcaaccacagggatccccctcaatcccacggaaggctgtctactgtcttcatctcagagtgttgacagctcaaagcttaggaggctggagctaagttcaataaatgaacgtgatgaataggagaaaagcgccattaaagccctccagacaagaaccactttggagcccctccatgggtccctggggtgtaggaggggcaggaaagcagataagattccattctgagcctctgcacttgccctatgcaagatagccacaagtaatgttttgtcctcacctcattagcaacaaatggccacactcaggggattaaaaaaagaaataacagccagcctttatcagcttggggctcttggctaattcctctttaagcttaagacaactctgcgggtggagtgatccaaacgactttctccactttgcaagttcccacactcggctgtatccttctgcttgagattggcagccccctggggatggttcctgctcacccaactcccctgaggctgctccccagtagaggcagagagaggaagggcactgatgtcctcagggcccctgcaataggtcaggacctgggttcactgctccatcaatcccacattgctcggccctcactagcaccacacagggtgggtggcagcctccccatttgatcratggggaaaactcagcacacctacttggccccagaactgagagtcaaacctggggacccagcttcgctgccctcagaatgttactcttccctcctgggtagcrtggtatagatagtgtagtattcttgtccccatataacggaagaggaaactgaggcccccagaaggctaagggactagcataggccttgtgtcttagcctgttaaggctgctatatcraaataccatagactgggtggcttttaaacagatatttgtttctcgtggttctggaggctgggaagtccaagatcaagcttggtatctggtgagggcctagtgctgccttctcgctgtgtctcacatggtggaagggacctgctagctctctgggtctctcccccaatgaggattgaacccccatgatctcatcacctcccaaaggccccacctcctaatatcatcactttaggggtaaggattccagcatatgaatttgagggagacatgagcattcagaccatgacaccttgtaatcagaaaggggttaaatatctttggttgaatatcctgtcctgccgattcagaatcactgctgtctataacctcttccctagatcactrttttagatgatgatgataaagatgatattaacggcaattaccaagctcttaaatgtgctgtgggtaaaacaattttaagctctttctgaatccagtctctttcaatcatcttcatgcccttgaaaggtctggatttttgtcgatttccctggtgaggaaacgggccctgggggcagaggtgatagggtggagccaagaagtaattcccagctgtttctctgcagaggcagtgctgctacaaacacatctccaggaaggggtacagccaaatgcttctctgtctcttgtgggttttgcagtggctgtcagctatgtgtctggcccggttgggaatgatgggggactgtgtgtgggaatgaatggctctgtctggctggctcagtctttacagaggtgctaggagtgtctgtttggtgctctgactaatcatgaaaagttcacgtttttatctttattttatttttatttttggtacccatggtgcattacagggaagggagacagcraaggagaattatttgttataaaatagtaaatattggccaggcacagtggttcacacctgtaatctcagcactttgggaggcagaggcaggcagatcatctgaggtcaggagttcgagaccagcctggccaatgtagtgaaaccccatctctactaaaaatacaaaaaattagccaggcatggtggygggcgactataatcccagctactcgggaggctgaggcaggagaatcgcttgaacctgggaggtagaggttgcagtgagccgagattgccccastgcastccagcctgggcaacaagagcaaaactccgtctcaaaaaaaaacaaaaacaaaaacaaaaaccgtaaatattaaattgaaaaagggacatacttaagggagtgaacctgaaaagccccagctgacacttggcaacaccttccttgtttgttttgggcttttttgagacagagtctcactctgttgcccaggctggagtgtagtggtgtgatctcggctcacctgagcctcagcctctccaggctcaggtgatcctmccacctcagcctccagagtagctgcatacaggcatgcaccagtacaactggctaatttttgtattttttgtagagatgaggttttgctatgttgttcaggctggccttgaactcctgagcccaagcaatccacctacctcggcctcccaaagtgctgggattataggygtgacccacagtgcctggccagcaccttccttgttaaattgcatgtgtcagccacctccctcggtgtcctcccagcctctgggcagtctggctccccattcctttctttatccaacagcatttttttgtgagacaaggccttgccctgttgcccaggctggagtggagtggcacactcatagctcactccagcctccaactcctgggctcaagtgatcctcccctctcagcctcccaagtagctgggaccacaggcrcagatcatcacgcctggctaattttttgattttttgtagagatgaggtctcattatgttgcccaggctggtctcgaactcctggcctcaagcaatcctcccgcctcggtctcccaaagtgctggaattacagatgkgatccaccacgcccggtcattctaacaatattgattattagatgttgccctagacacagcctactgtgcgtatgtgtaaatacgaattgaatcatcccacaagtagctgctaagtagaggaggtccagagagtggggaagtgtagccctggggaccttgggaggacaggggaggcttccttggaaggtgaagtktaggcttggctagggaacttgatataggttctatgaggctgctggggctggagcagagagaagggggagaatgtaggaggtaggagtggaggcccaagagggagagcgttggttttcctgtctcctacaccycttcactggccagttctgctttcatgtttttatttattatatattttttgagacagagtttcactctttcacccaagctagagygcagtggcacaataatagctccctgtaacctcgaactcctaggctcaagcaattttcctgcctcagccttccaaatagctggggctacaggcacacacctctgtccacagctaattaaaaaaaawttttttttcatagagataggggtctcgctttgagtctcaaactcctcgcctcaagcaatccttctgcctcagcctcccaaagcactgggattacaggcatgagctcctatgcccagcccagttctgcttttacaataccagggcttcctgtaggtttggaaaacacctgttgggttgcagcaaaggctctcaaagtatctcttcttactcagcatgtcatcctaaccaactctgccgggagagtagagtggggagatgaaggctggagaaagagaagggccctcacttacagaatggcttaggtcatgggctctggagctgggttcacctcccagctctgccccggctattactttgtgcctcagtttcctcacttgtcccgtgaggatgatgactgtgcttactccagttgttacaagggtgattcggtcagtgtgtagggacacggtgcatggacaggacaagttcaacaggcattagcagtcagctgccgaggacccaccgtcaagggccatgcrgtggccacmttcacartcacaccacagaagatccagaacctctggcatctgcctccgtgcggggcattaggtagagagccacttttctgcaggcaatggaggctgagacytttcttctttactagcccaggggtattgatggccctgcagagaygggttttgattacctctcactggatcccccagcagcctgttaccagaaagaagggcagacgcagggagcctgggtctgtgctcagtccccgctgggttttctccttttatggtcagcctacmgtgctctggcttcccagmcagaatccaccagcttgtgtttgggcttgggccgaaatagctggtctgtggggagctgggtacctcctgggagtcctcaggcccacagcgggggaggaaccgctgaagccctttatcttctcaggaaacgtgcctggggccttacacatccgaggctgggtggggagtctggggaggaggaagggagagaggcaygtttaaggatggggtgtgaggtgacatgagccccagggatctgggctgggaagctcagccccaggcgggtcctgatgatggccggccgcccccagctccagccttcccagactccacggaggctcggtactgtgtccccgcccactttggagcttctgtcccaggccctctgcttgggatgctctgcctcgacctctccccaggagattctttcacatttttcttaatgctgttcagtggtcacctctgccgtgaaggcttcctgtcttgctcaggtcagtgtgaaaaaacaaacaaacaaaaaacctgacgtctatagcacttgggttcacatccatcgtagcactgctcatctcttacggtcatttctttgcccatctgactcccaccctgggtcatgaacttctcaaaagcaaggataagcaagtcatgaagctcggtgcattggcttgagcctgtgatttcagttacttgggaggccaaggcgggaggatcacttgaggccaggagtttgggaccagcctgggtaatattactaagttaccttactaggccctgtctctacaaaaaaaatgaaaacaaaaaacaaaaaaaccattagccaggcrtagtggcatgcacctgtagtcccagctgctcaggaggctgagatggaaggatctgttagcccaggagttccagactgcagttagctatgatcgtgctactgcacttcagcctgggcatcagagtgacacctcatctcttaaaaaagaaaagaaaaaaaaaagcagatcttattgacttttgtgctttcggtacctggctcaggactcgtttgttgaatgaatatgtgaacacgtgaatatgcattttccattgcttctaccttggttgcctctctgagccagagagcaattcaaaataacaagcatttcctgagcacctactgtgtgtcaggcattgttccttgtacccgggatcaggcacagcccttgaccttcaggagctcattggttcaggggaaaagcattgaaaaygaacaattttgtaattgttggaaacctaatagagctgcatgaagtggaagaagtcagatttataatcattcagaggtggtataaaatgaacatcatttttaaaaaaggtttatgcggtataatttaaataaattcattttaaggatacagttcacacctaaaattgcagctatgtctgcataactgtctaaattcactcataatttacatggttatgcagccattgctgcaatataattttatatttctatcatcccccaaagaaatcttgtgcacatttttttgtcactccatattcctacccgcagctcctggcagccacgaattcacaaatctactttctgtctctatggatttgcctattctggacatttcatataaatggaatcatatgtgaccttttgtggctggcttcttttttttttttttttttttttttttttttttttttgagacagagtgtctcactgcactcgcccgggctggagtgcagtgatgtggtctcggctcaccacaaactctgcctcctgggttcaagtgattctcctgcctcagcctcccgagtagctgggactataggcacgtgccaccacacctggctaatttttgtatttttagtagagacggggtttcactgtattggccaggctggtcttgaactcctgacctcgtgatctgcccacctcagcctcccaaagtgctgggattacaggtgtgagccaccgtgcccagcyggctagcttctttcacttagtataatgttgtcaaggttcatccacgttgtatcatggattcatactatttatatattttttaagacagggtctgtctctgtcaccccagctggagtaccgtggtgcagtcgtggcttactacaacctccacctcctgggctcaagccattgtcccacctcagcctcttgagtagctgagaccacagggattgtgccactatgcccagctaatgtttgcrtttttttttgtagagatagggtttcaccatgttgcccaggctggtttcggactcccgggctcaagcaatccacctgcctcagcttcccaaagtgctggaatttcaggcatgagccatggccgccggccataacatcctttcttttcatggctgaatactatcccactgtctgggtagaccacattttgtttatccatctacccattgatgaacatttggttgtttctattttttggatattatgaataaagtccataatttttaccaatatggaaaagaaaaacaagaaaaactctgaatgccatatcatggatagatggcctattatcattccatatcatctgtacctttttccgccagaatgttttgagacatttattaagtaaggatcacaatgatgataattactaaaatggagagaacctgtggaccatgggaaccactaggccatgtgacactcatgtttatattagagaaaggcaccgttttctcaaagcacttttcctccatctgctgaaagattattacaataaatacacaatgcaatacaataaatgaccaatgcaaatagtttctccatagagttatgcagtgtacaacatgcaccacggtccayggccatcctgcaggtaggaggtcaagtggaaaggtctccaactcagctctagaaaagtgcagagttagagaaggtatcatagaagagttgactcccaagacgatgtttcagatacagattagggtatgtacccgaagaattgaaaaggtactcaaactaaaacttgtacaggaatgttcatagcagcactatgcagaatagccaaaaggtggaaataacccaaatgtccgtcaactgttgaatggataaacaaaatatgatccatccgtacaatgtgatatgactcagccacaaataggcataaagtctgggacctgctacaacatggatgaacttcagccacatgctgagtgaaagaagtcagacatgaaaggccgcacatgttataattccatttatgcaaaaatatctagaataggtaagaccatagagacagaaagcaaattggcggttgcaagggcttatgggggagtggctgcttaacgggtagagggtttcatttgggggtgacagaatattttagaactagataaaggtggtagttacgtaacattgtgaatgtactaaatgctcctgaattatgcactttagttatttttttatctttattactattttttgagatggagtctccctstgtcacccaggctggagtgcagtggcgcgatctcagctcactgcaaactccacctccctggttcacgcgattctcctgcctcagcctcctgagtagctgggattacaggtgtgcaccaccgcgcccagctaatttttgtatttttggtagagacggggttttgccgtgttggtctcaaactcccgactttaggagatccagctgtgtcggcctcccaaagtgctgggattacaggcataagccaccgcacctggcttgaattattcactttaaaatggttctttttatgtagtgtaaattttacctcaatggaaggaaaaaagagagagagagagagaatggattaggccagagaagaagtggtggtgggtgcactgggcagaagaaatcacttgtgcaaagcaaggagggagtgaaactgctttgtacggtggagaacactgcttttgagtccaacacaagctcaggcttggggaaggaatcagataaaaatttccaggatctcagagttccctgtgctccacacgggttggcagacagcacccacatggagtccttctgctcgtaaccagcaccctgcaagcttcccacgcctggaagtggtgtgtttttgatgggaacgtcaggccagaggtctcccagcagcccccagctcggagccgcgctggcagctcccaggccttctcctggagcccgctccctctcctgggggccctgtgagcatctgagcctataaatctctcctgctctgggcctaggattcacaaggctgccaggaaagcctgcctctctccctgaagtagtggatcaacacagcccatctgtctgtccatctcaaaatctttccttaagatagtggaggttgtctgggccggtcccaggaggttctctctgyctgggttctaatcacagggtacctggttcttctatccttcaccctcttttaaaaaatcactttttagtactttgggaggctgaggcgggcggatcacctgaggtcaggagttcgagaccagcctggccaacatggtgaaaccccgtctctacaaaaaatagaaaaattagccaggcgtggtggcacgcacctgtagtcccagctactcggggggccgaggtggaagaattgcttgaaaccaggaggcagakgttgcagtgagccaagatcgagccactgcactccagcctgggtgacagagcgagactccatttcagaaaaaaaaaaaaaattaaactggtttcccattttgctctgtcctcgagtgaatttctccccctgggtggaagctaaaggcacgggtatctgtctgtctccagagtataatggagagattaaagtttgattgcttttttcctgctttttttttctttgagatggggtcttgctctgttgcccaggctggagtgcagtggcaaaatctcaactcactgcaacctccacctcctgggttcaagtgattctcctgccttagcctcccgagtagctgggactacaggtgcctgccgccatgcctggctaattttttgtatttttagtagagatgggtttcaccatgttgcccaggctggtctcgaactcctgacctcaggtgatccacccacgtgctgggattacaggtgtgagccaccacgcccggcctcctttctcttataaatagggacaccattgatttaggtctcactccaagccaggatgacctcatctcaacatccttcccttaattacatctgcaagacccttattctaaataaaatcacaggtgggatacagtggctcacgcctgtaatcccagcactttgggaggctgaggcaggtgggtcacttgagcccaagagtgtgaaaccagcctgggcaacatagcaagacccaatctctacaaaaaatacaaaaattagccgggcatgctggcatgtgcctatagtcccagctacaggggaggccgaagagggaggattgcttgagcctgggaggttgaggttgcagtgagctgagatcacgccactgtacacccacctgggcgacaaagtgagaccccatctcaatcaattggttagtcaataacatcgcagtctgaggttctgagtgaacatagcttttgggagtcacagttcaacccaccctagtgaccttgggcaagttgcctcacttctgaacctcactctccttatttgtaaaatggaggcaatgccagtgcccaccccaggagctgctgagagaattcagtgggtcacttcaacacagaagttcagcatacgcctgcagtgcagtgagtgctcgggagatcggagctgttagtgggatcctaatgcggtggctctttcttttctgtctttttttagctttgtggtcatgatggtttcataaagaacaataccgactctttttctattgaccatttttggtgggatgaggaaaagattgtatgtgttcatagcacaaacataaccaggatagaagtagaatgggtgaaagtaggtcttcctcctgtcccttttctcaatacttcaggctcaggcctgtttgttggttttttttgtttgttttgttttgtttttggagtctcgctctgttgcccmggctggagtgtagtggcatgatctcacctcactgcaacctccacctcctgggttgaagtgattctcctgcctcagcctccggagtaccttggattacaggtgcatgctaccatgcccagctaatttttgtatttttagtagagacagcgtttcaccatgttggccaggctggtcttgaactcctgacctcaagtgatctgcccgcctcagccttccgaagtgctgggattacaagtgtgagccaccgcacccatcccaggtctgtttttagagatagggtctcactccattgcccaggctggagtgcagtggtgtaatcacagctcactgcaaccttgaactccttggctcaagggatcctactgtctcagcctcccaagtagctgggacaaggggtatgtctatcacacatagctaattaaaaaaaaatttttttttgtagagactgggtcttgctatgttgtccaggctggtctggaactcctggcctcaagtgatcctcccatctcagcctcccaaagtgttgagattacaggcatgaaccactgcatcctacctatatatctgtctttttaaaacacaaaaggtataacactatgctacctcatcttttatttttagcttaatatattttggatatttttctgtgtccatccacaaagctctgcctggttcttttcaatggctgcctattttatttatgtatttatwtcttatttgtttttgaaacagagtcttgctctgttgcccagcctggcatgcagtggcacgatctcggctcactgcaacgtccgcctcctgagttcaagcaattttcctgcctcagccttctgagtagctgggattacaagcgtgtgccatgacacccaactaatttttgtatttttagtggagatggggtttcaccatgttagccaggctggtctggaactcctgaactcaagtgatccaccctccttggcctcccaaagtggtgagattacaggcatgagccactgcgcccggcctgcctatttttaaatgtgccattatataaacacaccagaattgaaaccccagagctgactagtctttaggccttttgtcttgaggatttcgttcaaccaggccacccaaacatccatctataatccgagggaagagagagagaactgattggagttgggcatagaatctgaggaacgtgcccacatccaatcagttctctcttaagattacagatggaagaaagagtcatctctttcaccttgccttcttcagtcccatccatcctcccattcatattcccatccatccatccatccatccatccatccatccatccatccatccaactcatttaccggcctatacactctgtcctccctcccattcacccacccatccactctctcatccactcactcatccttccctcctscgtccaaccatccgtccaaccagctatatacccacccayctacccatctacacacccttccctcctttcttctttctttcttcctatctatccatccatccttccttctttccatccatctattcgtscacctacccacccacccactcatccatttgtcttcctgtctctctacctgtccatctatccatccttccatccagccatctgtctgcctattcacccagcctcccatccatttatcctcccgtccatttacctatccatccattcttccatccacccatcctttcttccttccttctttcctttcttccttccttccactcacttgcccatccacctcttcttccatcctcccatccatctactcatctatccatccattttcccacccatctgcccatccacccacccacctactcacctactcatctgcttatccaccctcccgtccatctgtctattcatccayccacccacccatccatctacctacccatctacccacccttccattcacccatctacccttccttcctttcttccttccttccgtccactcatcttcccatccatctactcatccatccctcaatccatccatctaacaagcataattcagcacctaccatctatgtgccagtactagagatacaatgtaaaaccaagcctaggagatttttgatgaaatgaagcttgtgagagctgagcactgaactagtaggactgaagccagggagtggatttaagaaatgcttgccactgtggcattgtctaccagcagatatgatgctgggatttctacattgttaggtgaccattgaacgtattggtaactgttctcagatctctctttgggaaggaaatgggtcttcagagcctggctccacctcagaggcctctttaagagtagaaggtgatggrtaatgtctgcttaatcacatctagttctttgatgacctctgtatcttttgggtttctctggtggtaaacaagagagactgactctgtcatctagtagaggaaagggatttgtaggggagtatggaggagctcacagttgcagtgggaacactaggaatcaggctaggtaaatgacagaaactgggctgcttgggcccaggggcagaaaggaagtctgcctcagggctctgtccacctgctgtgcttccctgtccttgactgagcttggagttttaggccagagagtctgaccaatgcagcctggaacacattcttacctctttgttgaaggtacttatgaggcagtcccactaagactgtacatgacggtaggggtgatgggggaaacctcaaggaccacaggatgcttctggaagaagaggaaatggatgctggatttacaaaaaaacacaaatgtgcacaatactatattacagatgaaggaactgaggcatggagtttaagaatatttgcccaaggccacagagcggagaagtggctaagggggaccccaatctgtatagatccaacatctgcgtttggtccctaacctaatctgggtggggtgggcctcccgggacacctccagagctgatgtggctggatgctaatgactcctggatcagtcaggctccagcatctttctggggctgcctctgggactttggggctgcccttttggctttggtcgtggcccctgtagcctgggcaatgagcccagctgacctgttgtcacttccaatgaggccagcatggagaagctttagaatgggagggccctgggaggagccaagtccagacccttagctcagagctcattttaattcatggctcttttttcttctttctgtttgcagatcgggaggaccagtccattctatgcacgtaagtggaactgctttttcttctgttttttttttkkttttttttttttttaatctgtagtcgagatccaacctatgaaagaaaagatccatgagtgcagagatctttgatttgttcatggttccaagtgcctctctttatacctggcaccatgtagatgctcactaaacatttgtgatatatggtcttctgcggaggcaggcaaacttaaactcttaatgacacctgctatcatttggttccatacctctcctccttctaaaaaactagcatttattgaacatgtactctgtgccaggacttgaactaaagattttatatgcagaatcttatctaattgcataacagccatctgtgttgatagggaagatgttaaactgtcactttagtatttcacatttatcaagccacaaacacatcagtgccatatttggtgattggtatcactgtttctttgaagacctaggtacataggcagaagatagtaactcaattttagaatcattgagagagttttcactattgtatttatatgcaagtaacatatattaatatatattgttgattcattgacattgaactcacagccagcagctctgtggctgatgcctggatgaagtttatctgatgtgtatttattacataatgggtatcacaactttattgtgcttggaaacatgagccaacacttgagcactatgctggggacatttttgtatgtgtgctgccgaagggagcacatctgaggggacattttaaactgcaaaataactaacaaaaagccacaaaaatacaaaaaaaggtggcactaaatacactacagaaaggacacttgtttacagtatgagagttgaaactagaaggtagagcattcccctgttcaacctgagctgggaacgtgtgcattgggggaatcgaattttccttactctgcacatgttcacaaatgactacaaaagtgccatgaatattgattttggggttacaaataactttcagcaggtcggtgaatttgaaaatatagaatatataaataatgaggatagactgtgcatatatatatttacataatatataatatgtattatatttaatatatttatatttatatatatatatatttgaaggtctggaagcaactaaagctataatcaacagaggttatttaaataaaatatagcatttccaggtagccactacaaagagtgaggctgatctatttatgctgagagagaaygctctttatagataataccgttgagtggaaaacacaggggcaaaccagcatatgcataatgtaaccgtgtgtgtctttaaaaagagcaggattgcatggacgtgcatatgtttcctatttgcatgaaattatctggaaggacaattaaaaactagtaattagaatttcagatggtgatggatggtaggatggcaatgaactgtattgagagaagattgaaacaattaataagtttggggttgatatagatagaaaacctggaaacaataaaacaaaggcaattataaactccaggaaaaaacaaaagttgggatggaaggagaagtaatcacattggactaaggagcccagctgtgcaagtttggagtatttatctaaccagaataactmcctgtgatggacttggctctgtggggaaagggaagaggattagatgggaactgaattctcatattccatggtaggatgtacacatttgatgtttgacaatgaatagtctggatctagagatataatgctacctagctatgaggatataaatgctaaaacaacctgccgacttggtttcctagttttctggcttctaggggtcacctgcattccttggctcatggtctcttcctccatctttaaatcctgcagcatggtatcttcaaatctctttctctggtccccctacctctctcttataaggcccagtacctttgtggttatattagccccacctagatgatccaagacagtctcctcatctcaagcaaacatattcacagattctgaggataggccatggacattcttgtgggggctgtttttcagctagccacagaggcatttgatcccctaggagccaaacccatgtgtgagccacatgtcatctccccaggaaccaaaatagtgtagctcaactgccctctgttgagtgaatgaattaagtgtggtaacagagaggtgcaggaaagagtaggactttcagatggcttcctagctatgtagctatgcacgggtcacttgacctctctgagctgagcttatggagaggctgtgaagatgaagaagaggccaccctgctctcatttccagcacccatgccatcagcaggtgctgtttcatctaaaacggtgctatccaaaagaactttgtgatgagcacaaagttcacttaaaagttcacttaattgagctcttaaaaagtggcaagtatattgcagaactgaatttttaagattttagttaatttagatagcggttcctgccttggacrgtatgatgctgaaatatttctcatctctgtccattcctctgactccaccgcctcttcctagttcagggtcccgtcacctctcaccagggcctctgtagcagtctcttaagctccctgctcccattgcttgcttgcttccttcctttaataaatatacattataagaatattcactcattattcattgaataaatattcattagcatgctgtcataaagtgtggattccagaacctaaccccttgggtttgaattctggccccatcatcgtctagttagttgtatgctccaggaaataagtcagttcacttctctgagcctcagtttccccatctgtaaaatgggaacaataagcaccccattgggttgttggaaggatgaaatgagtcactacatgtgaagaactgagaaacaggccactgccccatggtgagcactttgtaaggatcagctgctattgtagtgaaagtgctcactattttttaaaaatccttcctgcaatccagtatccatcttgcagtttgtttgtttgtttgtttgtttgtttttgagatggagttttgctctcattgcccaggctagagtgcaatggcgtgatcttggctcacagcaacctccacctcccaggttcaagtgattctcctgcctcagcctcccgagtagctgggataacaggcawgtaccaccatrcctggctaattttgtatttttagtagagacagggttttgycatgttggtcaggctggtctcgaactcctgacctcaggtgacccggggagcctcggcctcccaagtgctgggattacaggcatgagccgctgagcctggcccatcctgcagtttgttgtkgttgttgatttttttgttgagacagagtctcactctgttgcccaggctggagtgcagtggtgcgatcttggctcactgsaacccccgcctcctgggttcaagcaawtytcctgcctcagcttcccgagtattatgccatcatgcccagctaatttttgtattgttaatagagatgggttttctccatgttggccagcctggtctcaaactcctgatctcaggtgatccacccacctcagtcagcctcccaaagtgctgggattacaggcatgagccacttcgcccagcccatcctgcagttctgattctccccacactggttctaaagtcccgttcccctcgtgaaatggtttcctgcacccatgagaataaaactcagattccttactgtgacttggaagactgagtgtgatctgctcttccctcttcacttcctgctgtcctcctctgttgtggccctccagccatgctgggagccattctgtctcatacctgggcccagcatttccctcccttggacctctgtccatactgtttgccctgcctggcccacccttccctccatccttcccacagggctctcttgtaactttcaaggctcagcaactccctggcttccccatccacascctcccctctcctcccttcccctcgatcttctcagtcacatcacccagatgtagcaatgatatctccaccacgaactatcttgattatttgtttacttggctattgtgtatctccatctcctggaatgcagcgttagcaaggacttggcacactgcccacacacagccagtgctggagaaggaggccttagccattgttaggraggaaatcccaaaacgatcmgacttttatttgcaaatgcatccagtcagcccagaaccaccaacatcttcrgtctctgtattcaattttattttgcttgttgtgaaattcagccaaagtgacttgaaggacctacaagttgacagcagggctgagcttttacgcgtagttggtgcttaagagaagccaggctggagccaactgttyggttatgcagttaagaaactgaaaattggccgcrcactgtggctcaggcctgtaatcccagcactttgggaggccgaggcgggcggatcacgaggtcaggagttcgagaccatcctggctaacacggtgaaaccccatctctactaaaaaaatacaaaaaaattagctgggcatggtggcgggtgcctgtagtcccagctattcaggaggctgaggcaggagaatggtgtgaacctggggggcggrgcttgcagtkagcagagatcgcaccactgcactccagcctgggtgacagagcgagactctgtctcaaaaaaaaaaaaaaaagaaaagaaaagaaactgaaaattggccacgcaccgtggctcacgcctgtaatcccagcactttgggaggccgaggcgggtggatcacgaggtcaggagttcgagaccatcctggctaacacggtgaaaccccatctctactaaaaaaaatacaaaaaaattagccgggcatggtggcgggtgcctgtagtcccagctattcaggaggctgaggcaggagaatggcgtgaacctggggggcggagcttgcagtgagctgagatcacgccagtgcactccagcctgggtgacagagcgagactctgtctcaaaaaaaaaaaaaaaaaaaaaagaaaagaaaagaaactgaaaattggctgggtgtggtggcttatgcctggaaactcagggccttgagaggccgaggcgggagggtggctggaagccagaagtttgagaccaaactgaggaacacagtaagaccccattactacaaaaaatttaaaaattagctaggtgggatggtgcatgcctgtagtcccagctactcaggaggttggggagggaggatcacttgagcttgggagttagaggctaagtgagctatgatggcaccactgcacctcagcctgggcaacagagcaagacccagagacaggaaggaaggaaaggaagggaaggaagacaagaaaggaaggaaactgaaagctgaataaatgtaatttttaggcctgagttgtattttgtctagcatgtaatccatccagtataatcagtttaattagaggccatgggcctggctggagatagagctgtgtgatcagggggctaaagtaagaggaggagggtggtttcacataaaattagagagaggtargggggtgcttccaggccctggggaggagtttaaactttcgtctaaaatggatgacaggctgggcatggtggctcatgcctgtaatcctagcacttcgggaggccaaggcaggctgatcgcttgagctcaggagttcaagaccagcctggccaacatggccaaaccccctctctacaaaaacaaaaattagctgagcgtgatggcatgtgcctgtagtcccagctacttaggaggatgaggcaggaggatctcggttcactgagcctgggaggcagaaagttggcactgagccaagactgcaccactgcacttcagcctgggtgacacagtgagaccccatctcaaaaaatatatataacaataaaataaataaatgaaatggatgagaacgtgctaagggactcaagccaaggaaggacaaagtttaaccagtgggtcaaatcaggcccttgtctgtctgttccagataaagttttattgaaacacagccgcacccacttgtttacgtatttgcttttgtgctgcagtggagagctgagcagatgtgacaaagaatgcgtgaccctcaaagtctaaaatatttactgtctgaccttttacaaaaagagtttgctaactcctagcttaaacagtgggaaaatgtgaatattatttatattgtaatgataggatgaatgctgaaaatcattatacaaacaatatatracttctgtggaagcagtggttataaaagtaataataggtgggcacagtggctcacacctgtaatcccaacactttagggggccgaggcaggaggattgcctgaggcctggagttcaagactatcctgggcaacttagcgagaccccacaaaatcaaaaaattagctaggtgtagtggcacatgcctgtcatcccagctactcaggaggctgaggtgggagggtcacttgaacccaggagttcgagattgcagtgagtcaagattgtgccactgcactcyggcctgagcaagaagcaaaactctgtctcaaaaaacaaaagtaataataactaacattttggcataccaggcattgttctaagcattttatataaatgttcactcatttaatcctcataagaatcatataaaaggtcaggcatggtggctcatgcctgtagtcccagcactttgggaggctgaggctagagatcacttgagaccaggagttcgagaccagcttgagcaacatagcgagacccctgtctctacagaaaatttaaaaatcagccagctgtggtggtgtgcacctgtagtcccagctacctgggagattggggcaggagtatcacttgagcctaggaattctcagctgcagtgagctatgattgcatcactgcactccagcctgggccacagagtgagatcttgtctcaaaaaaaaaaaaaaaaaaatcatacaaggtaagtgtttttattatacccattttataatggggtaaagaaactgaggtatggagaggctaaatgacttgcctaaggtcacccaggtaactggcagaggagggatttgaacttgagcaacctggtcctggagcccattatgctattctgccaattgatgctayaggggagagaggcgttgcttctgcctggggttttgcaggacgtgtaggagttgtacagtacaaaatgccagggtgctttgccagtcacataaagaccagggactgaatagctgtgaggttcatcagagacaatttggctttcctaccagtggcaaaccacaggctgcaatggacttggcaatattcgaccctgggagccaggaccagctgcagaatttgtagaattttgcaaaatgaaaatgctggctgagtgcagtgactcacacctggaatcccagcactttgggaggctgaggcgggcagatcacatgaggtcaggagttcgaggccagcctcgccaacatggtgaaatcccatctctactaaaaatataaaaattacccaggcatagtggcgggcacctgtagttccagctacttgggaggttgaggcaggagaatcacttgaacctgggaggtagaggttgcagtgagccgccatcacacactgcactccagcctgggcaatagagcaagagtcagtctcaaaaaaaaaaaaaaaaaaagwaaagaaaaaaaatgcagagcgtttataaagaattaggaagaatttccagatggcaacattagagtatgaagcacagggtggtccctgtgagacggtacaggtcacactcatgaagccagcctggctgggggattaagtggccattgggtggttcttcccagctgctggggctggactgattaaaaggacttggcactggggtagttacaaggccaggaggccataacgtggtcatgagtctggtccttctccgggaagagggagctcagtaccaaattccccaagaaataagaaaggagtttagggtgctcagaccaggaaggcatcttcacccctagaggtcaggggtcagaaaagccaagctatgaatgtttctagaaccagctctaagcacatcaaccttcagacgcccacgagcctggagcttgggatgttttctttggcagaacctcccagggcaatttatttttctcaacagaacttggaaacagtggagcccagcagcaacatgggaaggggtagatgcccagagtttatgtcccactccccatcccaggcaaagtgggagaccatagccacggatagggcacattgatgtctttgtttttttttttgtctgtctgtytgtttgtttgtttgtttgttttttgagatggagtctcattctattgcccaggctggagtgcagtggcacgagctcagctcactgtaatctccgcctcctgggttcaagggattctcctgcctcagctccccaagtagctgggactacaggcacccaccaccatgcccagctactttttgtatttttagtagagacagggtttcaccatgttggccaggctggtcttgaactcctgacctcaagtgatccacccgcctcagcctcccaaagtaccgggatgacaggcgtgagccaccacacccggtgatgtctttgttgtaaaagggaggaggtgagagaggttcaaggccagggtggaaaggaaggaactattgtgggaaaggagaagtgagcagcagcagtctaggagcactggtttgtcagcatgaagagtgtgatccacacatgttgtttgtgcacactgctgtcctgattcttgtcttggatctgaataggttcatgaccacctacgcaagtggtttcctacatccaaaaatttctctcctttctcttgctttaatcagaatccaaccccttcactttagaatgaagtcaagcaaggttctgacgttagcctgattgaagtaattcatacttaggtgtgaatgactgagtggcttggttcattgattggggcaagtaaagcctcctggaatatatggcagaattccagtggagtggggctgggacttcactctgtcttttctctttgctgatttgttaaaataaaagggtaggaggcagaacatgggccctggtgtcaagtggacctacgttcaaatcctgcttctcctccatttcctatctgtgtgaaagcaggagcaattgtgggctggagcaatttamttcaaacctctctttgcctcagtttccccggatgggtgatggggataattaataactctstcattagattgctgggtagagtaaatgaaaakatctgtgagcccaaagcctagtactgtgcaggccttcaacaaatatcaattccccttcccctgcccttcttctggccttagaaagcaagtccctagagggttgggcctgtgtcatggaacaacttggtgaaatgtagtaaaaggaattctgactgcattagaatcagagacctgactttccattctgactgtatcccttctttgctgtgtgacctagggaaaattgcttacccactctgggcaagactcttccttctataataacatggaagcaggaagaggataaaggaaataattcatgtagagcatttagcaaagggacccttccccctatatccccccaatgacaaacgccaattcttctctgtcttaagagatgggatcttgctatgttgcccaggcttctctcaaactcctggcctcaaggcatcctcccaactcagcctcctgagtagctgctattataaacgtggccagttctctgctgcacctggccagttctcctcttttacacacacacacacacacacacacacacacacacacacacacayatattctggtcttagtttccccttctggggaaatggggtaatgccttcatggtccccatttcataaactgcctctgaggccatgtgaaataatgtggccattgggaaggaaggcctctaggaagggaagggaccacacaaagtcaccgcaagatgtttcatcattcttggccatcagacacttgatttctggacagtgggacctgtaggattaggcacagcaatttggggcactttttttttctttctctttcttttttcttttcttctatttcttttttaagccatgagccaagttattaatgggcctttggcagagaaaattaatttctttatttcctaattaggaagaagagcagagactgtactagctttggtggcactggttcagcacagagaaccttgggctgacctcggggtgaacaaattcttttttcaacttaaaaaaaaaactctcttatattttagagtattaagtgagctcagaaaataaaagagataaggcaaagaaaggaaacmcaaaaaacaaaagtaaactgaaaaatagaagaagacgataaacaagtgaagttttggtcaaggcactgtccttatctttcactaggagtggtggaacatagaggcagtatctggatggagcggttccattgtgatgatttctggtggccaaaacaggcagctagtgcacgaaagccatcttggtaaaaaaaaaaaaaaaaaagatctaccttcatattccaggaggacatacttttttgatacgacaaaccatgtcgtgctgatctaaacatatcagtcatttacactttagtgtgaattacttcaactgggtttattcttagatacttggctgagatcatcagcyagcttcctgatacatggggtgggattcctcagaggataaaggggcttgcatctgcccagtgaccaatgggataaccggttttttggtaaatttttctttccataagggagcttcttaaactttaggtcctggtactccagaggcacttacatcctttcttgaaggctgccttgtgcctggtctttccatttctagcaatgctaatgatgtctgcaggcggatcacgaggtcaggagatcgagaccatcctggctaacatggtgaaaccccgtctctactaaaaatacaaaaaattagccgagtgtgctggtgggtgcctgtagtcccagctacttgggaggctgaggcaggagaaccagggaggtggagcttgcagtgagctgaaattgtgccactgtactccagcctggggacagagtgagactccatctcaaaaaaaaaaaaaaaaaaaaaagtagataattccaaataaacctgtttggacctatgtaagaaaactaaggttttcttgttcactctatttttttagagatgaggtcttgctctgtcacccaggctggagtgcagtggtgtgatcatggctcacygtggcctcaaactcctgggctcaagccatcctcccacctcagcctcctgagtagctgggactacaggcatgcaccaccaagcctggttaatttttcttattttttatagagtcagggttgtgctgtgttgctcaggctggtcttgaactcctggactcgagtgatcctcctgcctcaasttcccaaatagctgggactacaggcatgtgccaccatgcctggctaatttttaaatctttttctagaggcagtgtctctctgtgttgctgagctggtctcacactcctgggctcaaatgatcctcccacctcagcctccccaagtgctgggatcacaggcatgagccaccacatccggcccaccttttcactctttgtatctgaattcttttctatgtcctcttggaagkaatagattgggcattggacctaggctggggacccagttccgctcactaccagagatgtggccttgggcaagttacttcccctctgggagcctctgtttcaccctctgggaaatggtggtgatgatcattattgtcctgcctggctcatggaactgcggaaaggtcaccatggaacgtgtgcatagatgatgttcccgtgtctttcagaggcgagtctggagccgggaaaaccgaaaacaccaagaaggtcattcagtacctggccgtggtggcctcctcccacaagggcaagaaagacacaagtatcacggtgagtggcagttcccaatcagaggccatgatttagccaaccggtctccagcttgcagcccaaccgagayacaaacagaacatcattgcaagaactcaggccccatctgactacccctcccctgaagactcaaagagggaccgtctttttggcgagcaggcctgttgagtgtgggtgatttcttggctcagctagaagcatccctccagaagggggcccgttttgtgaaatgagaataagccctttccttccatagcgagatcttcctccacgtcggggcttctcagtggtggcactgatgtcattttggaccagataactcttccttggaggggcttccctgtggctcgtagaatgtttcacaacatccctggcctcgacccgccagatgccgacagcccccttccctccagttgtgacaaccaaaaatatctctagacattgtcagatgttccctggggtgggacagttgccctygattgagaagcactcctttcatgaatctctgtaacgtcccaggggttaaggtaccttttgggttcccggattcctccacgtgtccccctgtccctgggatggagatgctggtatcactcggcccgtgggcttcagtgcaatgccattcagtaactgtggattgagcacctactgtatgccaggaaccacttggggtgrggacctggggataagtctgagagatgctgttattctcttctctgagcttccrgacctgtggaagagcatgtagttgtcaaagaatccctcaaataaacagatgatgacacggtatgactaagagcttgggaggaaaagaagagcaggtttctagagtcatcacctctagggcccatccttctcttcctcctcgtgtgtcagccctgccccatctatcccacaggagggggcacgtggtagggccgctaggactggccggtgcctccgtctgcaggtttgtgggtgggaagatggtaggatggagatctgaccacggcatggggtgtctccagtgttcgccattccagatgtcaytttgcgtcctcagaggggactctggggcagccaccatggccggcttgtctggaggcccttggagatctaggatgggcgctggtcrtggctttggagaactttccttctccaaacaaatgcaggaaactcaagattcagcatcctagaattgtctctggcaagttggtttccagccatagtgagtgggaacaatggccccagaggctgtgtggcagtttaaacacagtttccactgccttccctttccctaaagagtaaacacaggagataatactttctaacaactcatcgttatcaagggcctactatgtgctgcttgttttggctgcatgcgtaaacacatctcagacattgtctcactggatactgttttaaggagcctaatgtggccccagtaattatgaaaacctttgaaatgtctggatctctaagaaattagaaaaaggagggaatggctgagcatgggggctcatgcctgtaatctgtgttttgggaggccaaggtgggaggatggtctgagcccaggagttcaggaccagcctgggtgacatagtgagaccctgtctgtaccaaaaaaaaaaaaaaaaaaaaaaaaaaaaatcaagagaattagctgggcctggtgtgcatgcctgtagtcttagctacttgggaggctgaggcaggaggattgcctgagcccagtaggttgagactgcagtgagctgtgatcgtattcctgcagctaaacagagagaaaagaaacagtatcaaggaaaaggagctgaccagtctgtctgggagactccaggctgtttggggggatcaaagtcatatattctccagcccctgatgtccatgtgatggaaataacgctgacatttgttttatactgtgttgttcaaccacagcaaggcccatcttttgcctacgtgagtaactgagagtgttttcctggtgtgtaggggaggcacggagtgaacttagatctgcatgatcctcttgcacccaccgagtcccgtagctgstggtagaaatggggtaggccctagagtttcacaacttaaatcagtaaatgcaccaaaataccatcctgtgggtgtctgatgccagggaagggtgtgggggtgcatttaccacccacgggacgcctattggagtccccagggttgcgctccagcctgaaatggatttctccggttcagaatgaacccctgcacccttcaaagcatccrctcctggtacccttgactggaacaacctagacagagatgtctgtcccatctggctgagtgttttaggactgtcaggccccaaagcttccctggctcgayggacagtcgatggcacagctgtggcatgcctccctcttctctccctgccatcatccctaagtgtcttccctcagccctgtccctggtgcaccagtgtgtccctgtgcatgcgtgtgcagtgcgtgtctgtctcttgcatgctggttgcttgactcaagcctccagaaacagtcttggaggtcgcgatgcactagctttggtggcgcggtaaggccccagctacgcaacgcataacctggtcctgcttggacctgtgcatatgtaaactcatctctaacacagagcttggggggctgatgtgtgggtcccagcctagaagaaacccacaggtgtcttccttggctcccgaaaagatcattcaatccatcttakttagaccctgggtgactgtgttgcagatcagaaggagaattacagttcttatttgggatctgcttttgtgtgaccttggccgagtcagttaactcctcggggctatggtttcatcatctataaaaytgagggtttgaaccaggtcccccgatttaaagctctcttgccaagacttttcaaccttacctgccagaatccccattctagaaagggagcctttttcagagagcatggagaccccaagtttatgtgaacaaaagtgattcctttagtcgtcttcccaccaacaaagaaatgcccgtggtgctccttgtaaatttccaccagtctcagctgtggtgattccacttgtagctgagatttgtatgcrgatgaggcttttgcttcatctttctctgggagctacaaaaaggaggatgtgtggacaaatcaaaacagaaacaaatagcagcttcctgctttgtcctgtagaccaggtaccctgatgccttcctagcatgcggaggaatgaggaggaagccatgcccatccttgtcccctctagacactttcccggctcctgtccagcccagccctgatgcctggaaaaataaggaagggaaagcaggaggggaggacaaggagaaaaactcccagaatccagggcctggaggcctcggggcccaactgcagccgccatgttttagggctaggccaagagcagctcrtttgctttcccagcttaacttaccacattggccctttcctgccatgattaatcacgtgaccgcgtttgtgcaaaggcatcccggcagagggggccggtgggctgtgtacagtctcagcttcctttaacccaatgaatggagctcaggcaacctgctttgaagctttattccgcagtccgctaagaggattcctggtgggttttgtgcattccttacttgtctgctgtagaagacttcagaaaaccagtcctgagaaagaaaaaattgcaacttaaaaaaaattgcactaaaataattagaaggaggcttgtagtggtttaacttgaagaaggctgcttgttaaacatgaacagcagcacgactgccatgtacagtgggacaggtggtgcactgcacaactccggggggcaccattcatcatgatgtaaatgacatcaccgacattgtgcaaggcagtggctttgagtggcagtgatgttgcacagatgagcaggccctggtcttgaaaaaagtgaccttcctagggagcagatgtcctagctattagagagctcagacagttgcttctcttctgaaatcctcctgtaaatctgaacattagcrtcagggtctaagaggaggtaggagataggagagaacctgtgggttaagggcagagttttgtgacaacatccatccaaggtagaactgtcaggacctaggttgctttctccaataactagatgtgaatgaattttagggagagctggaaaagcagcttctacaagcaaacccgattctggaggctttcggcaacgccaaaacagtgaagaacgacaactcctcacgattcgtaagtagcaaagccacatggattttccagaaaagctttggtgtcatctcctgcctggggctgcagagtgtttgcgtgcagaggtgggaggggcatctgaccctggagagatgggctgtatctcacaatcttgcaagggctcctgcctctcactctctcattcattcattaatttattcactattcactcaacaaatattgattggcctggtgcggtggctcacacctgtaatcccagcactttgggaggctgaggtgggaggatcacttgagcccaggggttctagaccagcctgggcaacaaagcgagatcccatctctattattaaaataaaatttaaaaaattaggtattgagcacctggtatgggctagacccttatatccgataccattttatgtaacaaaacatgaattgagtgccaactgtgtaccaggcacacacctcctccaagaaatacttagtaagtacctactgtgtayaattactctggtaggyacttttacatgtaccaccattctctttgtttttttctcatttgctgtttttattaagtgcctactgtataccaggcactcagcgagtctcacaggattgcgatgaatagttcagatatggttccagccttcatgaagctggttcttccmactgaataacagagagtaagtgaggcagggggtactaccttcccatgcacactcccccaggctccaaagcaaaaagtttttgcctgagcccaacagggcaggggaactctgaaagtggatggttgatgataggtagacaacaatggttttattgtgcaaaagaagcggttgtctccrtaggagggtcagaaagatattttagtgagaaaagatgaaggaaaaattgcctctgcattccwkgagaagggggtctctgaactgttgctcgctgagatggggccctgtgaaagactctttgcagaaagctctgctctgctgagcaaatgcacatggtggtccctgaccctgtgatccccaaggcccattttagtaacaaacaattacataatgtctcctttcctcgcccgaaattagaatcatagatagtatcacctcctacacgtattagatgaatacacatcagcataatgccctaactggaatatgaagaagaaataacataagacaattcataatgaaagtgtgcatttcaggccaggcgaggtggctcaygcccgtagtcccagtactttgggagactgagrcgggcagatcacttgagctcaagagtttgagaccagcctgggcaacatggggaaaccccatctctacaaaaataaataaataaagtgcatttcagcatatcaatgctcgggccaggccacaccaacagaagacacagtaagagacagacacttaggtctatccayggcgacagctacaaatacaaggaaaagggwcaagttcaggcactgatgatgttggcatgggattttccagaatggcaactgactctcagtgaagcgctgaaccaaagaacaatcttctctagagtcacacagatgggatattcttgtattagaacaacattttaaacacttgttaatgctttcatttaaaagcataaaaatctagaccaggcacagagtggctcacacctgtaaacccagcaccttgggaggctgagttgggaagatcacctgaggtcaggagtttgagaccagcctggctaacatggkgaaaccctgtctctactaaaaatacaaaaattagctgggcgcagtgacacatgcctgtattcccagctactcgggaggctgaggtgggagaattycttgaacccggggagatggaggttgcagtgagccaaagtcacaccactgcactccaacctgggcgacagagtgaggctcttgtctcaaaaaaaaaaaaaaaaaaaaaaaragsgtaaaaatctaaagtcataaaggttaggttctaagcctggctaattacaaacagatttttacctccatgagtggcaggtgagacattggaagagtcataagggatatagacaaggattggcatcagagactctccaggtcattgcaggactcccaaaatatccttggccccactgttcactaacaacagcggcccccccccaacatgtgacaagccaaataatggcttccaccgatttccaaaatctccatagcagatgtgccgcctccactgagaagcactgcgtttgcatgttccaattctgtgcaatgtttctagcctgtcataaatggaagcacgtgcaagacaaatccctaaaaacatcctccactcactggcgtccctgccatcttgggaaggagagtgaagaaggtgcctgggccttgcctgtgaccagccggctctccctggctccatctgggatatggtcatcccaaatcactctactgcatgtttcccaatggggaaagtttgaaggttttgtcaaggactgagcaagcctaggggattgtgtccacacacgccaacacttcccaccatgttatgtcatgatgggggaaaaggatgaaatcctgtctcacctgttgaggaaacaggaaaagggttcatgccaacagatggaggattgggttccatccttggtttcatggcttagctgaggcaggtagatagggccatctttggagatacttgttgarcctctagggccaggaacatgagccattcctgcctaaaggacatcctacacagggcctgcttgggcagtgtggccaatgcatactcacctgtcccacagaaaaggtttaatccatagttggatgatgtggatgttttggagcagggtggggtctggggagggagccctctagcccctgaatatggaaaaaccttctttctgcttagggccctacctctcaggagcaacgtcacgttggacaagtcacttgatctcttttagccttagttttcccagctttaaaatggggatagtgggctgggtgtggtagtttactcctgtaatcccagcactttgggaggctgaggtgggaggattgcttgagtgcagcagtctgaggccaacctggacaacacagtgagatcctatctctacaaaaaaaaatttaaaaattagccagatatggtggtgcatgcctgtagtcctagctgcttgggagggtgaggtcatggggaaaaggggattgcttgagcccaggagttcaaggttacagtgagctgtgattgcaccactgcactccagccctcgctgacagagcaaaaccttgtctctaataaataaataagtttttttaaatagggatagccatgatggactacggtcattgcaaaagccgaatgaaattgatctgtgaacatgttttacacgttctgttgctgtcaggcctggggtggtttcagctcagcagatgttggttccgcctgacaacttgacctgtggggttctgagtgttcgcaagaatctcccygccccacctcccatcctctgtaccatctgcctcctgcttgcccacagcatggggttaamggctgaagttgggcagcaaagcctgaactgtgttttcctgttggcagggcaaattcatccgcatcaacttcgacgtcacgggttacatcgtgggagccaacattgagacctgtatcctttccctgagcctgggccaaaygggtacccctgccccctaccaatctcctgcccagaggctgggagagtccaagagccacctctatctttccagcctcttaggtttcttccagaacaaatctcccsttaacagcaggcattgtggtgcagtggttatacatgtgtggaccggacccctggtttgaaccctaaacaagcagcctaggctgcatgtgatgctcaaatgatctgtcccttagctgagtgaccttgggctggttactccacctctctgtgcctcatcagcaaaatggggatgataatgaatggtayctgcctcatagaaatgtgagaatagagtgaatgaactcatataaagctctaggcaccatgcgaggtgcagagtaagggctggctacgtagtgtctatcgtatgatcttcacttcatccttattcagccattgtccgaggccaaattctggacctgtcgtcctcttagagagttggtctgtgatcggctccacttcttaggtaggaaattgatgaaaacagagtttacccagaagaatgctggtatygcaaggaacaagtagagcatctctttcatgaacctgagcggtgaagtggagccaagttagaaatttctggacgtgggggaacaaccaggtctagagttcagtgactgatcagcctcaggagctttgcaggcggccctagggctcaggcttcctgtggaacacgtgcttggcaatgwataggacctgggggcctgacttagcttctttctgcacctgaggtcctctagcagcacctagtggtcccatttttccacgttatgtgccctggataagagggtgggttgtggagtagcttcctctccactgtacttgtctaagctgtggggatttgggaaaatcactgaagctctctgggcctcagttttgcctcggtaaaatgggggtgattgcacctagtttctggagctggtgcaggggttaaatgaaataatatgcataataatatgcacagcccttggtacggtactgggcccaaagtgagcatctcataggtggtggctattgygttaactcaatgttttctacgtttctactttaatctgcccaaaccagccaggattcccatcctgcagctaggagggctgtcaggcttcggtcaagtccagagccagggccctcttgtcctgcagccctgcacacacctctcagcaattcatttcctgtgtttagagcgagccccaggcatagccccgtccttctggcctcagccttccttttagatcagtggttctcaaagtatgtttccaaaccagcagcatcagcatcacttgggagctctttagaaacacacatctcagccaggcacggtggttcacgcctgtaattccagcactttgggaggccgaggcgggcagaccacttgaggtcaggagttcgagaccacctggccaatatggtgaaaccctgtctctactaaaaatacaaaaattatccaggcgtrgtggcatgcacctgtagtcccagctactcaggaggctgaggcaggagaattgcttggatccgggaggcagaggttgcagtgagccaagatcacacactgccctccakcctgggtgacagagcgagactctggctcaaacatacgtgcgtgtgtgtgtgtgtgtgtgtgtrtatgtgtgcgtgtgtatacccatgtacaccatgagaaagtctgagaatcactgctttccakattggacatgggctgtggtagcccrggcactgctagctggctttaggacttgaagaagacaaggtctgctgatctagccccatcatcccgcaccatcatgcttagtgctgtggaaatccacccagtacagtagcccagcctccyagctgccctytcccatcaccccrgaccctgtgatctccatgccaccctcacctgccctcccctctgctctccctcctgccaccccgcatcgcggagaagctctcctgaaattaattagtgtggcgtgtttacggtctctctcgcctccatcccgtcagaccccactcttggaacagagggcatggargacagctttgccacttgttagctgyatcatcttgagaaaggacttctcttctctgagcctcagtttccccttattgaaaacacygataatagttgcacttatttcctagcatactttgtgaggcttcagtgagacaatttatatcaatcatttcacacaggaatgaatcataaatcataggatcatagatggtgtcattatttgtattctgtcatgtctgaagacagctcattttaaagaagatttgctggtgatggctgttaggggaacatctcgttaccattaccttcttcctggagcctttttatgctttttcttttcactctattcccctcccttttttttgcatctgaagtctgctggcagcacccagcggttccatttgtccataggggcaatggtcaaagttagacattaccgatcccaggggtagaactggaaagtcatcccatgtgaattgggtgtgacagggatggaggtggaagaccagaggaacacccgcagtatccccagaatccctaactccctccaaaccagayctgctagaaaaatcacgggcaattcgccaagccagagacgagaggacattccacatcttttactacatgattgctggagccaaggagaagatgagaagtaagtgactagcaatgacatgtgattggatggcttgagccttccctttcatcagaatccggggttaagggattggctattaaaacagtctcagatcctgccagaaaggaccatgtctgtgagtgacatatgarcagttcttcatctcctcccaatgagtgagtgtggcttgtgttcagtcattctcatttactgagcacctactatgtgacatagtagccatcaactccaattagacattagatcattaatgattcatgtctcattagaccagagagcatcaagtccaactagacacaatctacgccttcaaggaaagggagaaagacatttgccttacttgccaatttataaaacttgcaaatataaaagatgcattctggttttataaggaatttgcaggggcagcrggactaagcatttttcattatacatgttttgccagtgactttgtagaacaggggtcaaractttttctgtaaaaggccagatagtaaatcttcaggctttgcaggccaggtggcttctggcacagctattcaactctgccattgtaatacaagagcagccacaggcaatatataaaccaatgagtgcaggcaacacataaaccagtgagctcaggcaacacataaaccatgagcacaggcagtacataaaccaatgagcacaggcagcacataaaccaatgaacataggcaacacataaatcagtgagtgcagatgcatcactgtgttacaataaaactttatttacaaaaacaggcagtgtgcagaagtttgctgacctctgttgtagggaaaagtttttttatgtaaatataatacactgtataccaaactccagtaggaagttatgagttctggacctgcagctgtttactaactcttaaaaatatatacaaatcgcatagcttaaaaaaggaatggatcagtgactatctgtacatagtagagtctacatgttagtaataagttttgagtctgaaattctatgggaacaatacagactttgcttcccatctcttttgtggcccaaggttagttattttggttaagacagttaccaaaaggatctgtgtgagctcagaacttcgctgtgtcggagtgtattgtagacctcagctactagggggtggcattatccattatttaaatttccagggtggggcaaagtggctcatgcctgtaatcccacactttcggaggcagaggyggrcggattacctgaggtcaggagtttgagaccagctyggccaagatagtgaaaccctgtctccccaaaaatacaaaaattagccaggtgtggtggctggcgcctgtcatcccagctacttgggaggctgaggcaggagaatcacttgaacctagaaggtggagtttgcagtgagctaagattgcaccactgcactccagcctaggcgatagagtgagactctgtctcaaacaataaaawtaagtttccttaatggctggctttcaggaacataggctatgaggtggagcaatttttggtaaaggggraatgctgaatggattttttatgtaccagcaaacatggtatattagcagttacagtgcaggaccctgtggaatgggccagggaaaaatgttgacattccttttccttttatttggcacccaagaaaacagtttggttgtttggtaccttgggttccagttttgtgctttgcctctggtcttccagaaatgggcaagtatagggctcagaactaaattcccaggggccgtttgtattctagatgatagaactggaaagatgttaggcttttagaaagaaccaaatattgctaaatgcatccaaactcgggataatgaagtcttggcaaakacctcaatcctcgtgacttgaatcaggcatttcaagttaatccaaaagtttgagttaactggtgccttcrgtcaatttaacctcgagtttatcaagcagcttccaagtgacttgacccataaaagaccttgattttgaaagaaaaatatcttgctgacgtctctccaaaagtataaccgaatccatcctaattaaagattgatctggaagaggatccttgatgtattggagggtataataaaagcaaatggtgcaggagaaagaaaggcaattataaagttgggggtgggggagaagctgaacaacaacaaaggaaatgtaatcataggatacagtttgacacagaatatctaattaatgtcataaaaagggagttggcaaactgtttttgctaaagggtcagtagtaaacgttttagactttaaggaccagatggcctctgttgcaactactcaactctgttgcctagtgagaaagcagccatgagaaataracaaggacatcagagcagctgtgtttcaataaaactttatttacaaaaacaacaggggaccagatttgccaacctgtgatataagccttatatattgattcaactaaaaatagctgggggtggctgggcacggtggctsacacctgtaatcccagcactttgggaggctgaggcgggtggatcacctgatgtcaggggttcaagactagactagccaacatgatgaaaccccgtctctactaaaaatacaacaaattacctgggcatggtggtgggtgcctgtaatcccagctactcgagaggcaggagaattgcttgaatccgggaggcagaggttgcagtgagcagccaatatcgcaccactgcactccaacctggacaaaggtgaaactccctctcaaaaaaaaaaaaaaaaaatagctggaggaaaggaaaggtagtrtaagaaagctgcatttttgcctaccatagcaggaagtcactagatactatctaaacttgacatatccagaaatcgcctattacagcgattgtgctttgcctctggtcttccaataggccaaaagcacctgttacttttggcactgaggactggtttcctggaagaaaakttttccacagactgggcgggcagggttggggggatggtgtggggatgattcacgtgtattacatttactgtgcactttattattacattgtaatatacaatgaaataattatactagtcaccataatgtagaatcattgggagcttgttttcctgcagtcccatcggggggtgatgggggacagtgacagattatcaggcattagagtgttataaggagggcacatgtgcagctcacgatagggtttgcgctcctatgagaatctaatgctgctgctgatcttatgggaagcggagctcagacagtgatgcaagcgatgggcagcagctgcaaatagcggataaagcttcacttgctyacctgctgctcacctcctgctgtgtggcccagttcctaacatggaccggtactggtctatggcctatgggttggggaacccttggcctatgatatgtaatacataatggtatatacattataataggctagtatatatagcaagcctattgtacagagagatagtggtaactgccagataaaaagcagctaaaagagataaaagcaggtattatggagtaaggtagagttggagaagggatgtgacaggagaatgctatttttcattataaacctttggtagtaattgatttttaaaactcatgtgcctgtttgaatttgataaaaattttataaatacatgaataaggccaggtgcggtggctcacgtctgtaatcccagaactttgagaggccaaggtgggtggatcacctgaggtcaggagttcaagtctagtgtggtcaacatggtgaaaccccatctctactaaaaatacaaaatttagccgggcgtggtggcgggcgcctgtaatcccagctactcaggaggttgaggcaggagaatcgcttgaacctgggaggcggaggttgcagtgagccgagatcgcgccactgcactcctgcctggacgacagagtgagactccgtctcaaaaaaaaaaaaaaaaaaaaaagagtaaaggttgatctaactcttctgacagctttgtctctgaaggctgaaggcagggtgcctctagacaattgaggtaaaggcatcccttcctccaggtaaatgtaacttcgtgccagggattgtggcttagcaagcagaaccaaggctggatatcagctgcagtcactggagcagtgcacaacctgcaccgctgtgtaaggctggcagtrgttggtgaggctgtctacgtgacgatgcgtgagggctttaaacggttcaagccttgataaagggaaaggaattatgatggcccagacccttgaccagatctcggtctcatgttgaaattagaagtatgtcttattgaccctgacctgtcttcctctccttctaggtgacttgcttttggagggcttcaacaactacaccttcctctccaatggctttgtgcccatcccagcagcccaggatgatgagatgttccaggaaacygtggaggccatggcaatcatgggtttcagcgaggaggagcagctatgtaagcctcacaccttgagtctggagggtagcttgcctggataccagtggaacctgttaagaactcttctctggtcaggacagatttctgctctctgaattccccaccttccattaaaaaaaaaaaaaaaaaaggaggaaaatgaattttattctaggtggtttgtttgtgttgtagaaaagtggctgtataactagggttgcaagtaacccgagctggcttaaaccaaagggaaaktgactaactcagaatgttgagaagttcagggaggttaggcacagtggttcaggtctgtaatctcagcgctttgcggggccaaggtgggcggatcactttaggtcaggagttcgagaccaacctggtcaatttggtgaaaccctgtctctactaaaaatacaaaaaaaaaattagccagggctggtggtgcacacttgtagtcctagctactcaggaggctgaggtgggaggattgcttgaacccggaaggcagaggttgcagtgagccaagattacaccactccactccagcttgggagatggagctagactccatctcaaaaaaaaaaaaagttcaggaattcaagcttcaggtacagtgagatctaggtgttcaaaagatttttctagaacctaatttcttgtcttctrtctctctcgactacattgtttctctataggatgcagtttgttgacagcaacatagctgggttccagcccttatattctttgggtttatgtccaaagaacagagtagattcccggcttaagttcctgaatggagtgtcattgactctgattggttggcttaggttgatatgcacattcctgagctatgcagcataggcagggttgtggaaagcgcagggtggtttcattatggtccctaagaatggattcttggagctgaaggtagagatgttggcctcatcaggaacatgtgggcagggtttaggggagggggagtgatcgaggcagtggatttactcaggcttttcctggaggggttgctctggtgatcarttgatattgatcaaaatcatccaaccaatggccaagaaacacactgggtcttgagaacaggacagctcagaaagaaattcttggtcgggacactgtgtttccagaaacgattttccttctgcgttagatgtgcctcagtgttgaaggttaatctctttcaggaacaccaggacagaactgtggaaagtttcccttccttcccacgcctacgcccgtttggagccccagaatagcactgaggttgctgaaatgctgcataaggggaggggcagctcctccgaagataacttggggtctggaaaattaggctgtatgggtcagttgacaaatggatggtgtatgtgggtcttggccagggtcccayatcagaatctagtgctgatagcctccttgtctgaatgacataggccctccaagaatgattcatttcatttgggacaggggtcagttttgcttctaatcttgcttttaaataacaatgaacaatggttaagtatttgctgtgtgccaggaatttaccaaatccttttttcttgatgtactacactgttcagtatagttttatttaaataataaaaaactggaacaggctgggcacagtggctcatgcctgtaatcccagcatttggagacactgaggcaagaggattgcttgagcccaggagttcgagaccagcctggataacacagtgagactctgtctctacaaaaaaaataaatagaaaaaaactggaacaaactaaaataggttgattaatagagggtttattaaatcattgtctgtccttgtgaaagaaaacaatgagaccatttaaattgttttgctgggcatggtggctcacgcctgtaattccagcactttgagaagccaaggcaggcagatcacttgagcttgagtttgagactaacctgggcaacatggcaagatcccttctctacaaataatacaaaaaattaactgggtgtggtggtgcacactgtagtcccagctacttgggagactgaggcaggaagattgcttgagcccaggaggtcgaagctgcagtgagccgagatcacaccactctgtcacctaggctggagtacggtggcgcagtctcagctcactgcaatctctgccttgcaggctcaagcagtcctcccagctcagcctctcaagtcgttgagactacagacatgtgctaccacgcctggctaatttttgattttagggtttttgttttgttttgtttgagatggaggcttgctattgtcacccaggctggagtgcagtggcacgacctcggctcactgcaacctctgcctcctgggttcaagcaattctcttggctsagcctccygggtagctgggattataggcgcccaccaccatgccccactaattttttttgtatttttagtagatactgggtctcgccatgttggccaggctggtcttaaactcctgacctcagatgatccacccatcttggcctcccaaagtgctgggattgcaggcatgagccacygtrcctggcctggggttttttgttttgttttggtttgatttttggaggggtgggtagagacaaggcttcaccatgttatccagtattctctggtcttgaactcctgggctcaaacaatcagcccaccttggcctcccaaagtgctgggattacaggcatgagccaccatgcccagtccccagtgttctcaatgtactttggcacttgtttcccctttaaccacagagaccagactccaggcccagcaccttcggcagccccaagcatctagctagaatttggtaatactgttttccttgtatttatatttataattgccatctatttatggcaagtgaagatgatttktcactgaagatagagaaagttttctattaaaacaaatgtaaggaaagagaaggaagtaaatttaaagaaaatgattaagcaaataatggagcagatggtacacagagcaagcattcagacgatggcgtgcaaatgacgaactctcataggaaccaacttagtcctaaatgtacaccaaccccatttataaaccaagagctacttccaaaccctccatcaaggggcctatggagaagggggtgggtcaggcttcaggctggagcttcatgaggctccaagtgaccaggggacaccaggattttccccaccacattgggttctgcagccttgaactcctggcctcaagatatcctcatgcgccaccatgcctggcctggttatactgcttctaatgtattttgaagataaaaaataaaatcacctaaattgtccatcctgtgtatccctggtggtacacatgtctgatgttggaaagtcctgtttcttattcctcagcaagaagagaggtgtaaggccactgtaaaaaattagcacaaacttgatgccttaaaacaacaggaatttattctctcccagttctggaggccagggttctgaaatcagggtgtcggcaggagccgggcataatggctcatgcctgtaatcccagcactttgggaggccaaggcaagaggatcgtttgaggccaggagttcaagaccagcctgagcaacatagcaagaccccttctctactaaaaatttaaaaaaaaaaaatttttttttttttaaaagacaagatgttggcaggggttgttcctcctggaggcactgagggagatctgttccttgcctctgtcctggcttctggtggctctggctgttcctggcttttccttggcttgtctcactccagtctctgcctcatccttcatgtggcattctactctgtgggtcttctcttctgtccatcataaagacacttgacattaaatgtagggcccaccaggttaatccaagatgatctcatcttgagatcttgtacttgattccatctgcgaagaccgattttttccaaaataggccacgttcaggctgggcgcggtggttcacgcctgtagtcccagctctcagggaggcagaggcgggaggatagcttgagcccaggagttcgagacctgcctgggcaatatagtgagaccccggtatccacaaaaaggaaaaaaaaataaatgtaaccccccaaattaggccacattcacaggttccaggtggacatattttagaaagaccaacattcaacctaatataggtggcttccactctttaycacctactaggccaggcccttgctcagcatcttacaagacctaaacttcacgaagcaggtactactgttaccatctccgttttgcagatagggaaactgaggctcatgggacttattgagactcatgtagagtctctatcctctattcatccatgattcatccatcaatccatcctctatcatccatctatcctctactcatccttccatcacccatccatccatcacccatccgtccatccatctacccacccatccatccatgaacccatcctctatacatttatacattcatccatccattcaccctccatctgccatccatccatctccctccctccccatgtgtatctggacccggaactaggatttggaaattcagagataatgagatttataagaagcaaagctgggatttgaactcaggactctctaactgcagagcgcgtgctttgcaccagcacaccaggatgctgccagccgtcaccacccttgctgtgttgtgtctcctcactggtttacttctttgctgtctgctaattctgccccaaggttcayctcttatggcctgggagtggtggcattcttttgtcatttctggaattacatttaactataccagaaagtgcaaaccaatggttcctgagcccacaggagagatcggccactacaaccttcaaaatttttagaaattggttcctaaagtttaaatatgggtaggccgggcactgtggcctataatcccaaccctatgggaggccaaggcacatggatcacttgaagtcaggagtttgagaccagcctggccaacatggtgaaactccgtctctactaaaaatagaaaaattagccgggtgtggtggcacacgcctgtaatcccagctactctggaggctgaggcaggagaattcccctgaacctgggaagcgcagaggttgcagtgagccgagattgcaccaatgcactccaacctgggtgacagcaagactcagtcwcwcacacacacacacacacacacacacacacacacacacacacacaccaaaaaacatgggtacacttcacataaaaactctgggtttccattatctagaaaaatcagaagttccagcaacacttggcttatatcccctgtggcaatgacggagtagctgctggccccttcagatgggtttgtggcctccttgggtccccacagtcctcattagttggctttgttcatttagaccagtggttctctgccagaggtgagtttgcctcccaggggacattgagtagtatctggtgacatttgtggttgtcacaactctgtcagggtaaccaccactgacatctagtggttagaggccagggatgctactaaacttcccatgatacccaggacagctccccacaatagagaattatctggcccccaatttctgcagtgacaagattgagaaaccctgagttggccggctcgcctgggctgtgcaggcatttcaggaatctttagtttaaattgacacttttaaaactgtgagtgcaactcttcatagtttacaaagactctttcatagatgttatggttaaaaggaagtgtgtttccaagccctgtcaacagcagcttcattcattttggggagaaggctttctaccatagtaagtgggagcaaatggatgggtggtcagcagctgggtccttttgctgagctgggccagggaccccatggcgtgagaatagctsttgtgaagggccttgtaatgtctggtttggcctgaggaaccagagaagtctgggatctctaggctttgttcctggaacatagtgactgatttgaagccagaactctgggtgatttgtacctgagttaagctaagccaagaatttgcattaatcatcatccatccattcatccatctaccatccatccatcatctgtccatccatccattcatccatccatcatccatccatcaatgctstatccattcctccatcaattctccatccatctatccatcgtctatccatcaatcctctgtccattccatctatccatctatcctctatccatccatccatcatccgtctatcctctatccatgaattattcatccatcaatccatcctctattcatccatctatcctctactcatccgtccatcattcayccattcatctacccacccatccatccatccgtccattcatccatgaacccatcctctatccatttattcattcatccatccatccaccttccacctaccatccatccatctctctccctccctcccatgtgtatcaggaccttggaataggctttggaaattcaaagatgattagggcaggccctccactctccagaaactcatggtcttatggggatttcagacatagaaactattttaacagtaacatggcctgagtatggagtcagaaaggttccaagtattctgggaacacagcgtttttgtttggagacacctggacaacaagtggaaacaaatgtatatcttcttcatcccaacatgggcatctgttacacccagaagagtatgtaagaagcacagggtttttatttcaaaaatccttttattgacatatgatttacatggagaaaattgtgtatgccatagcgtgcagtgcaaagaattattataaactgaacacgtctgtgtaactagaatccattttaaataagacaatgccaccagccccatggaagctcccacatgcaccttctaagaacttccctcaattaaggataatcattatcctgacttctaacagcatcgattagttttgcctcttcttgaatggacggtctatatatggacttagacagtatgttcttgtttccatctgtcctcttttgttcggtatttgtgtctggaagatatgtcagggttttttttttgttttagagacaggatctccctacattgcccaggctgtatcaagctcctggcttcaagcagttctcccacctcagcctcccaaagtgctggggtcgcaggcatgagtcactatgctggccccaatacatcagttttgatttgtggtagttgtagctcattcattctcactgttctgtggcaggggttgctaacacatttttctgtaaagggtcagatagtaaattctttagcctttgtaggccagacgatctttgttgcaactcattaactctgccagtgtagcatgcaaatagttacagacaatatgtaaatgaatgagtatagctgttttccactaaaactttatgtataatagcaagcagtgggccagatttggtccatgggctgtaatttgccagtccctgctgcgtggcattccattgtaatgcaaggttttaagcaaccatatgaaaatattgagctcagaatctagtttcttcagaggaaagatgtaagctggctctgggtccccagtggctttaggctccaaaactccagggtaccttggcattgacctytgtgtctgctctgcccttctctccccacctcagccatattgaaggtggtatcatcggtcctgcagcttggaaatatcgtcttcaagaaggaaagaaacacagaccaggcgtccatgccagataacacaggtacttgccactttttcctgatgaccaatgactttggggttgggggggtgggggaggtgacatttaaccactggttatttttcaaggtgaaggtatctgggattttaacaacagttggactaggttcttatcactcactttttcaaacttttcagtgctcaagaccctatgtggaaagttattgaatcagagcgcagggattaaaaaaaaacaaacctaatagttttatttatttgttcttttttttaaatacaaaattttacaagttttaatagagacgaggtctcgctgtgttgcccaagctgatcttgaactcctgagctcaagtgatcctcccaccttggcctcccaaaatgctgggattacaggcaagagtcatcacgtcctacccctaatagtgaccagacaagatcccgagggaccatctcttctaaaataccccacttaattgttttgttaaagaaatatttctcaagcccctgcaatatgccactgggatacagcaggaaatgacacaagaatagctcttcttacggtatctgtggtcgtcttggggagacagacctcaattgccctgagaattaggggtgccagataaaatacaggatgtccagataaatttcaattttaggtaaacaacaaacctttttttaaattttaattatgtcccttgtaacatttggaccgtgattataccaaaagagtattcttgtttatctgaaattcaggtttaactgagcatcctgtaattttccccctaaatctgataaacctacccacaaataaacagtattttgtgttttgagaagctggcctggctaccactatgcttgttggtggctgagctgagagcaaaacttaggtttcttatttcccagcccaggctgtatattgtgttgctttttcccgctccctagagcccaccttgatcaaacctgttgcaaccgcttactgggtttaccttgcccacagcctagacagagccaattaatcaagacaggggaattgcgatagagtaagagtaactcacgcagagccggctgcatgggagaacagagttttattattactcaaatcaatctccttgagcattcgtggatcagagtttttaagcataatgtggttagggggaggccagtgagttgggggtgctgattggttgggtcagagatgaaattacagggagtcgaagctgtcctcttgccctgagtcagttcctggacagaggccataagatcagatgagccagtttctcgatctgggtggtgtcagctgatccacctggtgccagggtccgcaaaaatatctcaagtactggtcttaggttttacaatagtgatgttatccccaggagcaatttagggagggtcagactcttgtagcctccagttacaggactcctaaaccataatttcaaacctttgggctaatttgttattcctacaaaggcagtctagtctccaggcaagaagggggtttgttttgggaaagggttcttgtgttttaaactataaactaagaggctaggcgtggtggctcatgcctgtaatcctaggattttgggaggcccaggcaggtggatcacttgaagtcaggagttcaagaccagcctcgccaacatggtgaaaccccatctctactaaaaatacaaaaattagccaggcgtagtggcaggcgcctgtaatcccagctactcaggaggctgaggcaggagaactgcttgaacgcaggaggcggagattgcagtgcgccgagattgtgccactgcactccagcctgggtaacagagtgagactctgtgtcmaaaacataaaaaataaactataaactaagttcctgccaagttaattyggcttacacccacaaatggttcagtggagcttggaggttagaagcaaggtggagtcsgttaggtcagatcttgttcagtgtctcagttataattttgcagtggcagtttcattctcaggtgtttgttatgtattagagtccctaaatctggcaaattaatggaatccggatgccaaggaaagacctcagggaaagagaaatgaaaaagtgctcttgccaagagatggggaaaaaaaaatcctaaaatcactctatttactctgccttgcacatgcaaagcagcatgtaatgctattttcatgttaagggaccagctcrtggtcacaccactgcacttcagcccgggcgacaggaagactgcatctcaaaataaaagaagagcatttaggttgactctagcattttgctattgcaaacaatgctgcaacacatatcctagaagggtgaaagaaatatttattgaacagtaactgttcaataaatgttactattaataactatttaatacttactaagtaactgttaaataaatctcaagggccagtggctcacgcctgtaatcccagcacttagggaggccgaggtgggcggattgcctgagttcaggacttcgagaccagcctgggcaacacggtgtaactccatctcaactaaaatacaaaagaaattagctgggtgtggtggcaggcacctataatgccagctactcgggaggctgaggcaggagaattgcttgaacccggaaggcggaggttgcagtgagctgagatcgcgccactgcactccagcctgggcgacagagcgagactctgtctccaaaaataaataaataaataaacaaayaaataaataaataaatctatctatctcagggactttacatactttaccttatttagtcctgggtaccaacaaggtaccgaagagctgaccctttttaaagctgagaaaagcaagatgctgggagggtaaagagcttttccaaagtcacatgacttggaagtgtgaagggacagggacttgaaactagaactacctgaccctaaacccccaactggggcctgcttcagcccaccccaatcattgcctctcagcaaaatactggggagtgtgaccactaatgacagcagcctttaggacacttcaagctatattcatggtcagcgggtcccatttccccaagagaacccgctgtattcacagatcacaaatatcccatgcgatgtgtcttcttgccaagctatttcttttgtgatgcactcacgatgtttcttttctccatccagctgctcagaaagtttgccacctcatgggaattaatgtgacagatttcaccagatccatcctcactcctcgtatcaaggttgggcgagatgtggtacagaaagctcagacaaaagaacaggtaatgatgtacttatcacttatccatccatgcacccacccatccatccattcatccatctatccacctgttcactcattcatgtattcattaatccattcacccatggtctgcctctgcatctgtccatccatccatctttctacccactcattcatctgtctgttcatccatccatccatccatccattcatctgcccatctatctgctcacccatcatctctccatccctcactcatccatctgtccatccatccatgacccagccatctgtccatctgtccgtccatccatcacccatccagctgtcattccattcattcattcattcattcatctgtccatgcatccacccatccatctctttatccctcatttattcaatactagaatattcasagtcccatgtcaggttttgtttgtttgtttgttttttgtttttgagccagagccttgctctgttgcccaggggggggtgcagtggtgccatcgcagctcactgtagcctctgcctcccagattcaaacgattctcctgcctcagtcccccaagcagctgggactacaggcatgcaccacaacgcctggctaatttttgtatttttagtagagaagggtttttgccttgttggtcaggctggtcttgaactcccgacctcaagtgacccacctgcctcggcctcccaaagtgctgggattacagtgtgagtcactgcacccggccaagaataaaaatcttcaccaccagcctggcttatgtgaaaatggagcccattgagaataaccgggttcccctggttsccctctgcaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtacagctcggtgggatcctaagagccatggtcttggttgtctgagatgggctttttcttggaggagtcatgattttggagaaaggcatgtagatggctactgtagggtaggaggctgtctagttaagggtggatcattgagggtataagagacagaaatccaacaggaaatgcattggtttctggaactgagaaggccagacatgtagctggatcccgtaggcagggtctgatctcccgccatcgttctctctctctctctgccttcctccatattggctccattctcaagcaggctctcccctcacgggggcaagatggctgccacagctccagactgcctctcagtaatcctggtaaaaaaaaaaaaaaaaaaaaagcacatatctcttttctaacagttccaaccaaaatcttggaattaagtctcactgactcttactcacctgaattgggctacatggtcacctccaagccaagaactgtttgcaggagcttgcaatacctcatgtagtagaaacatggatattggatcctttacccatgggtttgaagaaagttctcagagaaagggaaggttttttttttgtcttgtcttgtttttttttttttgagacagagtcttgctctgtcgcccagactggaatgcagtgtcacaattttgtctcactgctgcctccgcctcctgggttcaagcaattctcttgtctcagcctcctgagtagctgggactacaggagtgtaccactgtgcccagctaattttttttttttttttagacagagtctcgctctgttgcccaggccggagtgcagtagtgcaatcttggctcaccgcaacctccgcctcccaggttcaagtgattctcctgcctcagcctctcgagtagctgggattagtgccaccatgcctggctacttttttttttttttttggtagagacagagtttcaccctgttggccaggctagtctcaaactcctgatctcaaatgatccaccagcctcggcctcccaaagtgctgggattacaggtatgagccactgtgcttggccaatttttgtatttttagtggagagaggtttcgctatgcttgccaggctggtcgcaaactcctgacctcaagtgatcctcccgccttggcctccctaagtgctgggattacaatcatgagcactacacccagccaggaggttttaagattgatagatgtcccgaaagaagtgtactaccgagtcactttctctctgcgcctctgttttcacatctgtaaaatgtttccacatctgtacatgcagtagcgtgccttacgaggtttgtccatccatagatggttgtgcagatggaggagataagcatctttaaggtgtgtgagggccatgtgatatcaacttcaccagccctggtggactctaggcagcatgttttggggcctcagccctgtctgggtgctgggatggcagaacaggatgtgggcgggccatgggggcgctgtcgggtggagcttctgtggggctccttgtcttctgacttcataccaagatgctcacgccccgcccccacgccatgtgctcaggtgaactccttcgagcarctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccggtgaggggcacgtgggcgtgcggggctcygtcacaccttgtacacgtgtgtggcctctgtggagccgacgtggaccccacactctccccatgcacatagcattcccccacccaatccatcacccagtcctgaaaggctgtaagctgaatccttgtgaactcttacaatttccattaacccacattttcatatcaaaggtattttctttaatttctgccttccttccatcctcttttttcttcctttttttcttccctaccctctttcccttccctttccttctctgccattgctttttttttttttttttttttttttatgacatggkctgactctgttgcccaggctggagtgcagtggcacaatcttgcctcactgcaacctccacctccctgcctcaagtgatcctcccgcctcagcctcccaagtggctgagactacaggcgtgcaccaccacgcccacctaacttttgtattttcagtagagacagggtttctactaattagccgggcctggtggtgcacgcctgtggtcccagctatttgggaggctgaggtgggaggattgcttgagccctggaggcagaggttgctgtaagccgagattgcgccactgcattccagcctggataacagagtgagaccctgtctccaaaaaaaacttttctaacaggaaccctaggtgaattcaagtcaagcaacaaattcatttgcaagaattatgaactcggccgggcgcggtggctcatgcctgtaatcccagcactttggraggccgaggcgggcggatcacgaggtcaggagatggagacyatcctggctaacacggtgaaaccccgcctctactaaaaatagaaaaaatcagccgggcgccgtggcaggcgcctgtagtcccagctactcgggaggctgaggcaggagratggcgtgaacccaggaagcggagcttgcagtgagtcgagatcgcgccactgcaccgtctgcctgggcgacaaggcaaaactctgtctcaaaaaaaaaaaaaaaaaaaaaagagttatgaactcttcatgatgttgcctgcgtgttgcccactagggggcggcagcaaacattatgttctgccttccatccctgttactggtccattgggcacagggtaatttgaaggtagatttggaagcatgggggtcataaactcatctttatatgtgggcaaatacagtatcagatctyggcggatgcccatgcgttgtgtatagttggccagctcttcatggaatgcctgaggttgggtgttctctctgattcaagccctacttgtctcccacagaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgcygggaaggtaccagccacagggcccaggggactctgtctcaggggacccccagtggctgctcagcgcagagacagtctgagagtggcagaaccttgggctgcctggaaactgcaaagccatctgctgctaagcgaatcccaaccaagtcctattcgtaatttgtctacgcatctgtaaggcatcagctgtagccactctcatgttttccaaccgtgacgtccagacagttatttctttctgtttttgttggagacagggtctcgctttgtcgcccaggctggagtgcagtggtgcgatcatagctcactacagcctcaacctcctgggctcacacgatcctcctgcctcagcttcccaagtagctgggactacaggtgtacaccaccatgcccagctaaaatcttttttcctttttgagatggaattttgctcttgtcatccaggctggagtgcaatggcgtgatctctgctaactgcaacctctccctccgggttcaagagattctcctgcctcagcctcccaaatagctgggattacaggyacctgccaccacacccagctaatttttgtatttttagtagagaagggtttcgccatgttggccaggctggtctcaaactcctgacctcaggtgatccacccgcctcggcctcccaaggtgctaggattacaggcatgagccaccgtgcctggccgcccagctaaatttttaaattatgtatagatatggggtcttgctgtgttgcccaggctggtcttgaattcctgggctcaagmgatctccctgcctcggcttcctgaagtgctgggattatgagcacgagccactgtacctggcctcagcctgcttttcttgtatagactctaaatccttcctgctacaagttatacccaacaggcggggccaactggaatggggtgactaatacatccacacctggcttcaacaaaaatctcccatgtcacggtcttgagtttgctattgccagcctgctctggccagggaaatctatgatagttgtattcatcatcatcatcatcatcatcaacatgccttggctgttattgtataggcccttgccctgtggctctcaagagtcctggataatgtacaaaggacatagcttagtctggcttgcagaaytgtagtattctattgactcctcagtacctccactgcatcatgggcacaaacaatgctctctaccagggcctggcaacagagtccgatctggcccacagcttgttattgtaaataaagttttattggaacacagccatgcccatttgtatgcataatgtctatggctggctgcttttgtatactacagtgctagagttgagtagctgcgacaaagactgtatgacttggctgggtgtggtggctcacgcctgtaaccccagcaccaaggcaggtggattacttgaggtcagcagtttgagaccagcctggcyaacatggcgaaagcccgtctctgctaaaaataaaaaataaaaaaaatttaaaaattagccagctgtgagattacaggcacacaactgtaacctcagctactcaggaggctgaggcaagagaactgcttgacccaggaagttggaggttgcagtgagctgagactgcaccactgcactccagactgggcaacagagaaccactctgtctcaaaaaccaaaacaaacaaacaaacaaaacattgtatgacttgccaagccaaaaatatctactatctgggccttcaccaaaagtttcccaactcctagcctatattcaagggggtatatgttcctttaagcatatagagacaacacttttcttttccctacttcatcagtggattttttttattattattttcagtcttctctcagatcaagcctacctattatcctgataacccacatcccatgataacccagcaaagctgtattatcagttcctttcatttaatattcaccatagtaaaaattacggctttgggcattgtcattgtttgagtcaggaatgtaaaaagcctatatgtcctttttctgtatatccatatatcaggatctctgagttacaaattatgctcattagagagtggaaaataggatgccatgcttaattaatttatttatttaattattttgagacagagtctcactctgtcacccaggctggagttcagtggcgcaatctcagctcactgcaatctccgcctcccaggctgaagcgattctcctgcctcagcctcccgagtagctggcattacaggtgtgcaccaccatgcctggctaattttttttttttttttgtatttttagtagacatggggtttcaccatgttggtcaggttggtcttgaacgcctgacctcaaatgatccacccaccttggccttccacagtgctgggattaccagtgtgaaccaccacgcttggcygccatgcttaatttctaaaccaggatgattgggaagatgatgaggggggagttttgcatgtcggcaggagggcatctgccgtcatgaaatctcttaatagtgtataactcacaggtactgtgctggcttaggaggagggaggctaccacagcagcgttagtaggagaatatggaatggaaactaggctttcccagcaatggctatcactggctgatgtcctactacgtgggcacaggtccctgggctgttggtctcttcactggtgtttgtggagtcccatcatggtggtcataaacgtcatttcctctctgacctcagaagatctggaaggacaatgggagggctggggtcctggccttggtttctaagtttctagtttcccaggggttctgaccagcagggtgtccttggcaggtggactataatgcgagtgcctggctgaccaagaatatggacccgctgaatgacaacgtgacttccctgctcaatgcctcctccgacaagtttgtggccgacctgtggaaggacggtaaggccttctctgctcgggtccatgttctgctttgagctggagaattgaacacccaagtcccccgactctcacacctgccccaggaggggaggcctttacatgggggcaggggaaggaagagcattggcatgggctggtgatgtctcgttgaaacaatttcttcctgagtgggggtccctgagcccctcaatcctacatgtcccgaggggattgaggtcctgaggtcagggctcaggcaatagaggagaaacagcatgccaggcacggggagttagactgccctgtccagagtcagaaggacttcactgtatcttgtctctgccacctcctagctctgtggtcttggatgagtcacttgatgtcattaagcttcattgtcctcattagtaaaacaggagatgcaataatagttgccgtctctactagaggtattatgagggttaaattagrccagtgatgctcaaactcaagcaggcatcatgaccccctggaaggctttgtttatttatttagggacagagtcttgctttgtcacccaggctggagggcrgtggtgcaatcttggctcactgcagcctccaccttctgggttccagtgattttcctgcctcagcctcccaagtagctagcattacaggcacacaccaccatacctggctaatttttgtatttttagtagagacggggttcccccatgttggccaggctggtctcaaactcctgacctcaggtgatccgcccacctcagcctcaaaaagtgctgggattacaggtgtgagccactgcacctggccctctttggagggctttttaaaacccagatggctgggcctaccctaagatctaattctgcaggtctggggccagggatggggcgggcctgaaaacattcatcccaggtgatgctgctggtctagggaccacactccggctccctttgagaaccagtgaatagatgatccctgtgaagagctgctggagtgatgatgaggggagggggtttgctgtttgtccctggccatcagtgtccacagcaggttttattcttggcacagggcccatgggcctggggcttacaggactggtctccccttgttttaagcatgctaaaaaaagggctccaggaggggccagctgtgccctaaccatatgccaggctctgggcctagggaacaacatcgcaccctgggtctgtgtcatcccaggacacatgatgaagcctgtagtccctcctctgcgggacccacagtcttgtgggagagatgagactctcaaagacaagcagagagacaagcatgaggctgcgcatggtggctcacacctgtaatctcagcactttgggaggctgaggcaggaggatcagttgaggtcaagagttcgagaccagtctggccaacgtggcgaaaccccatctctactaaaaatacaaaaactaactgggcgtggtggtggtaatcccagctactcgggaggctgaggcaggagaactgcttgaacctgggagrcgcaggttgcagtgagctgagattgtgccattggactccagcctgggcaaaagagcaagactctgtcttgaaaaaataaaactaaaaataaaaaataaaaacaaaattagccgggtgtgctggtgggtgcctgtaatcccagctactcaggaggctaaggcaggagaatcacctgaacctgggtggtgaaggttgcagtgagccaagatcgtgccactgctctccagctgggcgacagagtgagagcttgtctcaaaaaaaaaaaaaaaaaaaaaagattgttacacagaatctgagtagaaggtgaagaaatggtgccatccatggcctgtgggttgggcttggcatgtgcaggacctgctgggctggtagaaaaagaaccttggaggtgatgatgatgatgatgatgatgatgatgatgdtggccgggcgcggtagctcacgcctgtaatcccagcacattgggaggccaaggcaggggaatcacctgaggtcaggagttcgagaccagcctgaycaacatggagaaactctgtctctactaaaaatataaaaaaaatgagccgggcgtggtggcgcatgcctgtaatcccagctactgggaggctgaggcgggagaattgctggaacccgggaggcggasgttgtggtgagccgagatcacgccattgcactccagcctggccaacaagagtgaaactccgtctcaataaaataaaataatgatrataataataataataataataataataataataataatacctactttttgttgagcacttactgatgtgccaggctatctcggagtgtgtgctgtatcttctgcctcagaatatttcttccgtggatacctacatggttacccactcatttcttgctggtttctgctcaaatatcaacttagcagagcccaccacctccttgtctaagagagcaccctcttcactctctctccgctttaccctatttttatttttctacgcacacctcactactcaagatattccatacttaacatctgtgatctctgtctgtctccttccctgtgatataagcggggtgagggggccgggtctttttttgttcacagcagtgtccccagggcctggagcacagaaggtcctcaataactatttgttggtggatgaaagattggaggctggcagggaataagtgccttctgtgccttatttttttttacccctgccctagaaggtagacggtattattacctcccttttgtagaaagggagactgaggcacaggatagtgccaagccaaggctagtcagtgagtggacagcgagagcaggcttgactcctaggtcagcgtgactccatcacagggaatttgttctttctgccactcaggtgctctcaggatttccccaatagacaatacttggaaaccctgactgccgaaggaggcgttggtgatggaaggaaagattggagtgggcaggttggtgggtggggctggggctgagcctctggcctatttaggggtgggtgggccagaggctgatgccaccctggctgtgccccatagtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagagggtgaggcccgccgcccagaccctggggctyccagaarccagggctgtcccaagcggtcacagcgtccccagggcgccctctgcccccacctacccygaggaccccattttccatgtggggaaggctatctgaatctcagacccattccccatccctggaggaaaaggaggaagggaggatgcatccagagacttttcagttgtggagttgctgtgcaggtcatccagccactcattcattcattatcccaggaagtattcactgggctctgccctgtcctgggtgctggggagcagtgttagaaaaattgtagcccttccctgtgggtttctcataatctggtgcaggcatcttcagcttggggcgattgtgtcctctatatggacatgctacagacatttttggttgtcacaaccaggagggggctgttagtcagcatctagtgggtaggggccagggatgccctaagcattgtacaatgcacaggatggtccctcaacccccagcacagaatccctacaagatgccagtagtgctgaggttatgggagacayggggagaggtaaacatacagctgatgatggtgatggaatgtggtcagttaggagaacaccaaagagccagggctcctcccacagcctcaggactcagagaaagcttctggtgaacttgaacgttaagaatgtgtggccatcaacttggtgacatggaaggcagggtggggcctaggataagcagggggcctaggataagcagagggcccaggctaagcaagagtgtggaggtgagaagtgaaggaactaggtaagaaaatgctagatagtgtccaggcgtgttgctcacgcctgtaatcccagctactcaggaggctgagaaacaaaaatctgttgaacccaggaggcggaggttgcagtgagctgagattgcaccacagcattccagcctgggcagcagagcgagactccatcttaaaaaaaaaaaaaaaaaaggaaagaaaatgctaaataggtcatttcatgttgcaaatgtgtgatggcatgaggtaggaatcagatggtgtgaggtaggattgaggctgaatgggtaggcaggggctagatcgtggtgctccttgtgttctttctggagcttggccttctctctctaggcatgccattgggggtgttaaagcagggctatatcatggtcagatttacattttaggaagtgaatgagggggctgggcatatgctagctcatgcctataatcccaacactttgggaggttgaggtgggaggatcacttgagaccaggtgttcaaggctagcctgggcaacatagcaagaccctatatctacaaaaacatttttaaaaattttccaggcatggtagcacatacctgtggtcccaaatacttgggaggctgatttgggaggatcacttgagcccaggagtttgaggctgcagtgagccatgatcgcaccactggactccagcctggctgacagaatgggaccctatctcaaaaaataaaaaggacaaagggattgaggggagaggcaagaccagagagagagaccaggtgggtggtttctgtggttgtccaggcaggagaagatagtggagacaatggtggtgaagagaagtgggggggttgggagatatttgggagctagaagcaatcaaactgctgayggacaggaagtgagggagacgaggtgatgaggaggaagccccaggttccagccaggcgatgctagtgtcaccaagaaccagagagwtcatgaggcagccattgccgaagcaaagagatgaaaacccagaggggggcactgctttgcccctcggccctcagctaagccctccttgggtgcttctgttggtaccctcatggcctggccaggtgggtcatccaggtaggaggtttggggctttgctgcgccatggtttctggccccagggatccactgccctctttgacctttgcagtcyggcaagctggatgcgttyctggtgctggagcagctgcggtgcaatggggtgctggaaggcattcgcatctgccggcagggcttccccaaccggatcgtcttccaggagttccgccaacggtaagtcccaaggtctggcccwggtagggcagggggtgagcrggactgggtggaggaatggatgytggaggtayccggggtgacttctgctctgtgtttcaagctacgagatcctggcggcgaatgccatycccaaaggcttcatggacgggaagcaggcctgcattctcatggtgagcccagaagtccaccagagacctcccaacctctggccgcaagccacctgctgctcttggtgggaccgttcttacccatgtcatcactggccaaatggcacagtggaaatcaggagctcttcctttccttccttttgcagatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaagtaaagatgctttcctgcatcctaatacctcaaacgcgaatcacaaacaggggcctttctgttctgattccctgattctaagaggccacctgtttaagatgcatcattgactgaatgacagccttttcttgaaggggaagaaatgcttctactttaaataaatgtaccaagttacgagtgcaggaagggaacgagttttagacctgggttctcatygtggatgccccagtttttgctgatgaaccttgggcaagttactctacctctctgagcttccagttttttagctggaaactgagcataatcattttgacctcagagagctgttcatgaggtgtcactaagataacgcatgacgagagcttagaacagtgcgtggttctcaggtcagaaatgattgttgttgtttttacctccctccctcactccttccttccctccctcccttccttccttcctttcttcttcctttttgagacagagtctctctctctctctctgtcgcccaggctggagtgcagtggcgcagtctcaactcactgcaacctctgcctcttggactcaagcaattctygtgtctgagcctcccgagtggctggaattagaggcgcccaccaccacactggcctaatttttgtatttttagtagagacaaagtttcaccatgttggccaggctggtctcaaattcctggtctcaagtgatccacctgccttggcctcccaaagtgctgggattataggcatgacccactgcgcccagcctagacatgttagaattggataaaccattgaggaaagaggacttgacggtgtctagatccccgtgtcccagtgggatttataaggcagggttttggagggtgtgatgtcccagctgttctgtgaagactgggagccggggaagggttcgggttccttaatgaaagtcataccccagggactgcagggacaggtggggtcgctctctgtctggggtgtgtgttgtcattgggcagagaccacaccctcaccagtaggaccctgatgtgtcaggttcattcattgacacatggacccaagatggtcaaggccagctttgggagctcttggccctcccgcaacagacctaacttgtcaagtttcgttactaagttccctgttgctgtccttcctggataactggggcaattttattcttaaagttttcctgtgtccaagatggcagccaagcagggaagacagaattacgttcactgttctatcgtttctcaatctatcgatagcccttaaacgggaagagtgctggttcagggtcacagtgtgaaattcctaaaacaacccaggagagaataggtttgacagggctgggtgtggtagctgacacctgtaatcccaggcactttgggaggccgaggcaggaggattgcttgagcccaggagtttgagaccagcctgggcaacatggcgagacccctatctctaccaaaaaaaaaaaaactttaaaaattagctgggcatggtagcatgtgcccgtagtcccaactacttgggaggctgaggcaggaggatcatttaagcccaggaatttgaggctgcagtgagccatcatcacaccactgcactccagcctgggccgcagagccagaccctgtctctgaaaataaayaaataaataaataagttagtcagaaacagctggtgtaggctgggcatggtggctcctacctgtaatcccagcactttgggaggccaaggtgggtrgatcacctgaggtcaggagtttgagacccacctggccaacatgggaaaccccatctctactaaaaatacaaaaattagccaggcatggttgtgggcacctgtaatccaagctactcaggaggctgaagcaggagaatcacttgaaccccggaggtggagtttgcagtgagctgagatcgtgccaccgcactccagcctgggcaacaagagcgaaactctatctcaaaaaaaaaaaaaaaaaaaaaagaaagaaagaaaaaagaaacagytagtgcagctggggagtacgggagcccccttaggaatgatgcacatagttgtgttttctgagtggtgtttggatctcagctaagtccagggcatgttgtgagccctgggtcttccttgtccactgaaaaaggctctgtcctgtagatgatttaagttgtttgcagccagacaacacatgtgtcacacagggtttctggaagaacctgagttggggagattggggcaygtccctgtgcaggttcaggatgctgcagggcagggctctgttgacagcagggtgtggcttcatgacccccgcaccttctcttccccmctccctagggcttttgccaagaggcagcagcagctgaccgccatgaaggtgattcagaggaactgcgcygcctacctcaagctgcggaactggcagtggtggaggcttttcaccaaagtgagtgmtctgccccagcccccttcccaggggcccccagccctgsttcttcactctggagccttcacatttgggacaggaggtggtcgcaagtgggtgtggaatggagggctcgaactcagaccttgagcattggcggttctctggcccgaggaggccctgtcctttggcacataggctatagccaggaccttaacacaaagtattaatatttccatccgcactggaatccctcgtgtggcccatttatagccacacccacttcctccgtagccatggaaaccactctgttctccagttctgtaattttgatggttcaagaatgctgccgggggcggcggctcacgcctgtaatcccagcactttgggaggccgaggcaggcggatcacttgcggtcaggagttcaaaaccagcctggccaacatggcaaaaccctgtctctacttaaaatacaaaaattagctgggtatggtggcaggcacctgtaatcccagatactcaggaggctaaggcaggagaatctcttgaactcaggagacagaggttgcagtgagccaagatcatgcctgcactccagcctgggtgaaagattgagactctgtctcttctttctttttttttttatttaaaaaaaaggccaggcacggtggctcacgsctgtaatcccagcactttgggaggccgaggcgggtggatcacaaagtcaagaaatcaagaccatcctggccaagatggtgaaaccctgtctctactaaaygtacaaaaattagctgggcgtggtggcaaacgcctgtagtcacagctactcaggaggctgaggcaagagaatcacttgaacctgggaggcagaggttgcagagagctgagatcgcgccactgtactgcactccagcctggtgacagagcgagactccgtctcaaaaaaaaataaaacaaatattctatacatggaattagagagcatccagactgttgcatgtatcaatactgcaggtttttttttttttactttttgcattttttgaaatggagtctcactctgttacccaggctggtcttgaactcctgacctcaagcaaccctcctgcttcaggctcccaaagtgctgggattacaggcatgagccacctcatctggccatagcatattattttttatttctggcagagtcagggcctccagaggactcaactggttcctgtagtggcactggttgcattgtccccatggcacaaagacatgctctgttgcaatagactaggcttctccttatatgcccttgagtgtatccactggtgcaaggctttttcaccaagcaaacagacattgagtgcctgctgtatcccaggcacatgctaggtgctgggggtgcagctgtgaacacacaccatggtccctgacctccatgaatattctagccgaattggtggggagtaaacaataaacagataatcacagagacagatacataatggcaaactgtgataagtgcatgaagcaagctgctggagtacatagcaggggcttccttgtgccaggcaggggcttgaaaacaaagagttaggaggcagcccagggaaggacagcagatgctgctttttggaaatgttcgtccccactgaaccaacttctgaaaaactatcctaagaaaatcgtcttagccaggtgtggtggctcatgcctgtaatcccagcactttgggtggccaaggcaggaggatcacctgggttcacgagttygaaaccagcctggccaacatggcgaaaccctatctctactgaaaatacaaaaattagccaggtgtggtggtgggcacctgtaatcccagctactcaggagattgaggcaggagaatcacttgaaccgaggaggcagaggtttcagtgagctgagatcgtgccactgcactccagcctgggtgacagggcgagactccacctgaaaaagagaaaagaaaatcaagagttaagggcattcattatggccttatttacaatagcagaatttcagtgtccagtcctagctgaatgatgagttcaataatggttcatctatcaatggaatgttttcagctattaaaatgatggctttggctactgaataggtctgctaaaaaaaaaaaaaaaaaagacttctacctagctgtctagttggacactgtggcatgtgcctgtagtcccagctactctggagctggggtgggaggatcgcttgaggccaggagttcaaggctgcagtgagctatgattgtgtcactgcactccagcctgggtgacaaaacaagaccatcgctaaataaataaattaacttaaaagatggctatgtaaagttgtaagaatgatgtaacagcatggggtaatacatatcttataatttttaaaaaaattttatttgtggagacagggtctcactgtgtcacccaggctggagtgcagtggcacaatcgtggctcactgcagcctcagcctgcagggttcaagcgatcttcctgcctcagacccctcactagctgggactacaggcacacaccaccatgcctggttacttgtttttgtagagatggggtctcatgatgttgcccaggctggtcccaaactcctgggctcaagcgcttgcctcggcctcccaaaatgctgggattacaggcatgcatcactgttcctgtctgtatcatataattttaaataataaaagcagcctctacaactaggcagcatggtcttaagtctattttttaaacatagaaaaagagccaggaaggaaatgtaaacaatgttaataatgactttgatagggaggtgggtgggatatgaaagattttttttctcccttttgtccttggaaggaaatatcacttttcagcagtagttctctgttgggatggttctaaagtggggaagatgagactttttcctttcactttgtaccttttctggtgctctgatttagagctcctcagtcttgccactgttgatattttggggtgactaattctgttgtgggggctgtcctgtgcactgtagggtgtttagcagtatccctggcctctacccactggatgccagaggcaccccccaccccagctgtgacaatcagcagtgtctccagacaatatcccctagtggggatcggtgggggcaacattgtccctggctcggaaccactgatsgaatttattatgacaacatatccctttgccacaaaaacaaatgatgggctaaccgtgtgtgtgcaggtgaagccactgctgcaggtgacacggcaggaggaggagatgcaggccaaggaggatgaactgcagaagrccaaggagcggcagcagaaggcagagaatgagcttaaggagctggaacagaagcactygcaggtacctgtatggatgcatggctggggttgctggggaacaggacttggccccgtggggctcacccgcctcctccccaccacctgcgtgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggtaaggtgtcacaggggcagcccgtggtgggtagcaaatcacttgaccctcaccacaggcctgtggaggtgcatccagggatatgtgtccctgctgggacagatgatgagacgggggcttggagagggttggtcatctgatcaaggccacacarctgggattgggactggaacacagtgagcccactctgttctattgccctgccttgcatgtgctaaccccttttctcctaacagcaagcctgaatggaggataattgtatttgttagctattgctacataacaaaacatgccaaactcagcagctaaaaataaaaagtattgcatagtcaggaatttgagagtggcttaggtgagtggttctggctgagggtccggcctgaggttgcagtcaaggtgttggctgaggctgcagtcatctgaaggctcatctggggctggaggacccacttctacttggcttattcacacagctgttggaggaggcctcagttccttatcatgaaggcctctcccctcagggctgcttgagtgtccttccaatatggcagcagagttcccccagaaggagtgatctgagagaggagaaaggaagccgcaatgccttttatagcctaatctctgaagttacattccatcacttcttcctgatttttgttgttgttgttagaagcaaatctaacccccactcaaggggaggagaattaggctccacctttttggagtmgcaaagaacttgtggatagattttaaaaccaccatggtacctactgtgctcattttatagatgaggaggttgaggttccatgaagcagagcagcttacccaggtctttattttttttttttttttgagacagagtctcactctcttgcctaggctggggtgcgatggtgcgatctcagctcactgcaacctctgcctctcgggttcaagcgattctcctgcctcagcctcccgagtagctgggattacaggagcccaccaccatgcctggctaattttttttgtatttttagtagagacggggtttcaccatgttggccaggctggtcttgaattcctgacctcaagtgatccacccacctcggcctccaaaagtgctgggattacaggtgtgagccaccacgctcaggcctttatttcttccttttaggaggctacagagttctgggcatcttcaggcctagcccctgtattcattagtccccagatcaccacgagagtaaatctgttataaccaaagctgttactcttttccctccacaacaaaggaccttgaagaacagctggaggaggaggaagctgccaggcagaagctgcaacttgagaaggtcacggctgaggccaagatcaagaaactggaggatgagatcctggtcatggatgatcagaacaataaactatcaaaagtgagtaggggccgggtgcagtggctcacgcctataatccgagcactttgggaggccaaggtatgtggatcacttgaggccaggagtttgagactagcctggccaacagggtaaaactccatctctactaaaaatacaaagattagccaggtgtggtggccagtgtctgtaatcccagccacttgggaggctgaggcaggagaatcacttgaacctgggaggtagaggttgcagtgagctgagatcgtgccactgcactgcagcctgggtgacagagtgactctgtttcaaaaaaaaaaaaaagtggaatcaagtttctgcattaaaaacaacaggcttaccaggatcagggagattttggggatttgggactttcagttctcaaagcagaaaagcccttagaaaaccaggacaagctggtcaccgtagtcagtagtcactaaccagccccacctgcttttagttctttgagctggatgtcagcttggcccctactgtgagccaggctctgtgttagatgcaggtatgcatggtgaaggaggacccttcccttgtggggtttatactgtagtgagatggcaaataatcgtcatttaccatggtgatcagggctctgaaggaaacgttcaccatattttaagagtgcggcaggccgggtgcggtggctcatgcctgcaatcccagcactttgggaggctgaggcaagtggattacctgaggtcaggagttggagaccagcctggccaacacggtaaaaccccatctctactaaaaatacaaaaaattagttgggtgtgttggcgggcgcctgtagtcccagctactcgggaggctgaggcaggagaatcacttgaacgtgggaggcagaggttgcagtgagctgagatagcaacactgcactccaccctgggcgacagagtgagactctgtctcaaaaaaaaaaaaagaatacagcagtgggggatagaggaagggtattcatagaagacttcctggaggaggtgacatttaagcagaaacttaaagatgaaggagcagttagaggggagtagaagagcatctcagctggttggcccactgtgcaaaggccctggggcagggaagagctggccagtggcaggaatggaaggagggtacctttagctgaccatacaatatgagggacaaactggcacgagatgagaaatggccagtttttggaaattgttatgggacttctctttaccatttaaaactctagttgtattttgttataatgtgggtttttctttcaactgtttacatggaaatcactaaaagtgaaacatagattctagagaaaagaaaaatcctaaagctatctctttctctttccccaaaaaggaacgaaaactccttgaggagaggattagtgacttaacgacaaatcttgcagaagaggaagaaaaggccaagaatcttaccaagctgaaaaacaagcatgaatctatgatttcagaactggaaggtaaaccagctaccaagagatttatttttattttattttattattttttttagagatgaggtcttgctctgttgcccaggctgcagtgcagtggtgcgatcatggctcactgcagcccgaaactcctaagctccagtgatcctcctgcctcagcctcctgagcagctgagactacaggcgtgcatcaccacacccagctaatttttttttattttttattttgtagagatggggtttcactatgatgctcagtctagtctcaaactcctgggcccaagcagtcctcccaccttggcctcccaaagtgctgggattataggcatgagccactattcctgggcttgaatgggtatttttaaaagcaggaaaatcagaaaggaaatttgaggatggcagatcatcccatgagtgacaactaactctatgccacctctcgaaatcacccttagtcatcacatgcactaataatatgataaaagggctgggtgcggtggctctcgcctgtaatcccagcactttgggaggccgaggtgggcggatcacgaggtcaagagttggagaccagcctggccaacatggtgaaaccctgtctcaaaatacaaaaattagccaggcgtggtggcrggcgcctgtaatcccagctactcgggaggctgaggcaggagaattgcttgaacccgggaggcggaggttgcagtgagctgagattgcgccactgcactccagcctgggcaacaagagcaaaactccatctcaactaataataatattatgacaatataaggtgctgttcatcgggagataatggtccagaccgtgactatgatggttactgattgggggatgtgttcatctcctccgggtaaaatgcctgggcaggaaggctcatttccgggcatctctctggggcctccccttcctgaagagcaccttggtttttgcagtgcggctaaagaaggaagagaagagccgacaggagmtggagaagctgaaacggaagctggagggtgatgccagcgacttccacgagcagatcgctgacctccaggcgcagatcgcagagctcaagatgcagctggccaagaaggaggaggagctgcaggcggccctggccaggtagcggggctggcaaggggcatttgctgtgtgtccatgtatcccctgggcccctgctcattcgctcattcgcagtggctgtcttggtcaaggyggccccaggcccttggcatgaacttcgtttcccaggccaggcctcccacaagccttctcgaccctgttcactcccccagatcctcaccttcgactttcttctcttccctgcaaacacatcatgtctttgcagttgatctcacctactcccatggtgttgctgctgcctcttcgacatccaggcttttctcatctakacccccttctgaatttccgattgcccaatgagtcaatttccaccgtcatctcaaacacccctgtctaaggcgggaatgaccttcctttccccagcccctccctctaagggccctcttttttgtgaacaccaatctcctcctttgtttctgccgacccacagcaagcagcaaccttcagattctgccagtccttctaaatgtcccccacccatttcctctggtttttccctcttcctggctcttagctggatttacactaatgctaatactgcagcagccastatgaatgattatttacctgctcactcggtgctaagttcttttcaagcaatacctttgcagacacctggccaggtgtactgccggtgtctttgaggaggaagctgagcctcctaggggtaacgcaacaggagcaatgtcattgcttctaagaggcagagctgggatttaagcctcaaagctttctgattgatcccctggcctggctcttttgtcggccaatttgtgctatgttgacagtgctacggtgatgaagggaaagcatctctctggggcaggaacctgctcacaaaactttgctggctggatgcagtggctcacgcctgtaatctcagcactttgggaagccgaggtggggggattgcttgaggccagcagtttgagaccaacatgggcaacatagcaagaccctgtccctacaaaaagttaaaaaatgagccaggcatggtggtgtgtgcctgtagtcccagctactcaggaggctgagatgggaggatcacttgagcccaggaggttgaggctaaagtgagctatgatcatgccactgcactccagcctgggcaacagagcaagaccctgtctcaaaacaataataacaacaaaacaaaaacctaacttcactggcttactagggaaaatccagtttccttagcctcaccctcagagcccatccaccctctgcagtctcaccccaacccaactatttcactttctctcttgttgctgccctttcacaagtacagtaaaatcaaagtgcttgcctctcctgcagcattctgccatttaacagggcttcttgcagcccaccttgatctctggtcaccacctccaccagatgcagagccccagtctgaatatcccccgcaagcagtggctggccaaatgctgtgcatggggcgggtactcagtcactgagcaaatgcagaaagaacagacagttgccagggaagaagaactgtccaacattcagaaagcatctacacagtccctactgtgaccaggtaccttgccagtctggggtcaatgctttgcattcttgcacacacatgcacacacgtgcatacacacgtacacacacccatgcacatgtacaacctgttttgatgtcagaccttggcactcacatcctatgttaatctcatatagtctggcatgtcaagaagcagacctggggacatggatagaargtgtttgatgtctstgcaacataactgtctggtcccagaaaagtttttggccacattgtaagagaggaaaccaagggacctgggggttcattctgctgggtctctccctggaaggcttgacgatgaaatcrctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcaggtgaggggcccatcaatcccaccatcctgctatcccactgcaccaatgggatgggggcagaagaggggacaaacccaaagcaaatcgtgcatcagcccctgtgcatttaccttcctggccgcggtttgctttaacttatagaagcatggttggctgtttcttttttttctttcttttttttttttttttgaggcagtctggctttgttgcctaggctggagtgcagttgtgccatcttggctcactgcaacctccacctctgagatttaagcgattctcatgcctcagcctcctgagtagctgggattacaggtatgtgccaccacacccggctaattttttgtttttagtagagatggagttttgccatgttgcccaggctggacttgaactcctggcctcaagtgatccacccacttccgcctcccaaactgctggtattacatgtgtgagccactgcacccgaccctcatcatcttatttctcatcagaagagtagtatataccagggatgtacaatcttttggcttcccttggccacattggaagaaaaagatttgtcttgggccacacataagatacactaacactaataatagctgatcaactaaaaaaattttacaaattggaaaaaacatctcatactgttttaagaaagtttatgactctgtgtcaggctgcattcaaaaccatcctcattggtaagcttggatatactcagagaacaatttgaaaactatagaaaagcagacataaaaaaaaatcacctttagggtcgggctcacgcctataatctcagcactttgggaggccaaagacaggtggatcacttgaggtcaggagttcaagaccagcctggccaacatggtgaaaccctgtctctactataaatccaaaaattacctgggcgtggtggcgcatgcctgtaaatcccagctactcaggaggctgaggcagtagagtcacttgaatctgggaggcagaggttgcagtgagctgagatcgcaccatygcactccagcctgggtgacacagtgagtgagactccatctcaaaaaaaaacaaaaaacaaaaaaatcacccttagtcacaccagttaacattcttgagaaattccttcctgtctgkgtgkgtatcagtcagtccccaagctccaattcccaagtatgtgtgtgtatcacttttgtgttaaattttaaaaataaaattgatcagattggttttcaattgaagattcacttcaaatgaacaaacaataacaaactgcctgccagatcacgaatcctgactctagtgaaactaggtcattgattcattcagtaaacacataaatgtattttgatgcaatctgtggtgttggcatagcatgtatcatagcatatagctatgctagctgtgccaacaccatataccctggggtttacttcccccactttgggttttgtgcagtgtcacatgcacatagagcacagcgttctgctcccttgccgcttggcctttgatacagaagagcccagtgcatgggccaggtatggtggctcatgcctgtaatcccagcactttgggaggctgaagcagacagatcacctgaggtcaggagttcgagaccagcctggccaacatcatgaaaacctgtctctactaaaaagacaaaaattagccgggcgtggtggtgggcgtcggtaatcccagctacttgggagactgaggcaggagaatcccttgaacctgggaggcagaggttgcagtgagctgacatcattccactgtactccagtctggacgacggagcaagactcgataagaaaaacaaacaaacaaaacaaaaaaccaggctgagtgcggtggctcacacctgtaatcccagcactttgggaggctgaggcgggtggatcacctgaggtcaggagttcgaaaccagcctgaccaacatgktgaaaccccatctctactaaaaatataaaattagccgggcgtggtggtgggcacctgtaatcccagctacttaggaggccgaggcaggagaatcgcttgaacccgggaggtggaggttgcagggggccaagattgcgctgtygcactccagcctgggcaacaggagtgaaactccatctcaaaaacaaacaaacaaaaccatggactcaaggtcaaggtttagcttctaattctggctccatcacacaatggctgtgacaccatgggtaaaactgcttaccctctcttagccttagtttcctcatttgtaaaatggaaataataacacacctgcctctttgggttgctctgaggattagatgatgtatataaaaaacttagctcagggcctggcatatagtaactgctcattaaataagagccaacattaatatttaagcaaaattttgcagttcacagacatcctttcaattctattactttgtgtatttgtttgccagtcattacagatgtcctaggcaggtgatatgctccacattttgcagctgaggaaattttaggtccagagatgttaggtgaatgacccaaggtcacacagctagagaggggtggtgatgaggactgcagctctgggtcctggaagagctctcattcttttgcacggcactgagatgaccctctgtctccacccaactgccattcactgtgttcctcccaccaagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggtaatgctttttggtgatgctttttggtgatgacacataagagtgacatcagcagcctcaaattactacaggtcagggtctgcataaagacaaaaaacaagttacataagattctaatgatgatgatagcagcttatatttatttacaaaatgcttcccatacaggctgggtgaggtggctcacgcctgtaatcccagtacttggggaggctgaggcgggaggatcgcttgagctcaggagttggagaccagcctgggcaacatagtgagaccttgtttctactaaaattttaaaaaagtaggccaggcgtggtggctcaagcctgtaatcccagcactttgggaggccaaactgggtggatcacctgaggtcaggagttcgagaccagcctggccaacatggcgaaaccctatctctactacaaatacaaaaaattagccgggcgcggtggtgcatgcctgtaatcccagctactcgggaggctgaggcaggagaatcacttgaacccaggaggcagaggttgcagtgagcagagatcatgccattgcactccagcctgagcaacagagcaggattccatctcaaaaaaataaaataaaataaaatattggccaggcctggtagtgcattcctgtggtcccagctatttgggaggctgaggtgggaggatcgtttgagcctgggaggttgaggctgcagtgagccctgtcatgccactgcactctagcctggacgacacagtgagaccttaatcaaacaataaaaataggctgggcacggtggctcaccatgtctgtaatcccagcaatttgggaggcaaggcgggcaaatcacttgagctcaggagttcgagaccagcctggccaacatggtgaaaccccatctctaccaaaaatataaagaattagctgggtgtggtggcatgtgcctgtaatcttagctactcgggaggctgaggcaggacaatcacttggacccaggaggaagaggttgcagtgagctcagatcgtgctactgcactccagtctgggcgacagagtgagccgccatctcaaaaaaagaaaaaaaaaaaagaatgaatagaaatgcttctcatacagtatgtcaattaatcttcacaaccaccctgtgagacgtgtactattaaactcattttacaagcaaagaaactgaggtcctaggtgcctagaggtgaagagacttacccaaggtcacactgctggtaagtgacagagccatgatttgcacccaaacagtctggtcctagaccccactttctggcctctacaggactgaaggcctataggatgggtggggcctatcaatatactgcccttcagggataagcaaaggtgtaacaacactttcggggagatttaaatgaaacttaaaactgggatcattctatccactttaatttctctgcagactggaggaaggccaggcatggcggctcatgcctcccgtaatcctaacactttgggaggccaaggagggaggattgcttgagcccaggactttcagatcgcctgggcaacatagcgatttttcttttgtaaaaaaaaaaaagactggaggaaacttgtcattatttgatttcaatggcagaacagctctctccggcataatttgagaatgactaggtcaaatcactctcccgttgttggaactctttgcggtgtatgggagtgggagctggtaaatagcagtaccgaatgctgaatcttgggtgctcttctctcctttggggtagtgcctgtgcttcattccccagggtaagttttttagcttgcgaccttcggccagattgttttcctgaaagcctgagttacattaccctcagcgttgcagctcctccacatccccttcagtggaagcttttggttctgctagattaagtgggtgcagcattgcctaaaaattttggggaatttgcatttggttctatcactagtgtattggtccgttgttgcactgctctacagaaatacccaagattggattatttgtttattttttgagcagtggagtcttactctgtcactcaggctggagttcagtggcgtgatcttggctcactgcaacctccacctcctgggttcaaatgattctcctgcctcagcctcccaagtagctgggactacaggcacacaccaccatgcccggctaatttttttttttttttttttttttagtagagatggggttttgccatgttggccaggctgatctcgaactcctgacctcaggtgatccacctgccttggcctcccaaagtgctgagatgacaggtgtgagccactgcaccaccctgagattgggtaatttctaaagaagagaggtttaattggctcacggttctgcaggctgtacagaaagcatagcagcttctgcttctggggaggcctcaggaaacttaccatcatggtggaaggcaacggggaggcaggcatgttttacatgaccagagcaggcagaagagagagaatggggagctgccagacacttttaaacaaccagatctcatgagggcagcaccaaagggatagtgctaaaccattagaaactgcccccaaaggccgggcgcggtggctcatgcttataatcccagcactttgggaggctgagataggcggatcaccaagtcaggagttcaagactagcctgaccaacatagtgaaaccccatctctactaaaaatacataaaattaggctgggtgcagtggctcacgcctgtaatcccagcactttgggagcccgaggcaggcagatcacctgaggtcaggagtttgagaccagtctggccaacatggcaaaaccccgtctctactaaaaatacaaaaattagctggacgtggtggcggtcgcctgtaatcccagctacttgggaggctgagacatgaaaatcacttgaacccaggaggtaaaggttgcagtgagccaagattgtgccactgcaccccagcctgggcaacagagtgagactcagtttcaaaaaaaaaaaaaaaaaattatggttggaagagtgaggccccagacagaatcactgaccctccccatgcttggggttcattagacgtgaacaggagctagaagccaagcccattcccagccaggcctctttgggaagacgcagttattaagaccaccagcagacggcatgtccattactgacccgcacaaagcaggtagaggtgcaaacctctgcccatctcaggtgcagggaaacagaggcctttgcctctaacaacttgaattctgatgtagagacctggttccatctgcttgtgggggaaacgtttaacatcagctcctacctgggctccccaggccctcgtgcggtttggccccagttctggggtcttaggctgggctaaggtttctgggagcccatgtcccctagggtccccgcttcactgctttgttaccaccaagagactccctgtccccatctgaggtctggcagctcttagtcatgtcttggagggaggacgggcatccagggctgaccggtcaacgtccagcacctcccagggactatgggaagactgagtggtgggtctcgtcctctcgggatacttgcgcttctctttccccttctctacaacctggaaagaagcccctcaccgcgtcctacttttgcccaacacgcttttttttttgagacaaagtctcactctgtcgcccaggctggagtgcactggcgggatctcggctcactgcaacccccgcctcctgggttcaggcaattctcctgcttcagcctcctcagcagctgggattacaggtgactgccaccatgcccggctaatttttatatttttagtagagacggggtttcaccatgttggccaggctggtctcaaactcctgacctcaagtgacctgcctgcataggcctcccaaagtgctgggattctaggcctgagccaccrcgcctggccccaacacactttttttttcctgtagggcaactcacatgcctacaggagctggttccataaaataagtttcccttaactaggacagaagtagcagtgtcaatcacacgacacctgtgaaggacgggggcggtgaaaggtgactgccccacctgcagagccagccgctacttagatgtggcagattgttgccttgaaggaaagcaagaccctctgtttccagatctttcgttgttgttggttttttgtttttgtttttaagtttaggattactgaggcatatgtagtaaaatttatccattttactgctccattaattttaacaaatgtgtattgtgtaactaccaccaccacagtcaccacatagaatgttagttattgattgattgattgagatggagtstcactctgttacccaggctggaatgcagtggcatgatcttggttcactgcaacctccacctcccaggttcaagcaatacttgtgccttagccaccccagtagctgggactacaggcgtgcgccaccatgcccggctaatttttccatttttagtagagatgcagtttcgccatgttggccaggctggtctcgaactcctcacctcaagtgatccacctgccttggcctcccaaakctacttatttctgaaacagggtctcactttgttgcccaggctggagtgcagtggtgtgatcatagctcactgcagcctccaattcctgggctcaagcaagcctgccatccgcctcctgagtagctgggattgctggtgtgtgccccccacacccagctaatgttttattttagtagagatgggggtctcactacattgcccaggctggtcttgtactcctggccttaagcgatccttctgcctgcttcccaaagtgctggggatgacaagtatgagctgccatggcatgccttcaaacattaaagttttttgaaaaagaagctgggaatccagatttttatgtgacatttattaaaatgtcggcaactcatttttttaaaagtagtgaaagggtcaaaggggacatgtcagcaggttggataccgcttgtgggattccagattgcaacccatgagctttaggaaaatagaatccaaaatatcagctgggtgcggcagctcacgcctgtaatcccagcacttagggaggccaagatgggtggatcacttgaggtcaggagttcgagagcagcctggctaacatggtgaaacctcrtctctactaaaaatacaaaaattagtcgggcatggtggcgggcgcctgtaatcccagctacttgggcagctgaggcaggagaatagtttgaacctgggaggcggaggttgcagtgagccaagattgtgccacggcactccagcctgggtaacagagttaagactccatctcaaaaaaaaaataacaacaaaaaaaccccaaatctcttactggtgattgtgtgccccctgttgtgtgccttcctggacctctctgagggaggaaagggcagggcctgaaacgttctcccggccacagcctccctgttatccctcccctctgcttccttcgccaggccaaggcgaacctagacaagaataagcagacgctggagaaagagaacrcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcaggtgaggaggtggcgcggtggtgtggtgggcagtgctgggtggtgcccagttctgtggggaggagcctcttcccggctcgctgaggtctctcttgctgcaaggcaagtcctttcctctagttgcgttcctggaggagaggcgatgatctccctgttcaattaaatattaaaaaaaccttctggccaggcacggtggctcatgcctgtaatcccarcactttgggagacagaggtgggtggatcacctgaggtcaggggtttgagaccagtctggccaacatggtgaaaagtctctactaaaaatacaaaaattagccaggcgtggtcgtgggcacctgtagtcccatctactcgggaggctgaggcaggagaatagcttgaacccaggaggcagaggttgcagtgtgcrgagaccgcaccattgtactccagcctgggctaaaagggcaaaactctgtctcaggaaaaaaaaaaaaaaagaaaaaaaacccttccttttccaatttgataagtatttattgagcacctgctgtatgccaggcactgtgcttaatcctgagatccaacagcaaggaagaagagacactgtcgctgccccagtaggactccagccgagtaaggggaagggaagggaagggaaagacatgaataatcacacaaatgaatgtcaaatgatgcagcaaagggaaggcacatgatgcccaagtgtaaataaccagggggcctaacctgggggaggaggagccacgaaaggcttccctaaggagcatggataagtctaccaggcagagggaacagcgtgtgcaaaggccctgtggtaagtagaaaaattaggagagagacatacagccagtagagctggagtgcccagctggggttgggggtagggggagatagtacagagtggggttggagggggagcttgtacccagatgatgtagggcttttgagaacctattacatgtatgttgatccttactctgggcaatgtgaagctgttgaggggttttaagctgctgaatgacatggtctttttgtctttggtcttctttcacttggcatagccatttaccctgccttgccactcatggggacgtggccaaagttttcacaaatgtttaacatgtccacagccagggaccaaggggcgagggaagaattaagtgagatgtttttttctcacatgcagttgagagcagggcttttgccgccctcatataagcagtgtcaagatcattcatatcctccttgtcaatggaagagatggaggggtaggctaacagcctcaaagggacttatgcagagacactagggagtaaaagccagagaatacagagaggacgtttttacctttagggcctgcgtctctggctttggccatcagggtcaaagagtargagtgaggaaggaagggatgggacagcatccctgggacgttcaagtaccatcctggtctcccttctccagccttagagagtggaccagccagagcacctcgtctggactctcagacctgctgctttgtctctaccaaccttggcagggatctaggatccatttagtgggatcaggtcccagtcaataccattggggctcaaataagttcttagaaccacagagtctagggccagggtcccaactcataggtgayggagttcccttcaagccacagattctgttttttktgtgtgtgtgtgtgtttttttttttttttatcagagtcccatacctcacsggtattttctcaatcagtgaacacctcaagtactagcccatgtgttttgagtaaaaagggctcctttcaacgaggatccccttctagaggctttgactaaccagtctcttggcacccttagaatgaagttgagagcgtcacagggatgcttaacgaggccgaggggaaggccattaagctggccaaggacrtggcgtccctcagttcccagctccaggacacccaggtgagtgtcctgccacatcatccaggggacctggggggtggccttcctcggggcaggtccctgggacctctttgcatcccttttgcaggagytgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccaggtgcctgccccgtgtccttgcttccttcatgggtcctctcaacttctctgcgctgagatcccccgcaggcagatcgcggtggagtgttggtgcgatggtgcttgaccccycagcttcccctgctattgggtttctccaacgaggagacatggtcttcscttctcagagtctgtggggccagggacaggggccaytcatggtccccctctcaccctaccctggacgctgtccttgtagctctccgactcgaagaagaagctgcaggactttgccagcaccgtggaagctctggaagaggggaagaagaggttccagaaggagatcgagaacctcacccagcagtacgaggagaaggcggccgcktatgataaactggaaaagaccaagaacaggcttcagcaggagctggacgacctggttgttgatttggacaaccagcggcaactcgtgtccaacctggaaaagaagcagaggaaatttgatcaggtagagggcgtggggtgtccccyactctggccatggacgctgggttggggaatcagctctgcagagtatgacgcgtggctctggcctgtgcctgcatcccctctccactctgtggggagccatgggaggctgtcttatcttgtcttgggcgaccatggagcattaacgctaccaggtcacagtaaggatggcaaagaagccttgatgactgtgacttttctgggtaccagcaccatgagggtcacctgcacacatggtgatgccttagtttctagcctgaagaaggaatgaggtgcttatttattcactraatgtatttactgaatacctattgagtagtattccaagtaattcagtttctatacttttaataccactcttccctaagatttcattctgtaaaattccaagtacacagcaaagttgacagaattgtacggtgaacacctttaaggccaccacctggattcagtcattgacactgtattatatgaactttatcagatacttattttgagacaggatctrgctctgtcacccaggctggagtgcagtggtgtgatctcagctccccgcaacctccaccactgggttcaagcgattctcctgcttcagcctttcatgtagccgggattataggagcacaccactatgtctggctaatttttgtatttttagtagagatggggttttgccatgttgtccaggctggtctccaactcctggcctcacatgatctgcctgccttggcctcccaaagtgctgggattataggtatgagccactatgcccggcccacatatttatttataaagactaattstatctatcatgccttatctcttgggtacatttcagagcaaattacagatgtcagtacatttccccttccacacctcaacattgcatattaattagagtttatttttaaacacaattttgcttcttttggggtaaaacttacatgtgatgagattcacaaatcttaattgtacgataaatggagacccctgtatgacccaaacccctaaataccaacttttaagatacattattatttagtaaatatgatttagtttacaagtgactcagggttattctaaaaatcagtttgagaggccaggcacggtggctcaygcctgtaatcctagcactttgggaggctgaggcaggtggatcacttgaggtcaggggtttgagaccagcctggccaacatcgtgcaactttgtctctactaaaaataccaaaattagccgggcgtggtggcgcacgcctgtaatccctgctactctggaagctgaggcaggagaatcgcttgaacccagggtggggtggaggttgcagtgagccaagattgcgccactacaccccagcytgagtgatggagtgaaaaccctgtctcaaaaataaataaaatgaggattgtacagtgaggctaaatgccagatgcctgcaggttccctacccctccctgactgacctcctagtgtcaggattctagataacatcccagtttctcctcttcccatcagctacctctcctctgggctgtcagctcatcttcaatgcttcgttatctggttgaargcctgaggttgcttttattttcctgtcacatagagtgtagtgcagtggcacacatagtgtgggatttttgtgttgactgtgccatttagaggtccctgtctttgctgaatactggaagtttggcttttggatgttacaatttataatctgctctgttctctctgaagatgagattaacgtgagcatggaatgttctctgagttgcttctccaagcagagagatatgtgtgcagggccacccatgcttaccatttccctactgaggctcttaggatacttttgtragatattaatagctacttgtggccatgaaacaaactaataactagcttctggcagctttaaatctcactttgacctcagtgtgctctaagcaacgtgggcaggtctagtggtttcgaagcacaaggatttggccaggtgtggtggctcacacctgtaatctccgtgctttgggaggccgaggcaggaggctcacttgasggtcaggagttcgagaccagcctggtcaacatggcaaaaccacatctctacttaaaatacaaaaattagccaggtgtggtggtgggcacctgtaatcccaactactctggaggctgaggcaggagaatcgcttgaacccacgaggcggaggttgcagtgaaccaagactgcaccattgcactccagcctgggtgacaaagtgagactccatctaaaacaaacaaacacacaaaccaacaaaaaaaaacaagtcagctgatttctggctctgcataaggttgatgtagaagtcagaacgccagatgattatataaattactcccatagctaacctacactgcttacacctgcacctcaatacattcagcaggacacagggcttcccccggtatttacaattcagtgacgctgaccccggatatgcctagaagtcacctctgggtcttgtgttgtagttgttagccgaggagaaaaacatctcttccaaataygcggatgagagggacagagctgaggcagaagccagggagaaggaaaccaaggccctgtccctggctcgggcccttgaagaggccttggaagccaaagaggaactcgagcggaccaacaaartgctcaaagccgaaatggaagacctggtcagctccaaggatgacgtgggcaagaacgtaagtggctctgggtggtttttctcgtccatgtttcgcctgcccaccctctgtgctattcaccagtccatgcgaggctagctcctggcctttttcatagcgaactatcatcggaaatggaaggaggtttttggactggtgcaggggctgggaggggctgagaatggcagtcgaggatgggtctgagttggggggtccgaggataaggctggggtctgaactctcaggggtcatcttgagtcccggccatgcatcctgtgggaggccaaagccacctccctgatctcctgaggtgccgctcacggtgggtttctcaatcgtcttcatgaagttgagcctcayagaatggggctgcccgctctgccggcaggtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaaraggaggcaactgcagagacaggtgygtgctgccgggkaggccagcagagggaggtcgggtggcctttttcattcctatcaccactctcatggttggtgtggaaacttcgttttctttatttttttttgaaacagagtctcgctctgtcgcccaggctggagtgcagtggcgtaatctcagctcactgcaacctccacctcctgcctcagcctcccgagtagcttggattacaggcgcatgccaccatacctagctaatttttttttttttttcagtggagacaaggtttcaccatgttggccaggctggtcttgaactcctggcctcaagtgatccattctcctgttggcctcccaaagtgctgggattacagacatgagccacccacgcccggcgtgattccgttttctcatctgcaactggggatgagatgcccacctcacaagggggctgtgctggggaaggggtgcagtgatgtgctgcctaggtgagccaaaggacctcccaggggcaagtggggcagcacacatctctattcctcgcccagcttcacgagtatgagacggaactggaagacgagcgaaagcaacgtgccctggcagctgcagcaaagaagmagctggaaggggacctgaaagacctggagcttcaggccgactctgccatcaaggggagggaggaagccatcaagcagctacgcaaactgcaggtgggtgacactaggagcttggggcatgggtggagggagggcacagttcccctcaggccaccraagtcagcagagcgggctccaggaagcaagcctgcacctgccattggtgtgggttcagctggggtttttctggaaccattcaggatttggtggctgtctcctgccctgggtagggcagcattattaggtatttggccactgccctcagatcacatcaggggctcagcttctcaggcagktctgtggagcccacccagaatggtgctcccagcgcaccaccagccacctggaactgagagccatgctcgtgcaatgggaacttctttgtggtcaactgcagaaaatccaaggggtgggtgtgcaaagctgaaytgggcagcagaacttgggggagtaaggacatctgagcttgtcctccctgttgactcatgcaggctcagatgaaggactttcaaagagagctggaagatgcccgtgcctccagagatgagatctttgccacagccaaagagaatgagaagaaagccaagagcttggaagcagacctcatgcagctacaagaggtaaagcctcgccttgctaggagagcctcagatgcgggtgtcayggtagcaccccttggcagctccagtctgtgcattcccagatttcatttcgtcctcctctggggtccacctgtctagaaagacacacgcttccctcctctatgtattcacggggcctcccctgagctcagaggaagaacatgtactttcaagggtggctgagttgtcagggtggactcttggtggggmttggcctttccctggcagacaacagccttcctccctcccacctaggacctcgccgccgctgagagggctcgcaaacaagcggacctcgagaaggaggaactggcagaggagctggccagtagcctgtcgggaaggtaggaaactgaatggaggaagagggctctgaagcagaggatggggggacaggcagcatcctcgacccccattttattttttaaattttttcgagacagagtttcattctgtcacccaggctggagggcagtggcacaatcttggctcactgcaacctccacctcccaggttcaagcaattctcctgcctcagccttctgagtagctgagactacaggtgtgtaccaccatgcctggctaatttttatatttttagtagaggtggggtttcaccatgttggccaggctagtcttgaactcctgaccttaggtgatcctcctaccttggcctcccaaagtgctgtgattacaggtgtgagccaccgtgcctggccctggacccccatttcaatgctgctgctgacgaagcgtcctctgagattggggacagacccatggtggttaggttttccgtcagcgctttcatgcctgtttgggggtgtggctgctttcattcattcccaataagtagctgtgtggggagaaggggaggccaggaagagtcagggaggagtgtgctggtccccatcccaatcccagctttgctgacacggacccggcctgagtcccggctgtccacttcctggctgtgtaactacagatgagtcttctaatcttctccaagcctcagtttcacccattagatgatgagggcaatacccctgaggcatgactccaaggagkgggcatcttttaaggcgggggagggtagaggcccccaccatggcygcccttcccccaggaacgcactccaggacgagaagcgccgcctggaggcccggatcgcccagctggaggaggagctggaggaggagcagggcaacatggaggccatgagcgaccgggtccgcaaagccacacagcaggtgagggccgcctggacaccacagtcacgctgcctactgtctctcctgcagcaggatcctgcaccagtcaacacaygcgtggcggcttcctgtgtgcaggccctggattgagggacaagagggtggtggggcctgagagtagagatccagggcccttacaccagtgcccaggctgctgtcttcagaatactcctctccacgctgcagtgtctcattttccagccacggcgtggctggctccccgtacctcacggccatccctggagtccgggccttgggatgctctttcattgcgttttcccctagctgaagctctgaccttatccagtgagcccttggtgatgtcactgagcactagttccatggtgggcactagggaccatccagtaacctgcagccccttgtggtgtagggtgaacaggcatcattctccaggcgactccaggacagagaaagcaagggacaagtcactcgctcagcctgggtggcactgacacttgtggaagcacytcttttttttggagacagggtctctctgtggcccaggctggagtgcagtggcgcaatcttggctcactgcaacctctgcctcccaagttcaagggattctcctgcttcaacctcccaagtagctgggactacaggcacgtgccaccactgcccggctaatttttgtatttttaatagagacggggtttcaccatgttggccaggcaggtctcgaactcctgagctcaagtgatytacctgcctctgcttccaaaagtgctgggattacaggcgtgcgccaccacgcccggcctggaagaagctcttgagtggagttttacaggatgaaggagaggacagggtgcccgggatcaagggactcgtgcagaggccaaacaaggcaggaagaggcatggtctcagtgcgctstcttgggcttccctgagtccgcctcatggccttcactctcctccccaggccgagcagctcagcaacgagctggccacagagcgcagcacggcccagaagaatgagagtgcccggcagcagctygagcggcagaacaaggagctccggagcaagctccacgagatggagggggccgtcaagtccaagttcaartccaccatcgcggcgctggaggccaagattgcacagctrgaggagcaggtcgagcaggaggccaggtatgcgsgtgtggagttccgaacccagtttgcaggggggtgatggacagcaggagtcatagtgaagtcagggaacctcttccagcatcagttctggcttgtaagaagcaagctstgtgatgcctacagtgcaggtatgttgtgagaactgaacgtaaacacagcaaagtgccctgctggttcctggcctagggcaagcacctraagtgtgagctgctcttagcatctccatggtcctcctgacattaacctgccttcccagcagtacatatgacttttcccagcctctgcagggatagcatgctgacagatcaaaaatccaaccaggctggacgtggtggctcacgcctgtaatcccagcaatttgggaggctgaggcaggtggatcacttgaggtcaggagtttgagaccggcctggccaacatggtgaaaccctgtctgtaccaaaaattagccgagtgtggtggcacatgcctattatctcagctactcaggagactgaggcaggagaatcactccaacgtgacacgtggaggttgcagtgagccgagattgtgccactgcactgcagcctgggtgacacagtgggacccttccacacacatacacacacamaaaaaaaaccccaaaaaacaaaagtccaaccggcagcccatttggtacacacactggaagccttcttaattatgggtcgaatgaggcatatgatcacagcacatttcttaccattggattctaaggattctcacccattctcttctagtagctttttcagtaattcgcacgccctgcaatgcacccatttaaagtgtataattcaagggctattcatatattcacaaacatgtaaaaacgatcaccacagtcattttgagaacattttcatcggctcaaacagaaaccccaggccatatgtggtatttcatgcccataatcccggcactttgggaggctgaggtaggtgggagcagcacttgagtccaggagttcgagaccagtctgggcagcatagcaagacttttttatttttatttttttgagacatagtctcactctgtttcccaggctggtgtgcagtggtgcgatctcagctcactgcaacctccgcctcaccctcccaagtagctgggactacaggtgcacaccactgtacccagcttgtaattgtattttttagtagggatggggtttcaccatgttggccaggctggtctcgaactcctgaccacaggtgatctgcccacctcggcctcccagagtactgggattacaggcatgagccaccacgcctggccagagactccgtttctatgaaaaacttttaaaagtctgagcatgctggtgtacgcctgtagtcccagctacttgggaggctgaggtgggaggattgcttgagccaggagttcaaggctgcagtgaactatgaactagggtgaagagcaggcattggagcaccactgcactccaacctgggtcacacagcaagaccttgcctcctccccgcaaaaaaaatagaaaccccatgccctgtaaccactcccttcagtccctggcaaccataatctactttctgtctctatgaatttatctattctggacacttgatatcaacggaatcacacactatgttgtctgctatgtgtcttctttcacttggcaagaattccaggctcatccatgctgtggcatgcattgatactttattccttttcatggctgaatactattccaccatctgactgattcttgagaggagtccagatacggggctcaggaaagcactcaagatgccacctccaggtgacacaccagctacaaggggtgccaccctccgctgaaaccacctgttttccttgctgtttgcagagagaaacaggcggccaccaagtcgctgaagcagaaagacaagaagctgaaggaaatcttgctgcaggtggaggacgagcgcaagatggccgagcagtacaaggagcaggtagcccctgccacccagcctccctcgagcccccagcccccagccggcctcccctaaccacccctccaactctccgcgacaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcaggtgaggagcccgtggcccgggaggaccccgtctctcaggccagagaaaagcactgggggctcgggctcctttcggcctgcaaatgccccttgtgcccacagccgccactcccttctgtggtttattcctgcttctccttaatcactaagcttagtgtgggccaggcactgagatcagacccgggccctgccttgcctggtagcagctaaccttctagatcctttaacgatcgaccgtctcccatccggtcctccggctgaggaggaggaagaggctatccccactgtctcctccagcccctccttcattgcatcactgagtcttcacgacatccattgaagctgcaacaccaccccccgccacttcacctccttcctgacatgctctgctcctcctttctccccctcagcactgctgccatctgggctgcattattctcgggtatgggggctgtccgacattccccatcagaaggaaaaagatccctgaaaagtagcaggtgcttacatttctggcctctacccaccggctgcagtagtcccccaccaccctgcaatgtgacaaccaaaaatgtctctagatgttgccagaagtcctctagagatgggagggtacgactgccaccccgctgagaattcctgctgtcactggagtgggggctgttttctctcccatgcctctggtaccttgggggtcccccctgctcccaagggctgcttccaccaccctgtccatccatcccgattggctcccaggaggttttagctccgggcttcctgtctcccacaccactcctcacagttctccatgatttcaacatccaggtgggcgacgcagcctctcggttccttgaccctctgggtgatcctgctgcttctaccgggccaaccagtactcctaggagccctcacaatttgaccctcaggcatcccattgtctgcctggtgccacctttctttggctctgtccccaacggggtcttcactccattaatgccatcagcctctgacccagctccaaaccagctgtctagtaacccccgtcgcgcatcctcaacatccggttccccctcttgcattgctgcaatcrtttggtgaaagcacaacccaaatgaaactcaagcttggctgggcacgggactcacacctataatcccagcactttgggaggccaaggcaggtgaatcgctttgagctcaggagttcaagagcagcaagaccccatctctacaacaaacaaacaaaaatcagccaggtgggatggcgcaaacctaaaatcccagctactcaggaggctgaggtgggacgatcagtggagccccagaggtcaaggctgcagtgagccatgatctagccaatgcacttaccctggatggacagagtgagaccctgtctcaaaaaacccaaaacccactctccaccttttcccacagagcaggccttgctcaggggtcctcccacacccctccctcatcttctcactctctgctgcttttcactttttctttgaacttatgatcgctcctccccattctctctcagctggggaccttacttcctacttaactcaaaagcagaaatgatcatgaaaygtgcacaagctcccactgcctcatcaycctacctccgkgcacctctgtacacttctattttttttccatttctatgctgaaccctctggcaccaaccgaggccaacacctccattggacccgaccctcttgttcactcaagcacatagctccaaaaatccttattttgcaaggttttctctttcatttgctccatcagcaaatggaataacctcttagccccatgtctaccttgctacccttactacaaaactggatgtgaatgccgaaaccctgtctctaccaaaaaatataaaaattagccaggtgtggtggtgcatgcctatagtyccagctactcaggaggctgaggcacaagaatggcttaaaaccgggagagagaggttgcagtccagcctgggtgacagagtgagactcggtctcaaaaaaaaaaaaaaaaaaaaaactgtatgtgaagagttgctggttcccctcgcccccacccatcactctcccaraagcctcccatgggtgacactaatggccagaggtcccctgacagggcagcagcacgtgacgcagtccatcatgcctctggcctaattcacttgcttccctggacttccccgacaccatccacacctgcttgtcccccgacctgkggggttgtccctcttcctctcctctgctgatccctcacctcgaaacctgcttgccactagaccgccccagggtatcarcttagttctcttttgrgcagagtcttgctctgttgcccaggctggagtgcagtagcactatctcagctcactgcaacctctgcctcccagttcaagctatttttggcctatttttatatttttagtagagayggggttgcaccatgttgcccaggctggtcttgaactcctgatcttgtgatccaccygcctcagcctccccacgtgctgggattacaggcatggaccactgcacggccttagttgttttcatctctccccagcrctaggtgagaggtctcaactmatcttggcgctttagaattccatgtatatctaawgactcctcagttcatctctgagaagccctagcttcttcctagaacctcagaccaccctcccgttcccacatggatgtctaataggcagctcacaccaaacatgctgcaccccaagtcctgactgaaactcttcacccccaaactggctcctctctccagctcagcagctaaaatgatgaagttgccaacaattcacatcacaaacctcgtggtccttcttaacgttttggtctcctttataccccacatcccatctatgggagaatctggtcaactttccctaaagaatcctgcccaggctgggtgcagtggctcaccccttaatcccagcactttgggaggccaacgcaggctgatcacctgaggtcaggagttcaaggccagcctgaccaacatggtgaaaccccgtctctactaaaaacacaaaaattagccgggtatggtggggcgtgcctgtaatcccagctactagggaggctgaggcaggagaatcgcttgaacctgggagacacaggttacagtgagctgagatcgcaccactgcacttcagcctgggtgacagaccamaactcggtctcaaaaaaaaaatctccagtgtctaggacagcaccaggcagagtgaacctttatccctcgggtcctagatattttccccgcttcattctcataccaccacagccatgtgctgagcctcttactacctttaataccaatgacttgatcttttaacagttttaatcatacatgaatataacggcaaataaacatacctcctctatatttttaaaccagcatcacctctatcaactggttacgatgaaagtaatatgataaaaatagtatcaagttcaatatctagctattgtggccacaacttgatcaccaagacctgaagcctacttctccactaaaaagggagtgacaacagccattagcaccaaatagactctctctgacatcataattagacttgtttaaaaagagttggaaaggaaatgactttctcagggcccagttcagttagcggatggcatgcccggaagccatctgaaatcacctctagagtttggggaccactgcgtgagacagggaaaagtccaaacccctctgagaaggggaagagagcagctggcgcagggcaccaagccttcagggaaaagccccactcgctgcatggtgagcgcttgttggtcccccatggataggagagaaaccaggcctaggctcccaaagtacagcaggggcctggaagcatctcccagggttgaggggtcagtggaggagagctgttctcactgtgaagactcctggggcaaagcgcrgtggctcacgcctgtaatcccagcactttgggaggctgaggtgggctgatcacctgaggtcaggagttcgagaccagcctggccaacatggtgraacttcatctctactaaaaacacaaaaatcagctaggcgtggtggcagatgcctgtaatcccagctactcgtgaggctgagacaggacactcctttgcaacccaggaggaggagcctgcagtgagccaagatcaagcctctatactccagccttcagagcaagactctgtctccaaaaaaaaaacaaaaaacaaaaaccctcagatgtgctctgctggcaaccagtccccctgcctctcctgagtggctgggctgagcgatggggatacagccactctgactccctaccccactgctgtctctgcttccctttctcaggcccagtgatttcttttctttttattatttatttttagacggagtctagctctgttgccaggctggagtgcagtggcgcgatctcggctcactgcaacctttgcctcccaggttcaagcgattctcctgcctcagcctcccaagtagctgagattacaggtgcgtgccaccacacctggctaatttttgtatttttagtagtggcaaggtttcaccatactggctgggatggtctcgatctcctgacctcgtgatccacctgcctcggtctcccaaagtgctggggttacaggcgtgagccaccatgcccggccggcccagtgattctttagcacacactggacacctcctgtgggttctgccccagacacttgagccttcttgggcagccaagggcaaagtggaacaaaaagaccatttttgccagttccgacacgaatacacacataatgcaggtggaaggtctgtcctgccttctgcatcttttgggtgcacaaaaacataaaatcaggcactagagccctgagggaggttggtaagcatgcctggctcctcagccaagaaggaactgtagtgcgagtttcaccaagttctatcagccagacgcatctcgacacaagccctctctaaagccagacccacttacctaccactggctacactgccagttacctccggcaagagctgtacaaggcctccacctctcctctcttgctagaggcccgaaagctaatgaagagcaagtaatcataaaccaagggacaggcggctgcaggttccttgcctgggacttcttggcttctgttccaacactgatttctcaaactagcttgctcaaatgcttttacttccctgaaccagtatgcaatcatgggatttataggaggttcttaaaagtagctctaaaggacagacattttcctttccatttaaaaaactgagccrggtgcagtggctcacacctgtaatcccagctctttgggaggccgaggtgggtggatcacttgaggtcaggagttcgagaccagcatggccaacatggtgaaactccgtctctactaaaaatatgaaaattagccagccacggtggtgcatgcctgtaatcccagctactcgggaggctgaggcaggagaatcgcttgaacccgggaggtggaggttgcagtgagcagagatagatcatgccagtgcactccatcctgggtgacagagtatcaaaaaactgcttatcctttcatctaccagcctcaccaaatgctcttggcgtcaggtgattcactgcaacgttgacttaagggtgcttttaatgccaggtgcggtggttcatgcctgtaatcccaaatcccagcaccttgggaggccaaggcaggaagatcattgacatcaggagttggagacaagcctgaccaacatagtgcaacmccatctgtactaaaaatacaaaaattagccaagcacgtggggcmtgcctgtaatcccagctactcgggaggctgagacaaggggatcacttgaatccaggacgtagaggttgcagtgagccaagatcgcacccctgcactccagcctgggtgacagagactatctcaaaataaaaaagagtgcctttaattattaaatcgaagcaaatgtctttaacaattaagaatatacttaaccgggctccttcttgtttgctgatggtaacctccggggattctctctctgtttcagagggccccccccacaggaaacttcgcagtgatgcaccaggtatcatgccttcagcttcgcagctgtgtgttgtctcagtatccatttcttttctgcccaatgcgcccctctgcccaccccaatttttaaacccttgcacatttccaygagattcttgcaaaatctggaggcttggatatctttgtgcaaagctttcattgaaaccaagatcaggatgacaaatagacctcatctcttgacccactgtccttcctgcctctgggcagcacatgtgacatgacacccaacagtgtgcgcccttatcactgcatcttgacgagatggcagaggctgtgtgtgtagcttggatttttcttcctttcatrccaaaagccactcttacgtggttagggcactcagcagtgctgtcctcccttgtccagtgaagacactgcactgaatgaatatgacagttccactatctgggcacattcctggagaacgtacttggcttctagttggctggtctgggtcacaagtcagagatcacaaagttcacggtaactgcggcgcggcaaccagtcctcccatgattcagctttcacaggcttgtctgcgaaggaaatgagctcactgcgatgtctgacaaatgccgggggctgcacgtggcttgagtgatgtctagctacaaactgcattttcagcacacggggtggaagctgaccaccgcaaagccaagcacagtcctggcagagccttttctggaggcttcacgggcatgtacatgttcagggactggggagtggatacccaagactcaaggatgcacacagggcccttcccaagaaagcatgaagaggtctctgctgctctgggattttgcttttttttttttttttttttgagacggagtctcgctctggagtgcaatggcgcaatcttggctcaccgcaacctttgcctcctgggttcaagcgattctcctacctcagccttctgagtagctgggattacaggctcccgccacctcgcccagctaatttttgtatttttattagagacaggatatcaccatgttggccaggctggtctcaaactcctgacttcaggtgatccgcgcgccttggcctccccaaatgctgggattacaagcatgaccaacttttcacaggtgaagttaggccatgtggatctgacttcacctcatggagaggccaaaccaaccctcatttgtgtccatcttcatttttggagaatctcagctttgctgtcactaccaaaatacttaaagcgcagggtgaggtcttgttaagagccagttttgtgggggagcagatgagtttctaggacacttcaagcagctctcctaccagctgattgggatcataggataagccaaattccagggtgggctgaagtgcagaacccactggtcagtgggaaactgagtccttgcaaactagcaggtgcttacactcaagatgattcccgaggccttggataagctgagtccacgaatagaatccaaatgctaggccaggcacagtgggtcatgcctataatcccagcactttgggaggccgaggcgggcagataacttgaggtcaggaccagcctggccaacatggtaaaaccccgtctctcctaaaaatacaaaaattagccaggagtggtggcatgtctgtagtcccagttacttggaaggctgaggcaggagaatcgcttgaacctgggaggcagaggctgcagtgagccaagatcacgccactgcactccagcctgggcaacacagcgagactctatttcaaaaaaaaattccagattctccaggatcagaccctttaagaaaacctttaggggggtcccttagttcctgtaacaggtatagttggtgtcaaccttggtctaggatttgaaaccagttccaagaaaagcacttcagccaaaacagagtatcttgcaggctgacagccaagcaaggagcttcaacggcccagggcacaatgtatttcttaggtcaagggagcaaatttatccattaagcttttccagttagcaaatagactcttccaagagccaaaaagagagtgcctagagcactgatgtggaggttagggactacttcccagctcatcagatttttttttgtttttttttttggagacagtcttgctgtttcccaggctggagtgcagtggcacaacgttggctcactgcagccttcacctcctgggttcaagcaattctcctgcctcagcctcctgagtgactgggattccaggcgcctgccaccacgcacggctaatttagtatatttagtagagacggggtttcaccatattggccaggatggcctcgaacaactgacctcacgagtgatctgcccacctcggcctccccaagtgctgggattacaggcatgagtcgcagcaactggccaacccatcagggtttgaacctggagttaaaactgtgacgaagagagctgtgtggggagcgtacagggaacagtcaaactgctgctcctctgcrctgaatttgagcatccttctgagtcaagcgcttggaaaacagtgctaaaaaagaaaaagacttaagggtcacatctagagagagaaggatggagagttctctagtagggctgcaagtccagaagcttctctgtgaagctgggctaggagtgtttactttgragtggctgcagctttaagtatttattcctgatcgctgcactgcgggaagtcccatcctttatagccaggtgggctttcccagccggggtctctcccatcctctgtcaacaaaagggtcatttgcgaattcctcttctcagtgatcatgaatctctgggccttgatttttttttttttttttttttgagacggagtctcrccctgtcgcctaggctggagtgcagtggccacatctcggctcactgcaagctccgcctcctgggttcatgtcattctcctgcctcagcctccctcccgagtagctgggactacaggcacccgccagcacgcccggctaattttttgtatttttagtagagacacggtttcaccatgttagccaggatggtctcgatctsctgacctcatgatccgcccgcctcagcctcccaaagtgctgagattacaggtgtgagccaccatgcccagccgagttgttccttttgactaaagaattggtyactgagttgtgttcatccttatggcttcttatccaacccttgcgtggggagcaaaagtctgctctcttctttgatgtcctaaaataagacctgtcttccgattcaggtcaaacagggccagatggccagagcccaacataattatttgttgcggttgctgaaaagagttaagtgtttcttctgaacggtgaaggctggcagcaggcagatctgatttttccttctyctgcccactctcttcctcctacccaaagtctcccctcacgtgaccagcccttcctgtgaagtcgaggtgataaactcaagagagaaccagcgcagagaggagatggcagcattaaggagagacaggggtgtcctactggctggagctaaaatccacctcagaggccaggtgcactggcacacacctgtaatcccaacactttgagargctaagacaggtggatcgtttgaggccaggagttcaagaccagcctgggtcacatggcaaaatcccatctctgctaaaaatacaaaaattagccaggcgtggcagtgtgcaygtgcatgtagtcccagctactcaatactgaggctcaaggactgctggaactcaggaggcagaggttgcagtgagccaagatcatgccactgcactccagcctgggtgagagagactcttaaatttcttttttaaatccaccttgaaggccaggtgtggtggcccacgcctgtaatgccagcrctttgggaggccaaggtaggagaactgcttgagctcaggagttccagaccagcctgggcaacaatatcaagacctcatctcaatttaataaaataatccaccttggattaacacgtataatttccttttctaatattcactgggcacctgttttacgccatgtgcggtatgttccacgatcagcaaaacagatgcagcagtccctgcagtggggaaaactcagtccatgaacattcacaccagcagggggtgctgtctcgccttttaaccagggagcycctctgtgtccttctcaaggctgcccttgtccatttcaccttcttccaattcaaatcttgaaaactcacctctaaggcgaatgggggtgaggagatacagaagaaaaacagtatgttctctcttcaactctgccccatgggctatgaataaagtcagaagacaaaatcccctgcttggtttttggcgtttttttcctattctaaatcaaagaccacagcagaccagaatcctgtggcttctcaaatgaccaagcctgacatattgaaaagcagatcgtcttgctttgaaaaaccttctccacccacccccgmaaccaatttcagctgattaaattcaatcactcatgccttaagactggcaatgatttgttgacttcaacttgaatatctgcatcttatttgtgccgtgtgtgttttctgccataaaaaaaatttatattgcaataggactatagctacaagtttaaaatagatttataaaaaatctatcccaaccatgaagatttctttgctaaataatgtgttttcttacaacccacaggcgaggaaacgagacctctttcgttccttctagaaggtctggaggacgtagagttattgaaaatgcagatggttctgaggaggaaacggacactcgagacgcagacttcaatggaaccaaggccagtgaataagcaabtttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccarcccaggacttcgaggctgcaatgagctataattgcatcattgcactccagcctgggcaacagagaccctgtctcaaccaccaccaccaccaccacccctactacccctgtattsaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtyacatgaattgaaaaggagacgctgctcccacggaggggagcaggaatgctgcactgtttacaccctgactgtgcttaaaaacactttcactaataaatggttataaatcacaatgtcgttggcttttctgttgagctgttttctatagaggaaaaggagttggggaaggctgggttttgcttcatcgtcccaaagattctctgaagtcagggttaacgtcatgaatgcagaaactgaggcctagagaggtgaaatcaattgcctacaaccccacagccagccagagagcagagcagagatgcaaagtgagactgtctaagggggttactgggccgctcagcagggagggcaggggagagaaataaggtgatgtgtggtctaagggccactgccccctgccctcgaacatgactgggaagaacatcttgactcatcaaaaccagtatcttaagaaaaatacaggatttccttgattttttgagtkaaaacacaaggtcttgtccaatgagtcagcaaacactttccacaaaacgtcaratggtggctgggtacagtggctcacacctggaatcccagcactttgggaggctgagatgggaaaatcacttgaggccaggagttggaggccagcctagccgagagagacccccgtctctataaaaaaaaggtgtttttttkttgttgttgttagtaagccaggcaggatagtgcacacctgtactcccaacctcttggaaggctaaggcaggaggatcatgtgagccaggagttccaggctgcagtgagctatgatcacgccactgcactgcagcctaggtaacagtaacaccttgtctctcacaccaccaccaccacccacccagccagatagtattttagcctttacaggctacatatggtcttgccgaatattcatcttctttaaaacaacccttaaaaacataataaatcattcttagagtaagggccataaaaacaagctgtaggccctgtccttctttcagcttgagtgttttagacagacatgcctgcaaaggctctgttcaacacaaacgatgccgtataccaccaactccatgggatcagacagatttgggagacaggaaacatggaaacaaaggactccatmttgtgaccagatgctaatatgccttgaatgacgcacaaacacatcccggatacatttctaaaaacctggcttgaatagaaattttcaaaaagattttttcatattttttaacttggttaaaaaaagtttttcaccactctgtgggaaaacattaaagtataaacatacaaagcctctttgaccagaagcccaacaagttcaacattcgtttctcttgattttattgatcttttaaaaaaataaaaggacatcttctgtggatacaggttaggatgtttctagggtaagaaacccaccatygcagcgtaattctctgcggaatttcagtagcacttggaaagttctgttttcaacctgaaatttttgctgttcttccagaaaataacttagtaacaaaatgaaggccgtgaagctgcaggcacactccagaaattagtgtgttcttttaactcgtgtcccaaagagacagcagttcctaacatgcagtgatgagtggacacaccrtggtgcgttggaaatcccacgttcacgtctttgacaaggaagcctcctacaatgatcttgtgctttaattttacttgatggtcaccctggttacttcattatgcctttgaatgaagtcctgttcttagtggctgcattaccaaggccatcttgccccaaagacccctcagggtcctgaggcagaattccccccaccccaccaggggactcaggaaaatgaatgatcgcagtttgccaaaagaggtcagatttcccactgacgctggttggtctggaaaattactctgaaaactcgaacgcacctctaggaatctcaatgagaagctaagaagcaggctacagtctcagaggtttatgacacctttttttttttttttggagacggagtctcactctgttgcccaggctggagtacagtagcgcratcttggctcactgcaccctccacctcccgggtccaagcaactctcctgcctcaacatctggagtagctggaattataggcacgcaccactgcacccagctaattttttgtatttttagtagagatggggtttcaccatgttggccaggctggtcttgaactcctgacctcaggtaatccacccgcctcggccttccaaagtcttaggattaccggcctgagccaccgcgcccagcctattccagtttttaaaaaggcatgtgactgttaagttctctgttcttagacatgatttcagtacaccacaaagcactgggagattttgttctggaagacgattccacctggttgggagttggggggaagagcctytgagagaagctccatcccacatttacggagacttgggacattaaaaacacctgtcaagaccaatcaggggccaggcacggtggctcaggcctgtaattccagcactctgggaggctgaggcrggaggatcacttgaggccgggagttcaagaccagcatggccaacatggtgaaaccccgtttctcactaaaaatacaaaattagtgggtgtagtggcacactcctgtagycccagctacytgggaagctgagataagagaatcgcttgaacctaggaggcggaggctgcrgtgagccgaaattgcaccactacactccagcctggacaagacagggcaagagcatgactctgtctcaaaaaagaaaaaaaaaaaaaagaccaatcaggacctccgcttgggttagtgcaacacaatggggcatgggaacgatggctcatgcttgaaatcccagcattctgggargccgagatgggaggatcacttgaggccaggagttcaagaccacactgggcaacatggcaaaaccccgtctctattaaaaatacaaaaaattcagccaggtgtggtggtgggtgcctgtaatcccagctacctggaagactcaggaacaagaaccgtttgaacccaggaggcggaggttgcagtgagctgagatcacgccaccacactccagcctgggtgacagagcaagactctatctcaaaaacaacacggtagcctcatcaccgacaacttagagcccttcccagagagccccttttgtccctctttgcaatgcacacggtggcaggtaaggatgaaaagacatttcccagggacaaaccccagagcacaggtgatggcctcggtcattggcttgggccgcaaagctaactaactatggtgactgctcttatttctcaaactaacttaaaacaaaaacctagtgtaaaaagacgacaaaaggtaacgacttccgcaccaacaccaagaccttcagcttccgtggttttcctaaagcaacatcttgactaccccctgggctgacggcagcggcgatgaagacatgtgtgaaggcrgcttcccaaattccaggcgcttccccaaccttcagacagagcaaaccaaattaagctgacataacagctgtgacaaactggctagcaccggggcccagagagttataagggtgaacatcaagagtcaggagcagggtctcacagggtctcaattttctctcctgtgaaatgaagaagaggacactggctacctggctctcagattccaaggtcacacaaaacgcccagtctcagacccactagaaaaatccatctcttacctattgtttgtttgttttacagcctacgcaacatagtgagaccctgtctctatgaaaaatgcaaacaaaaattagctgggtgtggtggcctgcatgtgtagtcccagctacttggtaggctgaggtggaaggatygctggagcccaggaggcggaggttgcagtgagccgagatcacaccaccgcagtytagcctgggtgacagagtgagaccctgtctccaaaaaaaaaaaaaggccaggcatgattgctaacgcttgtaasccccagcacttgggaggtcaaggtgggaagatcgcctggaaaattaatctgaaaactcacctctagaaatctcaatgagaagcagactacagtctcagaggtgtattctcaaactcaaagccaggaggtttgagaccagtctgggcaacatagcaagactgtttctataaaatataaaaaaaattagccaggggtggtggtgtgcacctgtagccccagctacttgggaggctgaggcaggaagatggcttgagcccaggaggacgaggctgcagtgagctatggtcgcaccactgcactccagcctgggtgacacagcaaaaccctgtctcgtagaaagaaaacaaacaaaaattaatttttttttttttcttgagaaagagtctcactctgttgcccagagtggagttcagtggtgcaatcttggctcactgcaacctccacttcctgggttcaagtgattcttgtgcctcagccacccaagcagctgggactacaggcatccgcgaccatgcccggctaattttcgtatttttagtatagatagggtttcaccaygttgcccagtttggtcttgtgaactcctggcctcaagtgatccacccacttctgcctcccaaagtgctgggattacaggtgtgagccacttcactgcacctggcctaaaaatccacgtgtaaaggtctcaaagttatgtgcatgccatggaaaatattcttaatttcctgtcacgtgtctgctacaaacccatcaaattcctacggcttggggcccagagagatggtagtcacacaccttgcagaattcctgaatctgaaagctgccccttttttttctgagacaaggtctcgcttcatcrcccaggctggagtgcagtggctgggaacacggctcactgcggcctcaacctccagagctcaattgatccgctgccctcagcctcccaaagtgctgggattacaagtgtgagccactgagcctggccctgattttctttaggcaagaaaattaatgacactgttagagatcagatctgyactgtcccatcgggtggctggtttcaggaacatagtctgggctagaagttagtgccagtttctcaaaggttctacagatttaaaaagaaaaaaaagggctggttgcagtggctcacgcctgtaatcccagcactttgagagsccgaggtgggtggatcacaatgtcaygagatcaagaccatcctaacacagtgaaaccccgtctcgactaaaaatacaaaaaattagctgggcatggtggcacacgcctgtaatcccagctactcaggaggctgaggcaggagaattgcttggacttgggaggcagaggttgcagtgagctgagatcatgccactacactccagcctaggcgacagagcaagacgtctcaaaaaaaaaacaaaacaaaacaaaaaaaaaaacttcaggggaagcagagccatgactgatgctcaattccccaaataagggctttatttttatttaactaattaattaactttttgatatggagtcttgctctgtcacccaggctgctgtgcagaggcacaattttggctcactgcaatctctgcctccagggttcaagtgattctccttcctcascctcctgagtagctgggactataggcacatgctaccatgcctggctcatttttctattttttttggtggagatggggttttaccaatgttgcccagactggttttgaactcctgacctcaagtgatccacctgccttggcctcccagactgctgggattacaggcgagcgtcaccacacctggcccaaataagggcttttatacaggacattctcacagtgtaaccgtgagtagcagctgtagaatcaaatgataaaaatgaccttcttggccaggcatggtagcccacacctgtcgtcgcagcactttgggaggatgaagggtgaggatcrcttgaagctcagagtttgagaccaaactcggcaacatggcaaaacctgtctctagaaaaaatacaaaaaattagccgagcacggtgacacgcacctgtactcccagctactcgggggactgaggtgggaggatcgtttgagctgggaggcagagggtgagccatgatcctgccatcgtattctagcctaggtgacagagtgagaccctgtctcacaaaacaagaccctctctctagccctttgttcaagccacaagacaccacctaatgctgcctgcagggagcagaggagaggataaggtttgctgaaataatcctataatttaaaaagacacatggctgtgggctgggggtgagtgtctcttgcctggggcaggcgggttctccccgccagcgagaggtttattagaaggtactgaccccttatcacccaaaggcacgctggtgctgcttggccgtctctccccgccatctctgttcttgctgctccgcccagaggctgggccacctgttcggtttggggactgatcrtacacgaggttccggcaggaagcgagtttggactccagtgcctggacagaaatacacttttatctctcaagttataggcaaggactattctgtcttaccagagcctgtacagaagaacgaaccccagacagtggttctcaaactgttgtgcactggaattccaaggtgggaccccaagaggaatccaacgtatatgccagtctcagaaccaagcaccttaagtatttgggagctggctgggcacaatggctcacacctataatcccagcactctgggaggccaaggcaggaggatggcttgacatcaggagtttgagaccagcctgggccacaaagtaagatcccatctcagtttttttttttgttttgttttttacttttttagacgctgtgtcacccaggctggagtgcactggtgagatcacagctcactgcagcctcaacctcccaggctcaaccaatccctcccacctcagcctcctgagcagctggaattataggcatccgcaatcatgcccagttaataaaaaaaatttttaatgcaaaaaattttttttaattacgaaaaattttttaaaatgtttgggagctgcctggaaaaagatcacggctcactgcagcctcaasyavtccttccacctcagcctcctgaatagctaggactatgcacaatcatgcttggcttaaaaaaaaaaaaaaaattcttttttaattacaaaaaattttttaaaatgggagctttctggaaaaatcactaacctaccaattatccaactccgcttgtaggaagtaggaaatccacttctggaatccttcaccctttggtttaccttgttaaacctctgcagaatggcaagaagtttggtaaggacttggtctggctacaacagaccctgaggaaaccaaaaggacactgacagcaccccaggcttctctatactccaactaggctaaatactgaaatgcagacctgcttctagaatagcaaaccagacagccaaaaaccagaagtaaaaacaaaagaaatgagttgcaagcttctattaagttgtagctacaaatacactgtgtacagtgacaacttggtaggagttaaattatgtggccttctaggcatcatttttaaaaataaactacaaagaatacctatgtttttacttaagcacaaaaggatccctccctgtaattaacataaaagctgaaaggccaaattctttgccctaggctttcaagatttttttttttttttttttgagaccaagtctcactttgtcacccagcggtgcgatctcagctcactgcaacctccgcctcccggattcaaacaattttcctgcataagcctctcaagtagctgggatcgcaggtgcccaccaccattcctggctaatttttgtatttttagtagagatggggtttcaccatgttggccaggctggtcttgaattcctgacttcaggtgatccacccatctcggtctcccaaagtgtcaaaattcacttaaaccccaagaaacaaaccaaaaaaaaaaaaaaaaaaaaaaarggtggcagtttttttctcttctgagacaacgtcgtgctgtcacccaggatggagtgcagtgttggaatctcagctcactcagcctcaacctcccaggctgaagcaatcctcccacctctcagcctcctgagtagctgggaccaccagtgtacaccatcaggcctggctaatttttgcattcttgtagaggccaagtcggggcagggggtttcaccatgttgccygggctggtgtcagactcctgagctcaagtaatctcccaccttggcctcccaaagcactgggattacaggtatgagcacccggccaaaagagaaggcagtttccaagtgctccttaatttttcgagttaaggaaaaaacacasatatcaccctaatttcccaaatttcctagaggaaaaacggtaaaaggaaagagacatacatagggttcagagcagggcttcgagtcagagctctgagtgtctggcagtaactcccacaggaagctctaatgattcccagggatgctaaaggagcagccacacctaaaactcaccacactgctatgaaaggggctggacgcattggctcatgcctgtaatcccagaactttgggaggccaacctgggaggatcacttgaggccaggagtttaagaccagcctgggcaacacagcgatacccacattactacaaaaaaatgaaagtatcagccaggcatagtggcgcacacctgtggtccaagctcctcgggaagctaaggtgagaggatcgcttgaacccaggattttgaggctgcagtgagttgtgatcataccactacactccagcctgagcaacagagcaagaccctgtctctaaaaaaaaagaaaaaaagaagagagggaaggaactagatcaacccccttcacacatcctgaaagacaggcaggaaggcaccaaacgccaggaaagtgtggtcttaccccgactttccgcagtaggtctcccacaatgttgagggctgatatccgggcygcaggtgtgaggggggtccccccggtggagtcgtccaggcctgggtgtgcaaagggaagagcatgtaactcaccaacctatagtcatgtctgtgcgttaacatcgctagatccaaaaccacgggacaggagggacactgacgcctttcctcggatcccaaaagctaccctatttctttccgtagttaaccgcatcacacacccaaggcccgtatgacaaccaatttttcaagtccttgtgatgactgcaacaaatacttatttttacatgttagtcttgctctgtcacccggactggagtgcggtgatgtgatctcagctcactgcaacctccgcctcccaggttcaagcgattctcctgccttggcctcttgagtagctgggattatagccatgtgccaccacacccggctaatttttgtatttttagtagagacagagttycatcacgttgtccaggctggtctcgaactcttgacctcaaatgatctgcccgccttggcctccaaaagtgctgggattacgggcgtgagccaccatgcctggcctttaacaaattttttttttaatagagacagggtctcactatgttgcccaggctgatcatgaactcctagtttcaagcgatcctcccaccttggccgcccaaagggctggtatttacaggcatgagccaccgtgcccagccacattagtctttttaaacaaacccaaaacaaatccttttgaaattgtagaaaatccatatagttaattaacataatggcatctgtgatagatacaagaactatagacaggatgatccagctttacaagggtcccgctctgcagagcctctcttctccaagtggggtccatgcaccagcagcacatgagaactgttagaaatgcagaatctctcggccaggcacagtagctcacacctgtaatcccagtgctttcagaggccgaggcagttcgatcagttgaggtcaggagttcaagaccagcctggccaacatggcaaaatcttgtttctactaaaamtacaaaattagctgggcatggtaacaggtgcctgcctgtaatcccagctactcgggaggctgaggcatgagaatcgcttgaatccaggaggcagaggctgcagtgagccaagatcaatgccgctgcactccagcctggccgacagagcaagactttgtctcaaaaaaaaaaaaaaagagagaaagaaatttcaggccccacccaagacccacttgatctgaggtacattctaccaagatccccaggtaagctacatgcatattgaagtgtggaaacatagccaggcatggagttgcatgcctctagtcccagctactcaggaggctgaggcaggaggatcactggagcccaggagttggaggctgcagtgagctatgattgcaccactgcactccagcctgggccacagaccaagactgtgtctctaaaaacaacaatgaaataaagtatgcaaaatggctctagactggggctaggcacagtgactcatacatgtaataccaccactttcaggggctgaggcaggcagatcacctgaggtcagtagtttgagaccagcccggccaacatggtgaaaccccatctctactaaaaatacaagattagccaggcatggtggtgggcacctgtaattcaagcttactcaggaggctgaggcaggagaatcacttgaacctgggaggagggggttacagcgagccaatatcgcaccattgcactccagcctgggcaacagagcaaaactccatctcaacaaaactaaacagaagggctctgcaccggaattctagaagtctcactggtctcttcatgcccaggggacaagctaagggataaggtagtagatggtagggtaagccctggagcctgcctgcctgggtctgaatcccaaaccatctgccattcaattgcttcatgactctgcttaactcagagcctcactttcatcaaacggggacagcacctgcatcctgggcctgcggcgaaggctgcaggctggccagcacacactgagcactccttaactgtctgttattaatatctgctgtaaaaggcctgatcggaagctgtcagcagaggggctggggtgagaactgagattctttttttctgcccatgcagcacacgttacgctgagtctagctctcggtggatgtattactaaacccacagaacgctttttacttttttgtatttggtcagtgacatttcaaatttgggaggttttatattcaacaagaggatttttgaccaggcgcggtggctcacacctgtaatcccagcactwtgggatcagccgaggtgggcggatcacttgagtccaggaatttgataccagcctgggcgacatggcaagactgygtctccacctaaaatacaaaagttagccagrtgcctttagtcccagctactccggaggatgaggtgggagaatcacttgagcccacgatgaagaggttgcagtgagccaagatcacgtcactacactccagcctgggcaacagagtgagatcctgtctcaaaaaaaaaaacccaacaaaaaaaaagaggatttctggctttgaagaatggaaaaagctgcagatgaagggccaatcctcgtagctgcagagtggcagccacccgctctgggtggggtttccatttcatcagactccactactgcctcttacccagtcctcactgatctcaatgcccatccccaagaacatcccagtctactctctgctcaaagcctgagagcaaatcaggctctgagcctgatgcaaatcatcacacccccaggacccaccccagattcttacccagaaacactttgtgaaccgagaaaatcctgcaattcccactccccttaccacgtctgaagctcccaggtgtgtttaaacttgagctgggtcctcggtgagcaatgggcgtggacggcacggagcccgtggcctgcacagctgtgtctgtcctctcagcttccactgagctgggcatgggggtcctgggtttctcctgcttctgctgcacggccagttcctgccgcaaatctgtgccagaaaaaggattcaggaattcaagtcctcagccaggcgcagtggctcatgtttataatgccagcactttgggaggccaaggcaggtggatygcctgaggtcaggagttcgagaccagcctgaccaacatggtgaaacctcatctctattgaaaatacaaaaattagcccagcatggtagtaggcacctgtaatctcagctactcaggaggatgaggcatgagaatcatttgaacctgggaggccagggtggcagtgagctgagattgctccagcgcactccagtctgggtgacaagagcaagactacgtctcaaaaaacaaaaagggaatttaagtccttgcttagggttggtggggtgcagggagagaggttcaacagtagataccagtcagaaaaaagacctactggggtgaaacactccaggtagaaaccccaaataaagggaaacccacaggaccttgccyagcagacttggaactctacaggatgtttctcttgactaacaaaatggtttcagatttttaaaaagctatgacagtgacacactaatgcttttattattgaaaaaacaattccaacatagcagtgtatttagaacactaaatgaaaatatgcccgggagcagtgactyatgcctgtaatcccagcactttgggaggctgaggtgtaagaatcacattaatccagtargtcgaggctgcagtaagccatgatcataccacttcagcctgggcgagagtgagacctctggctcaaaaaaaaaaaaaaaaaaaaaaaraaaagaaaaaaaaaaaaaaaggccagttgcactggctcaagcctataatcccagcactctgagaggtcgagatgggaggattgcttgaggtcaggaattttcaggccaacatggcaaaaccccgtctctattaaaaatacaaaaaattagccatgcgtggtggtgagcgcctgtagtcccagctgcttgggaggctgaggcaagacaatcgcttgagcctggggsacaagcagtgagtgcagtgagctgagatcacgccactgcactccagcctgtgtgacagagcaagactgtctcaaaaataaataaagtatgctttccagactatccccaaatgctcctcctcactcatcatcaccataacatgtgggagagcttttcaaccattgttctctgaattttttttttttttttttttgagatggagtttcactctcttgcccgggcttaagtgcagtggcacagtctcggctcactgtaaatctgcctcccgggttcaagtgattctcctgcctcagcctcccaagtagctgggattacaggcacgcaccaccacacctggctaatttttgtatttttagtagacacagggtttcaccatgttgtccaggctggactctaactcctgacctcaggtgatccacccaccttggcctcccaaagtgctgggaatacaggcgtgagccactgcgcccagctgttctctccattttcaaacataaactttatacatatgtatgtatctactgagcataaaacaagaaaattttttattaagcattactggaaacatacaatatgttgtcctgtgtatgacttactctccccacttcagtggtatgtcttggcaatgatttttgttttagagacagggtctgactcagtcacccaggctggggtgcggtggcacaatcatagctcaatgtaaccttgaactcctgggctcaagtcatcctcccacttcagcctcctaagtagctggaactacagacatatgccaccaggcctaatttttacaattttcatttttgtagagatggggtatcactatgttgtccaggctcatcttgaactcctaggctcaagcaatcctcttgcgtccgtctctcaaagcactgagattacaggcatcagccactgtgcctagccttggcaatctttctaccacaacatttctatctactgttcattttaaccattaacatttcacaaaatacatctatgtacttcatttaaccacttcattactgatggacatctaggaacaactactttattaaacttaagaatttttactttttatcccccacctactggttacacattagaaagcaaatcgacgttataaataattaattgggccagcaacagtgacccacccctataatcccagcactttgggaggccgaggcaggcagatcrcctggggtcaggagttcaagaccagcctggccaacatggtgaaaccccayctctattaaaaatataaaaattagccaggcatggtggtgcacacctgcagtcccagctactcaggaggctgaagcaggggaatcgctgaacctgggaggcagaggttgcagtgagcagagatagcaccactgcactccagcctggacaacagagcaagacgccatctcaaaaaaaaaaaaaaaaaaaaaaaaaaaggtaaaaacaacttggacaatccactaatgaatgtcttttttttttttttttttttgagacaagagtctcactctgtcacccaggctggagtgcaatggtgtaattttggctcactacaacctccacctcccaggttcaagcaattctcgtgcctcagcctcctgagcagctgggattgcaggcacccaccaccataccctcatgttttctatttttagtagagatggggtttctctatgttgtccaggctggtctcaaactcctgagctcaggtgatccacctgcctcagcctcccaaagtgctgggattacaggtgtgaaccactgtgcctggccaaatgcctcattacagtttcaacattctacctctggaagtgccaactgaaaaagagcaaatgctgatgaggtttcaaagttttagccaaatatattggttgccatcaagtcacaaaaataataggctagctggcaattccaccagaaatttctccccacaacatctttgcttcttaagagacagggtctcactctgtcacccaggctggagtgcactggtgccatcatagctcactgcatactccacctcctgggctgaagcaatcatcccaccttggcttcctgagtagctgggactacaggcacatgccatcacacccagctaatctttaaatgtttttgtaaagatggagtcccactatgctgcccaggctggtctcaaactcctgggctcaagagatcctcggcctcccaaagtgctgggattacaggtgtgagccactgtgccagatctccccacaaaactctctgttcctactgagcatcagggtagtttgctgtgtttgtgaattacagaccaggaagcatctttctggaaataaattctgctgcccagaggcagaatcccaatacaaggacttcatctgtgaaccccaaagctatttctctaaatacccataaggggcccttacagggctggatgtctgactgttctcagctccagccagggcccaaggcaagagtctgcccagtgcagtccgacaccctctgattagacaacctgggtgcagagcagggtgtggggtccctgtaaagataatgctgggagagcttgtgggacaagatgttgctcaggtagggagaggggaccatgctggtgaagacaccaaggcctcctgacctctggcttcatccttcagtctctgaacagattccaggagattctctttttcatcaagttcactttccaggaaggcatttctttcgatggcctgattcaagcgctgctcaaagtcttcgagagacatgatcgtggcgctggcgaagagaaaagcagagttatccaagaggacaaacsgcagcatccctccagcaccrcggatccaggaggtgcgaagggtcagacacacctgggcacaagtcccagccccaaacttcctagatgccacagagtgggmcaagtcccttaaccttctggggcatgggctctttaccygcagaatgggactcatcatagctcatggggtgcacgaggctgtcatgaggattaaataagatgctgcccacacagcactcagcaataagccaaagccctatcaggactgcatgtggcatttggtggtttgagaagaccactatgctccatcttctcttgcaagctcacaatgccaaccagcattaaaaataacctaatatgactgggcaaggtggctcatgcctgtaatcccagccctttgggaggccgaggcaggtggaagacctgagatcaggagttcaagaccagcctggcaagcttgggcaaatggcaaaatcctgtctctactagaaatacaaaaattagccagttgtagtgtaatcccagctacttgggaggctgaggtgggagaactgccaggaagcagaggttgtagtgagcccagattataccactgcactccagcctagacaacaaagtgagactccatctcaaaataataataacctaataaacacatataacaacatgattttttaagacacaggtttttgctgtgtctctcaggccgaastgcagtggtacaatcacagctcactgcaatctcaaactcttgggctcaagagatcctcccgcctcagcctcctgagttactgagattacaggcatgaggcattgtgccaggcataagatgcacttaagcaggtrgaagagatcatatttaacctctcagtggaagttcaaaatgcccagtaccagcccagctgccctgctcacaaccccttcttgtgaagggcataaacactgtggtaaaggcactgccaagtgctgtaagaaaacaatctgttataattctgggaaaaccaccttctctgcacctcagttttctctcatgcaaaacaaggatagtaatagtaaccttcatgcaggattgtggtggggaaggggtggcaagaagtcatacaggcccggacacggtggctcacgcctgtaatcccagcactttgggaggccgaggcgggcggatcacttgaggtcaggagttcgagaccagcctggccgacatggtgaaacctcatctctactaaaaatacaaaaattagccgggcatgatggtgcacacatgtagtcccagctgctcgggagggtgagacaggagaatcgcttgaacccagaaggtgaatgttgcagtgagccaagatcatgccactgcactccagcttgggcaacagagtaagaatgtttcccaaaaaaaaaaaaaaaatcctacaggaagcacacaacagatgttttacacataagcacacatctataaattttcagcaatttttattattgaccctgtgtctgtccccagaccttacacaacctgctaactgtatcccacagtggtcagaagcacgtgtttggagaggaacccaggagttaacacccagctcctcctccacctagaactcactgagtatcattgcggaacttgatctccttcatcctcagttccttcaatcaccaaattaataactgcactgattaatggctgcatcagttcatttattcaacatatcctactatgtctagatggagtcatacaagtacctaccctcacagggtctttagaagtagtggataggataaagttaccacagtaccgattaaaaacaacaaagggacaagcacagtggttcatgcctataatcccagcactttgggaggccaaggtgtgaggaccgcttgaggcccagggttcaagaccagcctgggtaatatagagagaccctgtctctacaaaaagtaaaaaaattagccgtgcatgatgcgtgcctgtagtcccagctactcggaggctgaggtaggaggactgcttgagcccaggaattcaagggtacagtaagccatgactatgccactgcactccagcctgggtaacaatgccagaccctgtctcgaaaaacaaaaacaaaaaacacactactaccaacaacaaagggataatacttcggagtacaataccagaaacagttaaaacagccctaaggttgacatatcaaagataaaatattcacataataatatgtagagtagtacagaatgcttgcagaaatgcagacatactgagtatataaagaggaagacccattatcatgcagaaattaattctccacaagttaaactgataaatttaacactgtcttaatacgtttctactgggggaataaactggactgatttgaaagatcctgtgacaatgaaacaagaatgatcagaggaactctgtaaaagagatcagggaactagctctaccagagagtcagaacgcactactataaagcctcaacaatgaagaatagtatgctactggttgtaagaacaaaggaaccaaaggtccagaaatagacaagagtttaatttataataaaggtggcatcacagatcattggtaaaaagatggcaggttcagttctagttttagggaccactgggtacccaccaggaaaaaattattagattcgtacctcatactgtaccctaacacaaactccgactgaatcggaaattttaacaaactccttatttggtcaaaatctattttgcttctggaatgctagggaactggggaccagcttcagtgccttttttttttttttttttaagatggagttccactcttgtcacccaggcggagtgcaacctctgcctccggggttcaaatgattcttctgtctcagcctcccaagtagctgggattacaggcacgcaccaccacatcctgctaatttttgtatttttagtagagacagcattccaccatgttggccacgctggtctcgaactcccgacttcaggtgatgcacctgcttctgcctcccaaagtgytgggattgtaggtgttggacaccatgcctggcccttcagtggcatttmtgaatttccctgcaacctcgacaccctgggtttaagtcatcctttcacctttttttttcttttttgagatgaagtctcactctgttgcccaggctggagcgcaacagcacaatctcagctcactgcaacctccgcctctcgggtacaagcgattctcctgcctcagtctgtcaagtaactgggattacaggcgcctgccaccatgcctggctaatttttgcatttttagtagagacagggtttcaccatctttgtcaggctggtctccaactcctaacctcaggtgatccgcccacctcagcctcccaaagtgctgggattacaggcgtgagccaatgcgcccagcgattctttcaccttcttacctcaacctcccragtagttgtgaccacaggcacaagctaccatagccggctagtttttatatttgtttctagagacgggagtctcactatgttgcccaggatgtcctcaaactcctgggctcaagcaatactcaagcctcagcctccccaagtactaagatgacagattacaggcatgagctatctcacctagcgtatttactttgaaataaaggtcagcatgctagttgtaactggagtgaaaattgctttatgtattttatatgttgaaattctgtcaactaatgtataaaagcatatttagtgcctgtaatcccagcactttgggaggctgaggcgggtggatcacaaagtcaggagatcgagaccatcttggctaacatggcgaaaccccatctctactaaaaatacaaaaaaattagccggttcgtggtagcgggtgcctgttgtcccaggtactcgggaggctgaggccaggagaatggcatgaacctgggaggcggagcttgcagtgagccaagattgtgccaatgcactccagcctgggtaacagagctagactctgtcttaaaaacaaacaaaaaaaacccatatttagtataacagcaaaatattgcaataatttgtgactatgaaagctgttaatttcatgtgcagttattgagaacctgaaaatacttaaataggaaaacagattttcagtaaatataaagagatatactggttagataactaagaacatatcctttttgagccaaaaaatgctttaaaagtccatggaattggctgggcacagtggctcatgcttgtaatcccaacactttggcaagccgagatgggaagattgtttgaatccaggagtttgagaccagcctgggaaacactgtgtgaccccatctctttaaaaaaaaaaaatgtgtaagttggactgggtgtgagagctaacggctataatcccagcactttgggaggccgaggtggtggatcgcttgaggtcaggaccatggtgagaccccatttctactaaaaatagaaaaattagctgggcataatggcacatgcaatgtagtcccagctactcgagaggctgaggcaggaaaatcatttgaacctgggaggcagaggctgcagtgagctaagatcgcaccactgcactccagcctgggctacagagcaagactctgtctcaaaaataaataaataaaataaaatgaaaaacttatgaaaagagtaaaactagattaaatctatttgaatttttgtaaaactttttggcatcttagtactcatatgaaacaaagtaacctttaggaaatgtatttaatttttagttacttccaattaggtcctgcacacttttcaaggttattcttatacaaagtgcctgtcctcagttaaaagtgagtagtttcgtttgagggacrtatagaagaaggaccatgagagcaatcaaacagctgatggtgctgagaaactcttgttcttggagaagactgtcaaacgttctaaatataactattaaacttgcacaaaattgtaacattttcaagtctttaaaataaagctttggagcctaggcaacatggagaaacccggtctttacaaagaatacacaaattagtgagtcatggtggcacatgactgtagtcccagctactggggaggctgaagtgatcgtgccactgcactccagcaggggcracagagagagaccttgtctcaaaacataaatacataaaactttggtgacctagaactttattgattctataatggtgaactgggcttctacctcatccgatttttaacactaaactattcagcatttggccaaattgtattaacaaaaacaatgcacgtttagtacaaaaataaaaatagaaaagaaagaaaaaacaaaaatactacaagaaaacacttggctaattgctttataaaccttggagtgcacaaggcccttctaactatgactaagaaatctgactacaaaaaaatcaaataccagcctggccaacatggtgaaaccccatctccgctaaaaatacaaaaattagccaggcgtggcagtgggcgcctgtaatcccagctacttgggaggctgaggcaggagaatagcttgaacctgggagggtggaggttgcagttagccgagatcctgcacctgcactccagcctgggccatagggcaagactctgactcaaaacaaaacaaatcagtaactctgtacaataaaatatacatcagacaaagctggaaacaaatgacaaactcccaatactgtccattcatgtcacagacaaatatataaaaatctcctagaaatcatgggaaaaaaaacaacgaacaacccaattttaaaatatgccaaaggccgggtatggtggctcatgcctataatcccagcactttgggaggccaaggtggacagaccgagtccaggactttgagaccagcctaggcaacatggaaaaaccctgtatctacaaaaaatacaaaaattasccaggtatagtggcacatgcctatagtcccagacactcaggaggctgaggtgggagaatcacttgccccaggaggtcaaggctccagtgagctgtaattgcaccayggcactctactctgggcaayggagcgaggcccagtctcaaaaaaaaaaaaaaaaaaaaaaaaaaaaaaaaaggcagtgtttaacagtgctggcacaactgggctatccacctaaagaaaataaaaataaaattgaacttgtatcttatactagatacaaaaataaattcattgcagactaaggaataaggatacaaaaaaattaaacaattaaaaaatattgcaaaaaaaacacaaaacacatgaacaatcaagaaccaaggagacttccctagtgaaatctgcaaacctagaaggtatttaaaaaaagatgtaactgatgacctaaaaatgaaaaatacatgtataaaaaattttttttcaaaagagaaaaaaggaaatatttgtatggaaaatgatasaatagacaaagtcaacaaacaaaagattaccacggaaaaaattattttcaatgcaggagaaaagattagtagtaaaaatatacaaagggccaggcacagtggttcatgcctgtaattccagctttgggaatctgaggcaggtggatcacttgaggtcaggagttcaagaccagcctctccaacatcgcaaaactccgtctctgctaaaaatacaaaaattagccaggcgtggtggggggcgcctgtaatcccagctacttgggaggctgaggcaggagaatcacttgaagcaggaaggcagtggttgcagtgacctgagatcacaccactgaactccagctccagcctgggagacagagcgagactccatctcaaaaaatatatatatgcaaagaactcctacagattgacaagaaaggaatttccacttctggtaatgaccaggaaacctgtatcagatcaaacctcgtataaattctaagtaaaatgtttacaacaataatctgagtgcactggcaggaactggaaaacaacgcttagaaaaacagaacaagactgggtgaagtctgcatctttacaagatttttgcctaaagctccagggatagaaatctatcaccgtgggcccccccacattctgaatatagtatcttcccacatctctggcctcccccaaaccacacgtgcacagagcagacacaaagcagcccagttacggctaaaaaaagcaaagagatttcagctactgcccatcaaaggggagacagaatttgggctgtaagctcagccaagtaaaccacctaagaaaaccaaataaatcaagaacataaaagaattcatcatctctggctgggtatggtggctcaagcccgtaatcccagcactttcggagaccraggcaggcagatcacctcaggtcaggagtatgagaccagattggccaacatggtgaaatcccatctctactaaaaatacaaaaattagccgggtgtggtaacacacacctgtaatcccagctactccggaggttgaggcaggagaatcacttgaatctgggaggtggaagttgcagtgagcagagatcgcaccactgcactccagcctgggcgacagagcaagactgtcttaaaacaaaaacaaaaacaaaaaacaactaatagtctgtgggaaacaccacgtgggaaacaccactcacactgcctacaatacaaccccaaagttattgaatgcgtggagtataaagaaaatgtgacccagatgttgaaaactgcacaaaaggacctcaaagcagctcttacaactatgctcaaggatgtcaagaaacctcaatagaacagaaattataaaagaacaaacacaaatcctacatctaaaaatacaatatattgaaaattcaatatttcatctgctataatggcagattggagagagaagagggcgtctatcaacttgaaactggataaacagaaattattcaatttgaagaacaaagacaaaaaaataattagggaaaagaaaaatgaagagagccttaggaacctgcctgacaatataaaaaggttatgtgtatagatggcgtccgagacggacaggagaaaaagaatgaggcagaaaaaaaactctctgaggaggccgggtgcagtggctcatgccagtaattccagaactttgggaggttgaggcaggaggatcacttgctcccagaagtttcaggctgcaatgcactatggtggcaccactgccctccagcctgggtaacagagcaagaccctgtttccaaaaataaatawaagaaaaaacatctgtgctttttttgtttttttgttgttttttgttttgttttgtttttgagacagagtctagctctgtcrcccaggctggagtgcagtggcgcaatctcggctcactacacgctccgcccttcccagttcacatcattctcctgcctcagcctcccgactagctgggactacaggcacccgccaccacgcccggctaattttttgtatttttagtagagacgggttttcaccatgttagccaggatggtctcgatctcctgacctcgtgatccgcccacctcggcctccaaaagtgctgggattacaggcgtgagccaccgtgcctggccacatctgcgcatttcactgtatataattcatatataaattttttaaaaacaagtgttcttatccaaaaaaactgcttggctgagagtaattcttctgtaaatgttagtcattatcattctgctaaaccacagaacatcagtttaggaatcactgggctgggcgcagtggctcacacctgtaatcacagcactttggaggctaaggagtttgagaccagcctggccaacatggcaagagcccatccctactaaagatacaaaaattagaatggtgtggtggcacgtgcctgtaattccagctactcaggagcctgaggcatgagaattgcttgaatccaggaggcagggattgtagtgagccgaaatcacgccactgtacaccaacctggcgacagagactctccgtctccaaaaaaaaacaaaaaactgttctttgaaaaagcttccttcccaccttaggggcttagcacaggcttggtgttctgtctggaatgttcttgtctcacacccctcctggcatcatggctactcattcctctggtcttagcctaaatagcatttcccctggtaaggctcgcctgacgctcccaggccaacagccaaattaatacatcctattacacacccccacagcaccctgggctgccagccttgctgctgtaatgaaattgcacttcttcgactattgtccatttccccccgggcactaaaatccagaagggcactggctttgttctgctcactgcttagttccctatactcagcacagggcccagtacccagctgctggggacaaaaagcagagaggagagtctcccactcgtgcttttcccttccacccataccgcttggctctttccaggtcgtcatttgcttgctccagctctctgatgtatttctgcaattggtctttaatggctttggtctgcgcgaggtcatcctccaaggctgagatctgccggtagccttcagagtgctgcacttcaaacttctcctgaaggacaacacagacactgagtgaatgacttaagacttctgagaaggctagacrcagtagcacacatccacctggagtcacagctactcgggaggctaaactgggaggactgcctgagcccaggagttagaggctgcagtgagctatgactgtaacactccactccagcctgggcaacacagcaagactccgtgtttttttttttttcttttgaggccgagtctcactctgttgcccaggcttgagtgcagcggcaagatcctggctcactgcaacctctgcctcccaggttcaagcaatgctcctgcctcagcctcccaagtggctgggaatacagccacccaccaacaatagtggctaatttttgtatttttagtagagaccgggttttaccacgttggccaggctggtcttgaactcctgacacctcaagtgatctgcacgcctcggcctcccaaagtgctgggattacaggtgtgagccactgcacctggcctgaccctctctctttatgaaactactcctcccaccacactccctgggtggggctccaggctttctgtcccaccctcccaccacaatcgggagacaagccaggctcagtcaacagaaccttctctccagagctgactcttaggcaagtgatgtaacgtggtgggaacaggcaggtgtcattcaaagcaggcacaacggaccaactgttttaattatgtcctgagtgcctctgccccctgagcaccttgaatcttgcctactctcaacagggttgagattcctatagcctccatcattcttcmgacaaatcattctacccaaggtgtccacagccaaagcaagccacgtaaacctctccaagcctcatccacacggcaacatgggcctccttcacacatatcatcagtgtattacaaagagagtcaccagcccggctcacagagtgagacctggcctctacaaaaaataaaaactagcagggcatggtggctcttgcctgtagtcctagctactcgcraggctgaggtgggaggaccattcgagcctgagaggtcgaagctgcagtgggctgtgaaggcaccactgcactccggcctgggcaactccctgctgcctcaaaaggaaagaaatcataatgacgtccgttgtttgtgcccacaacaatgggagggcagcatgaacttggttttaaaacagtccgccattctgaatttttgatccaggactccccgttgtgacatggagaaaaaaggaacagtttgatctctaggttatttaaaaacataaagacaggccaggcgcagtggctcacacctgtaatcccagcactttggagggctgaggtgggcggatcacctgaggtcagaagtttgagacctgcctcgaaaacatggtgaaatctggactctactaaaaatacaaaaaaattagccaggcgtggtggtgcatgcctataatcccagctactcagaaggctgacgcgggagaatcgcttgaacacgggaggcggaggttgcaccactgcactccagcctgggcaataacagcgagactctgtctcaaaaaaaaaaaaaaaaaccagaaaaacaaagaaagaaagaaaaagaaggagggagaaaaggaggggataaaatgggggagggagagagaggagagaggaagggagacagaggagagaggaagggagggagagggaaggaaagggagagagatctatgttaattaccaaaggaacagtccagctgacttctcaatgattccctgttgccagctgcagcaataacatccattacatacttattctgtgccacctccaggctaagtacaccacctatgttgtctcattaatcccactttggagacatgaacactgaagctcagtgacctgactagcccagaatcaactggtagcaaatgactgagccaagatcaaaccccagcctcctgagcaggtgtccttaagcaattatgctaaccagccccaaaccatttcaatccagatcacctgcccactcccgagctctcttgattctgttccggctctgcttccaaattactttccttcaccaaacacccagagccaggtgtggtgcctcatgcctgtaatcccagcactttcaggtggcagaggcaggattgcttgagcccaggagttctcgaccagcctgggcaagactctgcctctacaaaaaatgtgaaaacagccaggcgtggtggcatgcacctgtagtcctagctacttgggagggtgaggcaagaagactgcctgagaccaggaggttgaggctgcagtragctatgatcacgccgctgcactcccgcccaggccacagagtgagaccacgacacttaaaaaaaacaagcaaaaaaaaaaaaaacccaaaatcaccagcctggcaacatggcgaaaccccgtatctactaaaaatacaaaaaattagctgggcctggtggcgggcgtctataatcccagctacttgggaagctgaggcaggccaatctcttgaacccgggaggcggaggttgcagtgagcccagatcgtgccattgcactccagcctgggcaacaagagcaaaactctctggcagtggtgggggactgggagggggcgggcaggcaggcacactgaataactgtttcaattatgtcctaagtgcctcccacctcctgccccttgagcaccttgaatcctgcccactcccaaacctggttcccacaatcttcagacaaatcattgtctgaagcccccagcaatcttcagacaaatcattctgcccaaggtgtccacaaccaaagaaagccacatggacctctccaagcctcatccacaggggcaacgcaagcctgctttcacacattatcaccgtattacaaagagtcaccagcgtggcccacagagccagactcagtctctacaaaaaataaaaattagcagggcatggtggcgtcgcctgtagtcccagttaggaggctgagatgggaacaccatttgagcctgggaggttgaagctgcagtgagccgtgattgcatcactrcactccaacctgggcaacagagtgagacccagctatctcaaaaagcaaaaaaaaaggaatctcaatgacttctgttgtttgtgcccacaacaatgggagagcagcatgtacttggtttacacaacagtcaattattctgaatttttgatccaggactctccgttgtagcatggagacagaaagaacattccaatctctgggtttaaaaacaaagacaggccgggagcagtgacccacacctgtaatcccagcaatttgggaggctgaggcaggtggatcacctgaggtcaggagttcaagaccagcctggacaacatggtgaaaccccgtctctaccaaaaatgcaaaaaaaaattagccgagtgtggtggtgygttgtctataatcccagcyactcgggaggctgaggcaggagaatcgcttgaacccaggaggcggaggttgcagtgagcagagattgtgccactgttctctagtctgggcgacgaacaagactccatctcaaaacaaacaaacaaaaactaagacagaagggagggagaagatggaggaagggaaagggagagaaaaggagaggagagagacagagagggagatcttgttaattaccaaagaaacagtccagygcacttctcaatgattccctgttgccagctgcagcaataacatccattacatacttattctgtgctggcctccaggctaagtacacttcctatgttgtctcgtttaattccacttcagagacatgaacactgagactcaattacttaactagcccagaatcaaccagtagcaaatgactgggccaagaccaaaccccagcctcctgagcaggtgtccttaagcaattatgctaaccagccctaaaccatctcaatccagatcacctgcccgttcccgtgctctctcgattctattcctgctctgcttccaaattactttccttcaccaaacacccagagccaggtgcggtgcctcatgccgcaatcccagcacctcaggtggcagaggcatattagcctaggcaacataggaagactccatctctacagaaaatttaagaacagccaggcgtggtggcatgcacctgcagtcctagctatgggggaggctgaggtgggaggactgcttgaggccaggaggttgaggctccagtaaactatgatcatgccactgcactctagcccaggccaacgcttaaaaaaaaaaaaaaaatcaccagcctggggcaacatggcgaaaccaaaatacaaaaattagcccggcatagtggtrcacggctgtagttccagctacttgggaggccaaggcgggcagatcacttgaggtcaggagtttgagaacagcctggccaacacggtgaaacccccgtctctaccaaaaatacaaaaaatagctgggtgtggtggcaagtgcctatggtcccagctacccgggaggcaggggaatcgcttgagcccgggaggcggaggttgcagtgagccaagattgtgcccctgcactccagcttgggtgacagagaccccatctcaaaaaaaaatcaaaaccgaaaacacaaaacacccatcctagattctacaaacataagagaaaacacttcccacaagaaaggcgcaaggtctaatttaaaagttaaaaaaggccaacttctctttactcaatcaagtaaacaaagccgttgctagaaagtccggatgcacccagggtgatgtaatggtgcctaggccagagaggcgtggcgagagccattgtgcaagaagactccaaagaaagaacaaacagatgatttacagcgttggaaggatgaggagggcggaccacatccctgctgccgcccgcagcaccctccccatttcctggctgtaagcagagaagtatctgcacccagcaagtagaggcagaccaggccctgttcccaggcgtggctctcatcgcctcacaccctttatttgggaacatctccaaataaaacaggatcttaagtcattaacctaaattcaaacgcaggctccaggaggacgcagcgagtgggctccaccgactgcactggcgattgagagatctcctcggaacctgtggacatgaaaacctgttgctgaaatgttgtgctgccatttggggctaattcgaataagctgtcagctgatgggggcatcaatagatgctctgtttggtcccttaaaggctttttcattcaacccgtgatgaataagccagttgttaagaagtccggcccagctgaatatatttctcttaggtgactgacaaatacttgctggtggcagggtcctcgttattccaaggtaccctgtttcttcactgtgctgtgtgctctgagtctcctgcatctgacatgtggctgcagtacagtggcgcaatctcagctcactgcaacctccacctcctaggttcaagcaattctcctgcctcagcccccgagtagctgggactacaggtgtgcgccaccatgcccagctaatttttttatttttagtagagacggggtttcaccatgttagcgaggacagtctcaatctcttgacctcatgatccgcccgcctcggtctcccaaagtgctggcattacaggcatcagccaccacgccaggcccaagagctcagtcttgaagcagagaattastgagtaattctcttgatattttactcaggatccatggagggcctgttatcctctccaaactgcagttcataccactaatcttcctcctacccagcttttcaacccagagtccccttcaatttaggaactataatcagccaggcgcagtggctcacacctgtaatcccagcactttgagaggccgaggcaggcggatcacttgagctcaggagtcccagactagcatgggcacatgaacccgtctctacaaaaaataacaaaaattagccaggcgtggtgtggcaggtgcctgtaatctcagctacttgggaggctgaggtgggaggatcacttaagcctggaagtcagaggttgcagtgagctgagatcacaccactgcactccagcctgggtgacagggggagactctgtctccaacagcaaaaacaacaacaacaaaaagaacgataatcattgctcattgtgtgtagcaggtgttcagctgttaacaaatgggtgaagtgggccaagtacagggagaggcagatgacactaaggtctccgtgtcacggatatggggattgggggaaactcaacratgtgtgttctaaacaaccactactcaggttttttattttttaacttttgctctgtcacccaggatggagtgcaatggtacaatcatagctcactgcagcctcaacctcctgggctcaagcaatgctcctgcctcagcctcttgagtagcttagactacaggtgtgcactaccatgtccaatgaattttttrtttttatttttttgtagagacagagtctcgctatgtygcccaggctggccttgaactcctggtctcaagcaattctccctcctcagcctctcaaagggctgggattacaagtatgaaccaccatgcctggccagaaatccatctttttacaggaagctttacaaattttgatggatgggggaatatatataataaaaggcaagtaagtaggggaaatattattggtagagcctaggtggtggtggatacacaggtattcactggaaattctttcagccttatatgctggaaaacgttcatggggaaatgctgaacaaaaacccctgaaggcgatcaaacaacacctatggggcagatggatctgcagacggccagctgcactctgtggtctccaacagaaagcttcagcttcaatgaccaccttcaacgtgtctgggacctctcctccgccctgccccaaacccccaatccatttgttggtcccacaccctttcctatacattagtaaagctgggcttgccaaggtccacccgacacccattcttgtccacgtctgtgatgggtacagatcaactctccttcagccccatctccccaagcaccaagtgtcagcaacacatacacctacaaacaccctccacacagcctccctcaacccatgcagtcctttctttttctttctttttttttttttttgagacagagtttcgctcttgttgcccaagctagagtgcaatggtgcaatctcggctcactgcaacctccgcctcccgggttcaagtgattctcctgcctcagcctcccaagtagctgggattacaggcacatacaacaacacccagctaattttgtagttttagtagagacagggttttgtcatgttggtgaggctggtctcaaactcccaacctcaggtgatctgcccacctcggcctcctgaagtgctgggataacaggcatgagccaccgcacccagccagtcctttttctcttgaaaggcccccacatcagagttctgtgactgagcttcacgtccccaactgcttcatggcattaggtttgtcttcccaaagaaggcaaccagcacttcccctttcaccgtccatcatacctagccctgggcacmcacagttttgactcttccatgaagcagctcatcaaaatgtacattgggagtttaatgagaaaaagaaaaccacacagacatgccagggccccacccagacttactgagaaatggaatctcagagcaaggcggggagatggggatggggagagagggttcaggcctgtcggatgtttatgaagctggcctagtgatgctggctggcagctaaggctgagagccagtctctggggcacggtgttgacttagtgatcccttgctgagccctacagcatgtacagaagggatggtttttaccttgcagagcactgggtctccagatacctggctatgtctagaggtgcttttggttttcaccaccttggaggtgcggggaatgctactggcatctagagggtggaggccagggatgctgccaaacatcccacagtgtggtcaggcggggtgactcatgcttgtaatcccagcactttgggaggctgaggcgggcggatcacctgagstcaggagttcgagaccagcctggccaacatggtgaaacctcgtccttgctaaaaatacaaaaattagccgggcgtggtggctcacacctgtaatcccagcactttgggaggctaaggcgggtagatcacactgtcaagagatcaagaccatcctggaaaacatggtgaaaccccatctctactaaaaatacaaaaattagccaggcatggcggtgtgtgcctgtaatytcagctactcaggaggctgaggcaggagaatcacttgaacccaggaggtggaggttgcagtgagccgggattacgccactgcactccagcctggcaacagagtgagactgcgtctcaaaaaaaaaaaaaaaaaaaattagccaggcgtggtggagggtgcctgtaatcccagctactcaagaggctgaggcgggacaatcacttgaacctgggaggcggaggttgcagtgaggtgagattgtgccactgcactccagcctgggcaacagagcaagactccatctcaaaaaaaaaacaggctgggcacagtggctcacgcctgtattcccagcactttgggaggctgaggcaggcggatcctgaggtcaggagatcaagaccatcctagctaacacggtgaaaccccgtttctactaaaaatacaaaaaatttagccaggcgtggtggcaggcgcctgtagtcctagctactcgggaggctgaggcaggagaatggtgtgaacctgggaggcggagcttgcagtgagccgagatcgcgctactgcactccagcctgggcaacagagcaagactccatctcaaaaatacaaaacaaacaaacaaaaaacccacaaagcaaacctcagtccctcccaacggaggatgatccgggctccaatgtcaacagcagccaggtcgagaaacctgctctgaactggcagagtgcaacacaccttttggtaatgaaggaaatggtctgcagcccctctgtccactaaggaaactcactggccacacgtggctcctaagcacttgaaatgtggctactgtgactgaggaattaagtttttattttaattcattaaatttcaacagccaaatgtagctaagggctacaatattggacctgatgatattactctagcaacacctccataccctaaaaatgtctccctggccaggtggtggctcatgcctataatcccagcaatttgggaggccaaggcaggaggactgctcgcgtccaggagttcaagaccagcctgggcaacacagcgaaaccctgtctctataaaaaatacaaaaactaaccaggcatggtgccgcatgcctgtagtctcagctactcccgaggttcaggtggaaggactttggttttttttgagacggagtctcgctctgttgccaggctggagtgcagtggcacaatctcagctcactacagcctccaaccatcaagtgattctcctgcctcagcctcccaagtaagctgggactataggcgtgtaccaccacgcccagctaatatttgtaattttagtagagacagggtttcatcatgttggccaggatggtctcaatctcttgacctcgtgatctgcccacctcagcctcccaaagtgctgggattacaggtatgcaccacctcgcccggcccaggtgagaggactgcttaaacctgagacgtccagggtgcagtgagctgtaatccagccactgtactccagtctgggcaacagagcaagaccctgtttcaaaaaaaaaaaaaagtctccctgccatgtgccctataaaatcagtgtacacaaccaagaaagtccacgggaacatgtgtgtgacttgcttctcaaagctccacccatcatggatcccgaggtcaggagttcgagaccagcctggccaacataaaaccccgtctctactacaaatacaaaaaaaattagccaggcgtggtagcaggcgcctataatcccagctactcaggaggctgaggcaggagaattacttgaacctgggaggtggaggttgcagtgagccaagatcgcgccactgccctccagcctgggcaacaagagtgaaactccatctcaaaaaaaaaaaaaaaamaaaacaaaaagcaccacccactagaggcacaaagagttcaaagatcacgtctgccscacaggcccttccagagatgagcatgggcctggggtctggagtccctcattgcagkgttccttcttccagccaagcatgccatgcctgtgttggacgcctgtctacacctgagcacacttcctctcagcccctcaccttgatggtttccagctccatgcgaaggcggttattttcggacaggaggtctctgttcctggtttcaatttgttgcagctgcgtctccaattcagcttcatattctcggcttccctcctggaattctcggagttcctcttgcgtattttctgccctacagcaaaattgttaatcatcacgtagtaatatttttgaagacagagtctcgctctatcacccaggctgcaatgcagtgctgcaatctcgtctcactgcaacctctgctttccaggttcaagcgattctcctgcctcagtctyccgagtagctgggactacaggcatgcggcaccacacccagctaatttttgtatttttagtagtgacggggtttcaccatgttgsccaggctggtctcgatctcctgactggaggtgatctgcctgcctcggcctctcaaagtgctgggattacaggcgttagccattgtacctggccaaattcaaggaatattttaaaaatatcaagcctgaattacctttaagtcaaactagaataaagaaagtaggaagggctgggtacagtggctcattaagaattacttgaggccaggagttccagaccagccagggcaacatagtaagacctcatctctacagaaatgtgtttaaaaatcagccagacatggtggcacacgcctgtagtcccagctacctgggaggctgaggcagaaggatcacctggggtcccaggggttgcagtgagataggtcacacttgtgaagagccagtgcaattcagcctgggtgacagagtgagaccctgactctaaaataatttttatttatttatttgagatagagtcttgctctgtcacccagactggaatgcagaggtgtgatcatgcgtcactgcagcctcgacctcccaggctcaagcaattctcccacctcaggctcccaagtagctgagactataagaacatgccaccatgcctgctaatttctgtattttttgtacagacagggttttgccatgttgctagagctggtctcaaactcctgagctcaagtgatctgcctacccaaagtgctgggattacagatgtgagccactgtgcctggacctaaaataatttttcaataaatgaaagaaactaaggggactggaataaggcctctatgtacaaattataaagacccattataaataaaaacagtgccaaaccaaacgcacacacacacacctcccagatatgagccctgaccaaaacacgagtttcaaatcttaaaatctttagcaatrtattttgctaggcatagggaaaagctctttccctgtgcacaaagaacttaccagatatggcatctaggaactgataaaaacccttctagaaaataagatggacaccgggcgtggtggctcacgcctgtaatcccagcacttagggaagccgaggcaagtggatcacctgaggttgggagttcgagagctgcctgaccaacatggagaaaccccgtctctactaaaaatacaaaattagctgggcatggtggygcatgcctgtaatcctagctactcgggaggctgaggcargagaatcgattgaacccaggaggtggagcttgtggtgagccgagatcatgccattgcactacagcctgggcaagaagagcgaaactccatctcaaaaaaaaaaaaaagaaaataagatggaaggccaggcatggtggctcatgcctgtaattccagaactttgggagggtgagacgggcagatcacgtgaagccaggagttcaagaccagcctgaccagcatggcaaaaccccgtctctgctaaaaacacaaaaaattagccaggcgtggtggtgggtgcctgtaattccagctactcgagaagctgaggcacgagaattgcttcaacccagaggtggaggctgcagtgagccaagatggcaccactgcactccagcctgggcaacagagtgagactctgtctcaaaaaaaaaagaagaaaaagaaaataagaaaacaaaatgtaaagtagcatagtaggataatcaggaccataggtctggagttcaaattccagctctgctacttattggctgtgtgactgtgagcaagttatctgccttcactgaggctcagtttcttcatctatataatggggtgctaatagttttttcacaggcagttttgagatagtgtaagttaagcctttcacactgcctggcacatataggcctgcaataaatggttgctgttctttttatagaaaaaagagagctcacacctgtagtcccaacactgtgggaggcagaggtgcatcacttgagtccaggagttcaagaccagcctgggcaacatagcgagacccctgtttccgccaaaaaaaaaaaagcctggcctgrtgaagcacacctatagtcccatctacttgggaggctgagccaggatgatcgcttaagcccaggagtttaaggcggctgtgcactatgatcacgcctaggaacagccaccgcactcagcctaggtaacatagcaggaccccatctcaaaaaaaaaaaaaaaaggaaaagcaggtgaactcggactgacctctgtttgtaggtcatcgccagatctttccaatagttagcttcttcctcctcggagctgaaagtctttccggagtcctccattgtgaaaacaggggaagagatcactctccttgtggcatggtgtctaggagagaaggtttcaaaatgattacccacatctggttaaacagctgatcccctttaacagaaaaaaaaaaaaaaacttggccaggcgcggtggctcacgcctataatcccagcactttgggaggctgaggcgggcggatcacgaggtcaggagatcgagaccaccctagctaacatggtgaaaccccgtctctactaaaatacgaaaaattagctgggtgtggtggcgggtgcctgtagtcccagctactcaggaggctgaggcaggagaatggtgygaactcaggaggtggagcttgcagtgagccgagatggcgccactgcactccagcttgagtgacagaccgagactctgtgtcaaaataaataaataaataaataaactttatgctgggttaaatgattaaatactgccaaaaatctgaagctaaacccaaacaaaacacaatccactcacctgttatattccctgggttaacatcaaggctcatggatatccctatgcaaatatttattgagcacctactaaaggacctagggagccacataaaacgtctccaagatgcctgccttccctaaaggggcctcacagtctggtggagggagtgggggagtgggggctggaatggaaattacgcataaaataataattataattattatttgagacagactcttgctctatcacccaggctggagtgcagtggcgtgatctcrgctcactgcaacctctgcctcctgggttcaaatgattcttgtgcctcagcctcccgagcaactgcgattttacaggcatgcgccaccacgcctggctaatttttctatttttagtagagacagggtttcaccatgttggccaggctggtctcaaactcctgacctcaagtgaaccacccacctcagcctcccaaagtgctggtattacaggcgtgaaccaccgcacccaaccccatgtaaattatgataaaactatgtgcctagtatagccacagaaatgtgcacaggattttgacatgcaataaattgcatatatttgagtatacacattggtgtgttctgaaatatgtatgcacctgaaaatacatttctatcagtgcccaggatatttaagaagttcaaaactcaacccgaaagtcaaggaaggcttcctagaagaggcgacacatgaggagcatgtgaaagaatatgaaaaagccaggtgcagtggctcacgcctgtaatcccagcacactgggaggctgaggcaggcagatcaygagggcaggagttcgagaccagcctggccaatatggtgaaactccgtctctactaaaaaaaaatacaaaaattagctgggcstggtggcgggcacccatactcccagctactcaggagactgaggcggtagaatcacttgaacctgggaggtggaagttgcagtgagctgagatcgtgccgctgcactccagactgggcgacagaatgagactccgtctcaaaaaaaaaaaaaaaagaatatgaaagaactggaaggcaatggtaattgagcaggggaagaaggaatgaggagaaacagccaggcacttgtaggggagctagagggagtctggtaagcctgggttgaaaggtgacgagtggaagggaacctacctggacagactgaaataaaggggctaagtcacagacggcttttgcaagatgttaagaaacttagtggcaatgggaaaccattggagaaagttagggaagagagtgatgtgatatgatgggctctcctgcttaaaaagctggtcctggtggccatggacaggcagaggaaggacaaggcctaagatggggagctcctgcagcaatgcaagaaagaaaggaaggtggaggccaggtgcagtggctcacgcctataatcccagcactttgacaggccaaggtaggcagatcgcttgagcctgggagtttgagaccagcctgggtaacatggagaaactccgtctctactaaaaatagaaaaatatcagccagctgtggtggcacatgcctgtgttcccagctactcaggaggctgagatgggaggatcacctgagcacaggaggcagaggttgcggtgagccaagatagtgccactgcactaaagcctgggtgatgaagtgagatcctatttaaaaaagaaaagagaccaggcacggtggctcatgcctgtaatcccagcactttgggaggccgaggcaggcggatcatgaggtcaggagattgagaccatcctgtctaacacggtgaaaccctgtccctactaaaaatacaaaaaaattagctgggcgtggtggcaggtgcctgtagtcccagctactcgggaggctgaggcaggagaatagcgtgaacctgggaagcagagcttgcagtgagccgagatcacgccactgcactcaagcctgggygacagatcaagactccatctcaaaaaaaaaaaaaaaaaaaagaaaagagaaaggaacgtggcctgaattagaaagtgagaataggccaggtacagtggctcacacgtataatcccagcactatgggaggccaaggcaagaggaccacttgggaccaggagttcaagaccagcctgggaaacacagcaagaccctaccttgacaaaaaaactttttaaaaaattagactggtgtggtgcaacacatctgtagtcctagctactctggaggctgaggaaggaggatcacatgagtccaggaatttgaggctgcagtaagctatgatcacggtactgcactccagcctgggcaagagagtgagaccttgtctaaaaaaaaagaaagtaggaatgaagatggagggaacagaaatggactccaaaaatatttagaagscaaacttaccagaacttgatgaattatgacttttcggggcaggggagagagaaaaaggaggtgaggacatcttctggggctctaccttaggcaattgggtgccgccaccatccccatcaccagagataaagacttccagaaggtggctgggtgcagtgcctcgcacctgtaatcccagcacattggtaggccaaagcaggtggaatgcttgagcccaggagttccagaccagcctgggcaacctggtgagaccctatctctacaaaaaatacaaaaactagctggtcatggtggtgtgtctgtagttccagctactcgagaggatgaggggcaaggagaggtcgaggctgcagtgacccatgaccatgccactgtactccagcctgggcaacacagcaagatcccgtctcaaaaaaaaaggacaatcaaaaggaaaactcggccgggcgcggtggctcacacctgtaatcccagcactttgggaggccgaggcaggtggatcacgaggttaggagatcaagaccattctggctaacatggtgaaacactgtctctattaaaaatacaaaaaattatccaggcctggcagcgggtgcctgtagtcccagctagtcaggaggctgaggcaggagaatggcttgaacccgggaggcggagcttgcagtgagccgagatggcgccactgcactccagcctgggygacagagcgagactcaaaaaaaaaaaaaaaamaagtaaaactcttgggtaggtgggtgggttaaggagagataacaaacccagtctcagacattcacagcttgacatgtccatgacacaccaagatgcaatatcgcagctgaaactcagggttgaaattgggtcaacaatatccatttgaaagtcatgcgtctatagctggtttttctcttttcctcgtgaccatggaagaatcgcctagggactgtgtatggaacagtgaagaatgccaatattggaaaggtgggcagtttaagaaatggtaaccgaaggaggcagagaagaaacagagtgagagagatgagaatcaggaagactgtgctgtcctgggagtgggcggtttcaagggaaaaaagggaaasattccagtgtcacaaggatgcaacagagaagcagggaagataagggctggaaaatatccacaaggctgagcgaaagtcggtcactggcggtgtgagcaagaacagtttctacacagtggaggaggaaagacgaagaactgagtgcaggagtaactgggaggtgaaaaagaggaaagmgatggaattctggagaattacctaaaagacgatgaaataaattagccaacagctagaggatgtgggcggtaggggccttggctctcaggactttgagctgtttcacagcagaggtgagggaagcaattttttttttaagagatagggtctcaatctgtcaacccagctggagtgcagtgacacaatcatagctcactgcatctttgaactcctaggcggcactgatcctcctgcctcagcctcctgactagctgggactacaggtatasgccactacgccaagctaattttttttttaagagatggggtcttactatgttgcctaggctggtctcaaattcctgggctcaagcgatcctcctgccttgtactcccaaagcactaggattctaggtgtgagccaccacacccagcaagaaagcagacttctattaacagttgggctaacggtttgtatactccctgttgatagaggctgtttgatgtaatcacctattttctgaatttatttgaggctctgagcttgtcaaaagggcatgaggaatccaagtaagattgtgtccaggccagactcagtggctcgcatctgtaatcccagcactttgggaggccgaggcgggcagatcacaaggtcaggagtttgagaccagcctggccaatatggtgaaaccccatctctactaaaaatacaaaaattaggcgggcgcagtggcaggtacctgtagtcccagctactcaggcggctaaggcaggagaattgcttgaacccaggaggtggaggttgcaatgagctgagatcgtgccactgcactccagcctgagtgacagagcgagactccgtctcaaaaaaaaaaaaaaaaaagattgtgtccaaggccgggcgcagtggctcacacctgtaatcccagtactttgggaggccagggcaggtgaatcacctgagctcaggagtctgaaaccagcctggccaacacactgaaaccccatctctactaaaaatataaaaattagccgggcatggtggtgtgcgcctgtaatccccactactcgggaggctgaggcgggagaatcacttgaacccagaaggcagaggttgtagtgagccgagatcgcaccactgcactccagcctgggtgacagagtgagacttcctctcaaaaaaaaaaaaaaaaaaaaaaaaaaaaagattgtgtgcaaggtcccttccttccctcaagagaacttagaggctggtgtgtatccctggggacaaaagaatgagcaaaaaccatcactttctaagatataaccaacaagctatatagttttggttaaaacatgaaatcattaggctaaacatgtaagtgtcaacacagacaccaccactaacttctggtggaagttagtgagcctcacccatgttgagccaatgacagaggtgggcctaattcatgcagaaccaggaaatgcacaattgtacctagattcaagcacaaaacttaccgataactctgcatttgttgggactcatattcacatcctttctccctcctactttttcaatcctttccctcattcagagaaaacatgctatttcccgacccactcatccctctggaaagcagattctctgaaagtttgatcaaggcagaaaggcgaaatgtcatacaaagctggccagacgtggtggctcatgcctgtaatctcaacactttgggaagctgaggcaggcagatgacttgaggtcaagagttcaagacaagcttggccaacatggtaaaatcctgtctacactaaaagcacaaaaattagctgggtgtggtggcaggcacctatgatcccaactactcgggaggctaaggcatgagaatcgcttgaacccgggagccagaggttgcagtgaaccacgatcacaccactgcactccagcctgggcaacagagcaagactccatttcaaaaacatataaacaaaaaataaataaatgtcatataaagctaatgatttgtagttttgcttgttttttccagacatgcattcatttttccatcttctgtgacagcacaatattcccttgggagaataccctactcatttcatgagttcagagggatctgacatcatcctccacacctgggaagaggcatatgcctattcacgaccttagtgatcagctcatgggtgggcctaacccacgatgagccagtgacagaggtgggcctaattcacgcagagccaatgatagggtgagcctaacccccatgctcagccagtgacagtcacggatctaacccatgctgagccaatgattggcttaaggatgggcctaacccatactaagccagtgagggcccaggtccagaccttttgcatagctgtcaaaaatgaaactctctttccactagggttggtaaggtaagcctgaagctggaggtaagcctgaagccggaggtaagcctgaaactgccggtggtcatcttgctatcacaagggagagcctgcctcagagtgaagccaaaacagaggaaagctgggccaagggatggagagcctgggtcctgacaatatcatttgaacacctagatgcagccacacctgatttaaggttatgagataatcaattccttgtcttggttataccagttggggttagatttctgccacgcaggaatcttaatgaatgtatggaatcaacgaccttacttgctcaaagtcaaaagggtagagtggtgcctggcgcaatggctcatgcctgtaatcccagccctttgtgaggccgaggcagacagatcacttgaggtcaggagtttgagaccagcctgggcaacatggtgaaaccccgtgtctactaaaaaaacaaaaacaaaaatcaaacgggcacggcggtgcgtgcctgtagtcccagctactcagaaggatgaagcaggaaaaatcacttaagcctgagaagcrgaggctgcagtgagccaagatcactgcattccagcctcccagcctgggcgacagaacaagaccccatctcaaaaaaataaaaagggggtagagtgttaatagcagtcattaacaaggccaggagcagcataaacctaggccaaggagtccctgctcaagccataagctctaatgagcccagatctcatgtaatatgtactcatcaaaccaattctatagcaacaatagcccagggccaaggcatctatcaatgagcactgtgtggccattaagatattggtggctgggtgcgttggctcatgcctgtaatcccaacactttgggaagccaaggcgggtggttcacctgaggtcaggagttcaagaccagcctggccaacatggtgaaactccatttccactaaaaatacaagaaattagccaggtgtggtggcaggctcctgtaaccccagctactcggaagactgaggcaggaaaatcgcttgaacccaggaggcggaggttgcagtgagccaagatcacgccattgcactccaacctggacgacaagagtgaaactctgcctcaaaaaaaaaaaacaaaaaaagacattggtgatactattgagggcagtctcagtcccatggtatggaaggttgtcagcatacaataaagtgcggaagtgaggaaccagtaacaacaamagcagaatgactcctcctgaggtttggaaaaagatgtgcaagatccaatgtgatcaggcccctgcatagttttctacacatttcttaccctaccacctctcattcacttatgtcccagccacactgccttctttctcttcyttgaacacccaagcctggcagggtgctgtggctcatgcctgtaatcctgatactttgggaggccacagcgggtagatcacttgaagccaggagttcgagaccagcctggccaacatggtaaaaccccatctctgctaaaaatacaaaaattagctgggcatggtggcacatgcctgtaatcccatctactcaggaggctgaaacagaagaawctcttgaacccgggaggtggaggttccagtgagcagagatcctgccactgcactccagcctgggtgacagagcaagactccatctcaaaaaaagaaaagagtaataataataataataataawaaaagaaaagagcctcttaaaacactgttatcttggccaggaaggtttaaaaacttaatcctcaggaaagaaatgaatctgagatgctttaggaggtgcgtctattgtggggcaggttctaattacaacgggccaatgggagggatctggttttggatttcaaggactgaggagaaaataagcagagaactggatttgtatcacagcctgcaaaatctttcactccaaccaagagacaaaaaccacaggaacagcatttcaaccaaaaactcttacattttaaaagcaatccttagggaagagagatgctggaagcaaagaaggaagaagtaacagctgcacttcactttatcataaaacagcaatctttttttttctttttctttattattattatactttaagttttagggtacatgtgcacaatgtgcaggttagttacatatgtatacatgtgccatgctggtgtgctgcacccactaactcgtcatctagcattaggtatatctcccaatgctatccctcycccctccccccacccyacaacagtccccagagtgtgatgttccccttcctgtgtccatgtgttctcrttgttcaattcccacctatgagtgagaatatgcggtgtttggttttttgttcttgcaatagtttactgagaatgatgatttccaatttcatccatgtccctacaaaggacatgaactcatcattttttatggctgcatagtattccatggtgtatatgtgccacgttttcttaatccagtctatcattgctggacatttgggttggttccaagtctttgctattgtgaataatgccgcaataaacatacgtgtgcatgtgtctttatagaagcatgatttatagtcctttgggtatatacccagtaatgcgatggctgggtcaaatggtatttccagttctagatccctgaggaatcaccacactgacttctacaatggttgaactagtttacagtcccaccaacagtgtaaaagtgttcctatttctccacatccttaaaagtataagatttttgcctttgccattcaaaaatgtcagagagaggccgggcacgatggctcacgcctgtaatcccagcactttggcagactgaggtgggcagattgcttgagcccaggagtttgagaccagcacaaggtgaaccccgtctctactaaaaatacacaaatcagcagggcgtcacgatgcacgcctgtagtcccagcactttgggaggctgaggtgggtggattgcttgagcccaggggttcaagaccagcctgggcaacatggtgaaaccctgtctctactagaaacacaaaaattagccaggtgtggtagagcgcacctataattccagctacttgggtggctgaggcccaagaattgcttgaacccagaggcagaggttgcagtgagcagaaattgtaccactgcactccagcctgggcacaagagcaagactctgtctcaaaaaataaataaataaacaacatgaaaacrtcagaaagttctattgcagtactctctgtggcagaaagcaggcaacatgacttgcaagggttctcttattttatcagcattaagtactgaatttgaccttctgtttgctgtgtgctagacatttcaaaaattgtttgcaaacattatcttctttaagctgtgtgactgtaagagatggctaaacaggacaaccactctgtttcttggaagcaraaacaccgtatgccttggccatctctaaatgtgcatgtgagcagcagaggcaaactagatccaagttcaagggatctttgcattcaagtccaaggcttcccaggggttgcaaactgactgactgcagatcagattcacttgtttcatttggtccagttttgttttttttttttttgttttttttttttttgagtcggaatctctttctctgttgcccaggctggagtgcagtggtgtgatctcagctcactgcaacctctgcctcgcagcttcaagcgattctcctacctcagcgtccctagtacctcggattacaggtgcatgccaccacgactggctaattttttgtatttttaggagagacggggtttcgccacgttggccaggctggtctcgatctcctgacctcaggtgatctgcccacctaggcctcccaaagtgctgggattacaggtgtgagccattgcacccggccctcacatagtgttttaaaaggcactgtaataggcaagtgttaatgcctggtctcagtatatacaactttgcacctgctatcttaaaaatgcaccccacatgcatttatttcatctgtgtgccactaacctgcgttcttaatacgccaccacaccatcatgccccagcagctctgtagacaaatctgatgggatcatgcaaggaacaatgacaaactaggacccagtggtacaaaaagtatctattttgcacaacagagatctatgcctccttcaaaaatttgtttccggccgggtgtggtggctcatgcctgtaatcccagcactttgggagggtgaggcaggcagatcacctgaggtcagcagataagagaccagcctgggcaacatggtgaaaccccatctctaccaaaaacacaaaaaaattagccaggtgtggtgatgcacacctgtggtcccagctactcaggaggctgaggtgggaggatcacttgagcatgggaggcggtggttgcagtgagccgagatcgccccacagcactccagcctgtgtgacagagcgagaacccgtctcaaaaaaaaaaaattgtttccacatgctttttttttttttgcatgttttacatgattaaagctaacaaaaaagtctgaaaatacactcgagacacacacctctgattttaaaactctggaaaaaagcaaagcaatctctttcagctttcctctgagagaagaaacccagcactgctagtcaggagcaataaacatacagaaaccatcgataattactcaacacccttctccatccccactccatatccttcccaatcaaaacaaacagaagagcaggagggaagagaaagaagctgccaaatgtccacacatgctccgacagccaggacgcaggctttgcattttgcaggagtgacatcactggggcaacatcagtcaagagtcagcaagcctggcttctgtctttgtgctttccaagtttacaatgatcaacctacaaaaatacttaggcaggcaaggacccatgttcaaagatgcacaccatcattcackaatgtggaaaactggaaacctcaatgtcaacagaggactgaatggaaaacgatgcagttgttaagaactgtaagtactaatatggaagaaagctcaggatatgttaaaaatgggtgcccatttttgtttatttccctctctctgtacacagaatagaaaagggtctggaggatgcaccagaatgggggtaaagcaagccctgtggatttgtacctgacaccttgctttaaggtaaactacatacacatatatacagtaagcatagatcgctttagagattttaaaaagcttaggccaggcgcggtggctctctcccaccccggcacgttgggaggctgaggcggaaggatcgcttgaacccaggagttcgagaccagcctgggcaacatagtgagaccccaatctctacaaaaaattttaaaaattagccaagcatggtggcatgtgcttttagtcccagctacttgggaggctcaggcaagaggattgcttgagcctgagaggtcgagactgcagtgagctgtgattgcatcactgtgttccagcttgggcgacagagtgagatcccgtctcaaaaaacaaacaaacaaaaacttggacaaaaagtaaaatagctattgttccaggataattttattctactgaaccaagtgacagggaaagaatttttcctactgtggttttgcctcctccaacccttttcaaacatttcttgaatacctactaagtgctgggcactgctgaaggaggcagacaaaaagcacccacatccattgcacgaggtgcacgtgtagtactaactgcaggcacaaactttctgtacacaggaatgctcatgttaggaaattaccttgtgaggaaaaggagtgtcaattctcggctcacattctaaggcaaaagaacacactttgggctgcatgcagtggctcatgcctgcaagtaatctcagcactgtgggaggccaaggcaggaggactgcttgagcccaggaatttgagaccagcctgggcaacaaagcaagattctgcctctacataaaaaataataataatgatagagtcgggtgcagtggctcatgcctgtaatcccaacactttgggaggctgaggtgggcagatcacgaggtcagaagtttgagaccagcctggccaatatggtgaaaccccatctctactaagaattagccgggcatggtggcacgcacctgtaatcccagctactcaggagggtgaggcagaagaatcacttgaacccggaggactgaggttgcagtgagtcgagatcatgccactgcactccagcctggacaagaacaagactccgtctcaaaataaataaataaataaataataaataacacactttggaaacaaaaataagtcaagttaataaactgttatccaacatgggataaaatatatgaatcacaggcccctgagacttcagcggcacagatcatctgcatttaatcctacacaaaacacacactaagaggaaaggctcaaaatgggttgtaggccggcacggtggctcacgcctgtaatcccagcactttgggaggccgagggggcagatcacgaggtcaggaaatcgagaccatcctggctaacacggtgaaaccccatctctactaaaaatacaaaaaattagccaggcgtggtggcacgcacctgtagtcccagctactccggaggctgaggcaggagaatcgcttgaacccgggaagcggaggttgcagtgagccaaaatcgcaccactgcactccaacctgggcgagagtgagactctgtctcaaaaacaaaaacaaaaaaaamaaaaaaaaaacgggttgtataccaacgaggtgatggaggctggggtggtcgggtaacaagaggctttaggagtagctgggatctaattaatcttcaaaacacccgacccatgtcctaaaatgccatcctatgctagaatacactataacaaaactaaaaatgatgaacctgcctaggtcgtgctgcaaaggccttttctttagaaagttaaaaggggcctgaggctcaaagtagaaattaagaggcacaacctggtagtaaccacggacaaagcaatcaaggaagctcaggccctcaggaggcagaaagcctgagatggctcggagaagataaagtcgcctccccaaaagcggtgtcaaggtgacagcggggtttcccaggacctcagagactcaggtcctcagtgagcccagccatcactcaagctgcggaataagcattttcgtcctttacccaatccctccccaaagtgctgtcagaagaaacctgaaccgtcctgcggcagagacgggagcaaagcggagagcagactgccccaaacgtgttcccggagggagggagcagggtgggtttttggaaagaggcctgcaggggcgggacagtgggtgtgagggcaggggcaacgctgcaatcgaggggtctggggtcgcagagaagsgggtggcaggatggaggaataggagagagagagaaaagaaacgagggtcatctaggagaggagtatggggaggaaggaagaggagaaagaggatggagcctggcagcggggtttggggaccggcaaggcttaaccacccaggaagtcccggaaggagaagagggcaacggggtgggagagagaccaacgcagaaagagaaacaaagttgccaagggcgaggggccagcgcgaggaacgcaccggtggcaaggcactcagtgcctaactttttaggacgggaggctccagggaggcgggattttggagcccagggaccgggggagtccaggcggccgggaagcgacgcgcaagcgaggggcgtaggggtccctgccaggcggtggcccggggtcccgggatcctggggcggggcagaggagcttttcagccgcggtggaggtccccggacagccaccccgaccccagccccgcgcagcgcctcacttacccgagcaggggcggcgaggccaacgcggcggcggcggcagaggcggctgcgaagggcggtgcggccccggccctccggaccccgcccccgccccggagcctgcggtcggcgcctcccattggctgctgctctacggtaccgcgtccgcctcggccaatcagcgcagagcagcgtcgtttggaaacttttttcccaggccgggcgcggcgcggccaagcggcgaaggctcctggccggagggggtttgagaggcgccggctgccgggcgctgggctgcggcgggctggcgggcattggagatgctgcagaacgctgcctggacacccgggaaacgggtttgggcttgcgggccgcgcatttcaggaaaatacgccggcctctccttcacttcgattgcattttcccattcttgcactttctccaaatcagaaggaaagacaaagattcaggcccactgaagctagcagtgccccgtgcccttcctactcctttacaccaaaagtagaatcttcagcatcattatcttctccagaagcaggagaacgtagtgcaccagaatttggtcataaacttggctttgagtcctagtcctgccccttactaactgtgtggtcttgggaaagttgtttagcctctatgactccgtttccccatctataaaacgccattatgggtctggcgcggtggtcacgcctgtaatcccagcactttgggaggccaaggcgggtggatcacgaggtcaggagttcaagaccagcctggcacatggtgaaaccccgtctctactaaagatacaaaaaattagccggatgtggtggcacgcacctgtaatcccagctactcaggaggctgaggcaggagaatcacgggaaaccrggaggtggcggttgcagtgagccgagatcacaccactgcactctagcctaggcgacagggcaagactccgtcttaaagaacagrcaaacaaacaaacgacattatgcagaggactaaatgacttaacagcatttgtaaaaacgtttagaacagaaatttgaacttagtaagtacaatatatgtatttgttaaatgatcttgattttgtttatttatttattttgagatgaaatctccctctgtctcccaggctggaatgcagtggcgtgatctccactcactgcaacctctgccttctgagttcaagcaattctcctgcttcagcctcccgagtagctgggatcacaggcccgcatcaccacacccggctaatttttatatttttagtagagacggggtttcaccatgttggccaggctgctctcgaatccctgtcctcaggtgatccacccacctcggcctcccaaagtcctgggattacaggcgtgagccaccacacactgcctgaagatcgtgatttttaaatggctgtgtgtgccaggcacaattctcacagcaaccctaattgttcactaacaaattaaaattaaaaaataatttttttcttttcgagacagagtttccctcttgttgcccaggctggcgtgcaatggtgcgatctcggctcactgcaacctctgcctcccagattcaagcgattttcttgtcttagtctccctagtagctgggattacaggcgcccaccattacgcccagctaattttttgtatttttagtagagacacggtttcactgtgttggccaggctggtctcgaactcctgacctcaagcaatacacctcagtctcccaaagtgctgggattacaggcgtgagccatgtaactcagaaggcagaggttgcggtgagtggagatcacgccactgcattccagcctgggagacagagggagacttcatctcaaaataaataaataaataaaatcaagccaccatgcttggctggaatttctttttttctttattttcttctaaaacatcctgtcataacatgttcattaacaaataccgaacattctggttagtgggtacaaaaatagagttagaatgaataagatctagtatttgggagcacagcagggtgactacagtccacaacaatgtattgtacattttaaaataactaaaggagtataattggagtgcttgtaacacaaagaaaggataaatgcttgaggtcatggacacccatttaccctgatgtgattatgatgcattgcatgcctgttatcaaaatatctcatgtaccccataaatataaacacctacagtgtacccataaaaactaaaaatatatatattattatccagcttttttttttttttgtgagacagagtctcaccctgtgacataggctggagtgcagtggcataatcaaagctcactgcatcctggacctcccaggctcaagtgatcctcccacctcatcctccggagtagctaggaccacaggtgtgcaccaacacgcccagctaatttttacatttttttgtagagacgtggatctcactatgttgcccaggctggtcttgaactcctgggctcaagtgatcctcctgcctcagcctccctcccaaagtgctgggattataggcatgaaccacagcacccggcattatgagcattcttctgtacaatgcacccttacagcacagtgaatacagtcagacaaagtacctgtcctcaaagggcttatattgttaagagagaaacatactaaatctataagcagaaaaagtaacgtcatttcagatactgataagtgctatgactaaggcaagcccatttgatacaacgggctgggaggggtcacttcagatgctatagtcagggaaggccactgtagagaggagaccatgcaactgaaccacaggtgatgaaccacaggaaagcattaaattgtatccatgttaaagataagaaaataaaggtgcaggaagttaattgagttgtccgaggtcttacaactagtaattaacaaatcaggcttcagagctggctctgactcctaaaccctccttcttcagcactatgctagaggcaaagagatcttagctattacaggatctcccaccccatcttgccttcctgctatcctacaacagcctttctcaaattctactttgaactccttgctaattcctaaaaactgcttagaggcacaaaggggaaccccaccacctatcaacaggtttaaggaaagtaccaaatgtctttcaggaaacttcccaaacattaatgaatcatttacatgctgcttcacactttactacgtctgatgccttcccccttggaattttattttatttcgagacagagtttcactctgttgcccaggctagagtgcagtgctgcaatctcggctcactgcaacctccacctcccgggttcaagcgattctcctgcctcagcctttcgactagctgggattacaggtgttcaccaccatgcccacctaatttttctattttagtagaggcagggtttcaccatgttggccaggctggttttgaactcctgacctcaagtgctccayccgcctcagcctccaaaagtgctgggattacaggcatgagccaccacaccaagcctccccttaggaattttattacttatttacttattcattaagatggaatctcactctgtcgcccaggctagagtgcagtggtgcgatctcggctcattgtaacctccaccttccagttcaagcgattctcctgcctcagcctaccaagtagctggtattaaccccccttggattttttttttcttttttttgacggagtctcgttctgttgcccaggctggagtgcagtggcacgatctcggctcaccgcaacctcttcctcctgggttcaagcgattctcctgcctcagattcctgagtagctgggatttcaggtgtgcaccaccacgtccagctaattttgtagttttagtagacacagggtttcaccatgttggtttggccaggctggtctcgaactcctgacctcaagtgatccacctgcctyggcctcccaaagtgctgggattacaggcgtgagccactgcgcctggcccccctcggaattttatttggccctaaccactctgtgacgtttctggacaggaactaatcacctcagcttacagagaaaccgaagcacaaactgatgaggtactggtgttgcctaaatggctttgatcaaggtatttaaactagttggttctcaatttcccaaattttccataaagaaaaaagagagggcattgaaataataatccttaaagtcctatttgggaacaacatttagggaaataggtttgtcattgggtaaaaccttaaaaacatttaaaatgtttttcttgttctttttaaattcaatttgttttccttgtagctttggactatggctgagcagataactcaatttaacttccttaggtccttccatgatcatttattaattcaaaccactgaacctaatacaggtagaagattggtttctggggagaaactcctttaataacagcttggttagttgaaaagctgaattgcatgtaaagtagctacttaaatagcacacaaaaaagtctttcggttttcatacatgtgaagactataatttggacaagggaaaaactgaaagttacttgtactctctaaagttttcccagcaaagaaacaggaatacaattaatagaggatacatacttaaaatatatcttaagagaaaatttatgtattttgattcataattgtctcctaaggcctggtatactttgcttaggctcctagtctttagaaagcagcaataaaattacatttcttttaaaagtatttgtaattcagacttttattagccttccacttaatacgactgttttgtttttaaaaatttttttaatagagacaagtgtcacaccatgttgctcaggctggttttaaacaccaagcctcaaggggtcctcctgtctcagcctcccaaagtgctgggattacgacatgagtcaccatgccccgcccattttcaatcactacatttacttgttgtgactagttacagctttggacttgaaagaatgccaagctaagtcaaacaaaatgtgtctgcttggtaaaaaggaatctaaaagaaaaatatacatataaagaaaatgtggtcaagctcgttggctcagccctgtaatcctaaagaggccgaggcgggaggatcacttgaggctaggagttygagaccagcctggccaacatggcaatatcccgtctctactaaaaacacaaaaattagccaggcatggtggtgggcgcctgtaatcctagctactcaggaggctgaggcatgagaatcggttgaacccgggaggyggaggctgcagtgagccaagatcctgccactgcactccagcctgggcaatgaagcaagactttgtctcaaaaaaaaaaaaaaaaaaagtaaaaaggaaatgtgtctgcattctttgatgttttctggctaaaaactattttttaaaaaaagcaattagaaacctacaattaccttgtttcttaagatttttagttaatatggcttgtgttgaaacatactcaactgaaataaaatggggaaaaaacacctctgaagagtagcgtatttgtttggtactttgaaaaaagccaaaacgctagaaacgggtttttcatctattctaatctccacttggaaaatactacctatacacagacataatgaagatttttttctttttctttcttttctaaatagtgatagggtttcaccgtttcccagtctagtctcaaatttgtaggctcaagagatcctccctccgtagcctctcaaagtattgggaatacaggcctgagccactgcgcccagcccacagtcaagatttagtcagcagtaataaatacctacgcagggagaggatgtgtgcttgtcatctgccttctggaaaattaaatacaggcacaaaggattcttcagctacatgtctgatcctgccctccacaatacccgtctacagggatgtttacagggatgtgttaatccccacgtaatggggattgcctattgaaataacctcccagtaaggatttttttgggcaaaatattctcgtttggcaatttcgacttactgattcttttgcaaagtcaacttgtttctgggcaaactttaaaaataaactcctaaggtagcatttagctagcagctagcacatcctaaatcgtgtctagatttaacttacacaatatgtgctttgcttttttcctaatttgcaacagaaaatagtaatcagctggtagtttcagaaatcacccttttgctgagtcttaawtttttttttattccagggaaacgtgaagattgtggrgcgctatttttttttttaaagcaaaccacacagcatatctggccacctaaaacacaaagtgtttgaaactaaccgtaagatttcctttctgctcgcccaacctgtcactggaaacgcagtattcatttgtaaccagctttggagcagggcttttaaaaataacgttttcttgctaaagtccccaaaaatctcttgattcttggtggcaatgtccagttgagtctttgcacacactgtatttttgccaactgggtcgcaactttgcgagaactccgggggacctcgtaggaagccaggttggcagttatttttttctccacttgccactaggttgcactagatttaggatgctggggaatatgcgccatttaatttttaaaaataaagtaggaccatcacgtgacgagacccgagagaggaaaaaaaaaaagccgaagggacagggtttttcattgaaatcccgttcaaatcgccttccctccaaagcctgaaagagctgaattctattaaatcctggttggcaggttttttcctcgggtccacgtcacgagctcattctccgcttcaaggttcctttcgactycacaacgtgaagccagggggaaggcctccttaaactgggggttttcgccaaaaaagccagggtcaccccccgggaaagtccctatttaggggtttatcgggaggggactgagcctgacgaggctgcagggccgcgaggccccgccccccccggggttcccagcatgccccgcgcggacaggacgcggcggcggaggcggggcgaggaaggggcggggcgaagaggagagaagggcgtcggttttgcgacaggggcggtgcggtgcggaagcggaagtgaagggtgcgcttggcggcggcggcgggagctgcggagtcgggaatcaaaacaaagggcctggggggggcggggggaaggcggcggggccggaatgtgagcggaggtggagccggcggcagaggtgagtttgcagacagtcctgcgaccagaccccggcaggctctgctccgaggccagcggggcgggacggaggacagtgtcccctctttccccgcctattgctggtgggatggtggtggagaggggaggttagctaactgggacgcgccagttgggccccccacgaaagagttggcttgtctccctttcgggtccattcactactgtcactgttggcgccgctgttccccttcgagggcatttggctccccgcccgcccctgtctgacccctggtggggccctccaggagtgaagtgcacagctggaaggttaakagagaasgaaaggggcgggtgtttttgcaacacactcccccctccccggccgttttgcattctcctcggccttttagcaacacatagggtgtagtctcagggttgacaatgtctagggcttcagccactctcactagtagttgtaacgcgacctcgtgatacaccttttagagtttctcaagcacctttccggtattaccaagagctgtccaattgcatttgtgtcttttggacttctctgagcggtaaatattcttctcttttgcatatcggtgtattgaaacctaaactgttttcctatttattaagctttattcgttcaacagttatttattaaaatatgccaggcattgtactaaggacaggagttggaatagtggataagaaaacatagtctctgctgtcatggagtttatagcctaatgggggagaaagataataaaataagctaaaaaggccgttttggacagaagagctatgggggagaaaacggtaatgggatggggtggtgtggggtcaaagactagattgggtgctaaggaaacaacatttgctaaatgttccccgtggattacctcatgtaatccaaacaacggccttgtaaggtggtttctattattatcacacccattttagagatgggatctgaggttcagagaggttgtgagttgtccaaagctgcaccgcagtcaaattggagaccaaaatgcagacagtcgacagagcctatgctctcctcattgaattggtcaaaagacttgaagagagtgacagaaaggagactgtcgctcaagtcaaacagaacctgcttttggctacctaagttgcttcgtggatggtatttgggaagttttcagggtgcaggcacctgaaagtttttacttttaatcgcttgtattgagcagtattgaaggcaccttgatgtagtggaaaggggtgaacaagcctaatcttgtgtcaggctcgctacaaaacttcattaagtttctttttctctctctgcaaaaatgtagctaatttctcccctgtctatttcacaggattattgcraaaattatataagaggatcccaccgtctgggtttttttcatcattatattccttgtgccaagcacaggcctgctgcatagtagatactaagtaaatatttgctgaatgaagacataagtaatgttaagtgaaaatactttataaactagattatactgtgaatgttagctcactttcaggatttggctttgaagaagtttgagagaatgtttaagttatgaacactgtgaatatcacagattcttacgattttgagaggagttttttgggggacataaaacctgtatctaataggaaagacaagaatcgtaatttactatcagtggtagcagttaaatccatctccaaattaaccactcccaatagtgtgtagtaggtaatgtttactttgtatttacagagtagggagcattttggttggcacaagagatacagtggtgaaaatagacagtggggttcatttatctaattttttttttctctgtaatgcagtggcggggagaaattagccacattttgcataggaggaaacagaaacttgaaaacaaaaatttttttagagatggaatctcactctgttgcccacgctgaagggccagtggcacaatatagttcactgtagcctcaaattcttgggctcaagagatcctcctacctcagtctctctagtagctgggactaggcgcatgctgccacactatgc

SEQ ID NO: 13245 - DNA, 51749 bp, Homo sapiens
ccagaatctctggcacacatttaaagcagtgtgtagagggaaatttatagcactaaatgcccacaagagaaagcaggaaagatctaaaattgacaccctaaaatmacaattaaaagaactagagaagcaagagcaaacacattcaaaagctagcagaaggcaagaaataactaagatcagagcagaactgaaggaaatagagacacaaaaaacccttcaaaaaataaatgaatccaggagctggttttttgaaaagatcaacaaaactgatagtccactagcaagacaaataaagaagaaaagagagaagaatcaaatagatgcaataaaaaatgatagaggggatatcaccgctgatcccacagaaatacaaaccaccataagagaatattataaacacctctacgcaaataaactagaaaatctagaagaaatggatacattcctggacacatacaccctcccaagactaaaccaggaagaagacgaatccctgaatagaccaataacaggctctgaaattgaggctataattaacagcctaccaaccaaaaaaagtccaggaatgtttatatggwcttcagaggagagaataagttggcattgatcaggagaactgtaaggaaattaattgtttaggagagaaatgagatgtgatgaaggtgagaaagagcggattgaagcagcatgaaggtgatagaaatggcagagctkttgatcatttagtgaagagaactgggaagggatgcacccaggtttctgagagatgtccagttgtacacaggtaacgtctacagctcaagagccaggttagcgatatggatgaaataagtaaaatttgaaacttgaacctatggatacagttaaggtcatatgataagatcatgacaagatcatattataatgaaaagtagagggcctagaatcggaggaaaggaatctggataccaagcaaaggagttgagcaagaaaggaagggggctctggacatccttggaaggccgaagacgaaagggctaaaagtcgccaacaaacaaaatgagataagacctggggcatatcttttggccatggcagttaaaaaaggagtggtgaccttatcaggaggaatttcagagaatgttggggtggacttctaactgcagtggggtcaggagagaatcaaacgtgaaaaaaagacaacactctgtgtatacactttttataaagaagcttgatggagaatggaaaaatgaaaaggcagagttttatttccaaggtataaaaaatgaagactcccaataaactaggtattgatggaatgtatctcaaaataataagagctatttatgacaaacccacagccaatatcatactgaatgggcaaaagctggatgcattccctttgaaaaccggcacaagataargacgccctctctcaccactcctattcaacatattattggaagttctggccagggcaatcaggcaagagaaagaaataaagcatattcaaataggatgagaggaagtcaaattgtccctgtttgcagatgacatgattgtatatttagaaaaccccattgtctcagccccaaatctccttaagctgataagcaacttcagcaaagtctcaggatacaaaatcaatgtgcaaaaatcacaagcattcctatacaccaataatagacaaacagggagccaaatcatgagtgaactcccattcacaattgctataaagagaataaaatacctaggaatacaacttacaaggaatgtgaaggacctcttcaaggagaactacaaaccactgctcaaggaaataagagaggacacaaacaaatggaaaaacattccatgcttatggataggaagaatcaatatggtgaaagtggccattctgcccagagtaatttatagattcaatgctacccctatcaagctaccagcgactttcttcacataattagaaaaaaaaaactactttaaatttcatatggaaccaaaaaagaccccacatagccaagagaatcctaagcaaaaagaacaaagctggaggcattacgctacctgactcaaactatactacaagactacagtaaccaaaacagcatggtactggtgccaaaacaggtatatagaccaatggaacagaacagaagcctcagaaataacaccacacatctataaccatctgatttttgacaaacccgacaaaaacaagcaatgggggaaggattccctatttaataaatggtgttgggaaaactggctagccatatgcagaaaaccgcaactggaccccttccttacatcttatacaaaaattaactcaagatgtaataaagtattaaatgtaagacctaaaaccatgaaaatcctagaagaaaacctaggcaataccattcaggacataggcatgggcaaagacgtcatgaataaaacaccaaaagcaatggcaacaaaagccaaaattgacaaatgggatccagcttcagcacagcaaaagaaactatcatcagaatgaacaggcaacctacagaatgggagaaaaattttggcaatctatccatctgacaaagggctaatatccagactgtaagaagaacttaaacaaatttacaagaaaaaaacaaacaacaccataaaaaaagtgggcgaaggatatgaacagacacttcttaaaagaagacatttatgcggccgacaaacatatgaaaaaagctcatcatcgctggtcattagagaaatgcaaatcaaaaccacaatgagataccatctcacrccagttggaatgacgatcattaaaaagtcaggaaacaacaggtgctagrgaggatgtggagaaataggaatacttttacactgttggtgggagtgtaaattagttcaaccattgtggaagacggtgtggtaatttctcaaggatctggaaccagaaataccatatgatccagcaatcccattactgggtatatacccaaaggattataaatcattctactataaagacacaagcacacgtatgattattgtggcactgttcacaatagcaaagacttggaaccaactcaaatgcccatcaatgatagactggataaagaaaatgtggcacatatacaccatggaatactatgcagttcatgtcctttgcagggacatggatgaagctggaaaccatctttctcgggaaactaacacaagaacagaaaaccaaacaccgcatgttctcactcataagtgggagttgaacaatgagaacacatggacacagggaggggaacatcacacactggggcctgtcatgggggtggggtctaggggagggtagcattaggagaaatacctaatgtagatggcagattgatgggtrcagtaaaccaccatggcatgtgtatacctaygtaacaaacctgcacgttctgcacatgtaccacagaacttaaagtataataattaacagtaataaaaaattaattaatgaaaaataaaatatataatctgatacatttggatatatrtatatatacacgtacacacctgtaaaaacaaactagatagtgaacatatccatcacaccaaagtatccccttctcctttatactgcctctcacccacctctctctgccctctcctcagttccatgttccatgcaactattgatctaccgtatgtcactatagatcagtttgcattttcttgaaatttatgtaagtaaaatcatatacaaaagtaaagaaagtgtgtttttaaaaatatataagatattgagtataattatgagataagacttcaaaaaagtgaagaggttaaagatgaaggagtgaaggtaaatatttgcttaactaatgtagtgagttaagtaatggattcaatcacagatgatttartccactagtttacatattttactcacccaaggttagagtttactatttagacacttaacatttcttggcttactggacaatgtgagtcacctctccagaaaaattcatggcattgaatggatacgttaaaaaagtagaaactttgttttaaaaactctaaaatcaatcaccacagcttctactttagaatatcagaaaaagaagagtaaattaaacccaactaagcaaaacaaaataaataataaaaatgggggcagaaatgaatgaaatccagagagaaaatcaatgaaaacaaaagctagttcttttaaaagaccaatgaattgatgagactgtacccaggctaagcaaaaagaaaagcctaaattactaatatcagaaatgaaagtggtgaaatgctaaaaatcccatgtmcagtaaaaaatcataaaggaatactcaggmcagctctgtgcccacaaatttgataaactacatgacgtggatcaatttcttgaaagacacaatccgccaaaagtcacacaacaggaaatagaacatttgaataggcctatwtctactaaaaaaattaatcaataattaatagccatctaaaataattaccagacccagatgggctcactggtaaattctaaaaacaaattaagaaaacgtttactccaattctctaaatctctttcagaagatagaagcagaagaactactttctaattcattctatagggctggaattactctgataacaaaaccagacaaagacattagaagaaaagaaacttaaagaccaatatctttcattagtatagatgcaaaatcctgaacaacatattcacaaatgaaatcaaactatgtgtaaaatagttggattatacattgtgactaagtaagattgattgcaggtgtacaagrctaattcaacatttgaaaatcaaaggaatccgtcatatcaacaggtaaaaaacagaaaaaatcctcaaaaaattgctagcaactccaattcaacaacacattaaacagatcactcaccacgatcaagtgagattcacccgggtatgcaagtatgattcaatatacacaaatcaataaatgcgatacattgcattaaaagaaccaacaacaaaaactgcacgatcatttcaatagatgccgaaaatgtattcagtaaaatcctacatctctttatgataaaaatccttaacacattgggtatagaaggaatatacctcaaaacaataaaaaccaaaatgaaaaacccactgctaatatcatactgaacagggaaaaattgaaaacctttcctataagatctgcaacaagacaaggatgcccagtttcaccccctttattcagtatctgactggaagtcctggccggggcaattaggcaagaaaaagaaacaaaggacacccaaactggaaagaaagatgtaaaattagctttgctcaccaatggtataatcttataatcggaaaaaccaaaagactcccctcaaaaactactagaactaataaatgaatcagtaaagttgcagaatacaaaatggatataaaatatccgtaagatgtctatacatctacagtgaacagtctgaaaaagaaatcaagaaagaaatcccacttacaatagctataagaaatatgatgtataaaatacctagtaatcaatttaattaaaaaagtgaaagacttctacaaggacaactataaaacactgatgagaaaaacgtgaagaacacacacagaaaatggacacatattcatgctcataggttggaataattaatgttaaaagtacaatgctacccaaacaatttacagattgaatgcaatccctgtcaaaawaccaatgtcattyttcacaraaatakaaaaaaaaaaaaaccctataatttgtatggaaccacgaaaaaccccaaatagccaaagcgcattatcgcttcttgactgaaaactcccggacagttggggctttttcctgcacagagattggccacttcctgcacatcaggagatccccgcggcctgcgggacccgccccgccctcctgcccaggcgcccgctaggtggtgcctggctgggcccgactccgcccgcctccccattcactgggaactaacacccggcgccgctcagacatctctattcccgcctctccgacccggtctcacttcgctcctgggcagctgcgcggagaactgggrwaggtgtttgactttgggagtggttcccacacgctggattctcgttacctgctcytgagcccaggaaaagggcgggaacctacgaaagggaagcccagtgaagtgctcagcgcacctgttgctccagacctttccctggggctgtccttctttactcggtctctggcgggggctccctaagggcagggacttggctgcacttggctgtgtgccctatgggtccaggcgcggggaggggaggccagggcgaatgggcgcggagctggggggtgaaagtcctgcctgggctccactcatcctgcaggagctggaagtaggtacaatgaggcctcccaccctggtgaagtttwtgttgggcgctggaaggggctgtgaggcctgggacctccaggaaaaacaacagcagcagtatttatttgtcggtaccgaaactcgtatgctctcagtattcagaatttgtacttgacattcctcctcctttaaaagaaaccaggagaggcgttgatagtatgtttttggactggaaaaaaatcaaaatgaggacgatactgttgccagaaagcaaaagtgttgggatagtgtaaaaagaaagtaaccaatttacagagattcccagtagacaagttgtgagaatttgytcaagaacaaaaaccagtatgtgttaattgaaatacatgttacaacaaagccaagaaagagtcctttagtaaattcagataaaacaagtaaaatgggccaggcgcggtggctcacgcttgtaatcccagcactttgggaggctgaggggggcggatcacgaggtcaggagttcgagacccagcctggccaatatggtgaaacccagtctctactaaaaatacaaaaattagccgggtgtcgtgacatgggcctgtagtcccagctactcaggaggctgaggcagaagaatcgcttgaacctgggaggcagaggttgcagtgagccaagattgcaccactgcactccagcctgagggacaaagcgagactctctctcaaaaaaaaaaaaaaaaaaaaaaaaaaatgtaagatgagtttaaaggaggcaggaaataatttcaataatgtttacaagaaatgctgtgtgatgattcatatacgactgctgtgtaggaatagtgactataggcacctaggttgacaggcacagtggttacaaaaaccaayctgaaggcctaaatattaaaccaggagactttgaaagccaacttgtggatagaactctgtgttacgcaaatcagatgcacgagaacctcaaatagtatttcatttcaaggaaaggcatttggcaaaaaaaagaaaaaagcaaatttaatagttgtctttgcaaaatcccaatgtaggaccaaactgcaaaatggtccttacatttgtttggctttaaaaagcagtatgacctgaaaagtagcagtgtcaggtcagtcagagcccatgtcccaaccatcaatctggcagccccatcctattgtttttgtgaataggagatggtctgttattaatttaaccccagaaaagtattaaaataagcattaccatcaccctaggaaatataaaaagatagagtgaagataaagtgtataaaacccacagtattactagtggggtgctaraaataagttttataatcactgttgtacagttgtattttaaaacatgtttgaaagtcttaggagaatctagtttaacagatttataagtgttgatttattcagtttattattgtacaaatgcttatattaatgatatagttgttaattttgtaagtttgttctttaaagtgattacatctttaaaacatctgatacattaagctttatcatcaatgcttaaatgtttaaaataacgtatttgctgtgttagcagtgtgctttaaagtttaaggaaaacaatttgtttaccaaattaacaagaaattaattgatcattgactaaataaggtataataatagaaaaaattgktctctgtttatgaaaattctgcttcgggaatgaaaatcttacagactaaataaacctgcactcaccagcaggggggaaactgtgggagatgagaaatgggagtgatagattactcatatgtggttgagcatacgaagaaattactgaaagagcttgagtgatctgtagaatatttggtgggaggggaatttgccatagatttttaaaaagtgaaaacaagaaaagaggggaaggcaatagtgacataaggaaaaacagacgtgtaaaaaaagcaatgcatccattattgattaattggcttagcagcgaatactatttagttgcaataaggcaaacacttggagagaggaagtgaagtacggtaagtgataaaagaaaattaatcatcagccctaaattaggaaggcaatttataatgtcaaaaattgtggggttaaaaatagtcatatacacaattatttctaaatatgaaagtaaataccaagagaaagggtgcactgaggtttgattgtttctggggagttgggagtagtgggaagacactggttgatttgtgtaacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgagttagtgggtgcagtgcaccagcatggcacatgtatacataactaacctgcacaatgtgcacatgtaccctaaaacttaaagtataataawaaaaaaaaaagatctcgcctagtgttatctcacttttcaactacatgcaagtccattaatttcataaaagcacaatgaccaaatgacactgaaacaaatataggcacattgtagggaaaatagcaaaggatataaataaaattagaattactcattatccagaaatatgtgatgttcagtgtttccctgtagtctttttatctatgaattatacttacatgtaactttattcttaatttatacttaatattgtattttctcatggcatgactgtaatttttaatatctccatttatattcaatcatggatttgacagaatctaactggttctctgttgctgggtatttaaatattttctctgtagcatataaagtgcttcagtagtcatctttctgcatactgtttttatcagtacttgtgagctttatctttagtgaaattctttgaaatggaatttttcatcctaaaggtataaatattttcatggcattttctttttcctacccttccaccmtccctgtgttccttcctccatttataaaaacataattctaagttacattctgaaaatattgrtgtcccaatttacataatcacatatggaatataggagggaatacctattttaccagtattggaaatcaatagtttttctycttacaaatttcatgttttaagcaagtaactttcttgctttctgctgctgcttttgttataagtccttataccatggtgattaagaggagccctggaaccacaaagacctggtttctaatgcctacttttctgtttgtagttgagtgatctcaggcacaacagacttaaacagtgaaggctcaatttctttgcttgtaaagtgcagacattcactcacagcacctatctcatcagcttgtatggattaaatgacatcttgtaagaaaagccctagtgtagtttttgtgtgtgtacctatttgttcaatgaaaacaagtatccatttaactagtaataaatagagtgaaaagtaaatacacatgtaagcctatattaatgtaatattgtttaaaaatccattgtttcaggctcaccgtcatggatgctctatcagaagcaaatggcacatttgcattaaaccttttgaaaaagctaggggaaaacaactcaaacaacttatttttttccccatgagcatatcatcagccttggccatggttttcatgggggcaaagggaaacactgcagctcagatgtctcaggtacrtaaagccacttcaagacaacaataagtgctatcaatttatcagttgagctggacttctgcatttcaagtcttgaagaaattcctcctttaacagacaactctggtagtctcacaggatgtggatggagaattggcaggatggagcatgttttcaaggcctgaccttcttggtgacctggggtcactcatgtgggtgcttctgcaggcaactgggctagaaggtccaagaagataccactcccatgtctgggccttggttctggctagtggatgggccctcagttccctaaaagcaagtctttccattcctccttttatgtggtctttcctcaggatagcttgggcttctcgaccacggtagctgggttacaagagagggaaagtggaagctgccagactttttaagggctaagcctggaacagagccagttctgcattctgctgtttagagcaagtcacatggccagcccagattctgaagaaggggagagagactccatcttttagtgtcaggagcaccatgtgtatgcagagacaggacacatggttggcagctgcgtttttagaccaagtatcataaatagcacaagaaatccgagtcattttgttagggtttgcaaaaggcatatccacttataccaakacttagataacattcgtttcttttaggatgtgcttatagggaggcctgagaagaggcataggtaggcagacagggttgcttttgagacactctctatcttttattagattgatcatcttttaagctgtagtaagcatctgtaaatctcatattgctgagtttactgttgtgcctatattttgaagtcacagaatactgagaatgtgtatgtttattattattttattttcaggcactttgttttagtaaaatcggaggtgaagatggagatattcatcgaggttttcagtcacttcttgttgcaattaacagaactgacactgaatatgtgcttagaactgccaacgggctctttggagaaaartcttatgatttcctcacagtaagtcatacttstttattaggaaaataaagatagcaatgtggtgggaagtaggagaatgaatatgggctatgaattcctgcaggtggtcctgaactcagaactccacgcacgaatctcacacgcatcttgtgattcagtttgatcatctgtagcacaggctatatagcaaataccgttcagaattttgtgaagctttaatgagataatcttcataaaagaactgacacagagcgtaacacagttgaaaatgaatcagccaaaacaaagatgtggtgaaaatgactgtttctcrtaattgctttgcagatatttttaattttctatgcatgatgacactataatgtatgcattaaatagtttgactagatgtttcagcaatgaaaatcttttaaaactaattttggctaattacactggttgcwttcgctgacaatgctttcatgacttttctagtttttgaaaagaaaagtaccgaagtaatttcttgttatttaaaaacacaaacaacacatataaaccaagagatgtcatcagcttctttcttatgccacaactcccctttttaacgttagagctttcatagatttgatgtttcctccttcacatataaaaactttgcttcatgagtttttctcctatgtaatgttattgtactatgcatattgttttatactttgttagcttttccttaaaaatatgtcctaaattccttccatctcagtatatgtggatytgtattactctttttaacccttgtctggtattcctaagtatggctgtaccatggtataatagacctttcttgcattgacgagtatttaagcttatttactctggcccattacagacaggagtatttctttacacagttttgtgcatatgtgtatgagttactatctaaaatggatttgtagaagggaggaagggaatgaagctttgaggttttcataaatattgccaaattgctctccacagttttgtagccatttacattctrcagggggtatttataggatcctcagttccacccaccatcagcagaactgcataatgttaacctttaaaacttttggaagggtggggccaagatggccgactaaaaggagctcctgatgctggcgtcaccgagaggaaacaaaaggggtagtgaacactgaccctgaaagccgatcatctgagaaaccatgtcgagatccatctaggcagcaggggaacacacagagcagacaggaatgaatctgggcaccagcctgtctgggatcagtgcggtcaggaggacccctacaaaatggggaaggatgagtgaatgagagttcctagtgggattcacactgtccacagggacctatgcaagattgggaatgggagaatcctcctgtccccaccgcatttccccactgtgcttttagactggggcagagtgccacctggacgttttccaggggtaattctggagtccagggggacctctacaagccttgggccctgtagcagaccagcaccaaagccacagccccagtagaggccacagttgtggttcctgggagaagtaagattgctctacgccctcctaggaaataacattctggacacaggatttggcaaatattttatgacaaagatgccaaaagcaattgcaacggaaacaaaaattgagatatgggacataagtaarctgaaaagttctgcagggcaaaagaaactatcaacagtgtaaacagacaacctatagaaatggagaaaatatttgcaaactatgcctctgatagaggtctaatatccagaatctattaaaaaaaaaacaaacttaaatttacaagcaaaaaccaaacaacacaactccattaaaaagtggccaaaggacatggacagacacttttcaaaagatgacatatgcgtggccaacaagcctaggaaaacattgccaacatcactaatcattagagaaattcaaatcaaaaccatgatgagataccatctcacaccattcagaatggctgttattaaaatgtcaaaaaacagatgctggtgaagctgcacagaaaagagaacacttccatgcggctggtgggaatgtaaattagttcagccactgtggaaaggactttggtgatttctcaagaaaattaaaagagaattgccatttgacccagcaatcccattattgagtacatacctgaaggaatagaaatcattctaccataaagacacatatgttcattgcagcactattcacaatggcaaaaacatggaatcaacctaaatgcccatcaatagtagactggattaaaaaaatgtggtacatatacaccacgaaatacgatgcagccataaaacagaatgagatcatgtcctttgcagccacagagatggaactggaggctattaatcataagcaaactaatacgggagtaggaaaccaaataccacatgttctcacttataagttggaggtaaacatccagtacatatggtcacaaggaaaggaataacagatatgggggcttacttgagggagaagggtgtggggagggtgaggattgaacaactacctatcgggtactaggcttattacatggttgatgaaataatctgtatactaaacccctgaaacatgaaatttgcctatataacaaacttgcttaggtatccgtgaacctaaaataaagtttttaaaaaagaatctgaratggaatatttacaacatatgcgatagggaagggktaatacaaaacaagagaagcaammaaaaaaaaaataaaaacttttgattataaatgggattaaacacttttatgtgtattgagaatttctatctcttctgtgaattgcctatttacatatcctcttacacatttttctatggggttgtatgtctttttcttattgacttataagaattatttttgtagaggatatctctcttactgtgatatgtattttttcaaacttgctttcgactctaaattaattgtttgcaaacagattggtataaagtgaaggtggtaagacataaaagtgaaatatttataagatttgtatatgatattgtgattttacaacttcacttattttactagtcttagcactatttagtttattgccatctttttactagcttactagttttctatataaagacaaccaaaatgttaacaaccaaatatcaattcgtggtggatattttgaaagaaaagcattgatatttaaaatgttattttgatattggaatataaattaaaaagatgagaaatatttgtaaaccatttcagattaatttattatttattcttattttcaagaatcccataccaatagcaatatataattacatgttctttttgtttgatttgccacactttgtcaaatagtaacttaaaatagcagacagttatttaaaaacacgtttaacagatggaaagatcrcctaggcgtgcaagaagtcatcaatatgtgattcatcagtttgccttcagattattttcttacactgagagatttaaataatttccaaaccactgaaaaataggcagaggcagcaattttggaaaagcatgaattaygggaggattaagtgaaatagtgtacatcgatcagttaygtggtactgagaattcaaaaacgttacatgaaaaggtgatatttcatcaggacttcacagttatcttgtgaggtgtagctattactgcttccttgttctacaggagagaacatggaggcataaacagaggaagcaaatatttgaaggtcacacaactagtaagttgcagaacttgtgttcctaactacagtcacatttcctctccatgccatactgatacagaagtataaaattccaaagtaaaagcaaaattatggaaagggaaattaaatatttagytgtgagcagtttgagagaaagattgggaaacaattctataatgcatggttcataaattagttgtttcagctcatttaatttccaccaaatgttctgcttttatgtggcatagtgtaggtttctgttaagatcattataattctacagaatatattaactaaatatagtttgaacttttttggaaagttgatcatagtttgaaacacccataatgctatgcattatgtacatgagtataaggtttccatgaaattaattattcagttcctcagtccaactagctattaatatatttcaagtgctcaatagcctatgtggcaccgctctggacattgcagatttacaacattttcatcatcccagaaagttccgatggacactgctggtctaggattgtatatgtttcccatgtaatttatggaacaacagactcatatttataktctgttgttctaaaatgtagaggcaaatatagcacttgctgtgttaatcctcactcaacaaatttaataatttacaggagtgacagcttctatagtcaccatttgtaaaaaagaaaaaaaaagaatttattttctaaagcaattttaggttcacagaaaaattgagcaaaaggtacatgcatagtccctcctgtgattaacatcccctagtacagtcatgggggacagctttcttgtttctaccttggccggttaggaataaagctgttatgaatatttgtgtgcaggttttatcagctcctttgggtaaatggtaagggtcatgattgctggatcatatttttagttttataaaaaacttccacactgtcttccaaagtgactrtacaatattgtattcccaccagcaatgaatgagagttcctgttgctccacgttttcaccagcatttagtgttgtcagtgtgttttcactttcatttagttcaaactgtttttaatatcacttgagatttcttctgtgattcgtgtgttattgaatctccgagtacttttggaattttcagccatctttctcttattgatttctagtttaattcgttattgtctgagagcagacgttgcatgatttctattattttaaatatgctaagttgtgctttgtggcccagaatgtggtctcttttggtaaatgtttcatgtaagcttgagaagaatatagattctactcttgttggatgaagtagtcaatagatatcaattatatctagttacttgatgttgtttttgagttcaactatgttctttactaattttctgcttgctggatctgttcattcctgatagagggatattgaagtctccagttataatagtggattcatctatttctcctttcagttctattagttgttgccttatgtgtcttgatggtccactattaggtacttacctattaaggatttctatgtcttcttggagatttctcagtgttttaaattatctcattgatgggtgtactgccactctcatgaaggatccagcagttgatgaaaatcacttgatatgcagcccaccgcgttgcttagtttataagctaagattaggaatagctgaaaagaatttggactttaggttaattcctcatctttatttgcaaattatatatggtaaatcataaaaytattgattttctgatgtggcacaatgaagaagtaagccagtgatattagttgtttctgtagctgtgaaattatgtttttggtttttcctagggttttacagattcctgtggcaaattctaccaagcaacgataaaacagctagactttgtgaatgatacagagaagtccacaacacgtgtaaactcctgggttgctgataaaactaaaggtgaaaatatattgttattctatttcgataatattttaaacagttttatagtcagttctttacaaaactgtcaaatataaaaaggagtccttttttctctaaacaactatgcaaacattaaaacctttctttggaaatattgccaactcgtagaccttttctctagctttagcttttcccttatcaagtatctgtgatgtctctctagatgaaataatctcttccaggtttttttgcttgttaatattaggtagtttttcttttcacaaatagcgttaaaatttgaatttaaaaatttctagctgtctccctcactggtattgccatactgtatggtttacaggcttgaaatgcaactgctgtgatcagtgataagggaacacactgatgatttagattgaacagggagagttatattgttttctagggcacagctaaaaagacattccmtcaacccccttgcagccagaaagaccctgagccctcagaacttcactgacacaacccatattttctttccataactggccaacttttccctttgtaccaaagccagctacttagcttcagggagagaatgagactgaagattacaaggagacatccacattatatgtgggctgagagaggaaagagggagyatcagaggttgccgggtttgctactctcattcctcttcctcctctgcccaacacttggacttggaaagaagtctgaaaggtggggaataatcagcccatatgattctwccactgcagagagagcctctgagtgttacagccaggagcaacagggtggcaccctcttcttcagggaaacacacacctctttgcactgccttgtggatagtccagtcaagtggagtaagaggtgggagtggggagtgtaaatggagtaacctctaagtatccaagcaggagggtgttttttttttttctttcctggaatgaggataatcaaatcatttcaatatgaattatgaaaatgaatgataatggttttatctgttatagaaatataatataatcagactttagccatgtaaatcataaaacatagagataacaatatgcatattgttcctagagggtcttgtgaaattttgtttgtcatattctctttgaagagttatcattcactattttatttctgtcttgtaaagcctgaaagctcatgtgctgccttgacatctatgggcttctcagggcctcagaggcctggccatgaagtcccctgctcttgtcagatatgtgcaccctattcacccactgagcaggaaggctcttcccccttctaagttcccttaccaggcagtcagctgtaccctccctgggtctcaacgtggctcacttccctccagcctggaaaattattcaaacaagcctgtcacatctggaggagccaggaatcgcctcttcctcttgttactgcaaagcctgccttccacagcccctactggttcactctattcccaaatgcaactctcctgtgaccccgcatggcatgtggtgacctccctccctgtgagcagttgtgactaataaactgccgccaatttcatctgtccagtgtgtcatgccatgtgtctagttatctcctactatttaatgggggagatccctccttcaccaacaaggtgaatatgagacaatcaaaacagctacaattccgtgaaaggtccagcctcccaaataataattccatgtgttttgtgaaattgcactaagacatttcccttacactatgtagtgtttcttgtaagtatccacaaagtgagttccatttagaattgaattctaggaaaaaaagttgatctgacctcctcagatatgtttactgaataccttctttgcattggacattttgcatagattatttaatccttagkgataataaacccatgaggaatctgagactcagaagttaagtagcttgaacaagttcttgtagctagcaacgaggtagaatgtggatccaatgtctggtaatgccaaacactggaaaattactcaaacaagcctggtacatccagaaaagccatgagtaatctcttcctcttgttattgtgaaacttacctatatcagctcctaccagaagggcagctgtcagcacagtgcaggaagagtagggaccagaaacctgtctccctttaagatgaagtctgatttctttggctgtgttatcccatctgaaaagtggaactcagaaacttctggcaccaaaagcacatcatcctggatccagggatgagcatcctgggatatggagctaaggtcaggtgcatctgggcgctatgaactctgcaagcattgctaccccctccaggagtcctgaatggaggtcctgagagccttcactcctcctatgcttcaataagtgggaactctaaggctcttgcatccctcttctcaaagagggctgcagggccacagttgaaaaggagaggtccaaagcaagggatggtttggagactgagaagatggaggcagtaccttcatgaagtacccctccagaagctgatgygcttctgcatgtgaaaggtggcctttcctttcctgagctgaagcttctgtgttgaaggagatggagggggcagaggacttgagggaggtttccagtcctgagggcttgctgaacaagctgaygttgatctgatactcacagatcatagcatggaccatgcacacctgattggcgtatctagtggctgttggggaatgcagcataaaattcctctcccaccaatactagtgttgacttcagatgtagttttctttctttctttcttttctttctctttctttctttctttctttctttctttctttctttctttctttctttytttctttcttctctctctcttctttctttctctctctctcccttccttccttcattgcttccttccttscttccttscttccytccttscttscttccttccttccttccttgcttccttccttccttctttccttgcttccttccttccaagasagagtatcgctctgtcacccaggctggagtgcagtggtgcaatctcagctcattgcaacctccacctcctgggttcaagcatgtctcctgccccagcctcccgaccaatttttgtatttttagtagagacggggtttcaccatgttggccaggctggtcttgaactcctgtcctcgtgatccaccacctcggcctcccaaagtgctgagattacagacatgagccaccgcaccaggccggaagtagtttgctttctctagctgcttgtgaccaagcatamaatgttttaccagtgaattccttagatattgtccttgagatgaaggattctggagaggatcaggaaaagagacagattcastagttatcatccagatttaatgacaggcttgcctgagaactccattcattgctgtgccagatatcaatttattgtctatcagctctaaatctacctttgtggactttgtgatagtaaacctggatcctgtaacaagaacttgactgactggcccagtgttcrgctttgccaatagagggagctggagagacactgtaagaagatagaagtagaaatgcactttctggattctgatcttcttaggattattcagtgtaggcacccagcagctcacttggtcatctgtagccacattctcagggaatgctttctccacacaatggccatttctgcatttggtcaagatgcaacctctggcaactatatccctaccaggcatttgcttctatggtccagccccagcctgcccacaccctccagcaaggacatatggcttctcgtaagccasctttggccatctgacaagtttcatagccactgcagactgcatgttcctgtggcagccacaccttcaaagagctctgaatatcagccttgggacattcagtcatgttagtttgctyaggtgggtataataaaataccataggctgggtgtggtggctcatgcctataatcccagcactttgggaagccaaggtgggcagatcaccggaggtcaggagttagagaccatcctggccaacatggtgaaaccccatctctactgaaaatacaaaactgaaaacaaaaacaaaaaaattaactgggcatggtggcacctgcctatagtcccagctactcaggaggctgagccaggagaatcgcttgaacccaggaggcagaggctgcagtgaaccaagatcatgccactgcacttcagcttgggcaacagagtgagacactgattcaaaaaataaaaataaaataccatagactgggcagtttaagcaactgacatttctcagagttttagaggctgggaagtccaagatcaggctgccaggagatttggtttctgaagagggctctattcctggtttgcagaaggccaccttttagctatgttcacatggcagggagagcaatttatctcttcttcttttaatgccactaatttcttcaagagggcccaaccctcctgactttattttaccccaatcaactcccaaaggccctatctccagaaactatcatcttaggggttagggcttttacataaaaattttgtgaggacataatacagtctatgacctatgtcttttcctaagtccttagttctttttttttccacttaccccaagacatgaagtgacaatttctcttttgtaccttstacatctgctgccattacagtatttttaaaaaatctattacttaataattctttgtattaattctcttctcttcaaatctctgatgtagtttgtttgcaaagtgaacactgcctgatgtaactgaataagcatctctcccactattatgaaagagtgtggcaggagactgaagtccacagtgtggatctagcaaacacattctggcttgagggtgtgcagctattagaaaaactactccattaaaaactgaaaattctgagattaatgctgaaccagacaggacactagaacaagtggcaggaactcacactgtttcaacaatcaatggtaactctattgataagctaaaatctgagaggctatcagggatctcctattcaactttcctatctgcaacacattcaatcaaagcacgaaaagatacgtttagaaaccaaagagatctttctaattccctccaaattctttgtcacttaatacttccccttaacccccttcaaattaatggagagactgacgattcactaatgagggactaatggcagtttccaggcaatgccatatcaggagcctttttttcttttataagttccttgaaatacaataccaggcatattaatgtaatgcttttcacattaaggtccactgggttctccatacccttgatcagcagaggctctacaacatgtatgtttcattgcttacatttgtcttggtaacaatctagacattttcatataagcattgtcttagtctgttttgtgttgctatayaggaatacctgaggctgggtagtttataaagaaagaaggcttatttggctcatattctgcagaatatacaagaggtatggcactggcatccccaggcttctggagagggcttttgtgctatgtcaaaagacattgaacctcaggaggcggaggttgcagtgaaccttcattgaacctgcaggttcaatgagggaaaggtcaaaggggatgcaggcacatgcgaagagggaccaaacayggggagaaaccttactttataacaacccactctyggaggaattaatccattccatgagagctaattgtacctcactgactaccaggagaacaggaccaaggctttcacaagggatccacccacatgacrcagacacctctccctaagtggaacactggcacagcagggactgaatcgcagtgtgkgttttsgtggagacaaaaatccacacccaaaccacagccattatgttttggatkgtccagacatccactttataactcagtaatcttttgaatttaggattgtgctgttagtaagcagtacaaatttgtctggggaatgttaatgaaaaatgacagaagcagatcctgtaaaattgattcattaactcaaaggactaaccaaataatattcaagaaggttttaattgtttgaataaagagaagtggtgggagaactgaaaagagaatgtacttgtgtaaatcgaatgtacctgataggataggtacaccggtctcaaaaaaattggcactaacgcagtcagaacacatttcaagttaaaamtaggaattaactacagcaaaacagcaccacagatcacatacacggacactccatttcatcatttagcccaacttctcctagagagtgaacactccattccttaagtgttatcacaatcgaattaatttttcctgacatttatttatttcaattaaactcttcttccatcactgaatatgtgaaacactgtccaattgtcttgtgacaatattattaccacagggtatggcagaaaaagcagttctctgggaatgtggccatactgactgtagtctcaattcttctgtgaattcttcatgggactctgggcaaatcacacaaactacctctatttcaccatcctctcctgcaaaatataaggaacagcgtcaacaatatggttctttcaaatgcttacattttatgatgctatgtttgtttctctagcattaattagctgaagcaagtgtgttttgtttttgctttttgtgtttttttacactttctcaaaaccagggaagattgctgggaatctcatgggagattgagagctgtggccgggcatatatgaagtaacttttgctagagtatatggtcagtcactgaaggatattttggaactccggtgagactctttgttttttgtttgtttgtttgagacagtctcgctctgttgcccaggctggagtgcagtggcacaatctcaactcactgcaacctcccgaggttcaagcagttctcctgcttcagtgccccctagtagctggggttacaggcacctgccaccacgcctggctcatttttgtatttttagcagagacggggtttcaccacgttggccaggctggtctggaactcctgacctcaggtgatccgcccgcctcggcctccaaaagtgctgggattacaggcatgagccactgtgccctgccccgtgagattctttaaggtggagtatttgtgcattttacagcaaggagtacagagacctcgaatcaccccaggaagctccaattatgcctggactctacttccttcttgacaagtggaagtctaatttggagacggtggtagctcaacctgagactagcctaggagtgtgcccttcctgaggtccacaaagtcaggagccgagggagtcagacaaaactaggtcaaggttgagtcgggagttgagaaccagcagatactccctagtactgactgaagagatgtgaagttaggtatgaggcaagaagacagaagatgaggctgaggacagtttctgaggcactgaattatatactctggaaccttatcagttacctgttgtgtccccagtgggccagggtggagtggggagcctgttcaggctcactctgaaattgggctttagttattctgagagatgggtttcccttcagggcccagcatttaaattgtccatactcagaaaataaatacaattaatcctcgtgaatatcgacttgcrgacaaattccttacctaggaaaacagaccagttctacttttcattgcattatttcaaaaattagatttgttcattcttggattcatctttgattcttcctgctccctsttcctctcatggtccaagaagtgatgccaaatttatgtcctggaaattcctcaaggccatgtcctcctctccwtttctcctgcctctgtttcatttcagctttcctcatctctcatccatgctgcgtccttaacgcctcactgcaggcaatggtaccctcctacaatatactccatgttgcagccagagggaccttcgtaaatacaaatatgattatgtttctccccarcttaaaatccttttgtgtttccccatagtccacaagggaaygaagaaacaccaccaacagcgtccacatggccttcacgacatggccctgtggacacatcagacgttgtcttgcagtgcctcatccacactatctgtaccactgcaggcctggatacgtcatggttttcatggtgctatcttgtgcctctttgcacctgcacgcactgtgtttcctacatgggatatctgtgtttacaaccaaactcccaggggccaaattatatcctttgtaaasgacttcaaaccaccaggcatttgctggaagtttcacggaggaaaacaagcatttttcatcttttaatctgttttgctggtcaaagaggaaaaggagtggatggacaaagtggggcccaaagtctggatctagttctgaccaacaaggagaaattgatgcacaatggggaagtgaccttggcattttcaactggcagagccggtaagtttgggcacagttcaaatgtgagtctgtagccactagagagaggggtttcaaagtcatggagaaaagatgggggtgaatcctgcaccaagacttattgaggagagttcttgggaacagttacttttaggattccacagggaaatcactgagcgagttttacaaaatactgctgctgggttccctcctccaagagatctttacttaattggtttggggtgcagagtgggaatgtgcatctttaaaagcagaattcccaaactggagagctctgtgagagcttcctgcaggagacattatttgaactgaattttgaaagacaagcttgcatgccaggaaccccatgtatatgaacagaggatatgaaggaatgtaaataatttgctatggctctaaagaaaagaagggagaaatcaagacgtgaagaggcttacactccttgctcaatagtttctaatttatctttttggataagaggatgttataaaggattttaaactgaggtataaaataattagaattggaatgtttacctgaacttcagagtaggcaataggttggcatggatcagaactgtaggtaggaaaattaattgtttaggagagacatgagacatgatagaggtgacagagtatggacaggaggaacacaaaagtgatagaagtaacaggactgttgatcatttagttaaaagaactgcggagggacacacccaggtttctgagagatgtccagtagtacacaggtaacatctacggctcgagacaggttagagattttgaagaaataagttaaaagttgaaacatgaacctatggatatagtggaggtcatacaagaagatcatatyataatgaaaagaagagggcttagaatggtaggaaaggaatcaggataccaagcaaaggagtcaggaaagaagggaagggtgctctggaaatcctgggaaggtcaaagaagaaagggctaaatgtcgccaacaaacaaaatgaaataagacctgggatgtattttttggccaaggcaattagaaaatgattagtatccttatcaggagcaatttcagagaatgtttgggtggacgtctaactacagtggagtcaaacgtgaatcaayggtgaaaaaaggacaatagccaatgtgtacactttttataaaaaccaccctccaaggaccaggcactggccctctctccggtgcccrcagacatccacacaggcccaaagaatcagggattgcacaagccagagcaatcgaacggttctgagtcatctgccggaagccttgccctcaatcaaggcggacgtgaagcatctacaaaggaggaatagtcaaagcagcagcggcggcggcggcggcggcagcagcagcagcagcaggaggtgggggcctctgccaggtaccgggcggggcaggcacggaggtgcccaggttcccgcggaggccacctcttccctggagtgcgtgagagaggsgaagggaggaaggccagagcaggaatcagagcgaggcaaaggcgggcaggaactaggagaatgacggcgggaggcggccgggaaagagagtcgcggggctgtgggggtcgccctggcaccagccggggtcccaagccccaccgcgagacccggcgaaggccgagggccgggtccsgagaacaggtgcgcccagacccgccctgaataggaagctgcccctggagagggagcgtctgtttctaggcttgcgatttgctgcgctgtgatttgctgccggatgggagcggggggtgacgcgagcagtgagtttggaagcgccggaagcttgggcgggagccccgggagggcgagtgggaggagccgccgctgcggaggaggctccgggagtgcgggtggcggggcctggaatttccgtggcgcctggggcagatcggggaggcgccgagtccctgctcccctggcgcccaagcttgcccctgtgcttacagcctattggttgcaccttctccttcccttcctgtcccccccctccgttctttccacccctgccttcatctttctgtatctttcatattctcttcttcattgtctgcttcctctcaaatgggatggggttgggggtgcttcttcacctacgcccctctctgttgcagccaccggcgttactttaaccaattcctcactttccagacactctcagtcctctggctgctgcttcactcctgagacctctccattccaaagggcctcacccagggctgctctccgggcccctcccgcttccctgcctcgggctctgcgtagaccgcgccctcttccctgggtccactcgsaggggcagactcgtctccccagttctcccagcacaccctgatggctgggtctcagtctccgtttcgcgcgcgcgctctcccctcgccctcctctgtctcttccttttactacctccagatattggaaattccacagaaataggtggatttcttcccttgtgcctccactagatgttctgtgtagtttcatccattctcatggaacctctcggaatcgggatgctgatggctccaggtctctggctctagacagtctactcatccccgtccctaactgtttacaaacatccttggctgtctttgttacaggttcacctggtatggtgtgttccacgcatctcaaatggaacaagtcatattccccattccagcctgactcctcatttaaaattccagtggttcacgacccaccctgagtatgaatttataacagctaggcgcctcgggactgggccctcctgtgctctgtccctatgtgagcagtcactgcctggcaattccagcccccacttctctattgcagacaatccctctgctttcagcagtccctggcccatggtggtggcctacgcgccagctccccagcctcttttcataccaaataytgagccgggttatctttstaaagccccaatgcactcatatgagacgtttgtttaaaaaccatgcatggctttccagaccataatctcaagttcaaactcctaaatgtggcataagggtccgtcctatctcactaccacgtggctcacaggaaaccatagaaacccaccccaggggcaccacacaaaccatgccctttgtcttcctgccacattcttggcacctgctaattcctcagcctattatttgcatcccccatttcaccacctacggaatgcctgcccggcttttcttttttctttttttttttgatatgtggttttaataagtttcattacctattgaataaatacaaaagaacatttaaaatgtgtattgaattataaagaacagcagtacaacccatcacccagtttaataactggaakattgtcatcgctggaggccgtgtttccctactgatcacaccctcctccctcatcacatccgcttccctcycctctgtatcaccaccttcctgagtttcatgataataacgacatagttttactgtctacacatgcatccagaatgatttagtttagcctggttttgaactttacgtatatggaataatactgtattactctgtggcttaatcctttaatacattatttgtgggaattgtccatgtcaaaaactaaagaacttatagatatggttctttcagtttttattgttctgtattccattatactaatatactacaatccatttatccattctgtttttgatggacatttgggttgtttcttttttattattatactttaagytctagggtaaaagtgcacaatatgcaagtttgatacataggtatacatgagccatgttggtttgccgcacccatcaactagtcatttacattaggtatttctcctaatgctattcctctcacatcccccccgcccaccccacaggccccggtgtgtgattttccccaccctatgtccaagtgttttcattgttcagttcccacctatgagtgagaacatgtggtgtttgggtttctgtctttgtggtagtttgctgagaatgatggtttccagcttcatccatgtccctacaaaggacatgaactcatcgtttttttatggctgcatagtattccatggtgtatatatgccacattttcttaatccagtctatcattgatggacatttgggttggttccaagtctttgctattgtgaatagtgccgcaataaacatacatgtgcatgtgtctttgtagtagcatgatttataatcctttgggtgtatacccagtaatggggtggctgggtcaaatggtatttctagttctagatccttgaggaatcgccacactgtcttccataatggttgaactagtttacagtcctaccaagagtttaaaagtgttcctttttctccacatcctctccagcacctgttgtttcctgactttttaatgatcaccattctaactggtgtgagatggtatctcattgtggttttgatttgcatttctctgatgaccagtgatgatgaacgttttttcacgtgtctgttgcctgcataaatgtcttcctttgagaagtgtctgttcatatccattgcccactttttgatggggttgtttgtttttttcttgtaaatttgtttgagttctttgtagattctggatattagccctttgtcagatgggtagattgcaaaaattttctcccattctgtaggttgcctgtttactctgatggtagtttcttttgctgtgcagaagctctttagtttaattagatcccatttgtctactttggcttttgttgccattgcttttggtgttttagtcatgaagtccttgcccatggctatgtcctgaatggtattgcctaggttttcttctagggtttttatggttttaggtctaacatttaagtcttcaatccatcttgaattaatttttgtataaggtgtaaggaagggatccagtttcagctttctacatatgccagttttcccagcaccatttattaaatagggaatccrttctccatttcttgtttttgtccggtttgtcaaagatcagatggttgtagatgtgtggtattatttctgaggcctctgttctgctccattggtctatatctctgttttggtaccagtaccatgctgttttggttactgaagccttgtagtgtagtttgaagtcaggtaatgtgatgcctccagctttgttctttttgcttaggattgtcttggcaatgtgggctcttttttggttccatatgaactttaaagtagttttttccaattctgtgaagaaagtcattggtagcttgatggggatggcattgaatctataaattaccttggcctgcccagcttttaaagccagcttctctggaaagtctttccaggattctgtagaggttttcttmttattatttatttatttacttgtttttttctgargatttccatagcactttcaaaattatcctgttatagagcacctgactggcttgaaactacgcatttccatatgtgtgtcttctttagggtgtaagcttctgggcagtgattaacgcatttatttttcattttctcctcccaaaacaggtagtgaacattctacataaatgctctttgaataaactcacttttggatgttgtatggggatgggggagtggaggaggtagttcgtaggtatttggggctcccaggaggaggacratatcatatacttggaaacgtaaggcttgcttttgaggctgactctcactttttctgtgagtcctgtggacagtatttaattgcctctgtctttgtttgtttscctgaaaaggaaaaactastttaatgccaatttatttggttggctggaaataaaaacttctgattcctgtgtttttataacacaatctaattgtggcattggcacctaaagtattattttgtattaaaattaattgctttttagaaatattgggtaaagtccattttgtttaaagttccaaccctttcaaaagctataaagtccaaatgagattggarcaccaggaagacagggggaagagtcattctgttacctggttttctcccctgcctgacttctgacytgagcagaggccaasggggtgcacttgtgtgtgagtgtgtgcacatgtattgtggctgcagggtagatattgatgggaaataccacatactgaccagcacytgagtgttgaaaaggaatggaagtggggacatgagatgaaggaagaggaaagatggaagaaatcagaagtagcagtttgcaactaagagcagttaaaatgtaaagatgagattgatgcaatagttcagttcattcagaactattgaaactattgattcaatagttcagacaggatgattaaacacacctacacacacacacacacacacacacacaccccaacctaagttcatgcttgcttcaccctgagtccaaagctcttatgctaaggttggatcaaatccaaatttatttgtgtctctgtcttacccagtttacccaattctctccatctttaagtttctttggtgccaccttctggttggcccagttctatgaagtytgaatattccttcctgcctcccagtctctgaaatgtcctcgagtgaaagatgaggtyrtggaggaccccgggacttgcctgcacatactactctgccttccaacatctgcagaccctagtataagctctggagaggtcttatgatgtgaggatagtgagaaacaggaatattttgttccataataaacaacctcttaagtatagagtactgttgtgcaaattatgtcatgattgtgttttcttggttcacatttattttacttagttttctgaaccctaaccataaccctaaccctacttgtttttttctgaactgcactaacatttattttaaactttaaagaatttgcactgctttagactgttgttctatatttagagtgttgcctttacactttaaaaaaatatataagctcacttttttgtttaagtaagagacacccttctgttgaaaaatatcttaggaggaagcgaaatatcttaggaggaagcraaacatccaacagtgaagatactttggttaatacagttgttccccacttccttgtctcagccactcaattcccctttcctcctgtgctctaagagacccagaagacctgtccaagacccccactaagggcatacagtttcagagctgctgcaacaggcactttgtaggccgctgggaaactggatgaggctccatctgtttatagaaatgaacacatgcacgataatttatatctctagatagagtttccaggacttttcattttgctcatttgctaattttccaaactggagcatatttttcttgtttgactacatttttcagttaaaattatacatgtttatgaaaaaaaggataatataatagaaaaaatatctgtaggatcatgagattatagataatgatttgtccttttattttcccaaatgttctcaattgtaagaacaaaaaggctgagggaaattgagatgagttggtgaactgcaatattttatgaaatagcccacgtttttatagggtttaatagatataaacaacaatgtaggacttataataatgcactaaaattataataatagtaaactgtaatagctttttagcactttaagcaaggtgcccccctagattaggctcctaccttccacagaactggttgatagggatgctatctttcttgatgattacatttcaaaaggatggcttccaggtctttgagagactgtcctgggatgtaaaactagcaagaagcttttttaaaagatttacatctcaaaggggctgataaagaatttacaatgacaagttctctaaataaaatgctttaagaaaaaggaagaaagggcctagaggcaggaggaagcctgtttagtttgtttatttagtcaagtttaggttgtctaaagttaattcaagctgaggggaatgttaagaccctcttagccaggaggatccaaaaatcaatgcatctaattaaaagtgctccctcgatgacaagattagggcttcatattttatatccatgcctatggactttctttgcaactccgtaacccagtttcagcaactcttggggaaaatggggcatctttttggagtcactttaaaaagtaattttttttttttttgtstttccagtagcctcatatttcaggccagcctatctcaaacaaaccctccaaatttggtgaaatgtatctagctgttttcacaggaagtgatgacagaaatacagtttttattgataaagaattacatatataagttttagaacattctttatagattatattggagacattaaactgaaagataattagcagcaatagggggattttgtgtaatgattaagaattcaggctctggaatcaaactgtgggtgccaggcgtttatgactacctgagggttctggaatgagttactaaacctcactcagtcttctcatctctaaagtggggcaataactatactgacctcaatgtgttattgggtgataatggaaagtgctgaaaacagtgcctggcaccaagatctttttttttttttcctgagatggagtctcactctgttgcccaggctggagtgcagtggcgtgatctcggctctctgcagcctccacctcctggggctcaagtgattctcctgcctcagccttccaagtagctgggattacaggtgcccgccaccatgcctggataatttttgaattttcaatagagatggggtttcaccttgttggccaggctggtctcgaactgctgacctcaagtgatctgcctgccttggctttccaaagtgctgggattacaggtgtgaggcaccacacccgtccgcacaaagaccttttggctgctgctataccaagggaggaagtaagcaggtgttgcagggtgtctgtgcccctgttgctaagagggatacaagtcataggccctgagattggctattttatgaataaaccagtgtttttgtttcctattggtgtgataacactttaccacaaatttagtggctgaaaaatgacacacatttattatcttatggttctggaagtcctaagtccaaaatggtacagcatagcaatgttattttctggagtctctagaagaaaatctgttccttgccttttctggcytctcgaggaggttgcattccttcatcagtggcccctatccctctgacctctgcttccgtcctcatgtctctgtctctgactctgcccctcctgcctctctcttttaaggacgctcgtgattccattaagcccactgggataactcaggataatctcagatctcaaaatacttaactgaataccatttgcaaagtccttattgccagggcagatcatgtagtcacaggttttgggaattaggagtggaagtctttggagggtggttcttccacctaccacctcagcgtccactgactgggggatgaatgactgcgtggctaccggagtcattggcttatgtgcttttccctgctgtgcctttgatgcagaccttctctgatggatgacctctgtgaagcaaatggcacttttgccatcagcttatttaaaatattgggggaagaggacaactcaagaaaygtattcttctctcccatgagcatctcctctgccctggccatggtcttcatgggggcaaagggaagcactgcagcccagatgtcccaggtatgtgtgcttgtcacaaaggaaggagaacagtgtgtttcccttgtgcttccatacagctgtctttctgtacttttgctctagctgaggcctgtggagctggaggtagaaggaggagcagctcggcagtggagaagagcagaaaggggtagaaaggtgaaatgtgttggacagatcatctcctctgatgtttatgggagaagtcaagccatagagttattttctytagatcagatcatcaatacagtctggcaaattcacatctktgataagtaggataaagtataattctgtcccacaagaaagcaaaatattccaattttgttacattttaaacttttgctaacattatatttttaatagacatgtgggtgcgtagattaactttttgttaagtgggttattttagtgcatgattatgcatcctagaagaggaatgtaacacaagtgtggacttatatcttctggagtgatttgaggaatatataatctgtttgattcaaaatggtgatgtatgaccttatctacaaaygaggtgtgggataatgctttaggaacagttctctgactattggtgaagatgtcccagataattgccaaatggatatcattttgccaccaatatcaggagtgtatagacartctcctaaaatgcacccagggaccccagttgacatccttctgtggttgtttctttcaactgattggaggagtgaggctttggactgggggtgatcgagagatataggaataaccttaattctcactctgacttgacatttaatttataatatggtctggagaacttctgtaaaattgcagatgaaacatttttagttttattgctgcttttgtttgtattacccgagttgtaattcatcccagttacttacttttttctgttctgccttccccctgaattatcgcacactgccttgctggcatgaataaatttgctagactagtggttctcacctggtgggtgggaggtaggggtcggtgggtgaatttttccttcctggggacccttgcgaagacctggagttttagatcccataactgagaggtgctactgayatctagtggatggaagccagaagwgctgcaaaaatcctacaatgcttatatgagacaaggaagtgtcctggccccaaatgtcaatgctgcattgcccacgttgagaaaccctgtgctagacaattaggccaaacctttttaaagtaggatcctgtgtggtttttttagtacagaggtttgtttggagaaagctctttgggagagtataatggcagcgttaaaagtcagtgttggtttctgttcccaggcactttgtttatacaaagacggagatattcaccraggtttccagtcacttctcagtgaagttaacagaactggcactcagtacttgcttagaactgccaacagactctttggagaaaagacgtgtgatttccttccagtaagtagtattcacatattgatgacaaagaaattgaaagtaagttagactacagaagagcagataataaagtataactgtactgacttaaaaygtgcttggaattacacttctgaaattacaattttagattttatgatgacttctgaattacgtcctttgtaaattgttactgatacacccatccctgttatcaatcccaatatgtcaattctcctgcacgcagccctgcttctcccccttaattccctgtccctgagtgaccacatcattcaacacgctgtacagagctcctccccagtcccawgtgtggttattcggctgcctcctgctgaggtagcctctcaaattctcttaaatttgcccgccctcttctgaattgcacctacaactgacacaatcgtctttctaaaatgaaaatctgttcataaaattgaggttttaaatctaagcagtttctatttacttcagcatataattccaaggttccctagtccagcctggcataatgcaatcagtgaggttcaaaaatcatgccacctgatatgcagggtgatgttgtcttaaaattagtgaactgattgcagcaagcttggccatcctattggctggaggttctgagaggactcctctaaggctcaaatacatccctgtcctggtagctgctgggtgctgttcccggaatttgcctgctctgggtttatctacctcagaaggtgactytggatcccaggaatctcctgatgaatccatttcatttttgaacatcagcctgatctastactgttgtaatacttgggacacagggagccaacctctacttttcctggtggcttggctcctccttccctctatatcctctttctttggctgaaattaaaatatttgagaacagggaatggacagaggctgggagccagtttccaggcctattatatccaaagccaggtttttgtgaggtaagttatctgggttttaatgtgttgggtacaggacttttctgattggaccccaacttacatttcaaggctcttcccctgccactgtttcccttaatcccctccctgatacacacaaacacacatacacatgtacacacacacacaaacatgcatgcaatccacacacatgcaggtgcccaagcactcacatgtacacatgtgcactcatgcacacagatgttcacacgcatgcacacgtatgaacccagttgcacacacaccctatgatccaggcctatcacgctccattcccatggggccttccttgctctgtattcttccaaccaaccatatgacccagatctaaaatgctatttccttctttgcagttcaacacgatttcttaacaatctagttcccttataaagcctctcgtttaaccaaaaccacaatactgtagttggtgctggtgatgcaaaatgagtaaaagtgtgttagactgcctagtgagggaagcaatattaaagtcagtggagagcgtttgacaaggatgctcctgtgatgttttgtggatagtggcagctcatgatgtcctgtaagtgtctgggtgtctcagctscctcttctcaggctgtggacctcctcaagccaagcaccttgcccagtaccaggcaagaataggtggcccatacatttttgttaattgcacgcatgcaccttgaartggagtgtgacctgtccaagcacttattgtasaaatgcagtaagagaaaacaaaatgcttttgcatttgtgggaacctttmccaaatgagactaaactcagtgttttgtgtttgcaggactttaaagaatactgtcagaagttctatcaggcagagctggaggagttgtcctttgctgaagacactgaagagtgcaggaagcatataaatgactgggtggcagagaagactgaaggtgagacagtttcatttctgttgatttggaattactatacaacgaggcttagattgactgggatgggacttcccagggtgttgccactgtgacctgcrtaccacaggcctgtttgtatgtgtttgctgagtttacaggccagcaatgcaactctgtcatttcttatcagatcatgaagtactgatttctaaaactaatgttgaatctctgacctcctcccctgtggaccgtgctggaaaatccctggaaaatggctcctccttggaattctgttaatcttctatctgagaggcccttccatgctcggagacagaatggcattcaattaagttgcggcttagagagggcaacatttcatgctctcatgttatctcctccgcgtggtaatgggacagctcagtagtttgatctgcagccttctccttcctttttaacttggccatggctacatttgctctcagagtgtggccttttctgaatttgttccctattctggaggtgcagcgacatggagcctgcagtgttccctgcccagaccacattccatcccaccagaaatatttctgccagttctttacttcagtaggaaaaagggggagtcatactttaaagcatcctaaatacctaacaagtaatttcgatacttgtaaacggtggaggaattaagtcacttatttcaagggccaacctagcactcattattgcatccattccatcctatgtcgcaaccactgtgtgtccagcagaagtaatgcccctgattctactgaaagccaatacaataattaccatgggaagggaagagccttttgtgttttcatacatcatctgcctagtggtctttccagttgttcaacagtactgtcacctgaggaacctagaagtttctccacaccttccccccactgccctatacctgtcactgctcttccagggctgcttatgcccttccttcccttaggctgaccacccacatttcccccagaatattagagctgaaggggaccttggagatgaccttgttaccctctcattggacaactcaatttgggcccctctattctacccccctaattcctttgccccattcacccccttcagagaggctgccttctcccattgacagatctgtgttctctcatcctttggaaagctttccttgtctgatgaggtttgaatatatgcatagagcaatgatcctcaaccaggggtagctttgccctccaggtgccattggataatggctgaagacaatcttggttgtcaaaatgggaagaaatgctgctggctaaacatcctacaatgcacaagacagcccccataacaaagaattatctggcttaaaatgacaatagcggtgaggcttggatatgatagtgccaaggttgactgccccatagtcagaatcaagactctggggtgatgttctcaactcagccacttgtcacctgtgtgcactcagcaaaagtctggcaaatgctctggtcctgaatttctacatccataaattgagggcaaaatkatagttgcccttcctacttcaagatttttttcttaagcacaaatgttacactgtgtatgccacactgctaaacaccatcgcctaattcatcagggrcccagaaagacagaactccagcctgtctctcaaccaagcctctgccttatgtgtcaaagggatttttgtaaaagaatgcttatttccccacaaattgcaataaactctcatattctttataggtaagatttcagaggtactggatgctgggacagtcgatcccctgacaaasctrgtccttgtgaatgccatttatttcaagggaaagtggaatgagcaatttgacagaaagtacacaaggggaatgctctttaaaaccaacgaggtagggaaagatttttcagatatactgctactttcttaaagtaatattacaggaaatattctcttggaaaaatgaataatttatttgacatgatcttgattttaatctatttctgaattatattatattattttattttctttgagacagggtctctttttgtcacccaggctggagtgcagtggtgtaatctcagctcactgcagcctcgacctcccaggctcaaatgattccccaaccttagcttcccaagtagctgtgactacaggtgcacaccaccaggcctggctaatttttgtattttttgtagagataaggttttgtcatattgcccaggttggtctcaaactcctggcctcaagtgatacacctgccttatcctcccaaagttctggaattacaggcaggagccactgtgcctggcttcttttctgaatgaatttaatgcctcctgtgtatctttaatggcggaaggaagagagaaacaaaaataattttggtattgatagttttgtttttccatctttgatcaaatctaccttccatctctggtcatatgatttggattggaggagaatttcttctaagccttggaattatgtttgcatgatgctattactctctgkatttagttagatacctttttgcaatatcagtggcaactatgcctatttattgccttaaaagtcaaagttatmcaatcctgagcmcaagaaaaaaaagttagcagatgtaaagcctaactttacsttcccytttgaatattaaaatggctgrtatcaatagttgttagcttgggatttgacatccatcaaatatgatactctcatattgcacaaagatatgaaagttaaaaatatatttgatgcaggctttaaaaacagcagaccttacacatctcttcaaggtccccttcctaagaaagccaaggccataaaaccaattctacaacaaggcaactttccagagtttggaccgtacatcttttctaaccagatccttcagcccaagggcctgaatatttatcttaacttcgataaagaatttttagttggaagcttccatgagaaagcttctctrtgaatgttctcaaaaaagcaaacacagcttcttccaaggataatgtcaatttttgtgtccttctccatttaccaaactgttttttttttctcacctggtaatatttgatctgctggaacaatagcttgttctattcaatactaagatgtactaatgaagattttatatctatcagcataaatgtgcagaaacagtaattayacacacctagagtttctgtgagttagatatatcctatttttagtaaattatacccacttttcagtaatcgaactttaatttttccgttaggaaaaaaagacagtgcagatgatgtttaaggaagctaagtttaaaatggggtatgyggatgaggtacacacccaggtcctggagctgccctatgtggaagaggagctgagcatggtcattctgcttcccgatgacaacacggacctcgccgtggtaagctccaggcaatgagcctgagtatctgtggagtccagctgagctcatttctttatgttcatctaccaattggcatttgaggagtttccagytggggttattacagkcagtgctgggtgaacatcattgtgtgtcttttgatgaacatgttcatgcatttctgttgagtgtatacrtatatgagtggacaagttttgatgaagctaagaagagagagttctaaatatattattattkggaatattattctttattctgcatggaaggtctatttgaaagcccaatgattattgcacaaaagtcctggaagaagggtagggatcaatcttggcagtgattctcaaacactaatgcacatatatgattctagtgatcttgttaaagtgcagattttgattcaatggagtgtggcctgagatgttgcatttgtaacaagattccaagtgatacagatgcttggaaccacactatgaatagcaaaagtctaaagtacaggtgggaaatttaccttatacaagaggagagaaaagtcttactgtgacagaaaaggaacagagtccaggaagggaagtggtaaacttgcaaggtaggaggtgcaagactaatagtgcacttgtaaaccagctctgggaggtgggagaagccttcatttataaagtttgctgattctcatgacatggtaaatactcccaccatggccgactttagtctactgagggtttaacaattgataggggtcagctctggcacaccaatgcacaggatgttgagggtgggctgcttgattttcctggcttccctttggaatcagaaagctactgccctaagtcagggatgacatctgttgtggccacttatgagaaaattaggagagtctagaaatagagtcaaaatcaaaacaatgctcgttggagaggagtacccacctgggctccagttgttaaagggaaggggagatgctagtggaaggcctttctcccttttttctttctaccttattgataaatagaaagagtgatggatcttgaagaatttgaagctaactccaggacaggcagaggacaaacaaggatgctgatgaagtcttcttgcattccccatttctcgtctcatgctcccttctcatgcctcccttcatcttcagatgaaacacaattccctctcttttactctgagttgccctctgatttaaccctgaatagtcccctcattagactcagaagcagagttctgagccatgctctttgtcttttgtcaaacaatctctcccactcrcagtagtatgtattgcatgaagattaatgtaatgaattggttagaattttctaaactgttaaaaaatgtttttaacatttgaaaggagttaggtacaaattgtttttattaaaaatttctgcctgtctcaggtgtttactagctcttttacacttgtctccataaaactgtgaaaagatgaaaatttgggagaaaatcttggtgtgtttataaaagaaaatatctgtagattttcttggaccagaactcaccatctaattgcatgtcattgggggaggggtaataaatgggtgtgtgggtatcaggctattgtcatctaaattttaaggtttgagtctttcttatcctaggtggaaaaagcacttacatatgagaaattcaaagcctggacaaattcagaaaagttgacaaaaagtaaggttcaagttttccttcccagattaaagctggaggagagttatgacttggagcctttccttcgaagattaggaatgatcgatgcttttgacgaagccaaggcagacttttctggaatgtcarctgagaagaatgtgcctctgtccaaggttgcycacaagtgcttcgtggaggtcaatgaggaaggcacagaggctgccgcagccactgctgtggtcaggaattcccgrtgcagcagaatggagccaagattctgtgcagaccacccttttcttttcttcatcaggcrccacaaaaccaactgcatcttgttctgtggcaggttctcttctccgtaaagaggagcaattgctgtacataccctcctttccttctacctatcttgccttaattaacattccctgtgacctagttggtgcagtggcttgaatgccaaaataaagcgtgtgcactggatagtgtgtgaaagtctttgctgaaagttccagagccattgagaataactgaggccgcagatgcatgaaatttgggcctgggaaggctatgctggttttggagtgtttggggtgcctgccattgcctctgccttcacctaagtctgtgcccattgtttcaggggatcttatggagcatctcagggcttcaggagccagccctctatgtgctcttccatccgcccggctctgcccaccaccactgccaggctgaacaggggactagtgcccaggtgacactgcacacaaagccaagggcaaaccctatagagtaaagctgcagccaccctgtgtctcatgtgcagctgaaatagtgatctgcttctgtcactgtcacatagacagccctgcatgccccctgtctcacacagtttgtaatgaagacagctccttctcatctttccataagcctgagatacaagttcagggactcagcaatgcactttaggactgagctaggaggcaaatatctgaagcttgctatgctgttctttccattccttttccctctgaaacacacaaaataccaaaggaacttacrcaacacaccactgagtcctctaactaatcatatgtgctcagacacagctcaagcacaccccttagttaagaaagaacctccatatacattaatttttttctgcctaaaaataaaattgcgttgtggcagcaatttggaaactacagcaaagtctccaaaaaaattgaagtcacccacaattccaacacacagcaatcactgctgttaatagtgatatacatccttccctattatgtgtatgcaaatagaaatttataagcattttactacaagttaatcatatccttcagtagcttatttcttcccttatgaaaaacctcccttaagatctttccaggtcatcaatttgatgtgcatagtattccactgtgtggctggatttctataattgaatctaattttagacagtttgagtaattaaaattatttctattaacaaataatagattgctaataatatatattrtgctgttttggatatactaaatatttgctcacatccttaatatattttttaaaattcctaacaatagtactgttgagataaaagttgagcacattttgagacttcttccaaattggtccctagaaagttacactggtttgtactctcacttatgtcactgtttataccaccactgactgctgcctgctttattatttctttaatgagttggactgaacagtggttaatcctgactctgtttttgactgacagttaacagttacatgaaccattcatattacagctcttacttaaatttgaccaagccaggatatatctgttaggccacattcatttagggatcatgttttccaaagcaggtttgggcaaaattaatccacaggactgaaaggtatacatctgtgagttttgttctcacttccacctctaatttgaagaacactttaattgacacagaatacatttcacatatttaacctctacaataagttctgacacattttccatgaaacaaaccatcgctatattcaagataatgaacctatctatcatactcccaaattccttcttgcatctttgtaatttctcactcttccttctccctctccccgtcccatcccaaccactgatctgctcaggcaactaccaatcttctttctgtcactatagattaatttgcatttttaaagaaatttacatacatggaaccatacatcatctatgctttgtagtatgactcctgtcactcagtacaattattttgagattcatttatgttattgtatgtatcaatagttcatcccttttattggtaagtaacatttttttgtataggtataccatgatttgttgatgaacaaatttacctgttgatgaacatttacgttgttaccaagatttttgctattgaaaataaagtttttatgaatatttatatatatacatctttgtatggacatatgtcttcatttcttttgtatatagatacatagaagtagaatggctgggtcatatggaaggtgtargtttaactttttaaggatctgccaaattgcctttgaaagtggttgtatcatttaacattcccagtaaagcctaggagagttctggtttttctcycttctcaccaatacttggtactaccagtgttgttactttcagcgtgtaccggcttttggttgcatttccctaatgcctaattatgttcagcayttaaaaaaatgtgcttaggccgggcgcggtggctcacgcctgtaatcccagcactttgggaggccgaggcgggcggatcacgaggtaaggagatcgagaccatcccggctaaaacggtgaaaccccgtctctactaaaaatacaaaaaattagccgggcgtagtggtgggcgcctgtagtcccagctactcgggaggctgaggcaggagaatggcgtgaacccgggaggcggagcttgcagtgagccgagatcccgccactgcactccagcctgggcgacagagcgagactctgtctcaaaaaaaaaaaaaaaaaaaaaaaaaaaccaaaatgtgcttatttgctatccatatatgttctttgatgaaatgtctttttaaatgtctcatcgatattttattgcttcttgctttattttgttttcgtgtttttttttttttttttctttttgagacagagtatttctctgttgccaggctgcagggcaggggcacgatctcggctcactgcaacctccgcctcctgggttcaagcaattctcgtgcctcagacccctgagtagctgggactacaggcgtgtgccaccacagccggctaatttttgtatttttagtagatayagggtttccccatgttggccaggctggttttgaactcctgacctcaggtcatctgccctccttggcctcccaaaattctgggattacaggtatgagccaccgcacctggccttttgttttcttattgtattttgagaaatctcgtgatatggctaccaaatcttttatcatatatgtgatctgaaaacatttttctcccagctcatggcttcaattttcatttcttttttttttcaatctttattttgcacactttatttttttactatactttaagttttagggtacatgtgcacaatgtgcaggtttgttacatatgtatacatgtgccatgttggtgtgctgcacccattaactcgtcatttaacwttaggtgtatctcctaatgctatccctcayccctcccccccaccccacaacaggccccgggtgtgatgttccccttcctgtgtccatgtgttctcattgttcaattcccaccatttctataacagtgcctttaaaaagcagttcttaattttgatgaagtccattttatcattttgtttctttgtttatgcttaatgcttttgttgtcatattgaaggaatgctttgcctaatccaaagtcacaaggatctcctatgtttcttccagaagtgttaccggatttaattttcctttttggcctatgatcaattttgagttcatgttttgcatatgatgaaaatgctatccattttccactgaattgcctttgcatctttgtcaaaaatcagttgatcatggatatgtggttctatttctggattctattggattccattgatctgcttgtctatcttgatgtcaattccacattgtctgaattactgtagcttaataataagttttgaaaacacttaagtgacataagttttccaactttatttttcaaagttgttttatctgctttcagtcctctrtctttccctgtgaattttataatttgcttgttgacttgtacaaagcctgctgcaattttgattaggactgtgtgaattctaaatatcaatttggagagaatagacatactagcaatattgagtcttccaacccgtgaacaaggcatgtttctcattcttttaggtttttattgattaatctcagcatagttttgtagttttcagtatacaagtctggcacaaattttgtcagatttatccttaagtatattctattttgtgctattataagtggtgttgctttttaatttcaatttctgattaattgttgctagtatatggaaawataawacaggtttttttttgtatctcagccttatatcttgcaaacttgctaaaatcacttagttytagtagctgtgtttctagttccatgtctgctaataaagacaaaatttcctctttctttcacatttagatagcttttttttttytttgccttattgcactgacttgattaraagtagtgaaaacagacatccttgtctggttcctgatyttaggggaaagcacgaaggctcccatcattaaacgtgatattagctgtaggcttttcataggtgccctttaacaggtgaagaaggtctcttttattcgtagtttgttgtgtttatatcaggaatagatgttggattctgtcaaatgcttttttgtttcttttagatgatcatatggttttgttaatattgggattaatttttgaatgttgaaacaatcttgcgttactgggagaaactccacttggtcatgatgtatttcctattttgtctagtattggatgcaatttgttaaaatatttttagaattgctcatctccattcatgagagacattagtctgtactattcctattttgtaatatctttgtctcactttggttttaggtaattctggtctcaaagaatgagttgagaaacatacctacctttgcaattttctggaacagatgttgtataattggtattatttcttcctttaatgtttggtgaaaccatccgagactggagtggctttatattgcaactctattttcattaatagatagtgaactattcaaattacatatttcttcttgagttagctttggtagcttgtgtctttcaaggaatttgttcattttctagtcatcaaatttactgttgtaaagttgtttataatagtctcttatttttcttttaatagctgtaaaatctgtagtaataccatcgctctcatttctgagattagtagcttgtgcctttttctcttttctgatcagtatgactaggtgttgataaattttattgctgtttctcagaaccagcttttggtttcattgattttcactattgtttttctgtccacaacattgatttctgctctgatctttattatttcctttttctgattacttcacatttaattttttcactttttgatgtaaccgaccacgatccctgatgcactgaacaaagtaggatgaacgcgggaataaaagacaaagacaaaagagtatatttggaagaaggggtcgggggcaccttgcctctagtaggcaagggccctaaactttttcagtcctccgtatttattaggtaaaagagatagcaaaaaaagtgggggtgattgtcgggtaattgtcagtcggccgtttggttcacagcaggcttgtgacactgcatcctttgaacaataggcgctagattttccagtagataacytcaaggagcctggtgccagggagtgatgaccctcagcaaacctcttggcggcaggtgcagtgtgagtttacccacatcctgcattcatgataaacagtttgctgtttgatcatatagcctccagtggaatgctgagttggtcatgatccctttgctggctctctacattttgggtatttttttagtttttttaaggtgaaacaggtaattgacttgaaacttttcttggtttttaatataggtgtttaccaccataaaaaatttccctaagtattgatttagtggcatcaataaattttgatatcctttgcatttttattcagttcaaaatacattctgattttccttttgatttcttttttgactcatgaattatttgaaagtgtaatttttagtttccagttttgatgatttccaaagrttttatgttattgacttctaattgaatctcaccatagtcagataacatgtttttaatgacttgtattcttttaagatattgagatttattttatgcccctaaatatggtctatctcaggaaatgctccatgatcacttgaaaagaatgtatattctgctgttttggggtgtagtgctctgtaaatgtgaattccatgaagttggtgatagtgttgttcaggtcttctatataattascaatgttgtgtctgcctgttctagcaattgttgagagatgagtgttgacatgtccaactataattgttgacaggtccagctctaggtcaaaatcccatatgtgatcccataggcctgaccataggcaactacaaggcaggctgcatgggggaggtggggggaagctgccctgctcacagatttggtgcacagccagggcaytgaagtgtccagtgggagctgcagtcaaggactcaggcccttgagccaggccatgcctttatgcatctctacattccgagctcagacagcttcactcagagccctccttatgaggggagcagaggccttcgctgagacactgttcaggagcctctgaagagactttcttatcaggagccttgaagacactctcttgcactcaagctcagcactcagtacttttccacttctagtccatccttcccccatcccatccctcctgtccctccccttggctcctgggtccacaaaatggcaggaaccttgcgtttgggacttctaggcaatgagacaattctcccacctctgctgcttgtcatctgacccttcctggtgctgttccatggggaaaataatggcaccatgtcctgggtagcctcttcttatcacagtaagcaaataaaagcttgactgttactttcagtggggctagttgtcctaattcaacaccttaacacctgaaagtactcacatacatgccccctctctctttctctctctctctctctctcaatttgacaaaggagctgagtggtcaattaagcacaatgcctttttggaaaaacaaaaagcctaaaagtccttcagggcacagtagaggtgctggtggttcatctgcaagagtctgagggtaccgcagaacacttgccagccatgccacggggtgtctgggaggtgccagtggaccccgcagggcacccttagagtgtgctaatgtgttgtttacagaagcttttcggttccgagggggatcattggtcctcagctgggtactacttgggctccgacagatctggcaggtttggtacactgtaacaagacccatgccattgaaaaacacttctggatgcccttcgcagaggctatagtagccccgcaagtcaccctgggggtcctctgggtctacaatgaggggctgggggaagcagaggataagactgttcaccagactcagatttcaagaatttttatgccactactgctggttatcaagcccaggtaaacctcataaggccagctcagtccgtcccagacacaatccagctattttaacaaatgcctaaggcatggaaagagtggctgcttccaagaaaacagattgcagaagcagggaggcaaagatgactatcvggcgccctctactggacgatctaggcaatgacattcccaaattgctctctgagcctgatgattcaataaaggggctctcaaaggaggagactgaagagttcctcaccaaga

SEQ ID NO: 13246 - DNA, 86081 bp, Homo sapiens
gtgaagttcctgccaccttgggggcccctgtgtgagaagctggcaggcctcccgagtggcacgggcagcacaagcatgccagaggaggctgtggccacctcccttccggcccggcgcccctctcagactgccaggggattaaaggccttttggcctttgtgtcgggctctgagcccctggcagtttgtacaacaaagtgctgccccgacagattccttcctgtgtgctgtctgtcgcctgtggacagggcactgggtggcctgggggtggggcagggcaccttgatcctgtgtctggggcctgggttgcagccgagtaggggaagcacttgttttggggttacctaggagcctgcatcctggcagagggggatggggaccttgtctgggttcatgtccctccccagagatttggggaccatgggtcacattgtctgctggttccttggcagtgggcaggggaaggggcactgaggcagagcctgtggtgaccgtggcagggaggcaggtgggcaggcaggagctcttttgtccccccgcccctgcactgtctctggattttgatggggtgagctcactscatccccacatgcctggagcctggccctgggcagctgcrgccgccctggggactgtgcagtgctcagaccttcctgcctagctgcgggggcagtcgggggctcagtcccaggcttgggctacaaggagggtggggtggactggctgctgaaggcatgtgaacaatgtgtctggagaagcccaaagccctgggttggtcccagagtcagcctctgagcaggcagacaactttgagccataggacccaattctattgcccaccccttgctagggtcctgcccactcagccaggctcctcccttcatcccagatctggaggcgaccccaggcctgagcccacacctcacactccgcatgcatcacccctcaaccacacctacccctcacccctaccatgcaccctctgcatgatactaatcctaatgcttattaagcacttactgtataagtaattctagtgcttattaagcacttactgtataagtaaaygcctcactaagtgccttacctgcttgatcccatttacccagccgattctctctgagcctcagtttcttcatccagaaaacggaaataataataacacaagctcacagtttcttgaccgaaagcctcagagtcagatgtgttctggaattcagaatttttcaagtttgagaaggtgacatagagcatgtgcccagccggcatgtgacatccccattggagtctgggggtcacaccccatgatcaaacaacggtaatattgctacagtgaaacacaggactcttccctctgagtggagtgaacacactctgaatagcttcatgtcggttcagttcagggcttggcacccaatgagcttgctataaacttttttttttaacagagtcttgctctgtcgcccaggctggagtacagtggtgcaatctcggttcactgcaacctccgcctcctgggttcaagcaattctcctacctcagcctcccgagtagttgggactataggcatgcaccaccgcgctgggctaatttttgtatttttagtagagatggggtttcaccctgtaggmcaggctggtctcraacttctggcctcaagtgatctgtacctgctctccgtatctgtacctctccctccttctctccattctgtgccccactcctgtrgttttctcctccgttcttagtcctttcctaggcagccttgtctgcctctttatcctcacccaggccaggagaggaggatccagcctgcattcrttgtccctaatgacacaacttggacctggagttccatgtgaccctcgttctcaccaggagggcctggacatagcccacctctgggattgggtgcctcccagaagccctcgcccacagtcctgccagtgttcaaggaatgcctgcccactgggggtcaccctgcctgcatcccagccccaagcaattgttctcagcctgttagaacaattctctggcctgggcccggttgagtcagctgcctgcacaccgccaaaccaggaactgcagggtctggaaaatccccctctctgcttagctccttcctctctggccgaggtctgacccctagacccctcctctccagctgcccgtctggctccaacacatgcctgaagtgctgggttcctctgggaggaagccgggctccctcrccgccggagaygggctggagggcaggaaacctgggttctatttctgaccttggagctgctaatggccctccttgggacctgaggcacatgctgcacagtcccaggccactgccagctcaggcatcccatgggkccattctgagagctggtcaggttggggacagggactggccaaccctgggctccctggtattgctctctgcttaggcctcatggccagcccagaggtccagccctgcctcatttcctggtgagcagaaggcttggggtgggatgccagctcctcacctgtggtctgggcagacacgtctcccggggctcactggggaaggggagcattcatacctcctcagcctcctccaagggtcactgtcaactcaggtgatactaggctgaggaaatgcattgcaaagtggcatgcmgtgtggctgagaggctttgcaagagtgactcccagtgatctcrtatctgcttcattgcatacccctggtcacagaggtgatatagcacagtggtagctgcttaggtattggagcccgaccaccagggttcaaatctcagccctgccacatgccagtttccacgggtaacctgactttctctgctctctttgccccctttctcagtggagccccataagacctataacctggtttaggagtgcctggtgcatagtaagtgctcaataaatgttagctgttattattcttcaagcagatcctggtctttccctttctgggtccaaggtccttctatggtcaagtcccaagttccttttggctctttctgggagcctctttcctgtctggttccatctgctctcccagatgtgaaatacagagctsctggaaccttttgatcttcagctttttacaaatgaagtctctgctcttgctgacttattccttgctatgggcccttatctgaccctggatcctcagaccctagggtgggggctgcaagcaacagcagactggcagatggagggacccgtgctctggagtcctctggtggagtgtggggcacttctgtccaagtcccgacgtgctctggcctctctttcccctctccctgcagatgtgtgttcctggctttctttccatgttgaatctcactttgctatttcctgtctggtcccaaggccacccccgccgccacccgctgaccagctccctgctccctgggaaaagctctggaccttgctcatcattcaccgctaggttttcctttccagacggcagtgtctaggagatgctgggagtcgcagtgctccaggcatgccctccataaccttggttgcaatgagagggggattggcattgacagagccccccaccaggttgaggggacccctcaaatctcctctaaccagagtcagtgcccctgcaccagccccagcctcatacccacgttgggtcagtcaggcctgctccagccagtgggaacactgccctttaccccacccagggaaggaggcagagcgcctggtaggggctggtcttacggttctaaccagggactgtgggaatcccctggacatgcacaactaagaccaccctcctgggatggaaaaacctgactcactgtctctgagaaggagcccaggaatctgcatttctcaccagctcctggacgttctaaagcacactcctgaatgcgcatcccacgggcacagcctagaagtccacaggccagcactcaggaggacagggagagggcagggagaggagaaggaacaggaggcaacatttgccgctggattgttgggggtaagggctttaggccaaagcaggaataagatgtggacaactcagaccttccccaaggtctgagagcaccgcaaacacaaagatgaacaaatggcacccagccactcccccatccagggagctcacagcctaggacaggagatgcttatagattgcacagaggtaggtagtgcctccccaaagcaagtcatcttcacagagtgactggaattcataggtgatgaattccgtttttgtccgttcatttattcattcattcaagtatttattgagcacagggtgcagaaaaggtggagatgaattcatcacagcccttgccttcaaggtgcttccattccaacggaggtacagacaataaccttgtgagcccagaaccagactggggttgaggtcactgtgaacagcaaggagtygggacaaagagagtttctttctagtcatccttatttaggcataaatacacacaacaaaatatacccattttcagggtacagtcagtaatgagatatgtatgcccagggaaccatcaccccagaagtgtctcttgtgcccccttcccagtcacccccagcctgcccttggtcccaagtgactactgatctttctgtcactatggattagactttcacccctaagggttcatataaatggaatcgtatagtttgtagtcttgtgtgtctggcttctttcagatccacacctatcaatcagtggttygatcctccttattcctgagtaggtggaggaggtggtatttaagttgattttggaggatgcattggagttcgcctgagaaacaaagagaggaagggcattccagcagagggcccggcgtgagagatatggactgtgggagcagtaggggtggggagggaagggggcctggctggctctttgtttttttctcctccttggcctttgctctggcttggacctcactaccttgtctagcccttgtgggtttggttttcaaaagcgagaccatttccttctggcttaaggccagggcagggcctgaggccctcatgccaggccattgccagtctgtgcatacttgtgcttgtggaatctggggtccagccatcgtgaatctgcacacttgagggccacggggttcccttgggctcccctgggtttgttttcctctaagttatttggtaaaactgctttggaatcatccggatcttgtctagggggaagaggcactcattgcccggacccacacctgagaaggcaggtgttatggctgctggggcccttctgctccggcccacatagtttgcaggccccaaggtggagcttatcctgggctcggcagcagcctgaggtcacgtggagttgacaccacgcctgtccccattcagcccagatactgagctctgcctccgcrctgctgggcccagggatgagcctgtcagtgtggctgcatgtgccaaagctaattctccaacacagtggaatgtgttccctgcagcctggagacgggcaggccagagtgaggcaggaagaggagccaaatggcctggggaggagctgcctggggaggcaacggctttgagcagctcgcccttgacttctgcctgtgtccccacccatgctgaccctggccagccttccacctgcctgtgccccccatctgcgctgcccgaggccacccctttacccgcccgcatccccccatccactcactcatgtcctgggtgtcccttgccttctccaaaggaaaaggagtctttacttaccaaagtgatttacattttattgtctgctttatttgaggattcattcggaaatagcagggttgggctctgaagcctccaggggctaatgggacttggggaaactgaatcaaaagggttcagccccagcctggctcactgagccatactaagtcaaatttaaccactaaggggcctgaaggtgggattctgggtccccctggaagtgaggggaaggaccgtggggctcagtgggagctggagagagtgactcaatcagctctcgtttgcttacaggtgacccatgggctgagggcatacgatggcttgtctctgcctgaggacatagagaccgtcacagcaagccaaatgcgctggacacattcgtacctttctgatgatgaggacatgctggctgacagcatctcaggaggtgagccaaggatccaaggctgggagcagaggggtggggggtgagactgtgcttcttcccactggcatgggggaggagggtgaccgaccattccgagctttctcaaccctgtcccactgtatactaggtgcccagaacagtgcctgacacccagtaggtactcaacaaatacttgttgttgctgattacatctcttttttgcttatagacgamctgggcagtggggacctgggcagcggggacttccagatgggtaagttgctgcaggcctcctgcaggtctccctcctgtcccccagggaagccccagagccagtctcctgggctgagggctccttgggcctgccctggggtacaaagcaagaagaagtgggtgtgatctcttaacctgctgagtgacagttgtgcagactgattggcaggtccctgcaaggctggtgtggccaggtcctgtgcttgcccatgccacaggcacaggtatcagggcactgggcaggtaaagcccagttctgctggggactgacagccagtcagctgtttcacattcaaagcaaagttctcacctcccagggcagctcagctgttgagtccttccccagagccctcctgggggcacagagctggggatcccaggcaaagacaagtggaacagaggggctctgtggaatcgggcattcaggcaggcagcagggcatgcagagcacagatcgagcctgacgctaggcttgggagagaaccttgccttaaggtgggtcatcrgctgggaagcaagggttcctagcttagggaggcaaggctaggctcttggagggaggagagtcagcccccaccctggtcagactggcycagcactgggatggggacttatagtccctgcttccttccactctgggatactgggtggagaaggacctaccccaggacaaggccctgtggctctttatggttcctactgccctctctgggaggcagctcctgggacaatctgtgaccagggccaaggatggagcaggtgctcaggtcagaccaactactgggccatcccgtggcatccagggctgccttcaccctaggcaggccttggccaaatctggcctgggcctacttcaggggtggagtcacctccctttagctgacatatccggggccttcaaatgccagtgggtagcatcctaactgggtcagtgtagacaggagggtaggtcactgggtaacctggtcctgactgtgacctcccrgagcctggacttggggctctgcctgaaggttttccatttccatgtgtaggtctccacgaggctgcaggatgcctgsgagctgggtggggcttgggagagggagtgtcaggtgggccccaggcacacatggcacgtcccgtcctggaatggcctatgctaatgtgtccctggagctgcctctggccaagccaggcttgcctctgagatcaccctgtccattcatgaaccatctccagcccctccccgggggctgcccactgcagcagctctgccccagctgggcagtcctggccagcccacctgcccttcctgagaagcagctgtgagggcagacgaggccagagggggaagaggtggggaacagggcacagcagctgtagggggcccaagaccagggtaggtgcctttcctcgcaagtgggaacaggtggggcctcagaccctccaggccaaaccctggctcctgccagctgcccttggggcaggtccaggcagctgggctgaatgccagtcagggaggcagcaggtgtgcctccctgatcctggggtcccagggtgcccactcagacttgaccaagggcagtgcccccactgcgcccatgagccagagccatcctgcctgtcatggggccatgcctagcctctggcccagtcccagaccctggactccagcccctgagatggctcttcccctcctccccctgggcatggctgtggctccctggctcagctccagccccctgtgtgtcaagacccgtccctgatagcctcccctccctaggaccccttcccacgtctcctcccccagtttctttccatgtwctgacctgtctctttctgtcttcccccatgcccgtgtgtcctgctctgacccttgtcggcatgtctgtgtgtgtcccctgtcctccctgccctgggccctcttccccactccttgagtgtctgtctctgcgcctcctccctctgcctcatcctgttcttctccctctctctggctcaccatctctgcttctgtcgccctctgtctttccctctctcccctctgcctgttcttttttttttttctttttccctctgcctttttcttcacctttgtcttaccttttctctctcattctcccccgccccactttctttatctctgtctctgtctttctgtctctttgtgtctccctctctcttgcaatgtctctgcctctctctctgcttctctccatctcgtctccctcgctgtcaatgtcccttcttgcctccttctctgtctctactctgcaggctcagggcagcccctgggccrcccgcccgtggctggcatgatggtctcggagcctgatgaggagtcccctctcagtaagtgacccaggccctggccaggtgggagcgctgctctccctctgcctccctccccatcctctctccccactcttccttttctctcctttctccctgttctcttcctccccaacctgcactttgctgcgagtcacacaagaggctcagaggcacctccctgcagagtccaggggctaggccagccactgcccctgcccaggacacagccaggcccaccctgggcccacagatctaaacacagtgggctggaaccctggcgggcgttctyccccatggggtgttgacgggcagagatgggtgcagcagccctgcagggaccaggccctgcattccagaggccacttgtgtccaccccagcacaggccaatcctgggcccacccgagggacccacagggacccagggctggagttcgggggcctgggtgtgttgcagagagttctgttgagcagggatgggaatcaggagttggtgagtagcctgctccggggccagggctagtcaggtgtgcagcccccacttctaccctgagtgcagggcagctgtctccctctcccggcctctggctccaagggaactcaccagatagggtgagaggagggagaggactggccagagagcacccctattccaaggcagcctcgcccctgctggctgcaccagtgtccttggctctggaggctggttcttttttccttttcttttctttttttttttttttttttgagatggagtctcactctgtcacccaggctggaaggcagtacagtggcacaatctcggctcactgcaacctctgcctccctgattcaagcaatcctcctgcctcagcctcccgagtagctgggattacaggcatgcactaccacgcctggttaatttttgtattttcaccatgttggccagcctggtcttgaactcctgacctcaagtgatctgccggcctcggcctcccaaagtgctgggattacaggcgtgagccactgcrcccagcccgggggctggttcttgaaatagaggtggcctcaccttctgccccagtgctcaggcaccagctgcagggtgggaratgggaggtgttcacccagacctgcccttggtctcgaagaacgaagcggggtggggtcaggctgaagggcctgtgcccttcccaggccctagtagaaaggggctttgtggagctccagtccccttccccaggagcgggcacattcctgggcagaggcccggcctcctcgcccgcgctgggccgtggggctgaggccaggggcttgggtggggggactctcaatgggcctctgtgctggctcacaaggggcctctgtggctgagccatggcccccacactccagcccacagagccccgcccacccggcacccaggagcctagcccagcggttcagggcaggcagcgccagggctttcttcacctgagccacagagcaagaatgtcctgtgcacctgcgggcctgatggacagagtaaagcgggaggaggatgggcctggcagtagcacagacagtgccactccctgctctgccacctacacaccggatttcagatttttggattagggatgcttggcttgtatatgactcatttgtcactcttattcattcatatctatcacatacatgaattcacaaatattgtgaaacgtaatgagcataaaatgtctcatatatagtcggtgcttaagaaacgatagatgtactttgggaggccaaagtgagaggattgcttgagcccaggagtttgagaccagcctgggcaacatagcaagaccccatctctatcaaaagtcaaaamattagctgggcatggtggcatgcacctgtaatcccagctactcaggaggctgcagtgggaggatagcttgagccttagagtttgaggctgcagtgagctgtgattttgctaccgcactccagcgtgggtgacagagcaagaccctgcctaaaaaaaaaagaaacaacagatgcatgtgtatgttcacaccagtctgagatgaatttattcagccatcactttcaaggaacccgctgtgtaccaggcacgcggcaggcactggggatgcgggcgtgaatgaaatcccaggttcccctccatcaagcctagagtctggtggtggagagaggaccacagcagcttcgattcttgggcggtttgctgtgtgccagktgatgcatctgagtacaagggcctggtgcatgtgagcacaatgtcatgcactcctcgcagcaacccaggtggtacatgcagtcaatatccccattaggaaacagaaactcagagccgaggtcagtgcctgaggcatggctgaccttagaactcacaattgttactgtgatgtgaaacctggcagaatctatgcagtacacggtggaaggtgctctgctagggaaagcagggcactgtgggagcccaggggagcggtctctaccccagccagggcagatcaggaagatcaggagacaatggctgagccaagtcctgaggaatgagtaggaactgrccgaggaaggctggcagagcctttcccagtcacacgcaggtaatccctgtgccaggccaactccctctgggagccaccccttcttgtccagccttcctctgaactgtgggggtctcctcttttgcactagcacttggtttctggatcaggccatttcccctgttagttaaagcccctcagtcaagttggggccttggcattgacccctgagcatgtatacctacaggcagtcctgggtgtagcagtgggcacacaggtgtcagcctcgagggaggcctctgggggccatccccccaactctgcctgaatggtccaactgcctaaggccactagatrccaggctggggctctcaaaatgatcctccttcgattttccagtttatttccgagccctggtgaatttcactcgctccatcgagtacagccctcagctggaggatgcaggctccagagagttycgagaggtgtccgaggctgtggtagacacggtgaggtgaagggggtttgggaagctcgcgggtgtggcggggcaggaccgaggatggggtgaaggcctctggggctgatggcactgtgtccctccccagctggagtcggagtacttgaaaattcccggagaccaggttgtcagtgtggtgttcatcaagtgagaaggggctccctgggggctgctgggggacttgagcgggtaacctggagggggctgatgaggatgggaaggaagcctggcaccgcggaaaggcctatgggatgagtcgctgtgggtggaaattcaggaattggtcgggggatcattgggacctttagttgcccttctttgggtacaggctgtcccggaacagggcctgagcgtcggggcgggagcctcatggaggagctgagaacacaggtgtctcgctgaccctcctctcctgcctgtctccatccccagggagctggatggctgggtttttgtggagctsgatgtgggctcggaagggaatgcggatggkgctcagattcaggagatgctgctcagggtcatctccagcggctctgtggcctcctacgtcacctctccccagggattccagttccgacgcctgggcacaggtgagcctatcctggtgtctgggatcgcctcytccagactcgtggggtcccctttcagtgtctctgccataggctcccaacttgggcttgcacaccactagaaacagggagctcactactcctgagtctgccccatcgatctttacacaatcttggcttggtagagcacagactgtttcctctagcacatacccrttagacccgagttctgctccttccttctagacctctgcacattgacaataggtaatcaggcctttatttatcctgtacttccaagtccaaaacacattagtacttaataataatgagcaactgtttactgagcactgactgcctttatttccagcctccgggtcagtcttcacagcaattcctatgaaggagatgttattcctcctgtttcagagacsagggaactgaggcccagaaaggaaaatctaaatttgtccagaatcagatgggcagatagtgaawaggcgaggatttcaaacaaactcggtgtctgtgacagtcttgccagaacctgtgatgacagaagcaggagaaactgaggcacagagagactaggaaactggtccaaagccacacagcggttaggtgcagaatcctggcctttgtactctgggtcagcccagatttccttctactgtgcctttggtctcctgttttaacctcctgagtctcttttttttctctagaccgaacagccctagttcatccttcacaggtgtggttctyggccctgtctccatctcagttccctgtctctgggaagaccctgactcagtggaactcagaatggaacaaactccatcccctactatggtgtagcccaattaggaaaagacagtgaaaccatcacctcccttgttccgcacctcaattaaagccaagcgtggtggtgcgcgcctgtagtcctagctactcaggaggctgaggcaggaggatcaccggagcccaggagtttgargctgcagtgagctaggatcatgccactgcactccagcctgggcgacagagcaaaaccctgcctctaaaacaagacaaacaarcaaaaacccttaattattgcacccagagatcaagcttgctcttctgcatcatcaggcccaggtctaaagactgctgggggtccagccctcctctctcacttttcaataagtcctcctggctagggatggtggaatgtggcccagccctgcagccctcagctcccggctcccaggtggaacagccactgatcacatcttcctttccagcacagacccccccacccccgccggccgctgtggcggtcgcagtgacaccaggtgagagtgtaagccaggccgaggcccagccaggttcctagagaagttaaggttggagaggaggccgggtgcrggggctcacgcctgtaaccccagcactttgggaggccaagacgggaggattgcttgaggcaaagagttcgagaccagcttgggcaacgtagcaagaccctgtctctaaaaaaataaaaaagaagagagaaaaaaattttttaaaggatggagaggaaagaagggtgtgggcaagatggctggctgggcacagcccaagacagctgggcactcccttctcccctccttctttgtcctcaytgggccaggctgtggcctgcatgtgtgtggtgtggtggttgcatgcgtgtggcatgtcaactgtgtgtggggtctgttttagagatgggggaggccactgccgcatgtsccatgccccacgtgtgctgtggatgtgtctagtgtgtgctgcttgccctckttgtgcctgccagaaaccgagctgcctgacacagggccctggakcccactccagccacacagcacctacagcttcccgcacctgcctcctgccgcctctgactccagtctgcttcctttccacctgcagtgccccagttcccaagagcctgcacggaggccgagtttgcctgccacagctacaatgagtgtgtggccctggagtatcgctgtgaccggcggcccgactgcagggacatgtctgatgagctcaattgtggtgaggggatgtccggggccaygagtggtttgggtgccargggagggccagggtcctacacctgggtcttggagcccatcaaggactatgagggtttggtgcaggcagaggatgggggcataggaagggtgatgacagagccaggcagggggtggcagggagtggtgttggggagtacagggtgggcctggggagggttggggacaaggagcaggtgaggagccatctgcttctgccaaatgccaagcggaatctatccacagaggagccagtcctgggtatcagccccacattctctctcctygtggagacgacatctttaccgccccggccagagacaaccatcatgcgacagccaccagtcacccacgctcctcagcccctrcttcccggttccgtcaggcccctgccctgtgggcccmrggaggccgcatgccgcaatgggcactgcatccccagagactacctctgcgacggacaggaggactgcgaggacggcagcgatgagctagactgtggtgcgcaccggcaggggtgcaggtgggtgcggggagcaggaagctggcccgggaggatgctgctgacccctgcccggtctcctaggccccccgccaccctgtgagcccaacgagttcccctgcgggaatggacattgtgccctcaagctgtggcgctgcgatggtgactttgactgtgaggaccgaactgatgaagccaactgccgtgagtatccgagggtccagctgaggcccccttgccctgcccaggccgcttgctcctgccccgccttccactcctgccccgcccctaccctgcccctccgctttcccccctccccagtcccccaagcctgtttgtttgctctccctggctgagtgcggaaggccctggagacacaccccaaggtttatctctaaccagagccgtaaggccccttggccctgagctggcctttggtgaagctgtgtggttagcctgcctgtggttcgtgtctcgtcatttctttcctttatttttgttaccatgaagcttctctttgttttgtatgtgggtcggatgaatggctaggagggttctatgtgccaaggtcccttggtgatgggtccttggtgtatgtatgcaagtcagagccttacccacccatctgtccaactccccagccacccatgcacccacctatacacccattatccatccacccagcccttcatccatctatccacccatccatctgtcgtccttcttccctcccatccatccttccagcctcccacttccccacccttgtggtatccatcttttccagtcatggacattacgggcatcctgacagttaaataggagggggaggctggagaggcagcgaccacatcaggtggtatcctgtatgtcctgtcccgcaagaagcctgatgcttgwtagtgcaagattaaggataatcttcaggctcttctctgtggtcctgggtggtgtgtctgggcgcgtgtccatgttcctgctgtgagcttgtccagcttctccttgccttccttcccctgcccactccacagcaagccccggggagaggctgcaccatgccacagactggcagagtttgcgaacgcctttctgtggctctaagcttgcctgatagcaccagccccttgggagagataaagtaattgggggctttagttggaaggcccttctcaggggcctctcctggggaagtcaaaggaaggacaggtccttgtggacagcacagaaacagagaacatgaaagctgaatggcctcgtgggctcctgagagtgtggggaacagaagcgcctgagctgcgcccacggctacctcctggtctcctctcgcacctgctctgtggatgcgcggcttccgctcctgcatggctgtgacttctctgtccctgtctgtgtctctctcaagctccatctccctgaggaagaacaytggtcaccagccactagagaggcctagcagggcccagcccttgtcccgggccacttccagcctctggccactccatagagggcctgtcagtgggagcacagaccgtcgagcccctcaggggaccacactgtgccaggcrttctggtagagaagggtgggcggggcattgctggcgcccagagatgccagccccactggtggtgcctttgacatgggtcttgtccatgtgagcaagatagcrcttctgtgcctctgagcgtggctgggtgaygctgtggttgtgacagtgatgtgccagccataactggcatggggaatgcaggtggagtgaggggtgggggccgggtaatgtgatgagtkgttcgatgacagctggtggccgcatcatgctggctgtgagttggacagtgttgtgcagcaggggctaggcatggcgagggccgctgtgggttatgtgggcaagatgagagagtggccctggggatgcccagggaggatggacggggtgggctattgggaaccacctggctttgtccccagccaccaagcgtcctgaggaagtgtgcgggcccacacagttccgatgcgtctctaccaacatgtgcatcccagccagcttccactgtgacgaggagagcgactgtcctgaccggagcgacgagtttggctgcagtgagcagggagctggggtcgagatgcgggccctgggctgggttctaggggttctgtccacagcctcagcctccacccttctccctcctagcccctcggagccctccttccgctcctccttcctttgcccccgacccctcactcctgccctggtctcctcagtgcccccccaggtggtgacacctccccgggagtccatccaggcttcccggggccagacagtgaccttcacctgcgtggccattggcgtccccacccccatcatcaattggaggctcaactggggccacatcccctctcatcccaggtgcggctctgggcccaggtggtggggtgggaatgaggggcagctggtccagagccctaggccagatcctaccacttgtcttggggctcaccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgaggtactgccggagggcaggtgtcaccgggtgtgggggcrgagcygggctgcccaccacagccggctgcagcccccgcccatgccgcccagcaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgcgttggcgggcgggtgagcgctgcgggaggtgggaggtgggtacctctgtacccagggggcacagaggatagatgcggacagagggggccaggtttcgggaaggaatgtgagtcgctgaagaaacactgagccctgtcaaaaaagcatttcggggggaaaaccaagatgtttaggaagagccaaatccccccttgctacctacctgcttcaggttacggcgaggacgggccctggagccagcttccagcttcagatcctgacgtggacgctgtccacctgtgtcctgggtcaagttacccactatctcgtgtctgtttcgtcatctgtaaagtcggggggtgtggaataataactacctcctaggggttggtaaggacttagtggagtcacgtatgtaagcctctcagaattgtgctcagcgcattttcagcacccaggaggtatttgctaacgtcacagtcattgtcctcattctgagagacagaggtgccagtgtacccagattataggagcccaggctttggcatctccttggcctgagggtggcctccagctataccacttactgcygctgtgtctttgggcaagtctcttggcctccctggtcctattttcccaaagatagaggcaggcagatggactcagttctttctggcactgagaggcagaatggcaggatggctgagggcatgagcccaggcactgcctggactggggctcaggtcccagctctgtcgttttccacgtggcatcaagcagccctcaccctgctgagtctcacttcttcgttgcagaggattaaatgcatgtagagagttagctccaaagcactcaacacattttatgcccttttgttggttgaggaacctaaaaatgacttgtataaaacttagttacctggccaggcatggtggcttatgcctgtaatccaagtactttgggaggctggggagggaggattgcttgtggccakgagttcaagaccagcctgggtaacacagagagaccccatctctacaaataattaaaaacaaaaaatctagccaggcrtggtggcttgcacctgtagtcccagctacttgagaggctgaggcaggaggatctgttgagcctaggaggttgaggctgcagtgagcyatgatcacaccattgcactccagcctggacaacagagtgagaccccatccctraaaacaaaacaaaacttagttacttcccaaagttgtcccccagtatatttacaatgctaatggccgtggccaccatttggtgagcaggcagttggccctgtggcttgacgtgacagtcaacgaactgccaaaaacccttgcaaggtcagggctgatttcacagttttaagatgagagccccagggctctgagatgttgtggggcttccctgggttcacacagcagtttagagggggagctgaacccagggctgtctgattggaatctgggtggtccaggggagggagtggtgggaattccagggtgagcaggtggcctgtgtgtggatggtgaccaggagggaggaggcctgaagacatccccggaaggcagggaggaaagaggattgagtaacctagacccggggctgtgctcggtcattctgcgggtgaggagctggattcccctgtggttgcagggggttaattcaggatgagggggagaagctattggcagacagatgtggactctgtataaggaagaacttgctaagagtcaaagttgtccagagccgggagggacggcctttggaggttgtacgctctccatccatgacggctgcaccatccaatgtggcagtcactggccctgtgtggctctttaaattgaaatacaatgattcattcctgagcagcacaagacatgtctccagtgctcagtggccacatgttgctggtaccattacttttaatggcaaaaccaaaccagcaattactttttcaccaacctaacagctaccgtaatgaagagtgtaggtacaggatattttcactccaccgaaagttctctaggatggagctgtcctagagatctgggaggatgctgtcaagggaattcccatgtagggtgactgtgtgtgtgtgtgtgtgtgtgtgtgtgtgtgtgtgtgtgtgtacatagaagagggttggactagacgacccrtcataacaacagcaacaataagagctagccattttatatcaatgtgctcattttagcttatacctctaggaggcaggctactttaagcaccatcttacagataaggaaactgaggcccttgcccaggcttacaacacacctggacttggtctcctgttcctcagccctgtgtagmtctcctgcctgcagggttgttccagccctgaaagtctgtgggtctcttagcaagaaagaccctgagaagtctggctgcaaagaatccccttgtcctttctttaccctgtggttcccaaatggttcccagctatcattccatggcattgactttcccagagcatgctttgggaaatgctgctccagtatttgggaaggaggaaaaaactgcattttctttttcttttctttctttttttttttttttttttttgagacagagtcttgctctgtcacccaagctggagtacactggtgtgatctcagctcgctgcagcctccgcctcccgggttcaagtgattctgctgtctcagcctcctgagtagctgggactacaggcgtgcaccaccatgcctgtctagtttttttatttttagtagagacgaggtttcaccatgttgggaaggctggtcatgaactcctggcctcaagtgatctgcccgcctcagcctctcaaagtgctggcattataggcgtgagccaccacacccggcaaaaaactgcattttcttcactttggaagagagatcaaagttttctcgaaatcaaatttccactagaactttcccacctttctggattgctgcccctcaagatgggtgtatcaggcaggcccagrctgcagccctcagcctcccccttgccacccacaggtgtgaatgtgacaatgcctgcgcagcccggcacgccacccctctcctccacgcagctgcagatcgacccatccctgcacgagttccagctagtcgacctgtcccgccgcttcctcgtccaygactccttctgggctctgcctgaacagttcctgggcaacaaggtgaggggcctgggctgccaccctgggtggggaaagaattcctgtgggctctgctccttctgcagttggtggacaacaaggcagacttggagggaaaggtgttaccatgccccgatgcagccccctgtggcagcggctcatccattcagggcaggacctctcccctgcactgttggcttgggaagaagagctggcctcccctcctcccgggagccctccctgaccactcccccatgcctgggctgggttctgtgcctccgcactggcttccctgggtaccctgtgcactgcatgattccacaccctgccatggaccaaacaccctagagtcagggcctgagtctcgcccatctcggtttccctgtgcctagctcagtgcctggcacacagtaagtctcaggtaggcagagtgagggaggagctggaagactataggcacctyataggcacgaggtgtcaagtgtgcccacagctgcccgtgctgatccaccctgttgtgccaggtggactcctatggcggctccctgcgttacaacgtgcgctacgagttggcccgtggcatgctggagccagtgcagcggccggacgtggtcctcrtgggtgccgggtaccgcctcctctcccgaggccacacacccacccamcctggtgctctgaaccagcgccaggtccagttctctgaggtgggtggcgcctgagcccttagggctgggagcaaagggggatttaggctgggtaggcactgatgtgtgacccctgccaccttyacccatacccaggagcactgggtccatgagtctggccggccggtgcagcgcgcggagctgctgcaggtgctgcagagcctggaggccgtgctcatccagaccgtgtacaacaccaagatggcyagcgtgggacttagcgacatcgccatggataccaccgtcacccatgccaccagccatggccgtgcccacagtgtggaggagtgcaggtgcctgagccggcagggctgggaaccacagagaccctagcaaggatagaggagaaacggcagggcctcaccgtccttgcagcgactcttttggtcctgtccccacagatgccccattggctattctggcttgtcctgcgagagctgtgatgcccacttcactcgggtgcctggtgggccctacctgggcacctgctctggttgcarttgcaatggccatgccagctcctgtgaccctgtgtatggccactgcctggtgagtagtgccagcagacayttgaacactaaaataggagaagggacaatgtgtgagattccctgtgttcatgagctcagcacaagcctccagaatgactgtcatgactgccagatgaactatcatgacctctggatgcaataacagaaatataggtcaggcgcagtggctcatgcctgtaatcccagcactttgggaagcctagatgggtggatcacttgaggtcaggagtttgagaccagcctggccaacatggtgaaaccccatttctactaaaaatacaaaaattagccaggcgtggtggcgtacgcctgtaatcccagctactcaggaggctgaggcaggaaaatygcttgaacccgggaggtggaggttacagtaggccaagaccgtgcccctgcactccagcctgggcaacagagcaagactcagtctcagaaaaaaaaaacaacccagagatayagcatccagacaagggaggtgttggccctcctctccaccctcatcagactaatcctggagartgccaaatgaagaagcatggcctgcagagggcaactctagggggaagagcccttggggtgggaccttatttcttaggaatagtggcgagagctgggattgtggagctgacagaagaaaaggctcaagcagggcagcattgtcatctccaaatccctgcaaaggtgtcgggtagaagaaacagactctggagagcagaactggccagtgggtgcagattggaagagggtggcaggtttaggtcaataaaaagcaggcatttggaaccatctatgggacaggctgccgtgtaagatgatgagctccccatcatctataagtggttgcagttgatgctcccctgtctgcaaagctgtgcctccagcgtgatggggaggctgagctagacagcctccaaggtcccccgcagcatctggcccagttctgctctagaagttgagccataccctcctccttcttctagaattgccagcacaacacggaggggccacagtgcaacaagtgcaaggctggcttctttggggacgccatgaaggccacggccacttcctgccggccctgcccttgcccatacatcgatgcctcccgcaggtcagccccagctccgggtyrgggggggtttggctggggacagtgcaacaggccagagaatattctgggcagggaggcrggagacttggattcagatctctacctgatcactaagttatcccatgctcctggacctctctaggcctctgtttccttttctgtataatgggccccctgacttcctacagttgctgtgaggctgccgggcagggagatggcgtcatgcctcgtggcacactgtgtctgtgtagacagcagtcatttcccagggtgggaggagaaagcctgaccccagccctgccccatgccctgtccacttgatacctgcagattctcagacacttgcttcctggacacggatggccaagccacatgtgacgcctgtgccccaggctacactggccgccgctgtgagaggtgagggagagccttgkgggctgcaggaagggggctcctgggtggggtcatggaagtgctgatggcggccccctctctcccctagctgtgcccccggatacgagggcaaccccatccagcccrgcgggaagtgcaggcccgtcagtgagtatggctgccaccatcccctgacacccacctcccaacccaacctgggctgcacaccaggcaccctccctccctgccccagctcatgaaccttggggagccactgttcctctatctgcccggaccacgtatatcccattcccacctgccctgccaacactcgttttgtgtcccagaccaggagattgtgcgctgtgacgagcgtggcagcatggggacctccggggaggcctgccgctgtaaggtacgcgtgccatctgccacccacccaggggccttgggcccagcaccayagctgggaggaggaagaaggaagctccgtcctctccatagatccttggccagtgggtggtaacccagtcagaggctggtggacctggcccaccggccttccgtaccaggacaggtggcctggcrttgggaaggagcactggttagggagtcaggtgaccacagttcaagtcccagtcattctttatgcagcctttgtatctgcattgtacctttgcttttgccatactttgtccattgtcacattgatacaatgatatagatattagtgtccccaatttgtgaatgaggaaatggaggctcagagaagggaggtcacttgcgttaggaatgggagcatcggccgggcgcagtggctcacgcctgtaatcccagcactttgggaggctgaggtgggtggatcacttgaggtcaggagttcaagaccagcctggccaacatggtgaaaccccatctctactaaaaatrcaaaaattagccaggcgtggtggcgggcgcctataatcccagctactcaggaggctgaggcaggagaatcacttgaacctgggaagcagggttgcagtgagctgagaccgcaccactgtactccattgtaggcaacaagactgaaactccgtctcaaaaaaaaaaaaaaaaaagaatgtgagtatcaagtgtcggtgtaaaaaagaatggatggattctggagtcaggcactcctggtcttaaatcccagagtggatgggcaagctgagtaactttgtgcaagtcatttcacatccctgagcctctgtttcctcatgtgaaggatgaaggtatcacctacctctcaaggtccttaggggagttaaatgaggtgrtgtcgaatggaaagcagaacagtgcgtgaaacactccataaatagaagcagcaattatttcaatcaagtcgctgtatttcaagtctaaatttattggtgaaccccctggcagccaaagagaaaagggaaaaatgcttgcctaagtgcttgttaagtgggaattactattcagatggcaatgacgcctcatacatgtgctctttcttttcttttcttttctttttttttttttttttttgagatggagtctcgctcccatcgygtaggctggattgcagwggcgcgatctcggctcactgcaacctccacctcccggtttcaaacaattctccttcctcagcctcctgagtagctgggattacagctgtgtgccaccacgccaggctaatttttgtatttttaatagagacagggttttgccatgttggccaggctggtcttgaactcctgacctgaggtgatccacccgccttggcctcccaaagtgctgggattacaggcgtgagccaccgcgcccagccacatgtgctcyttcagtggctcccctgggtcttgggttcttatctggactgagggtggattcggccagagctccaggcagcctctcccatgggctstccttcagctccaactctgtgcctgcagaacaatgtggtggggcgcttgtgcaatgaatgtgctgacggctctttccacctgagtacccgaaaccccgatggctgcctcaagtgcttctgcatgggtgtcagtcgccactgcaccagctcttcatggagccgtgcccaggtacctctgcaaggtgggcgggcaggaccgccaagccctgggccggatggaccaagcgccagtcccaggccacrgcccccatcccagccctttctcctcctcccagttgcatggggcctctgaggagcctggtcacttcagcctgaccmacgccgcaagcacccacaccaccaacgagggcatcttctcccccacgcccggggaactgggattctcctccttccacagactcttatctggaccctacttctggagcctcccttcacgcttcctgggggacaaggtgggtagtgggtggaaaggcaaaggaaactccaggcagcaggaacagcgcaggcaaaggcttggaggcgggagggtcgtggtgccttgggagaatagtgagatacactgcatggaaaaggtggctggagcagtgacagggcccgaattcaggcctccgcaagctcctgtctaaccctggtcccaggtgacctcctatggaggagagctgcgcttcacagtgacccagaggtcccagcygggctccacacccctgcacgggcagccgttggtggtgctgcaaggtaacaacatcatcctagagcaccatgtggcccaggagcccagccccggccagcccagcaccttcattgtgcctttccgggaggtgagcaatactgtcccctgggggtaggggtgcgggcaggcccttgctcctgcctctccggcattcaatactccaggacgtcaggggctgagcacatgtgtcctctccttggcagcaagcatggcagcggcccgatgggcagccagccacacgggagcacctgctgatggcactggcaggcatcgacaccctcctgatccgagcatcctacgcccagcagcccrctgagagcaggtgtctggagccrgggcaggaggaccagcatgggcttggggaggggctccatctaagcggtgcagtacagcacagccacttacagactgtgtgacccttttgtgcctcactttccctgtctgtaaaacggagagtcttaacaatrtctcccatacaggctggtctggggccaggctccctagaaagaagcctgagacggggattggggtgcatgtgatycacaagkagagggacgcaggagrggggaggggccatgcagggatatggtttcaggtcaagtctagccccagcctcagcccacagggagctctggagagtcattcgcsggagagtgatcgttctttcaggcccgtgggctcttgtagcctgtatcagcctgtcattggggaccccaggggaacgaggtggtataacctctccaggtgaggaagggtgatggtttggagtaagttgcaggtaacagctgtttgccacggtcctcgcagcctctggagatctggacagggccccagcagcactgtgacagggctgtcgggaggactaataagaccctgccagyggaggactccaggcgtgcctggcacagagccagcactcctattcacgctgggtcttgtcacgcccagggtctctggcatcagcatggacgtggctgtgccygaggaaaccggccaggaccccgcrctggaagtggaacagtgctcctgcccacccgggtaccgtgggccgtcctgccaggtgagtcmtgggccccacgccagcccagccagccccctccatggtgcttcccrctccttctccatgagccctccacacctccccagccctggccatccagtgcccctacctgaatgggccgtgttcggaagtccctcccactgccatctttctgcccccaggactgtgacacaggctacacacgcacgcccagtggcctctacctgggtacctgtgaacgctgcagctgccatggccactcagaggcctgcgagccagaaacaggtgcctgccaggtaagtcccgccctccttccgcccaccccagcaatctgtggcctctggaggcccagcctcaactcacatcctgctcctccagggctgccagcatcacacggagggccctcrgtgtgagcagtgccagccaggatactacggggacgcccagcgggggacaccacaggactgccagctgtgcccctgctacggagaccctgctgccggccagtgcgtccagtccctgcctgcacctgcccttccctgaaatgtctaccacccgctcccacacccscttcatccagggcccttctgagaggcagtggttaaatcctggccttactgcctgctcagtgtcacttggtgtgagatacacttcactttcagggcctcagctgcctcatctgtgaaatggggtagtccaccctcctcagccccttgtgtgagagttgaatgaggctatgcatgtggaactcttagcacagtgccaggcatgcagtggcactgaggacacatgagttcacatgcctgttcttcccctcccctctcccctggtcctgaaggaggatcgggggagaggaaggagccactgcgttcctgactagaaatctgcccccacactcagggctgcccacacttgttttctggacacagacggccaccccacctgtgatgcgtgctccccaggccacagtgggcgtcactgtgagaggtgaggcagggggtggagagggtggggggatgcgcacagggggtgtccctggaatcctcaggcagggcccagcgctcccaacccagaggaatcagggatgcctctcgctcttaacctygcacaggccccagaagacagtcagctcccctcctcgggagactcaacctctagcccagaattcaagaccctcagacacacatcctagcctgcggttcaccttcagccccctggccccctgccccagccaggccagagtcttcccacaaaacccctgcttctttctgaaactccygggttcctacctgccccaattcactggctgtgcggtccagggcrcrtccctgctcttcyctgcccagtttcccygtaacatgggcgagtcaggctcttcttttcttccagtgcatgaggccattgaattcaatatggggccctyagcccagccctggggttctgcttcccttcatccaaaattcatcagaggctttttctctctgcaggtgcgcccctggctactatggcaaccccagccagggccagccatgccagagtgagtaggattggggaggtcattggggtcgggttacccagagtccytagggcggagctaggacagaagcctttactcccctttggctttgcctgtcygagcctgtttcttcatctgtmaaatggggataggagaaggccccaccaccyccgagggctgtcrtgagagtgttgagtactcacatcagaaatcagagctcccgctcwgtggtgagcagagtggagggaagaggggtgctgggtggcgggtttggggctccagccatggctttcttccacctcaggagacagccaggtgccagggcccataggctgcaactgtgacccccaaggcagcrtcagcagccagtgtgatgctgctggtcagtgccagtgcaaggtcagtccgaatccctgtccctgcggggcctgctctgcccygctgcccagaccctgcggggaaatcaggcagcatctggtggaagccgagacctgggcatggggggcagggcatgggggacagggcaggggctgcccggggctgctggaagtggccagggaggctggcctcaggctgctgggggtgcaggagacccactgagtcccctgcctgcctccttccatccgtctacccaggcccaggtrgaaggcctcacttgcagccactgccggccccaccacttccacctgagtgccagcaacccagacggctgcstgccctgcttctgtatgggcatcacccagcagtgcgccagctctgcctacacacgccacctggtgagagcctgtgctgcccagccccaggcggwgttgccacctgctgcctgttactgtccatctgagcactgagcccagcgaccctcatccccgcctcagtaccctcacatgcccccattatttctctcrcagtcctgatctcaacaggaccccattcygcaccttaacaccctcccgtgccccatcccccaccaaggcaccccggtgctcaggctgacgccccctcctttttcccctgccagatctccacccactttgcccctggggacttccaaggctttgccctggtgaacccacagcgaaacagccgcctgacaggagaattcactgtggaacccgtgcccragggtgcccagctctcttttggcaactttgcccaactcggccaygagtccttctactggcagctgccggagacataccagggagacaaggtgggccccagccaagcaccagggtcagccgtgactcagacatgagttcacctctgcgccgtctctcagcaggcaggcacctgccacctgcatggccatatcgtggttaggcacgtggcttttgcagtcccatagacattggtytgaaccccagctctgccgcttgccagccagacaccatttgataaacctcaacttcatggtggctgaggggattggagatcgtgcctggcacataataagtgctcagctgttcatgacttttagctttcatgcagttattctacaaacagatctgggagaggccgggaaatataaagacaagtgagacacagtttcagtgtcattcacrtgcccgctccgacttcactcatccacactgctggctctgtgcttgtgttggacacagtaattctcatgataggtcatgtgtgttgagctctcactatgtgctaggcagcatcctttacaaatcacaaatcacaactrtgtgagacaggtcctgctactgccccatttcataaataaggcaagaggggcttggtaacttacccaaagccccgcagctgggaggtgggaatgccgggatccaaacccaggtcagaggctgcccttcaaatgctctgccaaaggccagagcccacacctgtaattccagcactttggaaggctgaggcgggaggaccacttgagctcaggagtttgagaccagcctgggcaatgtgacgaaaccccgtcyctacaaaaagtacaaaaaattagctgggcgtgttggtgcatgcctgtagtcccagctatttagggaggctgaggtgggaggatcgctggtacccaggatggggaggttgcagtgagccataattgcaccattgcactccagcctgggtgacagagtaagaccctgtctcaaaaaaaaaaaaaaaaaaacaaatactctgccagtcagaggtgaacctgtctttgctactccagaacagggtctggtggaaaggtggtgatgatggtggtggcgatggtgtgatggtgttgtsgggggcaggggytcaggggtgggctctgggacarcctgcccaaatgtgttcttgagcagcacgggcatccggtggcacccacgctctggggttggggttgccctatccctgttcgttggacacagccaggtactccaggcttctcccggggctggctgccttctggtcccttctcccctctcccttctggggttcgctatctcctggcctccctgctgccctgtcctgcaattctcagacctatctctgtctcctgtcctggcatttccctgcgccccacagggggaggcgtactttgcgcggatgcgccgrgctcaccaggtaggcccaggacgtgcgtggtgtgaagttggtgtggtggggcgtggtgccttctcgggtgctcccagccctgcgtggggagatgcgcagtgcccaaggcattgggggtctgcatgaatccaggcggtgtcccatgaccccagggttggagccaggagggtatgtgcctcaccttgcctcacctgctgtgtggtctggtcctggtgccaactgtctgaagtcagaatggcaactgaggtagcaaggagactaacccgatgctaatccacatgactgtatctagccccccgggttcccctggccttgcctctcaagcaaccaccatgaaccctctgtgtgcatgtgggcggcctggagttaacccttgggtgccagcctggagagggggggcatgcatctttcttcctaattagtgtgggcctttctgactaccatgtccgtgggtagaggaccctgcccatggctctagctccaggactttgggaggtcttagctcgcctgctccctccatttcatcagaaccgcacatccctctcagaggagcagttgcgggcagccgtgacagctgggaggatcccagagcccccagagggcagggactgggcacagcgggcatcacaggtaactgaggacctggctaggacaggttgtacctagggccacagcgaggagaccagagagctgagtccaggcaggcacctgagcgaagactccagctttcctgggccatttcccctatgccaggccaggccccagcctgatgcctggtctgctctggtgtctcccctgggaaacattccagaaccatgaatggcttgggctgttgccagggcacacaaagagagtcaggccgaggagcaacaaccccgtccagatgcccctggggctgcctccagcacttctgcccctcccttgctgggcaccctttgtagggcttctcccatcagtcacggcccataggcagccaaacccatcccgggatatccccgcctagctcaggaggaacaagagggcagtgggtacaagggccagagtgccaggtatcagcacttgtgagcagacagtgcagagcrggtggctggctgggcccgtggggaggtgaagcctcacggacgtcctttctgtccctctctgctcccttctgccgctcttcggctcctggtcccccaggtggacgaggctcagagacggatggatgctgagatctggcagctcctgtccagctttgctgcccaaccccaaccccctccccaggggctctctcctcatccccagcctgcagctgctctgcgagcagcacctcctccttcttcttcctcctcctcctcctcttcctcagcttctctgtctttctcaccaggctctcaggtatgtgccaaggtgcccatcaagggatccccacccaccatgctttctagacttcagtcatttctgaaccaacttcaccaatttctgtgaactacttggactattatttctttccaattttctcttaaatcaatcatgtaccaactcaggctggttactctctttcaaatacatatgaaaggagccatcccattgaaattgtttactgatgtgctgtgtaaacgttggtccacaaaagagacccaccagatgggaggagaagccgacccaggccacgcccagagagagcagctggggacctgggccgggattgggaagaaagtcgtccaaagagcaaggccaggacccgcactgtcgggtgggagtggggggctctgtctctctgccctgccaccaggcctccctcccatgacggtccacccctgccggaaccacctccgccctcccacccccacccctgctcccctcggctcttaccacctgcccttccctcctagttctctctctcctacgaaggcttctctctgcttcctggaagcctctattactggcagctgccccgggccttcctgggggacaaggtaacaaggatttggggggattataggggtgtcatagaatcccaaaatatcagagggccctttgtcaaggccytttatgacacaaatggggagaccgaggctcacggtgggtagagacttgcctggggtctcatgttcaggtcagagcacagctgagactgaactcagctctgcccctgtccttcagcgggccctgacccctgacccctggcccctgacccctgtcagaggagctgtctcgcctgggagggtttctctagtgccttttctctgggcttccttgaccttgtgtctagatgctggcctagtttttggtacttcactcagtcattcaagaagcattaattatttactgtgtgctkcgtcgtgtacaggccgagtgggccctggcctcccagagctccctgtccatcccattatcattcctgtcaccatcagtatcattattattatcatcatgagtgctggcattggccttagatgagtattcatattgcctctattttgttccaacaatttcaagtacctcttaagaatacacatagcaggctgggcgtggtggctcacacctgtaatcccaayactttgggagactggggcaggcgaacacctgaggtcaggagttygagaccagcctggccaacatggtgaaaccctgtctctactaaaataacaaaaattagctgggcgtggtggcgggygcctgtaatctcagctacttaggagactgaggctgtagaattgcttgaacctgggaggcggaggttgcagtgagcctagatcatgccacttcactccagcctgggcaacagagcaagactccatctcaaagaaaaaaaaaaaattcagcttcctggctgggtgcggtggctcatgcctataatcgcagcactttggragactggggcaggcagaacacctgaggacaggagtttgagaccagcctggccaacatggggaaaccctgtctctactaaaaatacaaaaactagccgggtgtgttggcaggcacctgtaatcctactgcttgggaggctgaagggggagaatcacttgaacccgggaggcagagattacagtgagctgagattgcagcactgtactccagctgggcaacaagagtgaaactccatctcaaaaaacaaacaaaaaaaagaataggcagtcacaaggtacattcagagaagtgagacagggaggttgaggggtgaggataagaagcaatctgctggagccgagggtggagctggagtactgcagggttatcaagygtgatatgcattctcaaactgtgtggagtacatcaccatttgtgtcctatattacttaatcctcatgatacccttcaaagtgggtattacttttacttccatttccatgtgaggaaagtagggctcagagaggtgaagcgacttgtccaaggctgtatagccagtagagctagagtttgaacccaggtcattcagactgtggagtctgccgttttaatcactatgctggatctgggtacaatggctcacacctataatcccagcactttgggagactgaggctgaaaaatcgcttcaggccaggagttgagaccagcttaagcaacatagcgaaatgctgtctctaaaaaaataaatcggccgggcatggtggctcattcctgtaatcccagcattttgggaggctgaggcaggrcaatcgcttgagtccaggagtttgagaccagcctgagcaacatagggagaccccatctctatttaaaaaaaaaaaaaaaagtgcctgagcaacatagggcgaccccatctctatttaaaaaaaaaaaggtgaaaaaaaaaataaaaaatttttaaaaatcactgtgctgtacacacctgcaacttgccagaaagtcagtcccagaaatggctgtgaactttctggcattcaaagcaagcaggaaaccagttattttatggttatttggttccactccaaaattccttaccatgccttgagctcatggagaatatccctgtagccatgtagcccagggccgtgtgtgtaatcagcaggtgtttgataaatgctggttagctgagtgaacacacaaatgaacaaagaggtaggcttgatgcagtttggtattgagatgaatgtctgccctggtggcagrggagagaaagcaaagtcctgtgggacagagctgggkagcctcagctgtccacgtgaaggtcctctgcagcagaagtaaggactccccagtcatgagcaacacagtgcccaagtccagtgggcttgtctgcaacaaagmatctatcggctcatgcaactgcagagtctaagcatgtatggtgtcaggcatggccttatccaggggctcattagggctttatcttggttctccagcttctcatctgactgcagaagggactttctctggcctggtagaaagagcataagtgcacgggttacttgtctatccctgatggggtggcaaagggcagtggtaggttatgcagattggccaggcctggctcatgtctccactatagaggaggaggggatcagggccctcagaccacatggtctgcatgtgcggagacagttgttctttatagaaaaccacggtttagtttctagaaagcaggaactggatactgggcaaacaaaaaccacctgcctaggaggcaaggcctccgaggggctgccgtcagccccacccccatggctgagaacttttgaagcttccgcagcctccccatggtggtcattgtcattacacttgtctgccttatgggaaattcctgtaaatgaaagcagacctggagtttgttcgccggcaccgtcaggcaatggggaatagagaaccttgcagagcaaagaggcygctcagcatcatcaccaccatgtctggggctacagaggaactgagaaatgtcctgtttcccaggcaaccatgcaccctggcctcttggtttgggcagggaggggggtgggggagtgtggcacaggtgcaaaaaggccrccagatgctccatccctcacctatatggtccaacactcacaccccaaggtcagcctgtgacctctgggcttgcctctttgcaggtggcggcctacggtgggaagttgcgatacaccctctcctacacagcaggcccacagggcagcccactctctgaccccgatgtgcagatcacggtgagcatttggacaccatgctgggtgggcagaagggcaggatggaagccaggggcaccctcggcatttgtcctttgtcctttccatccagcactcagttttctggcacaggctgggggagttaggcccatgcccccacatccctgcctggttggacactacccaagcagaggatcctgctgctgggagaagggggcagtgggcatgtgcctgactcctttgggcgcatgagcttgggagagcagagaggtgggaggctgggggttacagagaatctaggactggtggaggacaccctggcaccccagggacccctcggctccccttccaatcctgctggtgtctttccagggcaacaacatcatgctagtggcctcccagccagcgctgcagggccctgagaggaggagctacgagatcatgttccgagaggtaaggggcacctggccatgctgtgtctaaccccaccccaccctccaccctgactcagagcctggctttgatacccaccctgtctctcgctccccaaccttcacctggcagccctcagtcagtgcctgtaaggcaggatttggggggtggtaactgtaggagcagcccacaaagcccactgcccccgcccacgttgccacccccaacccaggaattctggcgcyggcccgatgggcagccggccacacgcgagcacctcctgatggcactggccgacctggatgagctcctgatccgggccacgttctcctccgtgccgctggyggccagcatcagcgcagtcagcctggaggtcgcccagccggggccctcaaacagaccccgcgccctcgaggtggaggagtgccgctgcccgccaggctacatcggtctgtcctgccaggtgagtgtgtggccagctccaccacctctgcacaggcacagaggcatcagcaagcaaatcagccggcgtcgccgcagccttgattaccatcataactataatgacccctgcatctgggccctgcatgtattcctcccgacagccctgagttacatatcattatcccctttaacaggtaaaaaaatagaggtgctgaggggtgagtgtgtcccaagggcacacggctaatgtgtggcagaaactaatttgaacctgggtctgattgactccaaagcctagcatgtcctaaccactgggcagtgcakcctcacgtttgggccacactctccgggggttaaaacccagttcatgcccttgagggggcccaccagagacagggagccaattcagaaacacagattaytccggcccaaagcacagcatagagatgcctcccagaggtgaacagtgtggactgggagagggcygtgggtgggaggacagactgagcagaagtggggaaggaggggcgccrgcctgtgatgttccagggtcacccctgggaggacactggagggaggggttctgggtctgctggctgtgggtggggcacgttgggaacagaggccaaccttcctctctgcccctaggactgtgcccccggctacacgcgcaccgggagtgggctctacctcggccactgcgagctatgtgaatgcaatggccactcagacctgtgccacccagagactggggcctgctcggtgagctgcaagcgaggccaggacagggggtcagctcagctgggcctgggtgggggaccagggctggacaaggcaggcatcaatccaggggatcaggatcatggggcatggcctgtggttcaaagcacctgggtcagcaggccaggtcaccggggatggtggggtggccagagctatggaataacatccttctgtgtaaagaaaactttggttctttactatttttttctttttcttaaaaaaattttttttatctaatacagatggggtctcactttgttgctcagaaggtcttaaactcctgagctcaagcaacccacccgcctcggcctcccagagtgctgggattacaggcgtgagccaccacacctggcctttttactttttttttttttttgagacagggtctcagtctcgttctgcctcctgggttcaagtgaatctcatgcctcagcctcccgagtagctgggactacagacatgagccactgtgcctggcctcattacatatattttttataccttgacttttcagagtagcatgtatatagccccccagggtacgcagtgaaggggcaggtggttgacagccataacctaaacttggagcaaggaacaccctattgttgataccacaaacgtgaatctctttggaggagaatctgtaacccacatgtttttatgaggatgcacgtattttctttttcttttctttttcttttttttttcaagacagtctcrctccgtcacccaggctggagtgcagtggcgccatctgggctcactgcaagctccacctcctgggttcacgccattctcctgcctcagcctcccgagtagctgggactacaggcgcccgctaccacacccggctaattttttgtgtttttagtagaggcggggtttcacctgtgtcagccaggatggtctcgatctcctgaccttgtgatccacccgccttggcctcccaaagtgctgggattacaggtgtgagccaccacacccagcctcttttttttttttttttttttttttttttgagatggagtctcgcttttgtcacccaggctggagtgcaatggcacaatctcggctcactgcaagctccgcctcctgggttcacgccattctcctgcctcagcctcyggagtagctgggattacaggcacctgccaccatgcctggcgaatttttgtatttttagtagagatgggatttcaccatgttggcaggctggtctctaactcctgatctcaggtgatccacccacgtcctgagattacaggcgtgagccactgtgcccggctgacaatacacatttttaatgctctgcccccaaatacctgagtgtatacctttcctttgctatcacaggtacttagggagaaaatagaattagcatcaccctttttgacagctatttggatggatgtactttttaatttatccaattccctattcatggatgtttaggtttgtttctagctttttttgcttttttttttttttttttttgagatggagtctcgctctgttgcccaggctggagtgcagtggtgcaatctcggctcactccaacctccacctcctggattcaagcaactctcctgcctcagcctcctgagtagctgggactacagacgcacaccaccatacccagctaatttttgtatttgttagtagagatggggtttcaccgtgtcagccagttggccttgaactcctgacctcaggtgatccacccgcctcggcctcccagagtgctgrgattacaggcatgagtcactgtgcccagcccattttgctttttataaacaccacggagatgagtgtccttgtaatgaaatctttgtgcccttccatgattctttctttaagatgagttcacaaacttggaatttctagatcaagggattgcaaccctgaaaggcttctggtaaatttggcctaatggctggtgcctgccctccttgtgccctgcagcaatgccagcacaacgccgcaggggagttctgcgagctttgtgcccctggctactacggagatgccacagccgggacgcctgaggactgccagccctgtgcctgcccactgaccaacccagagaacatgtgggtaccctagctcaaggcccaaggacacacttccactggggaatgagtggaaggcgttgcactggcttttggggcagaagtgaagggagcaagatggagattgggcttcccatgacctgacctttgcctccccgatcccaggttttcccgcacctgtgagagcctgggagccggcgggtaccgctgcacggcctgcgaacccggctacactggccagtactgtgagcagtaagtttgtaaacagaagtagggggagggtggaggacaaatggtggactcccaagtgagagccttaaagggtgttgctcagaaaagtctcttctaggattatgctccttccctgcctcaaacacttctaagacacctcattgctcttgggacaagcccaccctccttaggcagctttactgtagcagtctcatcccacttctgacacccaactctgtactttagctgggcttaactttttaaatgctttttctytttttttttttttaaactgagacagggtctcactgtgttgcccaggctggtcttaaactcctgggctcaagcagtcctcctgcctcagtgctggcattacaggcgtgagccaccatgcccagccactttttgaattcttgatgttcaggccttgcttatgctgttccctctgcatggaacagtcttcacccctaaaccacccgttcctggctaacttccccttagccttcagacccagcttcattcactcattcagcaaatttttatcaagcagctcctgtgtaccatgctgtgtgctgaggtgttggagataatggagtgaacagaacagattccaccccagcccttacggagtctgccacctaataagagatcagccctaatgggagataagacagggaaaaagtaattgtgcaaatgtgtatttacaaaccatgttaagttatctgaaagaaaagtacagcctgctctgaggtaatacgagaagtcccatcctcttggaagcctccctggctctccaggstgggccagtgccctcctctgcacccgcacagccctgatatgcttcctgcactctcattttcatgtagaatttccatgttgggttcccaactagtaagtcccacagaccagggactttatcacattcattgttgtatttccaacacctatagcacatgcctggcattcagtcattgcttaatggacatttgctggccaggcgtggtggctcatgcctataatcccagcactttgggaggctgaggtgggcggatcatgaggtcaggagatcgagaccatcctggctagcacatcctgcctctactaaaaatacaaaaaattagctgggtgtggtggcgcacccctgcagtcccagctaattgggaggctgaggcaggagaatggtgtgaaccccggagacggagtttgcagtgagccgagatcgcaccactgcactcgagcctgggtgacagagcgagaatctgtctcaaaaaaaaaaatggacgtttgctgaatgaatttctctggagaatagagaccttacctctctcatcacccaacctgctaacactcccttacactcccctttctcagttcaccagcaccctgcgttggggcctgtctggtccccaaagtgcttccagagctccgagcctcctcacctgacattgggtggcctgctgagcttctggctccccaagtccaccatgaggcactggggcccttgaggcctgacattgccggcccttgttcccccttacaggtgtggcccaggttacgtgggtaaccccagtgtgcaagggggccagtgcctgccagagagtaagtgggaccatggcccaggatggggacgatgggcaaggcagggagccctgggaatttgggggatactgggtctggggacagggctgagggtggggtaccccagcttttgggagagcagagatattgaagacaatgctgaaaggcccttcctgtcccggcccccacccccagcaaaccaagccccactggtggtcgaggtccatcctgctcgaagcatagtgccccaaggtggctcccactccctgcggtgtcaggtcagtgggagcccaccccactacttctattggtcccgtgaggatgggcggcctgtgcccagcggcacccagcagcgacatcaaggtacccatggccctaggctcctcagccccaagagccatcccagtgggaggggaggcaggggcctgtccctgccctagtgggatgctgtccttgyrcatggggctggatgtgagaaagagtgtatctgcaccaacaagctcttgtctcctccccaccaggctccgagctccacttccccagcgtccagccctcggatgctggggtctacatttgcacctgccgtaatctccaccaatccaataccagccgggcagagctgctggtcactggtgagtccctacgccccctgtaaccaagactgcctgtcctgggctgggctgcaggctgcagattcaggcagatggtgcattcacctgctgggagggggcagtggttgcccgaacaaggtcagcagccatggagatgaggagaggtggcagattcaagactcattttagaggtaggatcagcaggacttgactggtcggtgagggcaaaagaaaagggtgggccgggcacggtgggtcacgyctataatcccaacactttgggaggccaaggtgggcagatcatgaggtcaggagttcgagaccagcctggccaacgtcgtaaaaccctgtctctagtacaaatgaaaaaattagctgggcatggtggtacacacctataatcccagctactcgggagaactgaggcaggagaattgcttgaacccgggaggtggaggttgcagtgagccaagattgcgccactgcactccagcctgggcaacagagcaagactctgtcttaaaaaaataataataataatgcacctcagagtcaccctgccctgtcgtccagggaaaagtgagacagggatgggagggcrtccataaaggctgtgtcaycaagcagattgccaccgtgagcagttgttgcttagtacaaccgaggaagcttttaaagggagccggtgtaaaacacgcacctcaaagtcaccctgccctggggtccaaggagctgcagtatgtctaggccagcttctgtcagtcattgactgagacctattctgggagcatcaagtcccctgcacatctgtcccacccatgggtgtgcactgtgggctccagtggcctgagaaagccctcaatgcaaagaagtgcagtggctggcagaagtcaggcaggtgggcacggggggtgggaagcgtggctaggccaccagcagcacaggctacaaacaggtcagagagaatcgcaagtttgttttggacgtgttagagtctgagatgtttgggaagatatctcattgagtccaccaggcaggcatttgggtatgtgagtctgaactccagtaagaggccccagccagagaaatgagtatggttgctgttggcacagggatggtgttcaaagctatgggacaggatgaagtcacctagggagagtgtggcccgaggacagggccccagcccagagtcctgaggagctccagtgtgaacatgtcaaatggaagaggaagggcaggaagagcctgagagagtgcagccatgaggcaggaagagacagggggcatcatgggaatcagagggaaaagggctttcagggcagcctccctgctgggaagtcacataagggcagagaaatagcccttggaggtcatgctttgacaagagcggttttcagtggagagaagrgatagaaaccagattggaaggaggcgacacatgggtgggaaggcagcgagtgtggacaactcctgcaagagtcttggctctgaagggaggccaggaagtgggtcattgactgcgagagcrtgaggtcaagggggagttttcggaaatgggaaatcctagaatgcactctggaccgaagtgatcgcatgagaaggaggagacgctgatgttgcgagagcagaagaagccccggggaggggtggcactcaggcgcagcagtgggatggggtgagggcaggagaaggggcctgtccttcagggaccagtatctagagagctggtagatttgagaggctgggaaaactcctgacttgtcgtttctattttctccataagtgtgtgtcagcgccactagctaagaaagtggaagggtggttggagaggctggaggagatgggaggaggtgtgaaatagttgtttttgggggatagaaactcaaaccagacggagaaacccagttggagtggggtgtgatgtgtcaggagctcattgtggtctgtgatcaggaactggagccaagtggacccatggtgtgatgttccccaaccacatcctgtggccactctgtgctggcaaggagggtggggatggtggggttcagccagaatgggggagggaggtgccagggggtagaatgagagctaggctggaccaggaaggaagtgatgcctagaggttatggagaaagacaaagtggccacaggaccggggcctagccagcaccggctcacaggggggcttcccgtccctgcagaggctccaagcaagcccatcacagtgactgtggaggagcagcggagccagagcgtgcgccccggagctgacgtcaccttcatctgcacagccaaaagcaaggtgtgcaggtcagggagtggggatggaggaagtctgtcytctggggtctctgagccccacccatgaccccctttcgccttgccctgcagtccccagcctataccctggtgtggacccgcctgcacaacgggaaactgcccacccgagccatggatttcaatggcatcctgaccattcgcaacgtccagctgagtgatgcaggcacctacgtgtgcaccggctccaacatgtttgccatggaccagggcacagccactctacatgtgcagggtacacctcccatctatacctgattctcccmccctgkctctcccccattcccaccagaattagcacagcatttcttcattctgctgatcatttctgagcacctgctgcatgcctggtcctggtctaggctctgcagaagcaggggagagaagcatgtacagtatctcggtcctcctgaagtacacgtcctaggcagggagaccataagcatgggaataaatgaacaagcaagataactacacatggcgatgagtgccaggctaggaatgatgagaaagcaagaaacaaggtgggagaaggccaggagcggtggctcacacctgtaagcccagcactttgggaggctgaggcaggtggatcacttgaggtcaggagttccagaccagcctggccaacaggtgaaaccctgtctctactaaaaatacaaaaactagctgggtgtggtggcaggtgcctataatcccagctactcaggaggctgaggcaggagaatcgcttgaacccgggaggcttaggttgcagtgagccgagatcgcgccactgcactccagcctgggtgacagagcaagaatccatctcagaaaaataaataaaataaaacaaggtgggagaggcaagggctactctagatagggcagtcagggagggcctctctgaggaggtgacacctaagctgagacctgaaggaaaggtaggcattgagcaagttagagagttggcagagtgttcttggcagagggagcagcacatggcaaggccctgaggcaggagcacgttgctatgtttgaggaacagcagagaccacgtggctggggctgtgggagggaggacgggtgtgggcagacgggagagcatggagtatgtggtggatcagggtaggaattttggattttattctaaaagcaacagggagtcatggacaggtctcaaggtgggaggtcacaaggtcctgttgacatttcccaagctccctctggctcctgtgtgcacagatggccgtggagggctagcctggaagcagagaaagtaggcagcaggactgttgtgtgagtcagacgacactccccaccctgagtgcatgttccttttcctcccttgtcagcctcgggcaccttgtccgcccccgtggtctccatccatccgccacagctcacagtgcagcccgggcaactggcggagttccgctgcagcgccacagggagccccacgcccaccctcgagtggacaggtgagrccgtgatgggaatgacattcaaggcctgactctcctgggtgtgggaggggaggggcaggactctgagcaggcttggtgggtgctgaccccacgtctactcrtcagggggccccggcggccagctccctgcgaaggcacaaatccayggcggcatcctgyrcctgccagctgtcgagcccacggatcaggcccagtacttgtgccgagcccacagcagcgctgggcagcaggtggccagggctgtgctccacgtgcatggtgagaggccgggctcagggtgggggccgggagtgtgctcagcccagggcgtgttctcacaggactctgtctgcagggggcggtgggcccagagtccaagtgagcccagagaggacccagrtccacgcaggccgcaccgtcaggctgtactgcagggctkcaggcgtgcctagcgccaccatcacctggaggaaggaagggggcagcctcccaccacaggtgaggagatgggcccacccaggaggaggaggcccacaggctctgcagagagtcccagccaccttccctccccsttcacgccccaccccacctcctcctctgtggctcccttcacctccaagatggtggtctcctgcccctgcatcccagcagggagcccctgccgtcctcttggctgcctggcgtttgtcctccttcatgccccactgggccctaatattggccctgcacctgcctctcccttttatgccctatctgtccccctggccagccgttgtccagctgcctctggggcagctgacccatctcacccrcggcaggcccggtcagagcgcacagacatcgcgacactgctcatcccagccatcacgactgctgacgccggcttctacctctgcgtggccaccagccctgcaggcactgcccaggcccggatccaagtggttgtcctttcaggtacggactctctgggaayggaggggtggggagggcaagccagggctcccctggggcctgctgacccctactctggccccagcctcagatgccagcccaccgccggtcaagattgagtcctcatcgccttctgtgacagaagggcaaacactcgacctcaactgtgtggkggcagggtcagcccatgcccaggtcacctggtacaggcgagggggtagcctgcctccccacacccaggtatgtgggccctgagcctatggcaggggacccagggtgcaggggctgtggcggaggcggggcctgtacgctgggcsggggaggcggcacactgccccacacgttccaccagcagaagccaggcctcatctccctccctcccagtttctagcatgggatggctcggagcagagccagtgagagtttgaatgaatcactgaggctgagggagtggtgacaatagcccccgtccctgtcctcacgtacctctggctcctcctggcccaggtgcacggctcccgtctgcggctcccccaggtctcaccagctgattctggagaatatgtgtgccgtgtggagaatggatcgggccccaaggaggcctccattactgtgtctgtrctccacggcacccattctggccccagctacaccccaggtgaggagccaggtgtggctrggccggggctgagccctaggagctcccaaggaagatgcctgtggcttcttcagtgggaccaggacaggggggcattccaggcaggctttgacccttcagcgcctgctcagagagagraggaggttgagtggacgggagggaggttaaggctggtccagcttacctgggctccctatgagtgactgtttcagaatttgtcaggaagcagcagaatgtccaggttgaatactaagctgggagtcggctgacctggttcaaatcccagatctgccccttagcaaccttgaactagcttttaacttttggggcctcagattcatctatgaaatggagcagtactgcccacctgcttggtcatggtgtggtttttttattattttattttattttattttattttattttattttattttwtttttttgagagagagtctcgctctgtcacccaggctggagtgcagtggcgcgtgatctcggctcactgcaagctccgccttccgggttcacaccattctcctgcctcagccttctgagtagctaggactacaggcacacccgccaccaggccggctaattttttgtattttttttagtagagacggggtttcaccgtgttagccaggatggtctcgatctcctgacctcgtgatccgaccgtctcagcctcccaaagtgctgggattataggcatgagccaccgcgcctggccagtcatggtgtggtttaaatgagacagtgtctatggaaagtacttgtgagcacacggaagacgtcctgtagaagggaggtgtctcactgtcatcckcatccttgggcgcagcctgggtagtaaagcttgctggttccctatgggccagaggagctcatcatcaagaagtcatgggtgggtcaatgggcctccagcttgtggttagaggctggggagggaagaagccatattcggctggccatgtggaggcagaagggtgtggccctagtcccagaaaggccrcctgtcggccgtccccactagggcctggtcacagcccagagccttctgccccagggctacaggttacagcccaagagttcaggcctctgagcagccgctctgtgtccagtgcccggcagcacccggcccatccgcatcgagccctcctcctcacacgtggcggaagggcagaccctggatctgaactgcgtggtgcccgggcaggcccacgcccaggtcacrtggcacaagcgtgggggcagcctccctgcccggcaccaggtatggcagccccccrggaccaccttgctggaggggcyggatgggactgttccagccccctcccaacccaccccatttgcacacagacccacggctcgctgctgcggctgcaccaggtgaccccggccgactcaggcgagtatgtgtgccatgtggtgggcacctccrgccccctagaggcctcagtcctggtcaccatcgaagcctctgtcatccctggtgagtgactcccagtgacatggaaagctggaggaggcagagaggcctccggggtggtgagatccaagggacccctcttgmtgacagggcagaaggcccacaccggagctggctgcagggccctgcccaggccgactccacctgtcagagtaaccaycgccttcccgtcacactttgctttggccacatgactcctcaggcrtcccctcccacctcctcttcctctctccaactcatctctgccctcatctctctcacttcctcactcccctctgcaaggcrtggcccatgccctggtcctcccatcagggttgctgagctgagggcatcaagtccaggcccccagatgcctgaaaagctggatctggccttgaaaccctgggctgagctagctgcagggtgggcaacccctgccctctcatctcaggagcatctacaactctcactcccatccccactgctgcaggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggtacagggcaccaagaatgtgggacggggccatggacagtgggttgcaggatcctggcccctaggctgaggggctggcacttcctagatcggggggacagcggtggggcatytgctggcctccgggaagcccccctcacacctctgcccacggctgcccaggttcgtggctcccgcctgtacatcttccaggcctcacctgccgatgcgggacagtacgtctgccgggccagcaacggcatggaggcctccatcacggtcacagtaactgggacccagggggccaacttagcctaccgtgagtggggccaccaggctgggctgggatgcagagaacaggctggagtggcttcagagaacaggagtgaccggtgaccatcttatccctcagctgccggcagcacccagcccatccgcatygagccctcctcctcgcaagtggcggaagggcagaccctggatctgaactgcgtggtgcccgggcagtcccatgcccaggtcacgtggcacaagcgtgggggcagcctccctgtccggcaccaggtatgggactggaggacagacaggccaagaagaggaagcgggtccctgggtggcggaggttattgggggagggctagaggctcccctgagatcaggaagccctggaccccattgcacagatgtatagtgcagtggttagaaaccagaatctaggactgacyaacctgggtgtgaattctggctccaccacttagcttgtgacctcggacaagttacttaacctctctgtgctatagtttcagggcctataaaatggtaacaatggtacgtaccagccgggcacrgtggcttacgcctgtaatcccagcactttgggaggccgaggtgggcgaatygcctgaggtcgggagttcgagaccagcctggccagtatggtgaaaccccatctctattaaaaatataaaaattagccgggcatagtggcaggcgcctgtaatcccagctactcgggaagctgaggcaggagaatcgcttgaacccrggaggcggaggctgcagtgagccaagatcacgccattgcactccagcctgggcaacagagcgagactcagtctcaaaaaaaaaaaaaaaagtacctcacagaattatcttaaagattaaaatatatgcaaaatcctcagagcttaggctcacagaaagtactctaagctgttaatattttactataatgccrttagctattgttgttaccatattttgtagaatttaggataccactgattkcgagatcygctatgattttatgtacctctaagaaaaagcttctatttgtaaggttattcattgtagatgcatcttgattttggagacatcgaaatgtgtgtctagaattgatgggatgtggtgtgagtgtgtacccagctcactggggctcctctggtctaccaccccgctgctggacaagagtcccccttccccatgtgaaggacagggaaactgatccagagctgatggccaggccttgggggtcagagtgaggcagggttgcaggttataggaacaggggtctcctgagggctccctctgactcacccccattctggccagacccacggctccctgctgagactctaccaagcrtcccccgccgactcgggcgagtacgtgtgccgagtgttgggcagctccgtgcctctagaggcctctgtcctggtcaccattgagcctgcgggctcagtgcctggtgagtagctctcagggagggcagrgctggggacccagggtgggaggccccccactcttgcaacggcaggatcaggaggccaagccrcagactgcacctgccttgagaccaggagccccatctcatctcacctcctagccrgctattgaccctttgccctctgtccccagcwcttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtaggaggcaggagctcaggaagcctgaaggacmctgtagctgcagtacaagagcataggcttgaccgggcrcagtggctcacgcctgtaatcccggcactttgggaggccaaggcaggaagatcacgaggtcaggagtttgagaccagcctgaccaacataatgaaaccccatctctactgaaaatccacaaattagcckggcgtggtggtgcgcrcctgtaatcccagctactcgggaggctgaggcaggagaatcgcctgaacccaggaggyggaggttgcagtgagccgagatcgtgccgttgcactccagcctgggcgacagagcaagactccgtctcaaaaaaaaaaaaccacaggctttgaactcaggcatgttcgagttcagacactgttccgctacttgcatgctgtgtgactttaggccagtcacttgtcacttgattctctgaccctcagtgtcctatgattttatgtacctctaagaaaaagcttccatttgtaaggttattcattgtagatgcatcttgattttggagacactgaaatgtgtgtctagaattgatgggatgtggtgtgagtgtgtacccagctcactggggctcctctggtctaccaccccgctgctggacaagagtcccccttccccatgtgaaggacagggacagtgatccagagctgatggccaggccttgggggtcagagtgaggggccaaatgggctcatgctgcctacctcatctcccctgtagcatgtcracaaacactggtccccacttttctctggtgccaagtctcagtcgtccctggcatgggtgaggtgggacgctagacccagtcctgacactggggcggtagataggaagggagaaggtggttttccctggaagagtttccatcgagttccagcwggctgggctgggagtggcaccagggaagggaacaggagcttggcgtgagccgcagtgcccagctctgagcctgcctcctccctcctgaccctcccaggtgcatggctcgaggctacgcctgctccaggtgaccccagctgattcaggggagtacgtgtgycrtgtggtcggcagctcaggtayccaggaagcctcagtccttgtcaccatccagcagcgccttagtggctcccactgtgagtgtctcgggggtcatgcaaatggtggagggctgggggaccccgactgcaccctcagcagctcccacaccctgccttacatctcaccctcccagcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccaggtacagggccagcaggtggggagggcaaaagcagggcacrccagcccccaatgggaagaggggggactctcagcacctcactctgtgctcattcagtcattcaamaaacattgagtatccttgctggatgggtcctagaccagtgctgagaatacagaaataaggctccctgacckcagggagatccacttctgcaccaaatctcactgaaaagctgctccgggycatgtcctgtgcctgacactgaagattccagatggaatgagacagttgcctgctmtcaggcagctcgcaggctgtgggagccccagcaggatactgtgtcaacactccggagggccttaacaggctttctggaggggtgacaaaaggctagacgtccaccccagcccagagacaggccacatgccatgctgggagcttcacgaaggccactgaggaggcaaggcagggaggcccccagagtccaggggcagcggcagcagtgcccaagatgtggaggagctgcccacacctactgccatacctcctgccayctgcttcctgcagatcgtgggctcccggctgcggatccctcaggtgactccggcagactcgggcgagtacgtgtgtcacgtmagtaacggtgcaggctcccgggagacctcgctcatcgtcaccatccagggcagcggttcctcccacggtgagagcagagagggcagggggtmcagacaagtggcgcagagggtggcagagaggtccccggtgccatcrctgttatctcamtctggctgcgtggtccacacccgtctgtccccagtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccaggtacagagtggagccacagcagcgggggtggaaccatggtctcctggggtgagcagagcaggctccctgtctcacggattgggccctgggtagaccgatagcagcctcaacaggctgagcaggaaggcctgagccagctggtgaccccagcgtccctccactccctctccctctccttccccatccgcacgyccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccggtgagtctgcctaggaaagggacgagggatgcaggcaacagtgttccctggggagaaggaactttcaggtcagagtcctcagacytggtggtactcaggcaagggccagcrgaaagatgcgtgggttcagtggctacggctaccccatttctaacatttcaaattctcartagccacgtgtggcttgcagccactgacttggcctgtgcagataaaaagcatttccatcatcacaggaagtttacgaattttgtgagggttaagtgagttagtgcatgtaatgtgcttagagygtgcctggcatgccagaagtgctttataagtgttaactattattatcatttttttttttttgagagggagtctcgctctgtcacccaggctggagtgcagtggcgcgatctcaactcactgcaacttccgccttccaggttcaagcgattctcctgtctcagcttcccgagtagctgagactacaggcacatgccaccgtgcccggctaatttttgtatttttagtagagacaggatttcaccatattggtcaggctagtctcaaactcctgacctcaggtcatccacccacctcagcctcccaaagtgctgggattacaggcatgagccaccatgcccggccaagtgttaactattagtgttactctggggggtgagattttctatggcagagggtcccaccaaccctrttcccaaatctgacaacggctgtgccgactcactgatctctgttcccccagcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcaggtatgcagctggcaggaaatggtgggagagccgctggatgtgggggccctggctagctttgccaagagggagacctaggagccccygtggggtgcagtacccccctgtgtcagaggttagaccctggccccaggccttcaacagttccagactggcacctgactctgttcctctgtcctgtcccctattcagacccgcggctcacggctgcggctgcaccatgtgtccccggccgactcgggtgaatacgtgtgccgggtgatgggcagctctggccccctggaggcctcagtcctggtcaccatcraagcctctggctcaagtgctgtccacgtccccggtgagggtccctgcagtgggacgggaaggccgggggagggaggaagggacagagaccagggggcagaactggcagaaggaaacactttctggcactcggcgagaactgccgctctgattccagacttcacctcccgccacccrcacggtcccaggaccaaggagccggctcaggtggagtggttcctgtccctctccacggcttgcgagcataggctttggactatgctcatctgtgcatgagtcccagttcctctggccacacttggagatgttgcacaagggacctcagctttccacctgtcactgtcccttatctgtaaagaaggggtagtagtactcttgtactctactatctaattatagagttcccaaaagcctgggactgcacctctgcgagtattggagggtgatttacacatctttattagagccggtgtggtagctcccacctgaatcccagcactttgggaggccgaggtgggcagattgcctgagctcatgagttcgagaccagtctgggtaacatggtgaaaccccatctctactaaaaatacaaaaaattacctgggtgtggtggcgcctaccgttagtcctaactactcgagaggctgaagcacaagaatcacttgaacccaggaggcagaggttgcagtgagccaagattgcaccactgcactccagcctgggcaacaaagtgagactctgtctccaaaaataaataaataaataaataaacatctttattagtactggtggcatataagggacaaaaaaacacatcaagcctgtccttatttcttggaaatctttgcttacaatggggctaagtagttaaggttttttttgttttgttttgttttgagacggagtcttgctctgtcgcccaggctggagtgcagtggcatgacctcggctcactgcaatctccacctctggggttcaagcgattctcctgcctcagcctcctgagtagctgggattacaggtgtgctccaccacgcccagytaatttttgtatttttagtagagacggggtttcaccatgttggtcaggctggtctcgaactcctgacctcatgatccgcccagcccggcctcccaaagtgctgggattacaggcgtgagccaccgcgcccagtgtgtagttaaggcttttttaaagtgaatcagttgaaaggaaaatgtccagtaattaatagcacagggggcacatgctatgcagaaatcatgataaggggacacagattgctaagcagtaaacatgatccagcacttcttaggtgttggaccctatcatatttacacatattagttcattttatcctcacaacagccctttgaggtagatggcattgttctctccattttacagatggggaaactgagactcagagaggtgaagttgttttccaaaggtcatacaactaatcaatggcagagctgggatttgaacccaggcagtctggccccagagtctgggttcttagccacattctatctgagtctgccaaacattagtggtctagtggtctgtgtggaagtgtctagacctcagccctggccccactggtgctgggagcatgggaggaggaggagatggtggggccattgcctgggggcggggctgggggaatgagaagtgcctccacctcccaggctagcccagctgctccaggcctcaatggaacgggaagggaaagaagccatgtcccaaatggcctctgrtcctagtatctgggccccaggggaagggctgagggcatcarggtgscatctcagctcactgacctctcccctgtgccccagccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtaaaggagctggagaaggatgcatgcatcctccacacctgcagtggtcctgcctgaatccagcgttgaagggaaagtggcctcagcaactggggcttgtgggaaatggcagcaggaggtcaatggaatcaggaagttgagagcgggctgggcacagcagggccaccaccagccccacagcaccttggtgcaaaatagaaaaggacatctctggctgggcgcrgtggctcatgtctataatcccagcactttgggaggccgaggcaggtggatcacttgaggtcaggagttcaaagccagcccggccaacatggcgaaacgaaaaacacaaaaattggccaggcatggtggcagatgcctgtaatcccagctactcaggaggctgaggcaggagaatcacttgaacccaggaggcagaggttgcggtgagccgagattgcaccactgcactccagcctggatgacagagcgagacactgtctcaaaaaaaaaagaaaaggacacctgttactcaaggctcttgacttcctcctgccggagaaaccatcataataaacatgccctccacaatgcggactgtcaaaggggtcgcctccaacakgatgcgcctacatatytgtgcatggcagtcccagggtgtgggtaccagaggcctgggcatctgaaggctccyagctcaccctccccgctctcaccccaccttggccaggtccayggcccactgctgaggctgaaccaggtgtccccggctgactctggcgagtactcgtgccaagtgaccggaagctcaggcaccctggaggcatctgtcctggtcacaattgagccctccagcccaggacccattcctggtgagtgatagggagcagtgggcgatgccagagcacaggcgcggggctccttcccagctctgctcctctcctctctcccagccgggcacttattgttgcctgcaggcggggtttcctaccacggaggatcaagccaacccaggtgttcccaagtctgacaatggtcccgtcccctcaaccagggggaccccagccctgagtttcaggaggacccttgagtccccagggaaaggagacccttcttaggttatatcagccactctcaagccaccgcgcccccaggatcaactggagctggtcttcactgccaccaccttcagcccctgccttgatcccyggagcctggcctctctcacccaccccctgtgcccacagctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccaggtacaggggccaggatggggaggattccaggtcaggcaagrttagacctgcagttgctttctgtacccaaacctcaygcaaacaccagcctgcttggggaccccaggggataaaatacgtttgsgggacgagttcaccagcctgcaaatcaggagacctgggtttttctcttggctctgcagctgaatcctttcctgggcctcagtttcctccactgtaaagtgagtgggttggacctctaggattctgtgaatgaagcttccaccagccctaccagctgrgaccctgagcttcygagagaactcttgggtaccggcacagttgggcttggggacattccttgtcctggggactttgccctgataactgtcccctcgctgctctgacagacccatggctcccagctgcggctccaccwcrtctcccctgccgactcaggcgagtatgtgtgtcgtgcagccrgcggcccaggccctgagcaagaagcctccttcacagtcaccgtcccgcccagtgaggggtcttcctaccgtgagtatggcagatgccatgggcaagrggggaagggagggccctgaagctaagcccacccctgctgagcccagccctctgcccctttggccccaggccttaggagcccggtcatctccatcgacccgcccagcagcaccgtgcagcagggccagratgccagcttcaagtgcctcatccatgacggggcagcccccatcagcctcgagtggaagacccggaaccaggagctggagggtgagccaggctggtgggcaggtgggcaagctgggggcaggcatgggggtgccgtcatccccactgtgcaagggtggggcagaagtctggacgccccacattcatggtgtggccctgagtaaggcccttcccgtctctgtatggcaagagcgctggacccaggagtttccaaggcctttgttacyttctgctatctgcgactccatgagctagacacamccaggccggagggattggggaagtgggcccaggggcacaggctggcagcaccaagacacragaaggaccaggtcaatcctctctcaccctcccccatgcaacctcacagacaacgtccacatcagtcccaatggctccatcatcaccatcgtgggcacccggcccagcaaccacggtacctaccgctgcgtggcctccaatgcctacggtgtggcccagagtgtggtgaacctcagtgtgcayggtgaggggacgttgaccctgtggggctctgccctgtttccagcmctgattctcagctcagagcctccaagtttaaatcctccttccaccattgactctgtcttgggcattctccctctctgagcctcagtttccacctcagtgcagtggggagacaggtgcccacccagcagttactaagctggaggccatggcagtgtgggtgagcagcagagccctgcctgtgtgtcagtggttgtcattcctyygcacagggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacrcggtgctgcaggtgaagccggggctgcctctctgggtctgaggcccagtccatggcccagccttgagcgggtgcttggaggagatagtagtggatgggcaggtggtgatgagtggatggagagaggaagggaggaatgggatgggatgggtggatgacgaatagactggaagatgagagggaagagagaaggaaggtaggagaaggaagaaagaatgagtgggagggtgggtcgaaggccaagtggatggatggactaatggggtgtcatgagggtgagccctcaagcaaccagatgggacagctaaaaaccaaggaaagggccaggcatggtggcacgtgcctgtaatcccagcacttkgagaggctgaggcaggaagatcacttgagcccaagagtttgagaccagcctgggaggccaaagtgggtggatcacctgaggtcaggagttcgagaccaccctggccaatatggtgaaaccccgtctctactaaaaatacaaaattaggctgggtgcagtggctcacacctgtaatcctagcaatttgggaggctgaggcgggcggatcacaaggtcaggagattgagaccatcctggctaacatggtgaaaccccgtctctactaaaaatacaaaaaaattagccaggcgtgatggcgggtgcctatagtcccagctactcaggaggctgaggcaggagaatgatgtgaacctgggaggtagagctttcagtgagcagagatcgtgccacagcactgcagcctgggtgacagagcragaccctcaaaaaacaaacaaacaaacaaaattagctgagtgtggtggcacatacctgtagtcccagctattcaggaggctgaggcgagaggattgcttgagcccaggaggcagaggttgcaatgagccagatggtgccactgcactccaacctgtgcgacagagtaagaccctgtctcaaaaaatraatatataaataagtaaataaatagataccaaggcagggtagaggaaayagggaagaccaagccagagctggggctgacatcagcgtccccactgagtccccacataaccagcctccttgctttctcccagatttcatcagctaaaccatcagatgcrggcacttatgtgtgccttgctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggtgtgaccaagggctggcacatagggctggcagggcagggatgccctggggtctgaaatgtagacacatgtgatctagagatgatgtcatgcccaggggtggggagtacggggagaccrtgttgctagcatcccccagtgatggccgaggaacccaactggggtccccatagagggacaggatcacccagggcccttcctcaccatrgccaccctctgcgggtccctgaggtagcccagtgacttctgtcatcttccactcgactccacaggcagccccgygcccaccatccactggtccaagctgcgttccccactgccctggcagyaccggctggaaggtgacacactcatcataccccgggtagcccagcaggactcgggccagtacatctgcaatgccactagccctgcygggcacgctgaggccaccatcatcctgcacgtggagagtaaggcctcatcccttctttgtctgcaccaaatggagatctgagccccccgactaggctccaccccacacagaaccccaggaaccccatccagaggtctccaggcgctgcagggtcctggagcctgccctgcccgacacccacaccctggcctgggacctttgctttccttatccccagtcctctgggctcaccattcagcttccctggacactggatccaacgacctgctgccattctgacctttgccctccccaatcctgacctctgtgtccccccactcaggcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaaggtgggctcagccgaggcctttgcccagctgctcgtccaaggtaagcagccccggctctgcgtggaaggggatcacctttcctcctggccctttgatgacccagctaggcagactcgggtgggaaggcctccctccataaccccacctggaatgccctcatctcccctactctccagggcccgaggcaggcttgccacctccaggaagccctccatcatgtgtgctcagctcctctagctctcacggctgctccccacctttggcacagccctggcactgccaaaggaaaccattctgtgtacataagcaccccagcctgcctcccctgccaggcagtgagaatgctcagggcagggcctggacccaggcatctcagcagccctgggcttaattgagggcaacaaggcccaggatgggctgggtaaatgcttgacagggacaacagtgaatgagtgacaggagcacccaccccagcacgcccagggcttcagtggatcttcagagagcccagcatttccatggcctcctgcatcaatgatacaaatgagggcttttgggccccaaacttaaagcagcacagcatgtagcccactggtcaagagcctggactgtggactcagacctgggttcaaagcacagcttggccatttgctggctgtgcaaccttggccaagtcactgaacctttttgagcctcagtttctttcttttttttttttttttttttttttgagacagaatctcactctttcacccaggctggagtgcagtggcatgatctcggttcactgcaacctccatctcccgagttcaagcctttctcgtgcctcagcctcccgagtagctggcactacaggcacgcrccaccacgcttggctaatttttgtgtttttagtagagaaggggattcgccatgttggccaggctggtctcgaactcctgacctcatgtgatccacccacctcagcctcccaaartgctgggattaccggcgtgagccactgcactcgtcctgagcctcagtttctttatctgtaaagtggagagaacaatgccaaccatgtaggctgagttggaaaggtacacagaggtaaacacagatgtaaaactgtggctcgcagtaggcacttagtaaatggggacagtatgcatcagcccccgcctcccatctgtcccctgcatgtgtaggtgtctttgccatggccaagtccctggattctcttatttaaactgcaggcagaataggctttgctgtccttccttaaaatgtctgartatggccgggcgcggtggctcacgcctgtaatcctagcaccttgggaggccgaggcaggcagattgcctgagctcaggagtttgagaccagcctgggcaacatggtgaaaccccrtctctactaaaatacaaaaaaaaaaaaaaaattagccaggcacggtggcgcacctgtagtctcagctactcrggaggctgaggcaggagaatcgcttgaacccgggaggtggacgttgcagtgagctgagatcgtgccactgcactccagcctgggaacagagcgagacyccgtctcaaaaaaagtattgagtccctcccactcttttcgtggcctgccctccccacccagaagcgaggagctgtggaaacagagcccagcgctccacaggcccttatccatgttggtggaatggcagctgtgtgtgcagatgaatgaatctgccactgaacggtcttttttccctggtcagagaggctatcaggagaacattccttgaatgttgggctgggggtttcctgggtccctggaggggcatcagggacatcacacacacatatacctgcagaacctcatacatgtccccgcaggccctcccggctctctccctgccacctccatcccagcagggtccacgcccaccgtgcaggtcacgcctcagctagagaccaagagcattggggccagygttgagttccaytgtgctgtgcccagcgaccggggtacccagctccgttggttcaaggaagggggtcagctgcctccgggtcacagcgtgcaggatggggtgctccggtgagtggggccgggggcaggactggacttgggcagcatagcccagggctcacagtgagcagagttaaagcacctgccccagggkgcgcaacatgaagcactgtccttggacacatcactttacctctctgagcctcagtgktctcagctgtacagtgggttatataagactgaatgaggtccaggcacggtggctcatgcctgtaatcccagcactttgggaggctgaggcgggcagatcacctgaggtcaggagtttgagaccagcctggccaacatggtgaaaccctgcctctactaaaaatacaaaaaattaactgggtgtggtggtgggcacctgtaatcccaactacgctggaggctgaggcaggagaatcacttgaacccaggaggcggaagttgcagtgagccaagatcgcaccattgcactccaacctgggtgacaagagcaaaactccatctcaaaaagaaaaaagactgaaaggagattgtctgaagcacttgcacagtgcttggtgcttggaaggccttcagtaaacagtggcccattcatatttattattagcggaggaaagagaacaggccctggggccagaaatacacaaatgaccccagatctcagctctgctacttgataactgtgtaatcttgagccctagaccataaggtctttgtctaaaatgagtgtggtgccccccaacctgcctgcctacctctagtggttattgggaaactagaatgcaacactgcgtgctgttctacatcagtttttaatgcccacacaattgcaaagcattcttttttttttttttttttttgagatggaatcttactctgtcacccacgctggagtgcagtggcgcaatctcggcttactgcaacctccgcctcccgggttcaagcgtttctcgtgcctcagtctcccaagtatctgggattacaggcgtgtgccaccacgcctggctaatttttgtatgtttagtagaaacagggtttcaccatgttggccaggctggtctcaagctcctgatctcaagtgatgcgcckgcctcagcctcccaaagtgctgggattacaggcgtgagccaccacgcccagcccaattgcaaagcattctatcagttgttttcaactccctgatgtcttattattttttctttatagaatccagaacttggaccagagctgccaagggacgtatatatgccaggcccatggaccttgggggaaggcccaggccagtgcccagctggttatccaaggtaggagggtggcttcaggcctctgctaagagcagggaacagagatgagaaaggcagagaggcacaaggcccagaccctgttccctaggaatccccctaaatgtgtcagaataaagagaattattccattttgccttgcttgtgtctagcatagagtaaaaggggcttgatacatatttcaagggagggaagaaggatatggatggagtgtgtgagtgctcagatgaaccgatgaagattgaatcagtgtgaaccgggcatggtggaacgcacctgtagtcccacctactcaggaggctaagctgggagcattgcttgagcgcatgaattctaggctgtggtgagccgtgatcacacctgtgaatacaaccaagaccctttgtctaaaaaaaaaaaagaagtggacacgtgagtgagtaaatgcataagacctgacaagtgagtgtgtttgtgagtgaatgcatgaaaaagtgaatgaggagtgaatgaatgctggagcttcagtgctcacctttccttgggcagtctatggcctccctcgggccaggcctgcagtgactgatctcactggacctctgcctccctcctccccagccctgccctcggtgctcatcaacatccggacctctgtgcagaccgtggtggttggccacgccgtggagttcgaatgcctggcactgggtgaccccaagcctcaggtgacatggagcaaagttggagggcacctgyggccaggcattgtgcagagcggaggtgtygtcaggatcgcccacgtagagctggctgatgcgggacagtatcgctgcactgccaccaacgcagctggcaccacacaatcccacgtcctgctgcttgtgcaaggtgaaggccagtggggacttttgttgggggacagtgagtggggcaggggcttctcctgctgccatcttctgcctgcccgctctgctcttcctttctgttcacttgggacattttccattgtgtgtgtttaaggggcaggtttcataacaggtggcagcagcaggggataaaagtgagattcccccagggcagcctggaatgtacagggagagagctaggccatagagcatcaagaagaaaaaagaaaccttgtcctcatctgcagggagtgcctgctytgctgggagagacctgcagcatagtctgagggcagagacataacccagtcaacaaacagacctaatagagagtaaaacaaggacaacagatgcagggcagacacaaacactgtgtgttctttaaaggcaattcctttttaccccaagccctgtgacttgcctccaaacttycttacctatactgcccctagtgtgcacttctcaggtccccaaagggctgcacaattttttgmccaggcrtgttgaagaggtctcaggctgtggagtgaaatggatctggccctgaaccctgactctgcccgaccaggagcaaacagccgcttttcccctctgagccataatttcctcatctgtgaaatggaatgtagtggcttccttcaaggggtggtgtgaagatgaaatgaatcagggtgcaggctgggcacatatctgtgactgtcatgttgatggcctatgtctcttccatgcctctcagccttgccccagatctcaatgccccaagaagtccgtgtgcctgctggttctgcagctgtcttcccctgcatagcctcaggctaccccactcctgacatcagctggagcaaggtaagtgctggagagggaaccagcgggcatgacttgggggctgggaacagatctgaagcgtctcagtgtccccaggatgtggcacaggcttggccaagagcaaacgctcaatgttggaaggtgggcctgaggcacagatgggaggtgggcccctggagccrtgggccarggccagggccctcagtgctagtgcatttrcagctggatggcagcctgccacytgacagccgcctggagaacaacatgctgatgctgccctcagtccraccccaggacgcaggtacctacrtctgcaccgccactaaccgccagggcaaggtcaaagcctttgcccacctgcaggtgccaggtaagacaccacccctaagaattggcagtgccctgcccactccctgactggcagggtcttcagctgtgctctctgctggcagagcgggtggtgccctacttcacgcagaccccctactccttcctaccgctgcccaccatcaaggatgcctacaggaagttcgagatcaagatcaccttccggccygactcagccgatggtgagcaggagggttaatttgcggggtgggctggcctgggttgagggacctygtggagtaactgccatcatggcaggagccctggctgcccctcagtcctgccccaatccctcagccctccctctccagaagcccccagacctctgggcctccaccctggtgtgccttctcttgtgcctcccggcttctccatccctgcctctgtgatatctccagcctcctcgtggctcctctgccaccggggcatcacccccagtcctcctgtcccagcttcctttccccatctctgctccttcctccctcctctgcctccatctcaccctttcctcctctctttctctcgtctcttacgggtctctgactttcactgtccaggcctccttctctactcgggtgagtctctgcctccctctcccccttgagggagactccagtgtgtgtgaagcaaattcagtttctttctaggggcgctcagtaaggcccttgcgtttggggcaccagccctgagatagtgagaaggccctggctgtgtgaggagtgccagagggagggacaggttccgagagtggacaggctcaagagcttgggtggtttctagggtgggggaggacagggagcctgtggctggaagggggccccttacacagtggtgcccacccagggatgctgctgtacaatgggcagaagcgagtcccagggagccccaccaacctggccaaccggcagcccgacttcatctccttcggcctcgtkgggggaaggcccgagttccggtgagacccccagcctccccacctacagggggactggacacagggctttggtctggcaagtgctaccctgggctccattatacaaaggagatctggaggaaggagaaaatgtggccgttacccttggtgaccacccaatctgctagagtaggaatagtatgccagtcaggtggaggagggtgcaacctcagacttgggactgctgcaggccaggattcattcattcattcattcattcatkcatgcatgcatcakttatttgctgaccaccccatgtgtgccaggcactgatacaggtaaaacaaaacagaccaaattctggctcttgtgggaagaggtgtattctcactggggaagaataaacaagccataaacagagaaacaaggtgatcacagggagagaggagtcctcagaggaacaaggaggccaggtgctaggctgcagggcgctgagcctggggtccctgtgggctgctctgggaaagctcccagcaaaaggatgtggggagagaagatccaggggatgggtcacggggagggacgacaagacagggacaggaacgggaacagccccagggctgggactgcargaagtggtgacatccctcctctgggacccctctayccaactgggcccctagcccttcttacaaaccccctatccactctctcctgccccggcctgccccacggagcaggttcgatgcaggctcaggcatggccaccatccgccatcccacaccactggccctgggccatttccacaccgtgaccctgctgcgcagcctcacccagggctccctgattgtgggtgacctggccccggtcaaygggacctcccaggtgagacccaaccccatactgctamttccagccctcatcccgcccttgcccagcctctgttgccattcctgacttccccacctccccagggcaagttccagggcctggatctgaacgaggaactctacctgggtggctatcctgactatggtgccatccccaaggcggggctgagcagcggcttcataggtgagccccctccccacctccagctgaggctgggccttacctggctggctggaagagccctggagagcctgggagggcacctcagggtatgggctgggacaccctgccctgtgctcatcctgcccactcacctcccaggctgtgtccgggagctgcgcatccagggcgaggagatcgtcttccatgacctcaacctcacggcgcacggcatctcccactgccccacctgtcgggaccggccctgccaggtgaccccacaccccacayaccacctggctgccgtggcctccacccctagccatggctggcccctgtggggattatggggggtactgaatgttctcggccttacttctgggggctgctttgcagaatggcggtcagtgccatgactctgagagcagcagctacgtgtgcgtctgcccagctggcttcaccgggagccgctgtgagcactcgcaggccctgcactgccatccaggtacgcaccccgacygccagtcgctgtcgccccagggcctgcctcttccctttgctgcctccccatatccaccaccatctcaaccactggggcacttccacaccccccactctcacctgagcactctccactcctcccatgtacccatcccccatctctgctacccgaaggccctcaccccatcactgctgcttcccctcctccagccctgctgaccaaattcttaccactaccccgccacccaggcactcccccacccccagcccatcttttttttttttttttttttttgagacgaagtttcgctcttgttgcccaggctggagtgcagtggcacratctcagctcactgcaacttccacctcccgggttcaagcgattctcctgcctcagcctcctgagtagctgggaatacaagtgtctgccaccacccctggctaaattttttgcatttttagtagaggcggggtttcactacgttggccatggctggtcttgaactcctgacctcaggtgatccacccacctcggcctcccaaagtgctgggattacaggcatgagcccccacgcccggcccccagtcccatcttattacccaggtgcccaccccattacccgccaccaggtgctccccctccaacactgtccagtctctgaagaacctgcagacacacagagtccctcgactgcttcccctgcagtcctccctgtggcctcttctggctcccgccttgctctgctcagttccctcctccaaggcctcccaggaggctggcctggccctcactagcccagccccccggggtgtgatgggcagacctctggcatcaggacccccctccctccagagtcacctccgtgtcttttcactggcctatgtgccccccagaggcctgtgggccsgaygccacctgtgtgaaccggcctgacggtcgaggctacacctgccgctgccacctgggccgctcggggttgcggtgtgaggaaggtgaggggagccaggcctgagacccccagggtcctagtgtcagctggggaggctgggtggggcactctgaggccatgatgggccctacggatgataaaacgattcccaagccagaggmtctcgaagtcacctggccacatgtctgcccagcctgagccccttattgagtgagggcccccaaagaggacccctgtcatattggagctcctcccagccccgtgtgcaagggcaggggggctcctgtgccactgcagctggtgccaactggtcctgagcctctgggcctggagagtgaggcaggcaagggtcccagaggaaggcagartagctggaccccacccgagggtccaggatccccactgcctcagctgagctgtggctgctgcaggtgtgacagtgaccaccccctcgctgtcgggtgctggctcctacctggcactgcccgccctcaccaacacacaccacgagctacgcctggacgtggagttcaagccactcgcccctgacggggtcctgctgttcagcggggggaagagcgggcctgtggaggacttcgtgtccctggcgatggtgggyggccacctggagttccgctatgagttggggtcaggtaagcacccagcaccaaatgcrgggctctgcacrccaagccttgtgcccccctcggctcttcaagccccagggaggcatgggaggataaatgcagggatcagggcaagtcccctcttcctgtgcatttcgtctctgtgtcacttgaggccartccctagccctctctgagccatgggctcctcatctggaatacagaaggctgtagggcattccccatctgctcagggccctgtttgtggtggagagggcagggagccccgtgtgcccccatgtgcccaaccctgcctggcatcctccccagggctggccgttctgcggagcgccgagccgctggccctgggccgctggcaccgtgtgtctgcagagcgtctcaacaaggacggcagcctgcgggtgaatggtggacgccctgtgctgcgctcctcgcccggcaagagccagggcctcaacctgcacaccctgctctacctggggggtgtggagccttccgtgccactgtccccggccaccaacatgagcgctcacttccgcggctgtgtgggcgaggtaagagcagcctcctcgggacaagcgggaggggaggggtgccaagccttgtgtccccctcggctctccaagcaccttggcattgggcccctccacctgcagccacccacgggccctgggccaggacactgtacctctgagcctcagtttcctcctctgtaaaatgggcatgatcacacctactttgaaaggttgggcagaggattgtctgcactgacggatgaatgtttctagcacacagtaggcactcaactcctgcgcctccctccccacaccgagaatccatgctaccactcagggcccaatgtgggctcccagctcccctctgctgcattcttctycctgctggtacacctgggtctctgcctcccaggcccctttagtccctcggtgtccctgtccccacaggtgtcagtgaatggcaaacggctggacctcacctacagtttcctaggcagccagggcatcgggcaatgctatgayagctccccatgtgagcgccagccttgccaacatggtgccacgtgcatgcccgctggcgagtatgagttccagtgcctgtgtcgagatggattcaaaggtgggaaagcctgcccagggcaccggaggggaggggcacaggtggtcagcgacacctccagcccatgcccacccacccactcgcctctgccctggcccacaggagacctgtgtgagcacgaggagaacccctgccagctccgtgaaccctgtctgcatgggggcacctgccagggcacccgctgcctctgcctccctggcttctctggcccacgctgccaacaaggtacccaggcctggcttctctccacttcatytctgtcttggggccccggagctcgacatagtacccacgggtgtctatgcccaccaactggaccctgcccttctccataggctctggacatggcatagcagagtccgactggcatcttgaaggcagcgggggcaatggtgagtacttgccatggcctcctccccagcttcagctcagctcactcttccagttaccccacaccctcaattctggcctgcaagcaaaacagctttatatgaggagcttgctgggcagagagacagaatgaagaccacagccatgtggagctagggcctgccccacacttactggctgggtgaccttgggcaggcctttgaaaccactctgacctcagtttcctcctctgtattcatgtattcagtcaacaaactattgttgcccatccttgccctgagagcagtaaatataagatgcataaagcaagaccctcattcccaagaattccaccgtctactgaaaagctaaggaaacagtgaagagtgaatgctgattgaatgtttacggacactgtgctaacccctttacagacacatctcttcttatgtatcactaatataataggcgaggcagtggtatagtgggtaagagtatagacttggagccagcctgcttgggttcaaatcctagctctcccacttactagctgtggractttgggtgagtcgcttaacctctctgtgcctcatataaaatggagatgagtaacatctttccctaaagatttggataaaattttatgtgagagtaaaattacttagtgcatttttttttaaggtggagtcttgctctttcacccaggctggagtgcagtggcacaatctcggctcactgcaacccccgcctcccagactcaagcgattctgctgcctcagcttcctgagtagctgggattacaggtgcctgccaccacaccccgctaatttttgtattttttgtagggatggggtttcaccatgttggccaggcctgtctctaactcctgacctcaggtgatccgccccccttggcttcctaaagtgctggattacaggcgtaagccaccgtcctaaagtgctggattacaggcataagccaccgcgcccggccacttagtgcattttaaatgcctagaacaatgtgtggtacagagtcagtacagaatgttagctgttgttaatattatgttcagctggccgggcacactggctcacgcctgtaatcccagcactttaggaagctgaagcgggcagatcacctgaggttgggaatttgagaccagcctgaccaacatggagaaaccccatctctactaaaaatacaaaattagctgggcgtggtggcacatgcctataatcccagctactccggaggctgaggcaggagaatcgcttgaacctgggaggtggaggttgccatgagccaagattgcatgcaccattgcactccagcctgggcaacaagagcgaaactccctctcaaaaaaaaatactatattcagctgggtatggtgactcacgcctataatcccagcactttgggaggctgtggcgggcagattgcttgagcccaggagttccagaccagcctgggcaacaaggcgaaatcctgtctctacaaaaaaatacaaaaagtagctgggcatggtggtgctcatctatggtcccagctactcaggagacaggcaggaggattgcttgagcccaggagttcaagatcaacctgggcaacacagggagacctcatctctacaagaaatttaagaattagctgggtgtggtggcacatggctatggtcccagctgaggcagaaggatcacttgagcccaggaggtcgaggctgtagtgagctacaattgtgtcactgcactctagcctgggcaacagactgagaccctgtctcaaaaaaataaaaaataaggctgggtgcggtggctcacacctgtcatcccagcactttgggaggacaaggtgggtggatcacctgagatcagttcgagaccagcctggccaacatggcgaaaccccatctctactaaaaatacaaaaattagccaggtgtggtggtgcacacctgtagtcccagctactcgggaggccaaggcaggagaattgcttgaacctgggaggtgggggttgtagtgaaccaagattgtgccactgcactccagcctgggccacggagcgagactccatctcaaaaataaataaataaaataaaaattatctatatataatattcattcatagggttgttgtaaggattgagttaaatgcagtggtgtctgtagctggatgggaygctccccgcacagccacatcataggtgttaggtaaatgtcagccgttctcctcatcatttggtggagggtagcagagggtcccctactcttgtcccctgccagagctactgtggccagtgccggcctgtgggatgggtcatgagcagatagggctgggggggtgtggagccacacacagtatggacatcctgggccagtcactcgcccaagcctgcctgctcttctgtaagatggagagaacaccaaggctctgaaccatttattgccacagtccaaggtgaccaacggtcccagtagctccggactgaggggtttcttgggatgtgggactttcagggctaaagccagacagaatttggcaagtagaatggcgggtcacccgacacggatcctgttgactacacaaaataaaataaaataaaatacattgatttaaggaaagcaattatgctgaagtaaagtaatcaaaacatgttttaagtttcctgacttgctatatatgtgcttctttattaacacatcaaataacaagatctggtgatctcagtagctaccacaatttcaaagcagcaatatgtgtaaatgatattttgaaatatttgcagctactgtcatgtgataagcaaatactagtaacaaagttgcaggtcctaccactgctactttggtttcttgcctacatctcattgaaagaactgctcaatttcagtgagaagtgagtgaaattgaggtgtaatgctttcccatccaaggtcataggctccctgaattctgttggcagcccccgtgggtccccagggactgcaggctcggagccccctagtcctgcatgttggcgtggaggtgggggtcaggggaactgacgggggattttgatgcctgatgcagcaggtatggcaccaccctcctctctcccacagatgcccctgggcagtacggagcctatttccacgatgatggcttcctcgccttccctggccatgtcttctccaggaggtgagactggcattggaagggcccatgggcctaatggggaggatgggaatctgggacttctgtcccctcacccgctcttcctccgcagcctgcccgaggtgcccgagaccatcgagctggaggttcggaccagcacagccagtggcctcctgctctggcagggtgtggtgagtgtgggtatccggctgggctcttggggctcctggggcaggaagctggcttcctggtggccggagtggtggggggaggggaaagcagagccccctggcctcggcagcctctgctctccaggctggggaccccagagaccctgtgcttccctggcaggaggtgggagaggccggccaaggcaaggacttcatcagcctcgggcttcaagacgggcaccttgtcttcaggtaggtcctggcacctggcccttcctctcccttccctggtcccagcaccccaccccccggtcctgccccagctcatacttcttgggcctggatgactgcaggtaccagctgggtagtggggaggcccgcctggtctctgaggaccccatcaatgacggcgagtggcaccgggtgacagcactgcggtaagggaccctgccgggcactcgggatggggcccagcgttctggagtggggcaggacgccccctaccatgggcagagaggcaggtattgagctctgtggagacagaacttgaagccaggggaggggagaacccaccagccagggctcrggcttccatctcggactgaactccgctgggggcaggcgagtgccccaggagtgggaggaaacctgggtgcagaaatgaggaagctgtgtttgtggggcccgatctctcgttcagcgggggaaagaaagagcttgggaaacagggacagacttctgagtctggagtctcgatatcagagggaggggactctgtcgtggggccggggagraccaggaagtttgtggaaaggggcctgacccagttccactgcagggagggccgcagaggttccatccaagtcgacggtgaggagctggtcagcggcmggtscccaggtcccaacgtggcagtcaacgccaagggcarcrtctacatcggtaagtctggggctccttctcagggcaggggcaggaacggcactcccttagggctagagctcgcccagccttcctcgcctcctgggctgctggagcccacaggccctgtcctctcacctcccggcaggcggagcccctgacgtggccacgctgaccgggggcagattctcctcrggcatcacaggctgtgtcaagaacctggtgctgcactyggcccgacccggcgccccgcccccacagccyctggacctgcagcaccgcgcccaggccggggccaacacacgcccctgcccctcgtaggcacctgcctgccccacacggactcccgggccacgccccagcccgacaatgtcgagtatattattattaatattattatgaatttttgtaagaaaccgaggcgatgccacgctttgctgctmccgccctgggctggactggaggtgggcatgccaccctcacacacacagctgggcaaagccacaaggctggccagcaaggcaggttggatgggagtgggcacctcagaaagtcaccaggacttggggtcaggaacagtggctgggtgggcccagaastgcccccactgtccccctacccaccgatggagcccccagatagagctgggtggcctgtttctgcagcccttgggcagttctcactcctaggagagccaacctcggcttgtgggctggtgccccacagctacctgagacgggcatcgcaggagtctctgccacccactcaggattgggaattgtctttagtgccggctgtggagcaaaaggcagctcacccctgggcaggcggtccccatccccaccagctcgtttttcagcacccccacccacctccacccagcccctggcacctcctctggcagactccccctcctaccacgtcctcctggcctgcattcccacccsctcctgccagcacacagcctggggtccctccctcaggggctgtaagggaaggcccaccccaactcttaccaggagctgctacaggcagagcccagcactgatagggccccgcccaccgggccccrcccaccccaggccacatccccacccatytggaagtgaaggcccagggactcctccaacagamaacggacggacggatgccgctggtgctcaggaagagctagtgccttaggtgggggaaggcaggactcacgactgagagagasagragggggatatgaccaccctgccccatctgcaggagcctgaagrtccagctcaagtgccatcctgccagtggcccccagactgtggggttgggaygcctggcctctgtgtcctagaagggaccctcctgtggtctttgtcttgatttttcttaataaacggtgctatccccgccaggggcctcctgagtctttgatgagggcttcactcagtggagcctgtggatggggcagagcagggcaggtgagatctgggggtgaagcaagctggcttgggatcagcgaggcccccaggcccccaaccctgtgaggcaggaattgtcctattttctagaggggcagctgagtctcagagggttagggggcctgtccaacatcagacagagagccagggggttagaacccaaagagtctgaccccagagcctagtatcattcccrtgtgcccgaagcccctctagggatggcctccctgatcctataaggctgggccactcaactgcagccccctggggagacctggctgggacatgggtagcacgtggtacaggctgtgctgcagtggaggcagaggccacgggcaccaggttgccaggccagccagctgggagagcaacagcaccagaggaggcccaggaggaggccagcagaggccaggagcatcgaggaggccagcgccacccctcagagctgggggcctgtgggaagagaaagtccactcaggcctcggcctgggtcctctgccccgtcyccatcacctagagagggacaggtatgattttggtgggaagagtaggagcaaggtgtaaccttccaaagctgcgtcttgtctcgtggggtccctgcctgctggggaactcctctcagctgcaatccagagggatcctgcagacccgagagctggggagggagtcagggatctggaggtatgggcatctgtacttcctgtctggctgggcaccggagagggacctgcatgggaaagaacagaactagcacactgagaactgccctttctgggacacttgtgtgtttcattcaatcctcacaagacttccctgagtttgtcactctgtgtttccattttacagagaggttgtcacttgccgagttcaattagctggaagtgataggaggacttgaactcacayggtctggctccagggcctaaggtctatgagtggagctacttcccaaggaagagggtgtacatgtactgagcattgaggcagggtctcactctgtcgcccaggctggagtccagtggcgcaatcaccactcactgcaacttctgcctcccaggctcaagtgatcctcctacctcagcctcccgagtagctgggactaccagcacgtgccaccatgcctggctaatttttctattttttgtagagacgggatctcactatgttgcccaagctggtctcgactcctgagctcaagcaatccacctgcctcagcctcccaaaatgctgggattccaggcgtgagccaccatgcccggccatgagcattttctgtgcatcaagcaccacactctgtgctgggcccgttacctatgtatgccactcacagtttacaacaactctgaagggtgaggtttatccccatttcacagataaggaaactgaggcatagaggttccttcttccattcatttgactagtatttcttgagcatctcctatgcccccaggcatggctctagcaactgggggatacaaccatgagcacatgacaaatatgtcttcatggcactgggagtttagtgtggggagaaacaaaacacatgaatagaatttatgtctaaaggagatagatgctagtgagaaaaattaygcatgttggtgggggcagggctgccgcttttcttttcttttytttttttttttttttttttgagacggagtctcgctctgtcgcccaggctggagtgcagtggcaggatctcggctcactgcaagctccgccttccgggttcacgccattctcctgcctcagcctcccgagtagccgggactacaggtgcccgccactgcgcccagctaattttttgtatttttagtagagacggggtttcactgtggtctcgatctcctgacctcgtgatcctcccgcctctgcctcccaaagtgctgggattacaggcgtgagccaccgcgcccagcgggctgccgcttttcttactgtggcaaagcacataacgtttaccatttaaccatggttaggggtacagttcagtggcattaaatatattctgatagagtttggatctgtgttcccacccaaatctcaggtcaaattgtaattccyagtgttggaggtggggcctggtaggaagtgattagatcatgggggtggatttctcatgaatagtttagcaccatccgtttggtgctgttctcaagatagtgagttctctcaagatctggttgtttaaaagtgtgcagtgcctccccactcactctctcttgctcctactctggctgtgcctgctcccctcgccttctgccaagattgtaagtttcttgaggcatcccctgaagctgagcagatgccagcatcatgcttcctgtatagcctgcagaactgtgagataattaaacctcttttctttataaagtacccagtctcaggtgtttttttatagcaatgcgagaatggactaatacgcactcacattgtgcagccatcaccgccatccatctccagaactttgtatctgcccaaacggaaactccatcaactccgtcaattccattaactccatatcctccttgtccccacccccccagcccctagtgaccatggctctacttcctgtctctgtgattttgactattctaatatacatatgtatatgcttataaagaaaatttataattttcttataaatttataaagaaaggtaatttataaatttataaatttataaaggtaatttataaagaaaagaggtttaattgtctcagttctgcaggctgtacaggaagcatatctaatatacatattagaatataataataagttactaataataactttttttttgagacagtttcgctcttgttgctcaagctggagtgcaaccgtgcgatctcggctcaccgcaacctatgcctcccgggttcaagtgattctcctgccttagcctcccaagtagctgggactacaggcatatgccaccacgcccagctaattttgtatttttagtacagatggggtttctccatgttggtcaggttggtctcgaactcccgactacaggtgatccgcccacctcggcctcccaaagtgctgggattacaggcgtgagccaccgcacctggccagggttgctatttttatataaaggagtcagggaagaacttaaagagacccaccargaagcaaaggaacgagcttgcaatgcagatctcagaagaaaagtcttctggtagaggacacagctactgcaaaggccagaacaaagctggagtgtggaggggaggcggggccagggagggggtggggcagggaggaggcggggccagggaggggtggggcggggggcggggccaggaaggaagaggcgaggccaggaaagaaggggcagggccagatcgtgcagggcctttgagcccgggcgaggctttgcctttgctgaatgtgatgagggttttgagcaggatagtgacataacctgatttactgttttaaaaggtacctctggcggggaagcataactccccactcaagtgggctatacatagtgacttcccaagaatacagtggggaaagatgggaccaaaagtaacggtggagaaatgaggcagacatcagccaggcggtcaaggtcagcgtcaaccaccgtccaacaccaaacacccaacaccaaagtcatgtttggtgtgatgtgatgtgatgaagatggcatttcacctctgtgaactgtaactctagtcttttcatgagaaaagtatcaaataaatcccaatagtggggcatcctacaaaatccctgagcagtactcacaactgtcaagatcattaaaaacaaggaaatcctgagaaactgccacagccaaggggagcctaaagaggcatgatgactattaatgaatgtaacatgaggcygggygcggaggctcacgcctgtaatcccagcactttgggaggccraggcgggtggatcacttgaggtcaggagtttgagaccagcctgtccaacatggagaaatcccgtctctactaaaaatacaaaaattagctgagcgtggtggtgtgcacctgtaatcccagcactttgggaggccaaggcgggtggatcacttgaggtcaggagtttgagaccagcctgtccaacatggagaaatcccgtctctactaaaaatacaaaaattagctgagcgtggtggtgtgcacctgtaatcccagctacaccggaggctgaggcaggagaatcgcttgaaccagggaggcagaggttgcagtgagccgagatcacgccactgcagtctgtctagcctaggcgacagagcaagactctatctgaaaaaaagtaataaaataaataaataaataaatgtaacatgagatgctgagtgggatcccgggacagaaaaaggacatgaggtaaaaactagggaaaactgaacaaactgtggactttagttaataatattacttcattaattaaaacaaatgtctcatactaatgtaaaatgtcagtaatagcacccaaactgagtgctgggtatatgagaattttctgtactatcttctcaatttttttgtaaatctaaaactgccctaaaaaatgaagttcatgcaatcccagcactttgggaggccaaggtgggaagatcttgagtccaggagttcgagactagcccttgcaatacagtgagacctcatctctacagaaaacacaaaaattagctgggcatggtggtgcatgtgtggtcccagctactctgggggctgaggtgggaggatcacctgagcccaggaagcagaggttgcagtgagccgagatggcgccactgcactccagcctggataacagaatgagaacctatctcaaaacaataaataagtaagttcatttgaaaaaaagaaaaagaaaaagaaggctcccccaggcttccttcttcctgtgttgtcagaggcaaaggacagaaggagggagaccagttcagaagttattagaacaacccagacgagagctggtggtggctcagaccaggtgatggcagagcaggtgtgagaarggtcagagtctggagagctttcaaaggacttgtcactggcttggttatgggttataggctatgggttaagcggggagtaaaagatgactcagtgaggcctgggcagctggaatgtgaagtcgctgctcagcgagagggaagcaggatgcagggagggctgtggacaaggagtccagtatggggcaagttaagtttgagatttcgcctatacatccacgcagagatgctgagcagggaggaggttatgtggctgaagttcaaagacaagtcccacaggtgataygatataaatgagacccacaagggaatgagcctggatggaggacaaggggacataggacctgggtctcatggcacaaagcatacagcatcagggaaatgaccaggaacctgcaaaaaaggctgagcgggggatggggaaggtaagtgtgtggggttctgggaaactgcatttcacccctgttcaackgtacatggcagccctacctccatcccactcctaattgggtgtggtgggcaggtgggacatctttagatccccaggaaggttattcctgggtgatttgttctggtcccttccaccaaccctagccctcctatcccactcccctgtctacagagatcattcctgctcattttactcactggctttatgaccttgggcaagtcacttctctctaggcctcagtttcctgatctgtaaagtgtgggaatcagactggattgatggttttcaaagtatgtcttgagggtgacactcagggccctcagagagacatcaggcagccagggccccaggcccaccatccagttaagcagaggatatctcctttgaatgtcttgggcctccatgccaggtcccatttagcaaaagtttccaccactaaagcatcatttggaatccgccggatgagatcatctgcagca

SEQ ID NO: 13247 - DNA, 12884 bp, Homo sapiens
gagaccatcctggctaacatggtgaaaccccgtctctactaaaaatacaaaaaaattagccaggtgtggtggcgggcgcctgtagtcccagctacccggcaggctgaggcaggagaatggcgtgaacccaggaagctgagcttgtagtgagccgagatcgcaccactgtacyccccgcctgggcgacagagtcagactccgcctcaaaaaaacaacaaaaaaaaaaacaacmcagaaacccaacagagacctgaagacgtgcctgcctcccccatctccgggacctctcccacctgggtgaagggggcacgtgagcctcacctgatcttgaccatctcagctaaaacactgaaccacccttggcacccaccagcagcagacggagaagaactgtatagggtgcaaaagygccccgccaccatcaggtccagatgaaaacctacaagttgaatcagcaaggtgctgasggatacrcaagcagaaaccctcttataggaggttcaaggctgggcgcagtggctcactcctgtaatcccagcactttgkgaggccaaggcgagcagatsacttgaggtcagsagcctcagaccagcctggccgatatggcaaaaccctgtctgtactaaaaatacaaaaattagccaggcatggtggggggtgcctgtaatcccagctactcggaagcctgaggcaggagaatcgcttgaacctgggatgtggaggttgcagtgagctgggacagcaccatttccctccagctcgggtgacagcaagaccctgtctcaaaaaaaaaaaaaaagtttgagaatgtcagacaaggcagcaccctgtgtaggtgctcaggttgggcrgagtctctctcgggggaggggggtaacaggacagcgcctcccggggcctccttgcatgtctgtgtcctgatgcacagcaggcgggggctgcggggaccagagaaggaagaagcgcmccagctgggcacttcccgaggaggaagtggtgccggaatttcccccaggtgtggcctcaggtataagagcggctgctgccaggtgcatggccaggtgcacctgtgggattgccgccaggtgtgcaggccgctccaagcccagcctgccccgctgccgccaccatgacggtgagcctctccacatgccgctcggatggatgctgcttggatgtgcagcctggcatggaagggctggggttctctgagcctgggaggagggtgttgggatggggtctgggaaacccctcagtctgggggtaggggaggcagctgcagatcctcggagcgctggcatgctgggtgtcttgggctgaagggctagcctctctgggcttcagtttccccatctatagagggagggctgtactccatctttccgctgggaacaaggaaagctgaggtggaagtgaggtgccycctgccctgggcacctcctaaccacccacctgcctgtttcaccagctcctccccggcctcctgtttctgacctggctgcacacatgcctggcccaccatgacccctccctcrgggggcacccccacagtcacggtaccccacactgctactcggctgaggaactgcccctcggccaggcccccccacacctgctggctcgaggtgccaagtgggggcaggctttgcctgtagccctggtgtccagcctggaggcagcaagccacagggggaggcacgagaggccctcagctacgacccagtgcccggtgctgcggccggaggaggtgttggaggcagacacccaccagcgctccatctcaccctggagataccggtgaggacctggggattccgctgtggcgtggggctgcccctcccctggcggggccctgactgcccggagagctctctgggccttggyggttctcacctgtcaagtgggcgtggccacctgagctccctccctccggccctcctgacctggackgctgagctgctgcttgcggctggccgtgccctgcctsccactgtcctaggtggccagggtcccctggggaaattctgggcccktcacctgagctcctgcagaagtggggctgggtgatgaagtggaagggagkctcctagaggcctccggaccctgctctgtgctcttggagggccctggggagacgtggattaccaccacatgtgagcccgactgcaccccaagcccgtgtggctcagccctcgctgcctcaggtcctatcctgagtacacggagaggggccctgaggggagaggggcctccaggaggacagggtagggccagagactcactgtgcaccccgtcccgcagtgtggacacggatgaggaccgctatccacagaagctggccttcgccgagtgcctgtgcagaggctgtatcgatgcacggacgggccgcgagacagctgcgctcaactcygtgcggctgctccagagcctgctggtgctgcgccgccggccctgctcccgcgacggctcggggctccccacacctggggcctttgccttccacaccgagttcatccacgtccccgtcggctgcacctgcgtgctgccccgttcrgtgtgaccgccgaggccrtggggcccctagactggacacgtgtgctccccagagggcaccccctatttatgtgtatttattgttatttatatgcctcccccaacactacccttggggtctgggcattccccgtgtytggaggacagccccccactgttctcctcatctccagcctcagtagttgggggtagaaggagctcagcacctcttccagcccttaaagctgcagaaaaggtgtcacacggctgcctgtaccttggctccctgtcctgctcccggcttcccttaccctatcactggcctcaggcccccgcaggctgcctcttcccaacctccttggaagtacccctgtttcttaaacaattatttaagtgtacgtgtattattaaactgatgaacacatccccagaggccaacattcaatgcgacattctcccgttcagccctggtccaggccagccatggacccaattctggggtgtccttccagaaaggtctacgcagccgcgagcartgcatgcaggtgggactgagctgtagcacgggggggtcacaggtgtccctgctctgcccacacagtgtctcccctgaggacacccctgggaacaggaaccagcctccttcctcaagcagtgccttgagccctatgctttgtaatgatgtgagcgcctaggggcaccctctcggcccccaaggcaagtctctgaggatgaactgcagggctgtcggctcaaggcagggcccccagccttcgtggttcggatcaacatccaaggccaagcgccctccctgawggtgaactagccacgcttcgggacccaggctctgttggagattttagttaaggggccccggggggagcagccccagtcgtggaaagggggcccaggcctgtgacagtctcagggtctcagtctctaggcccccggccccaagggctgacattgccatggggctgctgggcagttgttagcccctcccctgcctggccccctggctcacccacctactgcgtccaggtgcctggagatgggggtgggggtgctgcacagaagaacaaggactccactcagactcccaaagcaagaggcctcagggaagacttcctggaggtggtggcccttgtccaggagatggaattttcattcaacacatttattgagtttcttttctttcttgaaaaagggtctcgctctgttgcccaggctggagtgcagtgtggtatgacttcagctcactgccwcccccaccttctgagttcaagcgatcctcccagctcagcttcccagtacaggygtgcaccaccacacccaactcatatttgtatttttagtggaggcggggtttcgccatgttggccaggttggtctcgaactcctgagctcaagtgatcctcccacctcggcctcccagagtgctgggattacaggcgtgagccaccgcacccagccatatgagtttctactaagcacctggcactgggaacaggccgagaacaaaatggtgaaaacccttcctgcctccacggtgactaatgaaacaagtggtgtgtagtctgtgagtgagtccaggacagaggctctgggggaggggctgcagttcttttttttttttttgaggagtctcgctctggcccaggctggagtgcartggtgcgatctcggctcactgcaagctccgcctcccgggttcacrccattctcctgcctcagcctcctgagtagctgggactacaggcgcccgccaccacgcccggctaattttttgtatttttagtagagackgggtttcaccgtgttagccaggatggtctcgatctcctgacctcatgatctgcccgcctcggcctcccaaagtgctgggattacaggcgtgagccaccgcgcccggccaaggggctgcagttctaagcagagggtcagggaggcctcgaagacctgaaggggaggaggaaggagccaggcagccatgcagggaacagctccaggcagcaggaagagcccatgcaaaggcyctgagaagacacatgctgcgtgtgtccaagggtcagagagtggcctgcgtggctgatgccaggtgagagggggaccgcaggggcagggcagggcgctgggggtgcagatcatgtctgccctggggccatcagaagcttgtggctgtcactggaggtagctgagcctgtgggttctgagcctgcggattctgagccgsaggcactggggtgaggctttgggtttcaatggcagcatcaggatggtttcaggggatgagggcagagcgggaggcggcaggtggcctgggtggggatggcccatgtagctggggtctggatttgggccaggattggatgtggggtgtgggggtttcaagggtgacctgaagcttggtgacctggggggacggctgagatgaggctggattgagacgtctgtatggtgccgagtgttggctggtggggggtggattctgaaggcccccaggaacagaggaccctggctctgaagtgtgagttgctgggagagcaggtggacaagcagcaggcaagggcttctccggcctcaggggagtgggtgccttggcgagagcccaaaggtgggggacgtggctgaygccgggcaaagctttgggggcaccgggctggggtggtggtgaggacctgtgggcaggtgtgtgtgcagccagccacagcctccgcacaagtgaggggaaggggtggccagaagcccctgcaacttggcctgagcgtcctgggcagctggggggccccccagcatcagtgtgggggcaaacaaggccacatccgccaccagcttcaccccagcttctacggaaaagaggcgcagggtagaggctcaccacgtggctccgrccctgttcccttttcacttaacgccagcggcctcctctggaatccaagccccttagggaggcgttaggtgtggagggcctgcagggcctgcaggagctgtcaagggaggactctgctgcctcctccaggcccgggaggacctttctagggaggcacacacctggaatccaggtactatatttcgtggaatatacggtacccgggatttcgtgtgctgctgagaaggaaggcgatgctgatgttaatgaaactggaatgcggcccggctggcaggaaacggggtgcctgcccaggcctcgggaaccatcgctaccccagccccgcccaccggccccaggcagaggctcacgcgctcccggcttcgctgcrtttattgcaggtgggtgcacctggygggagggcaggtccggggcgaggtcacacgacctcgtcggtcaccgggatggggttgacctggggacctcccgggggtccccccgccgccrccgcagcctcctcctcgctgggcttcttgcgggcctcggccgggggcygcggckgggggttgctgggcggctgcttgatggtgcctccgatctgcggccgctcccggggcttgggctcgatgggcgtccactgctcgccacgcacagccrcctgcggggcactgaagggttgagccgcgccccagcgcccgccctccctccctccctccctccccggaggcccaccccgctaggggccctgggacaggctcaagtctgaatcccacrcaggatggtgtgactgccactcagagaggttaagtgacgcgcccgaggccacacagccaggacctgggtcggcctgacaccagcccaagctatttcttcatgccaggagtggggcccgaacccctgggcttctggaagatcccgtggtggacactcccagatgcaaattctagtactcaaattctcctctcaaggtgccaagggcagggaaggcagggaggcaggcccgaggtccagcaggaggggtggcccaggagagtagcaggccctgctccgtctggtgggcgccattcacccacgctggccggcagccccccaagggtgcccaggcatttctgcacatgggggtggtggggggagagcttgaagaccacgggattccactggcttttactaaaaatacagactcctgggcccatgcccggaggttccactgcaacaggtcaagtggacctgggagtgtgtgcttttcatcttctatcccataatatctggtggaaaaatatgtcacatcatatacgtcatgaacagaaagagaaactggacatgtgtgatcctacctgactccaaaacggaaacattccattctgaaaagcaaaactagaaggctgatagaagaaaaggcaggaacgtgaaggcaggacccagggccagggaaaggtgttttcacaaagcacagaccatagagcaggtgaacagggaaacctctgctcttccgtgcagtgaaggactccacgsgccaagttaacagaccctcaccagaaagcatgaaggcatccccagtgtytaaagkttacaaaggctaaatagctaaaatatatgtggacttcctgcaacttaagaaaaagacaatcaggccgggcgcggtggctcacgcctgtaatcccagcactttgggaggccgaggcgggcggatcacaaggtcaaggagatccagaccatcctggctaacgcggtgaaaccccgtctctactaaaaataccaaaaattagccaggcatggtggcacgtgcctgtagtcccagctactcgggaggctgaggcaggagaattgcttgaacccaggaggcgaaggttgcagtgagccgagatcacgccactgcactccagcctgggcgatggcgcgagactccatctcaaaaaaaaaagaagaaaaagaaaaatacaaaaaccacaatagaaaaatgggcaaaggatttgaacaggcaactcaagggagaagaaactccaacagctcaaatccacagtcagagaagggcgagtccaagctccacacggccagctcgtgctgtgaaactggcaagcgtgggagaaagcctagtgcatggtgggagagatggggccacatggctggtggtgggttgtctgctgrggagcagctgagcccggcagggtgaacggtgcagaggctgatgcctgacccagcaattcctctctgggtttagcacaaggaattcctcccgaggtctccaggagccactagctgtgcgtggcagcagggagacgggggggatgcgggtggcccccggaaaacaaagcaacagcccagatgagcacttggcaacaggaaggggttctaaaggagagttctgccggtggcaggtcagtgaggcttgaaacagaactccacttccatacgcggaaggcgtacacagaaagtgctgcacctttcccacgcacacacactagaagacgcacagcaaggggagggcagttgcctctgckggcaggagggacttggctctatggacaaaaggatttaaataagcaaagtctgagggctctgtccacccagagacccccgcagtgagaggtggcctgcagccgtctgttccggagcccagggcaggcagagggcatttcacccaaggcctggccaggctgcgccctgtcctcccacccatccctggcctctcagagagatcactgtatcccatgggatgggcagccttctaacagggtgcagcagtcataaaccaaacgcaggtgtcggcagtttaagaaaatgtctgcgtcctggcaccgcccatgaatcagcgcgaatagggtttaggtgagaaaagcctgataatgggacccaagcgcaggcacggtcttcggccggctgcgtgaccccaggccagtcacagcacctccctgagcctccgcatctttgtctgtaaagtggggaccccagtacccctcccagggctgtggtgcgggttaatgaggaaatgcaaggaaaygacccgacacactagacacgccaaaaatggcagcagcaaccgctgcgtccccgccgtgctgtgagcacacgcccaggctcacacttgctcccagccttggctcagcctacagagccggcttcaagggccatgcgtgtccgagggtgtcagggcaggggctggggatgggggtggccggggccgacctcagagggcgccactcaccagtaggtagatgcckctcgcaatggccaggcaggcggtcccaaggatggtggccagcaggaagccggcgggcaccgagagcctgggggacagcgggtgagaggcagggacacagaagggcactcagaaaggggaacggagccccaggtctgggggccaaggccacaaagtctcaggacaaggcagactgcagacccaggggacgtgygyggaccggggcttgtttcggtcctgggtgttctcrgccttgatgtggmcrctagcggctctggtgcacttgctcrgaggaagcagccacgtgtgggtgtcctggcctcagccggcagtaaccagcagacacacagcacggaaccctccaccctaccaggaagcccaggcaagaccccccagcagtgcatgctgaccccagaccctggcgacggatcggagctcctcggatttggagtggatccttacaaatcctgcacrctagacagcagacacaggccctgccagagccagggacccgaatttttgtttggaaaaayactgaggtaagtgggggtggctcctgtccaggcagcccggccggtgggacagtggggagggtcggctccaagccctcctgagccctagagggggtgcgggacggggactcacaggagaygcaggacggccyraacatagtaattcctggtaaagggcccgaasagcttcaccacggyggtcatgtrcttctgtcccctgggggagggaggaaggcgagacggcgcggctgggcctctcccactcgggactcctttgctgccctgctgaccaccccagggcacccaggcctctttcctcccacaaaacacaccgggcaggcaccggccttggtttacccacaagcaccaaagggttggttccggagcctccaagtgagaaaccaagctccacccaaccctgtgagccctgcctgggccccgcarcccccggagagamcccagagcaggaggrgactcaccagcgctccatggtggagcccttcktcctcttcccccgggggtactccagcaggcacacaaacacgcccgccacactgaagccatgtggttaaggaacagcccagctcagcctgaggggccacagggaactccctttactgaagacaacacagagaggggcccgagcacggtggctcatgcctggaatcccagcattttgggaggctgaggcgggaggatcactggagcccaggagtttgagaccagcctgggcaacatagtgagaccctcatctctacaaaaaatttaaaagccaggtgcagtggtgtgtgcctgtggtcccagctactccagaggctgaggtaagagggtggcctgagcccaggtggaggctgccatgagtcacagctgcaccactgcactgcagcctgggggacagagcgagaccctgtctcaaaaaaggtcgggggcagccactgcctgaggtcacagagccaggaggcagccacgggaggttccaacaggtctggcactcggggctgcccacgccctccctcccaccaccctgcccagtgctccttgtcgcaaggtccggctgggcggcagggctgagatggggcagaggaggtagaggggccggtcaagggggatgactgacaggagcgggcagaggggatcccagcagtccaacagggaggcctcagtgctggccctggccctctggtgacaccccctgcccaccactcaccaggacttagactggcgggtctgccgctgatcgccacatggtcctggcgaggggcctggctgctggggcctgggctgcccaacccgtgcacagcccaccctgtgtcccagcctggctgcggtggtggggagcggaggcaaacagctcactgtgaagtggctccccagctctgccctgggcgttccccgcccaccccagcctcaggtggaaggatacatggagtaggcaccaaagtaccactgggtgaagcgcccagctgyggccacgatgcccccggtgatgaggactgcggggagaagtgggtcaggcactgtggggctccygtcccgggggcctgggccaccccccttctctacctactgtgggccaccaggccacccagagctgccccctacccatccccacagcacagtgacagggtcggggacacccccaggaggcacccctctgcactggtgaagagcagagcctgtggcgcacgggctggcggagggggtgctggacatgcccgggctctgggtcccaggagtggccaaggacagcccgacctgcargccccagtgggctctgggacccccaaatggacccccttgtcaccatgagtctttgtttgatgcactgaaagctaacaggccgagtgtggtttctgcatcttcttgggggagtgtctttttccccccgatacggagttcctcttaacccgtcagcggttttgccttaatttcggtttcgtctgatatggctatttctgcacatttttgggggggtattgtccaatattcccccttactgttttttttttttttcgagacggagtcttgctctgtcacccaggctggagtgcagtggcgcgatctcgactcactgctacctccgcctccagggttcaagcaattctcctgcctcagcctcctgagtagctgggactacaggcgcccgccaccatgcccagctaatttttacatttttattagagacagggttttcaccacattggccaggctggtctcgaactcctgacctcagggaatccgcccgccttggcctcccagagtgttgggattacaggcatgagccacggcgcctggtccttcctactattttatttctttttttttttttttttggagacagagtcttgccctgtcacccaggctggagttccgtggcgtgatctcagctcactacaacctccacctcccaggttgaagcgattctcctgcctcagcctcccgagtagctgggactatgcgcgcctgccaccayacccggctaattttttgtatttttagtagagacggggtttcactgtgttagccaggayggtctcgatctcctgacctcgtgatccgcccgccttggcctcccaaagtgcyrggattacaggtgtagccaccttgccctgccagccattctgtttttgtctccacatggtcttgttggaagatttcctatccttggtttgagcccagctacacattaactctctgggtttgtctgtctgcgtcggaggaggggagggcagtgtccttgagtctactcagccaattgtccatgcatctttggggaccgtcctggtcccgagcctgccatccgaaagagggtgcaaagctgccgctggtgccaccagggaggtctgaggacgtattctggcacccagccacatttacagagcacctgctgtgtacaggggggactctttgtcaaggccctgctgtctccgggccagctgcctcctggggctgcacggtctggaaggacctccccaggcaggtggcatttgaattgagaaataaatgagacagccatgaggctctgcagaagcagcagcttgtgccgaggccctggggcacgctcaggagatctaggaacagaaaggaagcacggcagctggaggagggggccggagagccgggaggccagggcgggcagtgcagggcgtccagtctggctctaactcttcgggccaggagcccctggagggtttcagcaggaggccagactagagcccaggtctcctggctcccagctgggtgccctcagtccgtctacttcctgtagggagtgcggggcaggcagggtgagtctcacggggcagctctgggragagctgtctgaactgacccaccgacttcttggccgctgactcgaagcaggmggtcactttcctgggcacaggacaggctgcagggccccgtcctccagccctcccaccctgaggtctctgctcccactccagctgccacgcaccctccagacaacagggagggcgctcagagccccaggggagtggtggcrgcgggcccctcctcctcaccctcagcccccaggcccttcccaggcactcctcccccggtgcaggtccttcctggagctgctgcagtggtgcctctgccctcagacctcgcctgagcccagcctcacccgtgctgggccagacactccctggccctggtcccgagagggtccatttccaaatggagtccgctgccctcaccagaacctctgagcaaatgcacaggagggtgactgggggctgtgccatcccaccccaagagcaaagtgcct

SEQ ID NO: 13248 - DNA, 25968 bp, Homo sapiens
gttacagccaccggcataggcgaatctcagccagagagagtgaactgggacaccattcacgtgatgggccagatgggctggcagcggctcgctggagccgtccgggtgggaacgctgtgtctgttggtctggtgctgcttatgtggctggttcaggtctgtcatccgtcaacctgcatatttatcactggtgcattttcatgtatgttgtacctcaattaaaacattttaggsccgggcgcggtggctcacgcctgtaatcccagcactgtgggaggcggaggcgggaggatcatgaggtcaggagatcaagaccgtcctggccaacatggtgaaaccccatctctactaaaaaaaatacaaaaatttgccgggtgtggcggcacgygcctgtagttccagctactcaggaggctgaggtatgagaattacttgaacccagtaggcagaggctaccgtgagccaagatcatgccactgcactccagcctgggtgacagtgagacttcgtctcaaaaaaaaaaaaaaaaaattaaagcagatggggtgtgggggctcatccctgtaatctcagcattttgggaggctgaggcggaccgatcacctgaggtcaggagttcaagaccagcctggtcaacatggtgaaacctcatctctacaaaaaatacaaaaaatagccaggtgtggtagtgggtgccgtagtcccagctagttgggaggctgaggcataagtattgcttgaayccagaaggtggaggttgcagtgagccaagaatgcaccactacactccagcctgcgcgacagagtgaaactgtctcaaaataaataaatacataaaattatatrtatatatatatatatatatatttttttttttttgagactgtatytctgtttcccaggctggagtgcagtggtgtgatctcggctcactgcaacctccgcctcctgggttcaagcaattctgcctcagcctcccaagtagctgggattataggcgtgygccaccacgcctggctratttttgtatttttagtagagatggagtttcaccatattacccaagctggtcttgaactcctgacctcatgatccgcctgcctcagcctcccaaagtgctgagattataggggtgagccactgtgcccggcaataataatwtttttttttttgagacagagttttgctcttgttgcccaggctggagtgcaatggtgcaatctcggctcacggcaacctccgcctctcatgttcaagctattatcctgactcagctgggattacaggcacccaccaccacacctggstgattttggtatttttagtagagacggggtttctccatgtcggccaggctggtctcgaactcctgacctcaggtgatccmcccgccttgggctcccaaagtgctgggattacagccctgagccaccatggctgacaataataaaaaattttaaagcaaaactaaagatttataaattgtaaaatgcggttgtaacaagtatttactgtaccagtaaatatgaaaaatattaatgtcctcacacacatggaggtggcttgwgagtggtgtgagcatttcatggtcagagtttggcagttggrcgagagacaggatggattttaactcgaacatcgcagacacaaaactgaaaaccctgatgcggtgcctgcaccgttgcctcctttcctgcagctgtaaatgggacgagtaattccatccccctcccgcttccacccttcagcacagacgcagtcttcagcaaggaagtgctgggaacgccctggagtgaacccaggaagatgcctgcagtgggtgccagggcccctcyccaccgtycctgctgggcttcggggccacgcccgactgctgtgaacggcctgcggagcaccacgtgcgacggctggaggcgagaggtctgcctttgatgtggctgttggtgcagggcctgtggtgcsttccgcagcggaaatggcgcgccgcccggggagggcgggagcagcgtcccgggtgcccctgtgaggatgagcgacgagatgactggagggtccctgaagacctcacyagggtgcccccagccggtccgctcccaggaagcgacacccccacagccccagggctgcagctgagggggtcgccactctggctgggcgaggctgggcccttgggggcaggcgccagagtggcctcaggctctacragatgcctgaaaacaccaacctctccagggctcactagcattggacgctttcacgctctgccctggccggaagccccctcaccccgcgcgatgtgcaaactcctgcagggctcactcagtttccagaactttaattattggaaagttctccctggtccagcccccaaatctgccgtgaacgttgacagctgagttgctgctccatgcgtgctttggctgagagcagaggggacccctgtcctccctgagctgctgacgaggggaggggtgaagggtggggcctctggagagggcaggtcccggggaagctccggactcctagaggggcggccaggtgggggccctggtgaccaggacagactgtggtgttttttaacgtaaaggagatccgyggtgtgagggaccccctgggtcctgcacgccgcctggtggcaggcygggccatggtgggtgctcacgcccccggcatgtggccgcyctcartgggaggggctctgagaacgactttttaaaacgcagagaaaagctccattcttcccaggacctcagcgcagccctggcccaggaaggcrggagacagaggccaggacggtccagaggtgtcraaatgtcctggggacctgagcagcagccaccagggaagaggcagggagggagctgaggaccaggcttggttgtgagaatccctgagcccaggcggtwgatgccaggaggtgtctggactggctgggccatgcctgggctgacctgtccagccagggagagggtgtgagggcagatctgggggtgcccagatggaaggaggcaggcatgggggacacccaaggccccctggcagcaccatgaactaagcaggacacctggaggggaagaactgtggggacctggaggcctccaacgactccttcctgcttcctggacaggactatggctgtgcagggatcccagagaagacttctgggctccctcaactccacccccacagccatccccyagctggggctggctgccaaccagacaggagcccggtgcctggaggtgtccatctctgacgggctcytcctcagcctggggctggtgagcttggtggagaacgcgctggtgktggccaccatcgccaagaaccggaacctgcactcacccatgtactgcttcatctgctgcctggccttgyyggamctgctggtgagcgggagcracrtgctggagacggccgtcatcctcctgctggaggccrgtgcactrgtggcccgggctgyggtgctgcagcagctggacaatgtcattgacgtgatcacctgcagctccatgctgtccagcctctgcttcctgggcgccatcgccgtggaccrctacatctccatcttctacgcactgygctamcacagcaycstgaccctgccgyrggcgcggcragccgttgcggccatytgggtgkmcagtgtcgtcttcagcacgctcttcatcgcctactacgaccacgtggccgtcctgctgtgcctcgtggtcttcytcctggctatgctggtgctcatggccgtgctgtacgtccacatgctggccygggcctgccagcacgcccagggcatcgcccggctccacaagaggcagcgcccggtccaccagggctttggccttaaaggygctgtcaccctcaccatcctgctgggcattttcttcctctgctggggcyccttcttcctgcmtctcacactcatcgtcctctgccccgagcaccccaygtgcggctgcatcttcaagaacttcaacctctttctcgccctcatcatctgcaatgccatcatcsaccccctcatctacgccttycacagccaggagctccgcaggaygctcaaggaggtgctgacrygctcctggtgagcgcggtgcacrcggctttaagtgtgctgggcagagggaggtggtgatattgtgtggtctggttcctgtgtgaccctgggcagttccttacctccctggtccccgtttgtcaaagaggatggactaaatgatctctgaargtgttgaagcgcggacmcttctgggtccagggaggggtccctgcaaaactccaggcaggacttctcaccagcagtcgtggggaacggaggaggacatggggaggttgtggggcctcaggctccgggcaccaggggccaacctcaggctcctaaagagacattttccgcccactcctgggacactccgtctgctccartgactgagcagcatccaccccaccccatctttgctgccagctctcaggaccgtgccctcgtcagctgggatgtgaagtctctgggtggaagtgtgtgccaagagctactcccacagcagccccaggagaaggggctttgtgaccagaaagcttcatccacagccttgcagcggctcctgcaaaaggaggtgaaatccctgcctcaggccaagggaccaggtttgcaggagcccccctagtggtrtggggctgagccctcctgagggccggttctaaggctcagactgggcactggggcctcagcctgctttcctgcagcagtcgcccaagcagacagccctggcaaatgcctgactcagtgaccagtgcctgtgagcatggggccaggaaagtctggtaataaatgtgactcagcatcacccaccttagccccttccagaaagtgcttgaagtttgcgggtggagggatgggggaggggaaggtgggcaggggtgagagtcgagagggaagaaaggagtcccggaaaacgtggctgcctccccaggtgaggaagccacagccccagaggccccaaatgcctggggagtgtggaggtcccaaccaggcttgcgctgaccctgcttctcggttttctctccgtgctgacaaaccccagcctagaggaaggacgagcaggtgcagcagggccccagtcccctccactcttgacgctgtcctagctgcagaagaggcgggttcccagccttccctgtgaccacatgtgacctcagscgggacacatccctttgctggccctggccctgagtccctccagccatgatgagccgtgaatgggaccatccctgtccactctgagatgcctggaagggggctcagtgcaggtgggctgggggctgggtctgctgtctgcccagcactgccattctgggagtaggcaggtggggaaggggtcgggggtggagggtctgtgttcagccagtcctgggaaatgcttgatgtgaggcttctgaagatggcagtgaggsagaggcccagccggcggagaagtccctgggagtgagtacctggggatgaactatgctgcctggtgctggggagcagtggcgcccctgggccatccctctgctgaarcctgggcgtctcgctgaagagaccacctccatttcctctgcwgagactgagcactcagtcagcccccttcctgggacaggctcaatggaggctgcagggccatcagccgactccwwcgcaggctcagtcagcagccccctggccagccccacccctgactgccggcctcagaactgggagctgcttcctggcagggcccgcctctgctgggagaccggacggtgagtcagccttaagcccggcaccagacccctctgaggatggagcaggagctggctgccctgaggctgcaaaacttcttccctcgtggagacagggaggcacctcagacactcaccccggactcccttgaacagggacagggaggaaccccaggcagctagaccccagcagcagccacacgagcacactgtggggcagggaggggcatctcttgagaacaaaagatccatttctmgactttccaaactggagagcttcttgagasaaaagagagagacaggtacaggtccacgccacccacacacagccctgtgcacacagaccggacacaggcrtccacaggcaagttcgcagctgctcattttgtgaagtgaatgctgatttgggggccgggtggggttcgtctgtacatcgtgcactgtcagacccttcctgaaggatttttgttactgaagtatcagaaggcccttgttctaaggtggtggcactgtaatatctggcccaggaggaggtcagtgccgtgccggcgagtcctttgctcccttccttctctgaccagtaaacgcatctccagtcgctcccccgaggcccccctgcacgcagwctccgacctcagagagtgagtcagatagaagccgctgcccaccctcccccaccctggccgggttcttgcctggcttgtgcgtccttgtgacaattcctgacacggatgcgcaccgggcagtggcacgtccaggtgctgtgcgcgcccgggcccacaaagctcctttggacgctcatggcagccccttggtggaggaggtcgggtgcccaccccctccccgcccactgcggaagccggcgacccacggagctcgctctcggccgccgccacccctctgtgttcgcgcccttccgagctctgatccgacgctttgtttcttctcagtgggttcagggcctgggccagcctttacctacctcccccacccaaaaccggcaaaagctcagagcaccttgtctgccaaaagacagggagctggsatggtgcgggttggtctctaaaccggcgtggggaaaaaagaccctccgtacaaagccgcagggtggggctgtcgcaagggcggaaccgagagggtagctgggggcggggttcccagggccaagaggggccattgtcctccctggagcccggcgcccccacagccagctcctctgggagacagcccctcctttcgaatgcgcggggccctcagaccgcgcccggcccagcgctgggggatccttggctgcgggaggggcgccgcattgcgcgcggcgggcggggacgcgcggtgcggagcctgcgggccgggcggggctctgcggcggcgcctcccgattggccacccgcggtgacatcagccgatgcgaagggcggggccgcggctataagagcgcgcggccgcggtccccgaccctcagcagccagcccggcccgcccgcgcccgtccgcagccgcccgccagacgcgcccagtatgagggagatcgtgcacatccaggccggccagtgcggcaaccagatcggggccaaggtgaggctgcgcgccccggcctgtcccgggccccggggcgggaggagggaggcgccgtgccccgcgggccgcacctccagctgcccccgcccctgcgaacctgcaacaaagggatgcgcccagcgccgcgccgggcggccgggacgcggggcccccgccctgggactctcgcctgcacctctctgcccctgcccaggtgacctcgggctgtcgaggcgcagctcacgtcagtcgcgaagcctcagccccctccacacctgcgccccctccacacctgcaccccctccaccgggcctccgcaggtgcagctgggagccctgtctgggcgtggccctcttttttggggccgcggcatagccttgagtgagacgggtggggtaggcaggtttgggtggggtggggggttctcctcacagccgtgatttcctcggcccgaaccccccactggagtagccgaacgtcccccgagaggctagagccgccccgatttccccagcctgctccgacacccctcggcgtcctagctccaccctgtccctttgttggaggggttgggcctggactcgagatgaccttggtccaggaccaggctctccatcggcgcagccgctcctgggcaacccccgcggggcttgaccgcgcccacccagggtctaccagtctggggattggatgtgggaacaaagccgggctgtggggtgtggaggctgcaccgtggcgcgcccctccctccattgttagcccacctcgcagatgttggggccacgcagaaaggggcgttggtgcagctgtgcagggacccctgcctaaatcattaaggggacgtcgtgtcccctggtcctgggaggctgtccctggcccaaggtcacacagcaggtgcgagagagctgggctggcccttggttctcatcccctgcaggagccaacctggggctcgggcggggcgggttgggggcgctgcttgccaaaggatctgccctccgaacagtgttggggaacaggggatcggggggggaggctggctttgtcaggaccaaggccagggacccagctcagggctggtgcagcgctgattctgggaaggagggggtgcaggagacggtcctggaggggaaggggccagagaaaggcagcctccggaggctgttgccatggaaaccaggcaggaacaaaaagctaattacaacagggccagccacgtggctgacatgtaaattgcaactttggctccgggtggaggcgcctctgagggtgggaggcccagtagtggggagactctaatcacccaagragacagctgtgcctgccaaggagagcctgggggaggggagacctgggggacagtggcctcaaatcaaaccaggactcccggagcagcctctgacagctgccttggcctgatgggaggggctgagggctcattaatgtggtcactggggccaagcctcccctgagcatctgctcctgggagggtcaggggtcgctggggggagggagggcaggcagccctggggctcctgggagggtcaggggtctctggggagagggagggcaggcagccctggggcccacctggggtttctccttctatggctgggatgggcccagagctgtggtcccacaaggcacttgtcaggcaagagctgggatctagaagtcaggtgcacatgcagacwtcccctgaggctccacgggtagcagagggagcccttgtcccctggaccgtgtccttsgctgccttgtgctctgcttctgaacactggagctcttagtttgcccgctactttttattccttttgagttgtttgttttttcttaatatatttctttttaaaaattaatacctggccgggcacggtggatgaggaatctcatgtaatcccagcactttgggagactgaaactggaggatcactttagcgaaggagttcaagaccagccgggataacatggtgaaactccgtttcttaaaaaaaaaaaaaaaaaaattagcctggcgtggtgggccgcgcctgtagtcccagctacctgggaggctgagatgggagcattgcttcagcgtgggaggtcgaggctgcaatgaactatgaccgcaccactgtactccagactaggcgatagagtgagatcctgtctcacagtaataatagtatctgattctttttaacaatgaaagcaacagagaaggaaattttctcgggggcgkgggcggcaagagcgtgttcctttgctctgctgcccttgtggaatcaatgggaagttccttggccgttctcggcctccactcccgcagctgatagggggtgcaacgcggctgcttccctgtctggggtcctcgggcggtgcctggctgggcaggaaggcccgtgcastctgggcagagggaagtcggggtgactcgaggccgggagcaaagccgggtcccgggcggtcacgcggcagcgcggacgactcaccgcggtcacccctgcgctgggagccgagcccccggcagctcgcggggatgcagtaagccgggcgcagcccgccgggaggatgagaaaacccgaagcccggaaagccgagcggccgcctgcagtcaccccggggggggcaggggcgggccgggctatgcagaaacaccggggcccgcgggacacaggacgctgccccactgccgcagagctgaatctggacccccgggctttgctttcctggggcctgtgctcctccctccccggggcggggttcgcctgcagcggcggaggggggagcctttgtcctccgcgcgggctgcggcaccgcctcctcgcggctgcggggcggggctgggggcggggcctggccgtctcagccaatgggaggcggagtccctggctcgccccgccctctcgcctgaaagacctgcggagccgcgggccgggcgggaaccgcattcgggtcctggaggggcttggaggccccagtctcgcagccccttcatcggggacccccgctcccacctgccttggccactgccctcaaagcccggccccgctttccccaggaccccaagcgctgcgcgaggtcagcaccaaggacagcgcccgggccgagcgcctggcctcgaacgccgggttctgctttgtgtttccaggtttttgtttttggttatgagaggaggcctggctctgtcgcccgggctggcgtccagaggcgcgatctcggctcactgcagcctcggcctcccgagtagctgggaccgcaggcgctcaccaccacgcctggccacaattttccttttttcttattttcttttagatggagtttggctcttgttgcccaggctggagtgcagtggcgcgatctcggctcattgmamcctccacttcctgggttcaagctattctcctgcctcagcctcctgagtagctgggattacaggcgcccgccaccacacctggcttattttgtacttttactagagatggggtttctccatcttggtcaggctggtctcaaactcctgacctcaggtgattcacctgcctcagcctcccaaagtgctgggattgcaggcatgagccaccacgccgggccgatttccttttctgtagtgatgttaacaatttagtttataaaattatattttattgtttattaaatatgtaacataggccaggtgcggtggctcacacctgtaatcccagcactttgggaggccgaggygggtgratcacctgaggtcagcacttcagggccagcctgggcaacatggcaagactccgtscctacaaaaaataaaaaacaaaaaaaattagctggacatggaggcacgccggcctgtggtcccagctacttgggagrcagaggtgggaggatcacctgggggaggtgggcagaggttaaagtgagctgaggtcatgcccctgcattctagcctgggcaatagagcaagaccytayctaaaaaaaaaaaaggaacaatatattttattactttatctcaaattataattttattaattttaactacaaaagcaattaatatattstcctggttaaaaaaaaccttaaatattgcagataaacctggtgcccatctagccacctctctctatccaagtgggaacaaatttctttttctatccttctggtccattttttttaagtgacctgtgcatatggttttaaaactttaaatagtatctaaaacatttgaacaaaatgaagccaacatgtgctgaatgttttcatgtcaagctttgtgctaaggcctggatgtgggcaccattcacacgttcatctcacagatgagaaaacaggtcctgcgaggcacgcgcctggcccacagctgtgctcgtgctgggtcttgaatccactctgctccattgctcctgctgccctgtgcctcgctctgcagaggacttcccatagatgtgttactctctccacccctcctttacaggggctggtggttgtgggttccctggaaccataaatttggggtgtcccagtgctttggggagcaaggtccccgactcaagtggactgccagcaactaaattaatgggggatcctcaaagagastgttagggaggcaagcagtaggtgggaagcttggacaagccccaaatgcctcagggacctttctgtattttttttttgagacaggctcttactctgtcgcctggactggcatgatctaggctcactgcaacctccacccccctggctcaagtgatcctcccacctcagcctcctgagtagctggggctataggcatgcgtcaccatgcccaactaatttttttgttttttggtagagacagggtttcaccatgttgcccaggctggtcttgaactcctggactcaagtgatccacctctcttggcctcccaaactgctgggattataaatatgagccaccatggccagctgatttttttgtttgtttgtttgagatggagtctcactctgtcactcaggctggagtgcagtggagtgatctcggctcactgcaacctccacctcctgggttcaagcaattctcctgccttagcctcctgagtagctgggattacaggcacccrtcaccacactggctaattttttttttttttttttgaggcggagtctctatctgttgcccaggctggagcacggtggcacaatctcggttcactgcaagctccgcctcccaggttcacgccattctcctgagtcagcctcccaagtagctgggactacaggtgcccgccaccrcgcctggctaattttttgtatttttagtagagacagggtttcactgtgccagccaggatggtctcgatctcctgacctcatgatccgcccacctcggcctcccaaagtgctaggaccacagacaggcgtgagccactgcgtctggcctaatttttgtatttttagtagagatggggtttcaccatgttggtcaggctggtctcgaactactgacctcgtgatccacccgccttggcctcccaaagtgctgggattgcaggcgtgagccaccgcgcccggccttttttttttttttttttaagatagggtttcactcttgtcccacaggctggtgtgcagtggcttgatctcagctcactgcaacctctgccccctgggttcaagcgattctcgtgtctcagactctgaaacaactgaaattacaggtgcgcgctaccacgcccggctaatttttgtatttttagtagggacagggttttgccctgttgtccaggttggtcctgaactcctgacttcaagtgatctgcctgcctcagcctcccaaagtgctgggattataggcatgagccaccacacccagcytgaatcatttttgtaatttaaaaatttaacgcaaaaagaataaaacttagcaataacaaaaatgcacaaaagatggaaagaaatccacccctgacctttgtggagagatgacctctgatracagtctcagggtgaacgggcacctctgataacagtctcagggtgaacgggcatcccgagacactgttagcagaggtggtccatgtccatgctgtccgcgttacaataattacactatgtttattcttaaggttttaaaaacatttatttttaacaaattttctttgaaaagctaccgtgtgcacgtgagaaaatctcaacaagaccacagggcacccgtgagaagaagctcctcccagtctggggcccctccccaggcacagccttccacacatctaccagaggcacccacgcatagagaagcacccacaagcagttttctttctttcttttatttgagacggtgtttccttctgttgcccaggcttgagtgcagtggcatgacataagctcactgcaacctccacctcccgagttcgtgtgattctccgcctcagcctcccaagcagctgggattacaggtgctcgccaccacgcctggctaatttttgtatttttagtagagacagggttttgccatgttggccaggctggtcttgaactcctgacctcagatgatccacygcctcagcctcccaaagtactgggattacaggcgtgagccaccgtgcctggcacaagcagttttctccccttccttccttccttccttccttccttccttccttccttccttcctctctctctctctttcctttctttcttccttcattccttccttccttccttccttcctttctttctgacagtctcgcactattgcccaggctggagtgcagtggcgcgatctcgactcaccacaacctctgcctcctgggttcaagcaattctcctgcctcagcctctcgagtagctgggagtacaggtgcgcgccaccatgcctggctaatttttgtatttttgggagagatggagtttcactatgttggccaggctggtctcgaactcctgacctcgtgacccacccgcctctgcctcccaaagtgcagggattatgggggtgagccacygtgcccagctatgagyggttttgtttctatttatttattattattctatgagacagagtctcactctgtcgcccacgctggagtacagtggtgcaatcttggcttactgcaacctccgtctcctgggttcaagcaattcttctgcctcagcttccggagtagctggaacgtgtgagccaccacccctggctaatttttgtatttttagtagagacaggctggtctcgaactcctgacttccggtgatctgcccacctcagcctcccaaattgttggtattacaggcgtgagccaccgcacctggcctctatttatttatttattttgagatggggtcttgatatgaattcctagactcatgcttctcatgcttgctaccacccagtcctgcctcctgcacagcagtttccactaaagtcacccctttacgagaggcatcttttttttttttttgagatggtgtctcactctgtcgcccaggctggagtgcaatggcatgatctcagctcactgcaagctccrcctcctgggttcaagtgattctcctgcttcagcctcccgagtagctgggactacaggcrcccgccaccattcccggctaattttttgtatctttagtagagacggggtttcaccatgttagccaggatggtctcgatctcctgacttcgtgatccacccgcctcggcctcccaaagtgttgggattacaggcatgagccactgtacctggcctactagaggcatcttaaaacacatctcctgtgtctccattccaaagcgcatctttgtctacactcctggggtcctcccacgtcagcctcccaaagtgctgggattacagtcatgagccactgtgcccggccccaccaaattgttttctaacctgcttttttcttgaggaatcttctgcagcacatgactcacatgtagagccccttgtttcttgaggccttcatacccgtcagctcatctaaaagtcactcctgaggagtaagggcaaggggcattgggagaggtcaggcagccctgggaagcctcccagcgtgtgtcccaggaggcctgctgcctgcagacactgctcccagacgcagcggcctcggccatcagagcgtgtcccacgatgaggtggcaacttccctgaagggcttgctctcacccaggggtgtggttctccgtgtgcacacagatagatagttctacgtttgccatataccatttatatgcctcacacagattaacccactttcatttcaaaaagacctcctgtcatcgtgcccattgtacagatgaggacactgagacacggaatcctagtgacctgtgcaaggtcacacagctgggaagggtgagggaagcgtctgtgaacccagcaggcccagcccctgagtctaggctccgctcggcagctgtcatgggagcagagtccgagaagcactgcaggcacctgctctagggggagagaggtggaggtggcaggtagagagaggacgacccctgggagctgagacgatgccagcctcacacggacaggctgggtgacctcaggcaagtcgcttcccatttgggaccccaaggacccttctgcagacccagctgggggtccccgatgagactggctctcagagtccctgtgagtcccgtcagctgaggccagtaatgtcctggcaccatcactggacatggtttgctctcccatggaggggcaggtgtagcagccaaaagcgatcctgagctctgggcctctgaaccctgctctgccagctactgtgggtgtctctacccgctctgtgtctcagttccctttcctgaaaagaggggatagtaaaaactaaccctcaaggtgtttattaccaatgcccttcatggaggaatccgctgctccaggcccttgccagcagctgcacagctgggcctggggacctgggtgtgggtctgttgaaccttggcccaccctggggctgtggtcggcctggacgygtaggtgtggaggtrcatatttattatggcaattttctgacaggtaacagagtgtggggctctcttctgaatggggctcgtggaggccgtgggtcaaaagccctaattttgtagtgagggctaaaaggcttcacaagggaaagggcctggytggggctatgggccggtgccgaccccysctctcccactttgtttgcagttctgggaagtcatcagtgatgagcatggcatcgaccccagcggcaactacgtgggcgactcggacttgcagctggagcggatcagcgtctactacaacgaggcctcttgtgagtgcctgycccagcctccctatcccagccctggactgaccaggtctcagcgtctgactgaccaggtctcagcacctggactcaccagctctcagcatmtctgtcctcccatgggttaggttggctgagatgccagcaggcgtaactggatgtcaggcatccagacgcacagaacagacaataaatcacagtcacaaaagtgagagccaaacatattagtgccatgagggcctgtgcgtgtccaggggcacagacagggatggggcaggccagagactttggaggccataagagggcctagagaaggggtcacctggagggcttagtcaggggctctttagcaactggtgtgaagtgatttccatatcaaagtggtgatacacccacctgcccacatggacatgtgatttaaaattttatttaatttaatagagacagtctcgatatgttgcccaggctggtctcgaactcctggactcaagcgatccacctgccttggcctcccaaagtgttgggagtgcagacacgagcccctgcatctggtggacgtctgactgaatcctgcctgtcctgctccgtcctgtcctgctccgtccttaaacacagtgaggcttaagggtgaagaaagttgctgaagcttgcctttggtccaggactctgacttcagagtacaggctcttaggatgtgagcaggaggatggcaggcgggcacagaattcagaaagaatgagggagaggctctggccctctgtgacccgaatcaccgagcccctctctcccctcagctcacaagtacgtgcctcgagccattctggtggacctggaacccggaaccatggacagtgtccgctcaggggcctttggacatctcttcaggcctgacaatttcatctttggtaagttccccctgctccaagctctgatggcagaccccatcacaggcaagcccaggtcggtggacggggacggctgtgagaaacaaggaatggtcagctcctcacatgatcctgaatggtgggaactcatctctccattttacagctgggcattggaggcccagagaaagggttctgtggggagaacagaaaccactcatgcatttcaagtggaatgaagtgtaaagcagacagaagcttacagaattgctagagagctggtgagacagaacggggcctccagaggactccggggtccaggagcacgaggccttgctgcggtcaagagatcaggacgttcccatgcctgtgtcctggggttgggccgtggatgccacgttcccaygtctgtgtcctggggcggggccgtggatgccacgttcccacgtctgtgtcctggggcggggccgtggatgccacgttcccacgtctgtgtcctggggcggggccgtggatgccacgttcccacgcctgtgtcctggggcggggccgtggatgccacgttcccacgcctgtgtcctggggcggggccgtggatgccacgttcccatgcctgtgtcctggggcggggccgtggatgccacgttcccatgcctgtgtcctggggcggggccgtggatgccacgttcccatgtctgtgtcctggggcggggccgtggaygcgccacagaaacaggagggcctcgcttcacttctgccttcccgaccgcagcacatccagctggtagatgccaactcgcatccagcccccagctgccagggattctggggtggctgtttgggctcctggcactgccagtcggaaggaaggtatgctggagcaggagggctgatccattcacccaggatcccctcaggaggcagagcctygctctgctgtgaccccaagttctcaagacyctgtccagagccctcgtcctgagcactcagcagcatsggctcagggaagccacggcgggtatgagaaggggtgctcagtggggcctactttacagaagacagaacaggcatggggctgccacggctgcccttgggatgttcaggcaggggctggaggtctggactgcagagtccctggcccctgtctcttacccctcttctccctgtacaggtcagagtggggccggcaacaactgggccaagggtcactacacggagggggcggagctggtggattcggtcctggatgtrgtgcggaaggagtgtgaaaactgcgactgcctgcagggcttccagctgacccactcgctggggggcggcmcgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctayggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctrgccatccagagcaagaacagcagctacttcgtggagtggatccccaacaacgtgaaggtggccgtgtgtgacatcccgccccgcggcctcaagatgtcctccaccttcatcgggaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaarctgctcgcagctggagtgagaggcaggtggcggccggggccgaagccagcagtgtctaaacccccggagccatctygctgccgacaccctgctttcccctcgccctagggctcccttgccgccctcctgcagtatttatggcctcrtcctccccacctaggccacgtgtgagctgctcctgtctctgtcttattgcagctccaggcctgacgttttacggktttgttttttactggtttgkgtttatattttcggggatacttaataaatctattgctgtcagatacccttgcttggtgccagagatgtccttttattctggaaagttgtgtccagtaggtggaggggctgacagggaggcccgggtggacaggcaagaagagctcatcctctcccaggctggcggctgagagaggcctgcgctgggggccggaatgtgtctcaaggcacagcccgtggggagacccyggaaacgggaagcccgggagaaggaacgggaagtacctcattccagacctcaagatgcagccctcccgacttggaaataaccccrcactcgttccctggcctcccacagagcggcttgcaccccagacttttctcccacctgtctgtaggctgaaagttggggcaggtggtccctcctgcggtggaaactgccatcagacctgaagcctcgggtcacaaccagggaggtagggaagggggccccgagtgctccctgaaaaagacggtgtgtttagtgtctcggggctgggccctgggaggggctgctgaggtcagggagatgcggccacaggacgcaggcctgggctgccgggagggacgtatcagtcctcccgcccccggcagccccttcctggggtgcatgatacttgstgtccagccacacagggcatggcctgaggagccgctcacctggttccccacatcctcctacagggacagagcctggagcccagagaggccgactgcccagccctccacagtcgcctccctgccaccccgccccttggagctgaggggcatcagcagcctcagtctcccaggttctgcccagtggtaccctgagagcggccccttcttcttgaatcacccttcaacctggcaatgggcgcagaagaagacaggccgtgtgcactgcrggccccagcttcagatgcgagggctgcaggccccagaggccgccatctcgagttctggccctgacacccccaacatggatggggccggggatgtgtctcctccgccggctgctgctgtgtaacaaatcaccccaaatctacctgaaacagcacgggatcctttctctagacacagcgtgttagctggatccttctgctcctcacaatgttgggaggggccagctgcaagctctgacatctcactcttggggttgtcctccgcacggctgcctggccgacccctcgcatggtggggmggaggctggaaccacgtcttacatggcaccggttctttttttctttgtgacagagtctcgctctgtcgcctaggctggagtgcagtggcgcaatctcagctcactgcaagctccgcctcccgggttcacgccattctcctgcctcagcctcctgagtagcagggactacrggcgcccgccaccatgcccggctaattttttgtatttttagtagagatggggtttcaccrtgttagccaggatggtctcsatctcctgacctcaggatccgcccaccttggcctcccaaagtgctgggattacaggcgtgagccaccgtcactgattcttaagtgtgccagacccatgtcaatcacaggcctggcatcactgtcccatattcagtgggttcaagcaagaccagagccagtgcagatgcaggcagggagggaaaagccctgtggtgcggactctggggtgtggttcctgggaggctgcctgaacacagcctggcttgcacctgcaactccacacatgcggagctgagctcctgacccccagccctgcttctccacatccctcaggttggtgatgccaaccacgacaccccaggtgctcagggcaaacagccggggtcaccaggtatagggtccagccccatagggtcggtgggtctctccctgtgtgcggcgatgacagagtgtagaaataaagacacaagacaaagagataaaagaaaaggcagctgggcccgggggaccaccaccagcaagacgcggagaccggtagtggccccgaatgtctggctgcgctgttatttactggatacagagcaaaaggggcagggtaaagagtgtgagtcatctccaatgayaggtraggtcacgtgggtcacrtgtccactggacagggggcccttccctgcctggcagccraggcagagagagagagggagagagagagacagcttacaccattatttctgcatatcaagagacttttatactttcactaatttgctactgctatctggaaggcagagccaggtgtacaggatggaacatgaaggtggactaggagcgtgaccactgaagcacagcatcacagggagatggtaaggcctccggataactaatgattaatgatattcatatataatcatgtctatgatctatatctagtataactcctgttgttttatatattttattatactggaacagctcgtgccctcggtctcttgcctcggcacctggatggcttgccgcccacaaccaggggcttttcttcccctcaggtccacatctgctttgacagcaaatctggccagctgcaccttcagaacacgcccacagcccagcacccctcatgtctgctgctgcctcgggtcttcctcgtcccgtccgtgcgattgtctcctcactgggctcccacagctgcctggccgctcctcacatgcaatttggcatctgctcccgtgccacgctgtccttcatatcctcttgttatatatgccccgtccacaccacgtccctaatgttctagaacattggggcccggggaatgccctccacttgagtgtcctccctgcagatatccgacggcatcaccctaggggacccttcctggccccccgtgctctgaactctcctcccagagctgctttctgtgcagcactcagcacccacttcaggagactgtgccttcaggggaggggtcaacaaagagggtcgaatggcaggaatgggcctaattaaggggtcctggagcactgaaggtgaaggggtgggagggctggaccctggtgagaactggagcyacaggagaggccaccccggctgagctgaggtctctgaagggtaagaaccccatcagagcagagggagccccggagccaacaccctgacctctctctcctccgtccccyrgyctccaggcaccctgacytctctctcctccgycctccrgcctcttgctgagctcagctggaagtcaggggacgtccaggtcagcctccaggcagagaggagggccaggaggcgtgagaggtgggtctggggccagtggaaggtgagaacctggcccaggtctaatgtgtcatttagtccccaagtgtctcctccacggggtcagctccacaagggacttctgtgttgttcccgttggaccccttaacctagaagaatgcctgactcatggtaggtaaagatttccggaaaaaatggcttgaattgtggtctttcatgtaacaacagactggacatggagcagttccagggtggggctgtgtgttggtctcatccttactgggtgagccccttcgtccgagaaaacggcccctgctccagttgttagaaaaccgcctttacaggccaggtgtggtggctcacacctgtaatcccagcacttcaggaggccaaggcagacaggtcatgaggtcaggaaatggagaccatcctggctaacaaggtgaaaccccgtaactamtaaaaatacaaaaaaattagctgggcgtggtggcgggcgcctttagtcccaactactcgggaggctgaggcagaagaatcacttgaacccaggaggtggaggttgcagtgagctgagatcccgccactgcactacagcccgggtgacagagtaagactctgtctcaaaaaaaaaaaaaatgtgattgctatgtaaaatgattgtgtgccacagagatgaccaggtttcttgtggatttcatcttaactgtggctgtcctaagacttttgtcatccacagataactgttgtcttgtttcaccatttttttttttgttttgagacgaagtttcgctctgttgcccaggctggagtgcagtggcgcgatctcggctcactgcaatctccgttccctgggttcaagcgattctcctgcctcagcctcctgagtagctggggttacaggcatgcgccaccacacccagctaatttttttgtatttttagtagagacgggagttcaccatgttggtcaggctggtctcaaactcctgacctcgtgatctgcctgcctcgrcctcccaaagtgctgggattgcaggtgtgagccactgtgcctggccacattactgattctttttgttttgtttttcagagtcaagaaaaccttttttcttttgagctatttacagcttttagcagttgagtaaagtacacccctgtgaccaaaacttggtgcatttttctttctctacctgagttctccagattttggaaactgtctgtgagtattcttttttatttatttatttatttttaaaatttcagtaggttttagctggtgtttggttacatgaatgagttctttagtggtgttttctgagattttggtccatccattacctgagcagtatacactgtatccartatgtagcytttatccctaaccctctcccaccctttcccytgagttcccaaactccttcatatcattattattattgttattattattattgaaacagtgtctccctctgtcacccaggctggagtgcagwggcacgatctcacctcattgcaacctccacctcctgagttcaagcagttctcctgcctcagtctcctgggtagctgggattacaggcacacaccaccacacctggctaatttttgtgtttcttagtagagatggagtttcaccttgttggccaggctggtcttgaattcctgatctcaagtgatctgcccgctggcttccaaaatgctggaattacaggtgtgagccaccatacctggcctattggatcattcttaagcctttgcatcctcatagcttagctcccatttatgattgagaatataggatgtttgctttaccattaacgtattcttttcttctctttttttttttttttttttttttgagatggagttttgctcttgttgcccaggctggagtgcaatggcgtggtcctggtccactgcaacctccacctcccgtgttcaagcgattctcctgcctcagcctcctaagtagctggaattacaggcacctgccaccacacccggctagtttttgtatttgtatttttatttaatttaatttatttatttattttgagacgagtctcgctctgtctcccaggctggagtgcagtggtgcgatctcggctcactgcaagctccgcctcccgggttcacgccattctcctgcctcagcctcctgagtagctgggactacaggcgcccaccaccgtgcccggctaattttctgtatttttagtagagacggggtttcaccgtgttagccaggatggtctcaatctcctgaccttgtgatccgcccgcctcggcctcccaaagtgctgggattacaggcctgagccaccccgccgggcccacactaatactttcaaatttgtcttttgtttttctgacctggactcaatgaaattgctactaactttttcccgaggcccagaaagttgaggttattctttgtaacacaggtgagaacattgtgtcagactgccaggggcttcctgctctgtaactaaagatgctttgagtctaacatctggatagatcgtgtccaacaataaacttcgtttttcttctgttttcatagaaatacctcttattaaaaatctgttcaccttcctcatatacataagtttagcccatctgcaacctcctgytatgggaaatagctgtttaacggaactgatcttgtctcaggaccaggaaatcactacaaagatatgtgacagtgtatctaaatttgttctttcctgtctatcccaatgtgtcttttttttttttttttttgagacagagtcttgctgttgtctcccaggctgaagtgcagcgatctcagctcactgcaacctccgcctcccgtgttga

SEQ ID NO: 13249 - DNA, 47196 bp, Homo sapiens
  misc_feature (1)...(47196): n = A,T,C or G, or insertion/deletion polymorphism (see Tables 1-2)
ccttggattgggtccatggttaagtgagtgagtgaggctcaagggcttctttttttttttttagagatagggtctcactctgttgcccaggctggagtgcagtggcatgatcacagttcactgcagctgcgacctcgtgggctcaagccatcctcctgcctcatctcccttagtagctgggactacaggcatgtgccaccatgcctggcaatttttttttgtatttttggtagagacggggtcttgccatgttacccaggctggtcttgaactcctggactcaagtgatctacctgcctcagcctcccaaatggctgtgattacaggtaggagccaccgcgcccagccttcaagtgcttttttttgttagtgagactggtacaaccaatgccaaggctggtgagcaaagttgcacccagttggggaggggcgaaaccaagggcagaagggcccagggcatggcctctcatggctgaaggaagaggggacacgtggccagtcacagtgacctctgcagacctcaagaaggaggccagctaggagccatagctgtcactaagacagtcaaaatctaatcagcaccctggcgccaagaggccattgtccgctgctcaggacagtgagtgatagtcgataaccagctctctggaggtcagggccccgaggtggctgagatctgtgcctgcattaggacatttaaggggactccaagccaggatttgctagtgtttgcccagcagggagaggtggaaaattggggatgaccaaccaggcctccctgctcacagccaggggaattcatcctgtcgttcttccattcarcaaatattcatggagcacctgctgtgtgccargcaccgtgctaggctctggggagatggctgtgagcgggatcgacactggccttgtgtgagctggccttgcagtaggggatatgagcaccaaacacataaggcccgagtgtgcaatatgccacaaagattgcagagaaataaagcaagataacaggttgcagaaagatggaggccaggctggctgctgttcctgggtaggtggcttctggacacagtttcctcaggctctgtttcctcctttgggcctctggaatcttctgaagacaggcctggcttccaggatcccggatggagttgcctgttgactgtgtggactcaaagtgtccacagtgcgccggagcgcgtggtcttccccagcaaatctgcttctcttctcggctctccatcgtgggaagggtccctgggatcctccccaccaccccagcctgaggccactttccctctgtccccgctctccccagcctgctttccccaccaagcgccaccaagtccctgctgcctcctcctcccaaacaggctcaaacctgccccctcttcgccagctctcagctcagcccgctcctctcctgcttaagagccttcactggctccccactgccctagagacagagtttgagtctactgccatggcttggcagacgrtgttgtcccyggcctgccaaccttccagctgccatcccagccagtccttctcccccttgctccagccaagggccccgcttgtagggtgggaagtgggccgtgccctccctcctgcctgcctattcgctgggtcttccctcattccctccctcaccccgccctctcataagaaccttcagaatctgccagacgcagtggctcacgcctgtaatcccagcactttgggaggctgaggtgggtggatcacctgaggtcaggagtttgagaccagcttggccaacatggcaaaaccctgtgtctgctaaaaatacaaaaaaattagctgggcgttgttgtgggcacctgtagtcccagctactcgggagactgaggcaggagaactacttgaacctgggagacagaggttgcagtgaactgagatcccaccattgcactccagcctggactacacagtgagactctgtctcaaaaaaaaaaaaagaaccttcagaatcataaaatgggtttaataattatacttatctcatagggagggcttaaagcacctaggccagtgtctggcaccaaggaaacactgtatacctgttaaaataagaataaaataaaatacacatgctcacttattgagtgcctgctgtatgtcgggcccctccccgagagaactctggtgcatccccgataaagaaacctgaccctctaggatgagggagggtcttccctgagcgcctgctaacagcctcctctgctaatctgaagtcctgcagcttgcccagcaggctggcttgtcacacgggctacccccacaggccgccatcttggaaaaggccaatggctgtggaatcattcttgactcctattagccttcctgttctctctcccgccccacagcatccatcctgtcagcaaatcctgtgggctctgtcttcaacacagatctagaattcagccccttctcaacctccccatctccgcagcctggtgtgagccctggcacctctctctggggccagtgtggtagcctcctcactgctacccacttctacccgtgcccccaccacccaagcaagagaggtcttttttaaagtctcatcatgtcacttctttgctcaaaacgctctggcaacttcttccttgctcaaatatttgttaaaagaagaaaggaatgaatgaatgaatggcctgtttgcatctgtaatagccagcacataggcagtacttggaaaacacccacagcaagaataaatgaggagatggctggacacggcagctcatgcctgtagcatgttggaaggccgaggcaggaggtttgcttgaggccaggagtttgaggttgcagtgagctatgattgtgccatagcactccagcttgggccacagagagagatccccatctctacaaaaatttaaaaattattcgagcatggtggtgtgtgcctgtagtcacaactacttgggaggctaaggcaggaggatcacttgagcccaggagttcaaggctgcactgagccrtgacggtgcgactgcattctagccacagaatgagaccctgtctctaaagcaaaaaagagaaggagaataagtgaggtacttgagcaagtgggtgaggatggttgagccacagcaggcccacagggaggctggtgggtgctgttggtggagggggccgatttgtgttcctggtggctgcagagccagtctgttgcctcccctccctcccactggctgggctggggacggagccaaccaggcagatcccgggccattctggggccctggcctggcctgccttactatcccagtggggccaccgacgtggctgccatttctggaaaccccagttctaggtaggttactgtcccaggaagaagtgcatgcctagcttcctgccagcccagcccagctgtcccagaagccagaggaagctctgggctggtttcttataagtagcatgactaactgattgcgccacaggagctgaggtttcaggccagtttctgtcgtggagtttcaggggtcagcggctccaaagccccagcccccacccgaggcccctgctgtccctggattcctctccacatgccacctgtcacagaggtgcttgcatcctgtctgcagaaccagcccctcctccaagccaggtttcctgcccagagggaagaagagcagaaggcctgtaccgccccctgtgcgcccccagtcctccgccccctgcccccctgccacccgctgtgggttcgggaagagtcctgctgggtcgcttccaggctgctgctggcttctgacatttcaaggcttaatcacttaatctcccccgagttttttaaaaaaagtgagtcaagtgtgttctcctggtggcgggcgtgttttcccaggcccatgcttctgctcatttcctggctgcggccttcactgactttgctgcttcctaactctgtgaccttggccttgtcacttgctgtctctgggtctcaggccaatgggtctcaggccagtggggctccccggacaaagttccagggttttggggactgcatttcaagggtcagcaaccacagtccttaaacacgtggattttggagtgacaatgcctaggttatggytctgtgaccaccagcaagtgctctagcctttttgtgcctcagtcttctcatcagtaaaatgggaatgttaatggcacctacctcatagggtcgttgggagaaccaaattgattaatmyattgtaagtacttagaacagggccaggcacaaaataagtactgcatatacagttaactatggacaaaagcttgggacctggttcatgtttaaaaatgattattgaggccaggtgcggtagctcatgcctgtaatcccagcactatgggaggctgaggcaggcggatcaggaggtcaagagatcgagaccatsctggccaacatggtgaaatcccgtttctactaaaaatacaaaaattagccaggtgtgatggcgtgctcctgtagtcccagctactcaggaggctgaggcaggagaatcacttgaacccacgcggaggttgcagtgagctgatatcgtgccactgcactccagactggtgacaaagytaggctccatctcaaaaaaaaaaaaaaaaaagattgttgaatttattattgctgaatttttttttttttgagacagaactttgctctattgcccgggctggagtgcaatggtgtgatctcaactcattgcagcctctgcctcttgggttcaagcgattctcctgcctcagcctctcagcctcccgagtagctgggaatacaggcacccaccatcatgcccggctaatttttgtatttttgtagagatggggtttcaccatgttggtgaactcctgacctcaggtgatccacctgcctcggcctcccaaagtgctgggattacaggcgtgagccactgtgcccagcctattattgctgacttttaaaccattcattcatttaatatatgtttattgtacacatgctatgcctgtgtcaggcactgtttcaggcactggggataaagcagtgagcacagcagacataaagctctgccctcatggggcttgtggtctctcagagggaggcaaacaatgcatttatagacaaatacataatttaaatttgaggttacctattatactcccaacttgaaaaactagcagtatattgaggtggctatttcacatctgatggaggaatatgtcttttgtgaaccatttatgttctttgcctatttttcttaaagggatgtttgtcttattgatttgtaagaactcttcatatattaaggccattaaccgttcataatgtagattgctacctttttctagtcttttgcttgctgatatagttgggatgtcatcctctctaaatctcttgttgaaatgtgatccccagtgttggaggtgggtcctggtgggagatgttgggtcatggggaygggtccctcatggtttggttctgtccttgccatagtgagtgagttctcacaagatctggttgtttagaagtgtgcggcacctccctcctctctcttgccctggctgtcaccatgtacgcctgctcccctcttgccttccccgtgaataaaagctccctgaggcctccccagaagccaagtagatacgggtgctatgcttcctgtacagcctgcagagccataagccaattaaacctcttttctttgtaaattactcagtctcagatatttctttatagcaatgcaaaaatggactaacacacttgagttctgtctttttcttatggcatattttaatctaggccagacacagtggctcaygcctgtaatcccagcactttggaggccaaggcgggtggatcacttgaggtcaggagtttaagaccagcctggccaacatggggaaaccctgtctctactaaaaacacaaaaaattagttgggtgtggtggcacacacctgtaattccagctactcgagaggctgagacacaagaatcgcttgaacccgggaggtggaggttgcagtgagccgacatcacgccactgctctccagcttggggaacagagcaaacctccgtctcaaaaaaaaaaaaaaaaatctagggaagttgaaaacattttgcagtcaaagctatctttgctrtctgcatcttgaaataaaataaacattcatacatgtaacctcattaatctgattagagatagtgataagtactgggacagacataaacagggtgctgtgataagaagtcacagggagggcccgcattagttgaggggggtcagagaaggcttctgaagtgtttctggtgcaaatgcttggaaaagggagagctgggagtgtatcccagggctgaggccaatggaggattgcagaagagggagaggggataggaggggaatgttagagggataagcaggggaattggctcttttcttcattttcttaaattaaactttttattttcagataattaaagatttacacacagctggaagaaatcatagagaagccgggcgtggtggctcatgcctataatcccagcacttttggaggctgaggcgggcagatcacttgagatcaggagttcgagaccagcctggtcagtatgatgaaaccccatctctactaaaaayacaaaaattagttgggcatggtggcttgcctgtagtcccagctactggggaggctgaggcaggagaatcacttgagcctaggaggtagaggttgcagtgagccgagatcacaccactgcactccagcctgggcaacagagtgagactccatctcaaaaaaaaaaaaaagaaaagaaaaagaaaaagaaatcacagagagacccctgcttctatgctgttccccccgagggcaagattgtagaaatctgtaatacagtatcacagctgggatactgacactgatataagctactgaccttattgggatttcccgatttacttgtactcatttttgtgtttgcgtacgcatgtgtggtttagtgctatgcaattttatcacggcataggtttgtgtatgcagccaggatccagcacagttctatcatcacaaggatggctcaaattctccttttatagccacatccaactcccttcctgacccaccccctcagcccctggcacccactgatgtgttttccatttccatggttatgtgatttcaagtatgttacataaatggagtcacggggtgtgtactctgggaactggcttttttcactctagggcttggattttattctaagtcagagatgcttctctaatgagctgtgaaccccctggggatctgtggcccctgtgaagaagccctttaggagccagggggcattggatgtgtgagctggccctggtctcatttctgattttaaaatggctctggctgtgatgtggagaagaggcagggtgagcctcatctgcagcaactgctaactgcccacatccccccrgmcttctcaaaaatttgccactcccctgctcaaagaccctcaaaagctgcccactgcttagaggacaggcctttgacctgaggtcctcacttgggcttcagggattctgtgaacccctaaaatggaatgcagaattaagtgtatgcaccttgccagaaacagggtttggggtttacattagatgctcagataggtcattgatccccaaaacactaaggwctctgacttctagacagatagtagttaagaaccaaagctttggagcttgagtgctggatttaagacccatgactgtcacagctgtgcaacctcagacaaatcactcagcctttctgtgccttggtttcctcatctgaaaatggagaaaataatattacctatttcatagattattaaatgcattcttgtatgtaaaagatgtaaaagaaaacttggcatgtggtaaactctgtgtgtttaagtgaatggtgaggctgcccagtataggagggcagagctttccaggtaaagactttctaggcctcctgggattatcaggccctctctgtgttggttgttgtcatacatgacagcagtattccttccaaagggatgccaagttgtggttgcacactgcacttagatccagttgattgacagcactgttcaagtcaactgtgtccttactgatttctgcctgctggatctgtcgattaccaaaagagttgaagtaatagtaataatactattattatccaataatagtattattcagaataatcacacagatttctctatttctccttgctgctctcagtttttgccttacatattttgaccctttgttgttagttgcctacacattaaggattgttatttacatcttcttggagaattaactcccgaatcattatatagtgccacttttttttaatttaaaaattttattttttattttttgagacaggatctttctctgttgcccaggctggagttcagtggcatgaacacagcccactgcagccttaacctcctgggctcaagtgatcctcctgcctcagccttcccagtagctggggctacaggcatgtgccacctctaataacttttctttaatttacartagtattagtttgttctcatgctgctctaaggacaygcccaagactgggtaatttataaaggaaagaggtttgactcacagttctgcagggctggggaggcttcaggaaacatattatcatggcggaaagggaagcaaagacatcctttttcacatgacgtcaggaaggagacacgccaaggaaagggggggaaagccctttataaaaccatcagatctcaggagaactcactcactgtcacgaaaacagcatgggggaactgctcccgtaatctaatcacctcccatgaggtccttcccccaacacgtggggattacaattcatattacaattcaaggtgagatttgggtggggacacagagccaggccatatcacattattattaattagtgccttctctctcatttttttgattcgcctaggtagagatttatcaatttcattgatcttttcgaagaaccaatttttgatttcattgattytcctcgattaattttctatttttaatttcattgatgtatgctccaattttgtatttttttcttctgcttgttttagacatatattgcttttctgtttctagtactctagatggaaacagattattgattttagaactttctttctaagatatacattcaataatataaatttccctctaagcactgcttttgctacgtctcaccgattttgataggctatattttcatttttattkagttaaaaatatttttagtttctcttgtgatttcttctttgatccatatgttattcggaagtgtgtttttaaatctccaaatacttggaaattttctggctttcttcctgctagtgacttctaatttgaatccattgtggcctaagagcatatgttgtgtgatttctaatgttttcaatctcttaaggttgttttatgtcccagaatgtggtctgtcttggtgattattccacatgaacctgaggagaatgtatattctgctgttgtgagatgtaacagtctataaatggatacctctgttaatatgacctcgggtgactctttttttttttttaagttgctgcttcaccattggcttttggagattttgcagatgataaaatcctcaggacttttctgctgctcagtcagattttcttatcctacacttgcggaactgttgtttgaaattgacaagcaggatggccaactctgcccggctcattttatttcatcttattgggttcagcctgcagttttaggagatgagattgaaggaactggtatactggaatccacggtgggctcggaagcaaacaaacgtgggttctgattctagctctgaccttttaccagctgtgggacctggtggatgggttatttggcctctctggcctcagtttccttagctagacagttgggataacagcctacctttcaggattcttgtgtggattcggtgaggtaatacttctaaagcacctagcaaagtgtcaagtacaaggtaagtgctgggcaagcagggattttgttcacacaaagccttgactcaacataaggaggctgtttccaatggctctgcttaactgagacctgagagtgattgctccatctgtggtggcatatgggctgaaactgcctagcagcatgtcagargtggggygttcgcaggacatccttgtccaggttggcagttgagcttggcaggtgaccgctgagaccccttccaactccaccacttcaggaatctcttttttttttttctgagacagtcttgctctgtcacccaggctggagtgcagtggctcaatcttggctcactgcaagctccgcctcccgggttcaagccattctcctgcctcagcctcctgagtagctgggactacaggcaccygccaccacgcccagctaattttttgtatttttagtagagactgagtttcaccatgttagccaggatggtctcgatctcctgacctcatgatctgcctgcctcagcctcccgaagtgctgggattacaggcgtgagccaccgcgcccagccaggagtctcttgatttagaatgggaacttgaaatcatctcctcttgccgtgtacttgaacgcgataacctggcacttatctttttaattcttttactcacctgcatctttgttctttttgcctctgatgttcagggaagcctcttctcccactgcatctgtgatctctcctgaaatgtagcacccacacatccctgagaagctagctgcggcacgtgtgtgtgcacatgggcatgcrtaagtctgggcgtgccttccacaacagattaaggatatcaatcctgacgccatgctgggatgttttagtgaatcttgacagggttgttgactcccctgtttccctggaggactttaccatgaaagtcttctgctgtgtgactttggacaggcgtcttggcctctctgtttctctttattcataattgaggctaaagtgacacctttgccatctctgccacaggatactgtgggcatctgtgtagttgtgagagtaaaagttactaggacttgccaaggaaatcagtgtcaggaacccaccaccccattcccgcccctcctttacttgagactttacttttgtaactctcagcaaggaagacgagttcaacctttgagccgatacagagccttcccctagagagagctttgcagcctcatgctgagccagttaggggccccacatcatgtccaaaatgaatttaatcaacaaacagttactgaacacgtcctatgtgccaggcaccgttgtagatactggggactcggcagtgaatgggacagaccctggctgtcaggatgacagacaatttaaaaagggacagatgtcccacgctggcttgtcctttgcaccccyggcacttcgtgaggagcagcggccagttcttgtatatagactggcccttggtgtacatttgtctgacgtttccaaatgatgtatgcatccttggcaggaacccaggaaaagacatgctgtgctcttctcaggaattgtttcagggaggtgatgttggggatttgtcccattcttgttggtgagtttagatcacttggtgaaggtggtgtctgccaggtttctgtattgtaacgttcattgatatgtattttcactcattagttaatatacaatacaagttttgcagggagttactttgaggctgtcatagtaaaatagagctttcccttcttccctgtttatttatttattagagatgaagtctgactctgttgcccaggctggagtgcggtggtgcgatcatagctcactgcagcctccaactcccaggctcaagccatcctcctgcctcagcctcccaagaagttgggattacaggcacacaccacactgcacccggcctcctccatttattgatctatgtcaatacagactcctggactttaactccaagggttacaagtggataccataatattcattttgatgctcaaaatgtgcctgttttgtccaggtcaggctagctgctgagtacttccttattgtctggcacaagaattccaagcctatctggtacttttccttctcctggaatcagctatttctctaaggcgctctggttcctttcagtacagaatagtatttagaagccaagacctggtcactaggaaggcatgataatcaaatgtgatgaatgatcttggattgcatcctggacgtataaagggcattattgaggcaattagcaaaacataaataggggccgtggatgagatagtggtgatgcatcactgttaatttcctgatttcgatggttgtattgtgattatgcagagaatgtccttgtttttctgacatgcacactgaggtattggggtaatttattcattatggagatatgtgagtgtgtttatgtgtctcatacacagatgtttcttaatgatggggttttgtccccataaactcatcataagttgaaaatattattaagtcagaaatgtacttcatactcctaacctactgaacgttatagcttaacttagctcggaacacttgcattagcctacagttgggcaaagtcatctaacacaaagcctgttttgttataaagtgttgaatagcttgtgtagtttatggaatactgagagtgaaaaacagaatggtcgtatgggtgctccaagtactgcttctactgaacacccattgattttgcaccatcataaattaggggaagagaggaaaagcacgcgtaagggaggaagggccgggtacagtggctcacgcctgtaatcccagcactttgggagaccaaggtgggcagatcgcttgaactcaggagttcgagaccagcctgggcaacataatgagaccccatctctatcaaaaatacaaacacttagccaggcctcatggtgcacatctgtggtcccagctactcaggaggctgaggtgggaagattgcttgagcccgggaggtggaggttgcagggagtcgaggttgtgccactacactctagcttgggtaacagagtaaactctgtctcaaaaaaaaaaaaaaaaaaaaggaaagggaggaagggaaggtccctccaggtggaggggacagagagagaaaaggcatggaggtgggactgagtttggtgtgtttaagaagtgcaggtggcagccgggctcagtggctcacgcctgtaatcccagcactttgggaggcygaggcaggcggatcacctggggtcgggagttcaagaccagcctgaccagcatggagaaaccctgtctctactaaaaatacaaaattagttgggtgtgtggcccatgcctgtaatcccagctactcagaaggctgaggcaggagaatcgcttgaaccygggaggcggaggttgcagtgagccgagatcgcgccattgcactccagcctgggcaacaagagtgaaactctgtctcaaaaaaataaaatgaaataaaataaaataaaatgttaaaaaacaaaaaagaagaagaagtgtaggtggcaggcgtaggatgcatgggtgctgggcccaggtggagagggaggtggagccctgctggggggagggccttcaagtgtgcccaagtcactcggagagcatccagcaggggcctagagctcctgaggtggccttaagttcttatgatgccccagacactgcacacagtrcttcagaggcaacacctccgttcctgtttgctgcaagcctgtgaggttagccttggaaccattcctgtgccacagaaacacagccagagcaccaaaagagaaatgctgttaatggcaaagaactactcactagcagaacaaagcctgggagctgcttttttgaataagatcccaggagagagacccaagcgggaagtgaaggatgggcacttgaaatgttgcagggaatataacccagcgcgtgctgttttcttttttyctttttcttttttttttttttctctttttgcaacagggtctcactgtgtcgcccagcctagagtgcagtggtgccatctcggctcaccacaacctccacctcctaggctcaagcgattttcctgcctcagcctcctgagtagctgggactacaggcacgcgccactaccgcccggctaatttttttttgtatttttggtagagacaggtttcaccatgttggccaggctggttgtgaactcctaaagtgctgggattacagatgtgagccaccacgccyggccccagtacacactttttggagggtatttgacgttatgtaccaggagtgctggggaaaagtacacacttgactccgtgagattctgcttcttagcatttttttcttttcctttttttttttttttgagacagagtctcactctgtcacccaggctggagtgcaatggcatggtctcggctcgctgcaacctccgcctcctgggttcaagcaattctcccacctcggcctcccgtgtagctgggactacaggtgtgcgccaccacactyggctaatttttgtatttttagtagagacagggtttcactatgttggccaggctgktctcaaactcctgacctcgtgatccgcccacctcagcctcccaaactttctgttttcttttcttttcttttttttttatgacagggtcttgctggagtgcagtggtacggtcttggcttactgcagccttgacatcccaggctcaaacgatcttcccacctcaacctcccaagtagctaggattacaggcatgcaccaccgtgcctggctgattttgtttaatttttgtagagataaggtctcactctgttgcccaggctggtcttgaactcctgggctcaagccatcctccctccttagcctcccaaagtgctgggattacaggtgtgagccaccacacctggcttctgaacattttttcttaatgataatagctggtgctatgggctgaatgtgttcccccaaattcatatgttgaaacttcatcccattgtagtcatattaagagatggggcctttggagaagtgattaagtcatgagggctctgtggttggtcatgaatggggttagtgccctyatgaacgggctgaaggaagtgtgtttgccccttctgtcatatgaagacacagcagcatggcatcgtccgtgaggaatgggctctcaccagatctggatctcctagtgtcgtgatcttggacttcccagtctccagaactatgcattagaaaatttatttatttattatttatttattttgagatggagtcttgctcttgtcgcccaggctggagtacaatgacgcgatctcgactcactgcaacctctgcctaccccagttcaagcgattctcctgcctcagcctccagagtagctggaattacaggtgcccgccaccacactcggctagtttttgtatttttagtacagacggggtttctccatgttggccaggctgatctcgaactcctgacctcaggtgatccacccaccttggctccccaaagtgctggaaatacaggtgtgagctactgtgtctggcctgaataataaaatttaaaacaatttttcaaaaattcaccatgaggtctcactatattccctaggctggtctcaaacccctggactccaagtgatccaccccaccttcccgagtagctgggactagagatgcacaccattgcacccaatagagcaatacgtttctgttctttgtaaattacctgctctaaggtatttttgttatagcagcctrtatggactaagctgacttgtaacgttacttgagactttaaagtgttccggtcactgttggagggctctgtctgtgttagctcatttaatccccacaacacctcaatcagatggggctattcttagtcccactttatagataaggaaactgaggcatggaagcacagcttgctcaaggttcacatctagtcagtgacagagcaggtatttaaacctcaggaaataatcagagaaacatgtgtagagggttgtccaaggaaggccacatccagaagcatctcccaggacagttgttgtgtagctcaccctctggactttgtgggtctgggtgttgtttcatgwttatagagagagctctgtgaacgtggaggacctgttgtcggcagagacacaaatggccagggcatggctgggcagccgcagtggctcaggcctgtaatcccagcacttcgagaagaccagaggggcagatcatgaggtcagaagttcaagaccagcctggccaacatggtgaaaccccgtctctactaaaaatacaaaaattagccaggtgtggtggtgggcacctgtaatcccagctactcgggaggctgaggcagaagaatcrcttgaacccgggaggtggaggttgcagtgagctgagattgcaccrctgcactccagccttggagacagagcgagactctgtctcggaaaaacaaacaaacaagcaaacaaacaaacaaataaatggccagggcaggggagggttgcatattgaataagatgagctctgctggaagcacaggtcagcactaacctgcttcctctctctctgcaggtgccttggcatctcccaatggggtggctttgctctgggctcctgttccctgtgagctgcctggtcctgctgcaggtggcaagctctggtaagtcaccacttctcaatcattcatttgttggctattaatggcgtgccagggtcctgcagtatgtcacctggccttatggagattacactgcagtgggaggggacagccaatgacaagtggccctgattatcagtaaattctaaagattgttagaaagtgatgggagccgggtgcagtggctcacacctgtaatcccagcacttcaggaggccgaggcaggaggatcgcttgagcccaggagttcgaggtcagcttgggcaacatagggagaccttgtctctacaaataataaaatattagccagrtgtggcagtgcacgcctgtagccccagctactcaggaggccgaggtgggaggatcccttgaactcaggaggtcaaggctgcagtgaactgtgatcgcgccactccactccagcctgcgtgagaaagtgagaccctgtcaaamaaaaagagaaggtgatggggaaagaacacagaacagcataagagggggttggggaagctgggtggagtgggggggaytgcagttgaaagtagggaagtcagggaaggcctcattgagctgacttggaggaagcgggamccgtgcagatgtctggggaaggctcattcttggcagagaggccctgcactgagcctggcgggagggttgagcacaggagggaatgtggtggaggagagtgagcagcaggagggagcagtgaaggtcagcaaggtgacagagtggctgaatcaaaaaagaccttgcagtgtttgagcagaggatccatatcatccattatgttccaaaggactcttcaggatgccgtgtggagaaaggaagagggtggaagccaggaggtctggagggaggtctggagtggaggagatgagaggctccggatccctctgggaggtagatttgaggacagattggaattgaggtgaaagacagagaaagagaagtggccaggatgactccaagatttctgacctaaactactgggaaggacgcggttgtcatttctgaaatgcagaaggatgccagaagagaaggtactttggggaggggcgggaatcaggagttagttttggacatgagataagcttggaatatttatttgctatctaagayagctccttaacatggtaagcccttatgcaagttgttgtcagctgagatgggcgtggcactgagcatgggagcatggaggcgcctgagtggtctcatgctcaggtgrtttagcaaactcagtgtacatcctgccaattccagtcctgccatggccactgacaagctaggagggygctgaaaggagaaggaccccgatgtctcctccagcccatccatctcctstcwcccattggccaaacccaaccggaaacyaaaggccaagggtacccggtgatgaagactgtggtatcagcctcctgagcacagagagggcagaaaggggtggagacaaagaggggcgcagatagtgggcaaatggggaagtggcacttcccctagctcgagggcagaggcttggtgtgatggaatggcactccttaaactgctacatattttccctttaatttggccaagaacaagttgtcaagtttgtgtragataaaggtgcacttggttcgttcttgtctaatggcccccrcacccatgggtatttcttcagcttccacagtcatcccracactagctgggaagctccagcagccctggtcctggccccagctctgtgggcgctggccctcaactttgcctgcactgtgcttttgtgytattccccttggtcctgtttgggtgcaagtccccctcacgcattgagttcctgggccgctcaggctgctcctgtgtctccccagggaacatgaaggtcttgcaggagcccacctgcgtctccgactacatgagcatctctacttgcgagtggaagatgaatggtcccaccaattgcagcaccgagctccgcctgttgtaccagctggtttttctgctctccgagtaagcctgcgctggagctggaggtttggggaggttgtgcccaaagggtttgccccaagagtgagctgggtccaggtggtgcgctggagtgcaggatgctgagtatggtttgctgctgtttatatggtgttagaggggaggtcccatctccagggacatgttatgtaagatacagtggagcgcatggtgggagtgttggtccacrtggcacatggatacggctggaatactggactagaccagcagttctcacactttttggtctcaggaccctttttcacacttaaaaatgagtgaggacccaaagggctttggtgtaggtaacacatcattctatgtttacctaattagaacttgcaatgaagaaatggtgtaatttttaaaaaattaaaacaattaaaaattttttttcttactgaaatggaggtctcactgtgttgcccaggctgctctcaaactcctgggctccagtgatcctcctgcctcmgcctcccaaagtgctgggattacaagcgtgagccgctgtatccggcccaaaatggagaaattttaagtcccaacaacatgcaagcccgcattcaacaaatcttcagatcaattacatgatcacaggtcatgtagcctctagaaaattccactgtacgccagtgagagagagtgaaaaggcaaataacgtccctgtattatgatgaaaagagttttacctggtgggcccagaccacactttgagaaccactggactagacccttgattgaggagtacggtgttgagagtggagtyctctgtgatggtggatggaccaggacacatggcataggagtcaggtggttccctgggctactccatggtgcacaggatgcttcgttacactggtgcccaggacataatcacgtacacaagacacacagttacggggcagactggggatatacggcacaccagcatgcagsgttcaccagtaaaggtggtattccatgattattctaaggtagatgggctgtgctttgtttccattggcttagtccagggattggcaaactatggcccgtgagccaaatccggcccactgcttgtttttgtaaataaagttttattggaacacactggctgctgtagttgtaacagaaactgcatggccctcctttatgtttttttttgtttgtttgtttgtttgtttgttttctttgagacagagtttcgctcttgttgcccaggctggagtgcagtggcacaatctcggctcactgcaacctctgcctcscgggttcaagcgattctcctgtctcagcctcccgagtagttgggattaatggtgcctgccaccacacccggctaatttttcgtatttttagtagagaccggttttcaycatgttggccaagctggtctcgaactcctgaactcaggtgatccacccgcctcrgcstcccaaagtgctgggattacaggcatgagccactgagcccggcctyctcctttatcttaattgaaataattcagaaatggaaagtcaaatactgcatgttctcacttataagtaagagttaaataatgtgtacacatgggcattattccatgtaccatggaataacagacattgaagacttgggagggtgggagaggggtgaaggaagagaagttacttaatgggcatagtgtacaccatttgggtgacggacccaccagaaccccagacttcaccactakgcagcatatccagtgagaacagatctgaggcttgccatcaaaattgcacttgtaaggccgggcrctgtggtggctcrcggctgtaatcccagccctttgggaggccgaggtgggcagatcacttgaggtcaggagttcgagaccrgcctggccaacatggtgaagctccatctctactaaaaatacaacaattaactgggtgtagtggcgcacacctgtaatcccagctactagggaggctgaggcgggagaattgcttgagcccaggaggtggaggttgcagtgagccgagatcacatcactgtactctagcctgggtgacagtgagactttgtctcaggaaaaaaaaacaaaaacaaaaaacaaaaaactcgtaccccctaaatttatacaaataaccaaaaaaaaaaaaaaaaaaggaaattgtgtggcctttgaagtccaaaatattaactatctggcctgttacagaaaaagtttgcagacccctggcctagcccgtgagatgtgggttggctgttaaggtggaacattggaattatcttacgatggccaaactgtgcgatgcagagcttatgttgttctaaattaattagtgccaccggttcttccctttcatgggctttcaggaacaagctaagtcccaggaccagggccggcagctaggcaggtgtgaggagcatccttggtgcatgtggtaagaggctgtggccagcaagagaggcaaccctagtcggctgccccagcacaccctggccgctcccaagcccccagatctgtcctcacatccgtgatcgggaagctggaagagtctgatgcggttcctggaggcatgtcccggacacagctgtggggcccagccagcctacaggtgaccagcctaacccagcccctgtgtctgcagagcccacacgtgtntccctgagaacaacggaggcgcggggtgcgtgtgccacctgctcatggatgacgtggtcagtgcggataactatacactggacctgtgggctgggcagcagctgctgtggaagggctccttcaagcccagcgagcatggtgagcagggcggagtgyggcaggggtggctgggtgtgttcccacagctgcctgggytgagggtggggtgrgcaggggaggaggtggggtcatagcaacagcaggaggaagccgcctgtattttcccaaatctgatgggattcctgcccctgcctgggcctcagtcctcccacctttgaaacggagctggtcgcagtagaccaccaagcccccttcagcccagctgtttccacccctgaacttaagtgcccaggaaggcgtattgrgatgaggtgtgcttgctggaaggcatgcctgctgctgattgaaaaccgaactgggaacaktccttccattctrtgtccactsgtcagctgctgcggctttggatggtcttgaccgtggaaggctgaccttcttytggtacccggagtccctgcaggaatcccccttgagcttgctgggctgtggtgacaggagtttaaaacatgcgttgtattccagtgatgcatgatatgacatgcatcacaggaataaaaacctgaggtctcatggatatgattgcttcaaargagaccaagttttaaaacagatgaatcaaaataaagaaaaatactcagtaaatcatcataaagtacagagatgtggccaaaggtgtgaaggatgcagctgtaaaagctgaagtttgaggcygggtgtggtggttcatgcctataatcccagcactttgggaggccgagcccrgcggatcaccggaggtcaggagttcgagaccagcctggacaacrtggtaaaaccccgtctctactaaaaatacaaaaaattagtctggcatggtggcaggcgcctgtaatcccagctacttgggaggctgaggtaggagaatggcttgaacccaggagaaggaggttgcagtgagcttagatcatgctactgccctccagcctgggcgacagagygagattacgtctcaaaaaaataaaaataaataaaaataaaaagattttttaaaaggctgaagtttgggttactttggctcatacactttgccttcactgtagaaaggtggttagtaaagaccaggcgcggtggctcatgcctggaatcccagcactttgggagcccagcgcaggcagatcacttgagccctgggctattgaggctgcagtgagctgggattgtgccactgcactccagcctgggcaacagartgggaccctgtctcaaaaaagaagaaaaaaagggtaattaataaacactaaagttctatgtagaattttagcaacattattgttattataatcttctttgctatggctctgaatctgtgtggtgctccagaagtatgctatggaggttttgtcgaccaaaaatctgggtggtggctgtggtttgtaggccggggctgggctgggtgatgggggagtcactgcatagatcctcacatagaggccgcttctcccrcagtgaaacccagggccccaggaaacctgacagktcacaccaatgtctccgacactctgctgctgacctggagcaacccgtatccccctgacaattacctgtataatcatctcacctatgcagtcaacatttggagtgaaaaygacccggcagatgtgagtgggcatgctttgacgtttttctgtgacctctggggaacagggtgggtgaccagcagaggcccagtccctggagccaggagcctgggaggcaagcyctggggctggatagcaawtcccaggagctagagacctggcttctcacctggctctgcmctaggcaagtccctttgcttcctggccccccrcycctcacatcagagaaggggagttatctctgcatgccgctcctcctctgtaaaggtagrgctgtgggccacrtctgtgtttcccagtttgggggacacaagtgatcgtaggtggcacattgacagctcacttgaataaccctattattgaagagaataatactgactcaagagacagtgacccgtgtcagttcccttttgaggccaacgggttaaggagraagtccccatacagctgactcgtttactaattcctcttaatgaagagagcagaggccacaccccaggcttagactttcccaagaaaacaagatcagtttgttggttgttccccatggaagctggtcctgacattcccttcacagtagtgttggtggagtttttgttgttgtttgttttgagacagagtctcactctgtcacccagggtggaacacagtggcgtgatcttggctcactgcaacctccgcctcctgggttctagcgattctcctgcctcagcctcctgagcagcygggactacaggcacctgccaccgtgcccagctaatttttgtatatttagtagagatggggtttcactgcgttggccaggctggtctcaaactcytgacctcagatgatccactcgcctyggcctcccaaagtgctgggattacaggtgtgagccaccgcacctggccagtggagttccttcttaagtacatgtattgacatctttaaaaagggcragaggatttacaggaaactatcaggtcartaatggcaggggccgtccacagtgggtggctgagtccccctatttttctgctggtgtgcrgggaggtcatttcctgccacccatgtttccccaccctgaatccaccttcctcacattcccattggagggacamtctctggacatatgggacctggggtcccacagggctgcawtccaatgcctgctgtgccactcgccagctgtgtgatgttgggcatatcccataacctctttgtgcctcagtttcctcatctgtaacacaggagtgacaagagcacccgcccacagggctatgacagtacaagktgtgtgatacagatgagctcccctgtttggcccacatgtgtcctaaaagccatgtgccctttctcttgagtgccccaggccacagagatccccatctgcccrctgtcccacacactggtctgtcatttgttccttgaggtttgtgagggccggctctgtgcatcccaggggcccaggctgggcctggttggctctcagggagcaggcacccgccaccttaagctcccatgctggtgtctgtcactgcttcctctcaatctggccaagccaggggtgtcgatttatatctctcaggtctggtttcccctttggcactgggccaggtatggggaaagagcaggaatggggcagttggctcacacagcagaggctcagaaagcrgggggcatggggggaaggagtgcacagatgctagagagtggggcaagttttgtttggtcaataaatctccttctcatgccccaggcctgtgcaagacctacagagagtcccaaggatgggctggggggaagagaaaggtaccaccttcagagtccaaagatatgttatttaatattttcatatttctagatctgccttcaggcatggctggatccagcttctaggaacctgtccagctctgcgccctgctttattctgtaytggcttcrtttttaggcaggctcttccctcatgtagtggcagatatgcctactagttgctccaggcctacatcccaaagccacagtgggaaaagggttttttttcttgacggttctaataagagtcctaaggctgctgctcagtggcctggcttcgatgctgtgccagcctctgaaccaatcactggctgtgggtggagagaggrtgctggtggagggccctgcttgtccagggaggagtcacataccygcctctagggctgcaggtgggctcagctccatccaaaccagatgaactgaaaataaggcaggagtggcttccccaggggaaactggggaagaggaagcaggactgtgctggctaaaatgccagccaggtttaagacgtggcaccagatgccagtcatgggattggattggtcagcatgcctgggctatggcttaggggtatgttggtgctcagggatgccacaggcctccagataccaggtctgaggcagaagaatgaagtccagcttctcttgtgggtggaacagtggcaactgagataccccatctctcccttcccaagaacagagctgaacataaagaatttagtgattggccagagcttggccacatgctcccctctgatgaatgataggccaggtgatgggattggcacaattggcttagactaatgagggttggccctggagttgcaggcagtggagttctgtcctaagcagtgggcacctaaacccgatggcataaaagctgggcgggtgtccacctgcatctgccacagcactryaggcaccaactgtggctcatactgagtgggataaattccagaaagaaacattaggaacttactatagaattttggggctagagctactcattcattcccctagataatttctaggcaaggttccatagtggagggggagttttggcttgggcattgaaggatgcataggagttttctagatggggaaagaagggaacggtagaccaggcagagggaactgcatgatawaaggtttatgggtgtgaaaattcatggaatgtttgaggattatggggttgggggatgtgggaatatgtgtagcgawaaagcaccaaacaaagccaaaagtttagttagagccctgaatgcctgcctcataatggtttccatattttatatgcctactatgtgccaggcacattgctcagggtcacacagctggaartggcagggctgagtttttgttgttgttgttgttgttgagacagagtctcactctatcacccaggctggaatgcaggggcgtgatcatggctcactgcatccttgacttcctgggmtcaggtgattctcccacctctgcctcccaggtagctgggactacaggcacaggccaccacgccaggctaattttttgtatttttagtagcgacagggtctcgccatgttgtccgggctggtctggatctcctggcttcaagtgatmcccctggctcagcctcccaaggtrctgggattacaggcttgagccaccrcatccagcccagatctgagatttgcacccagtatttgaactcccaagcctgtgctctttttcctcccatggacatttctctcagagatggtctcccaaacacctgtccttcttgttaaaaaacagacaaaccgcaagtagttctttggaagctcagatttctcttttgtttcttagtaaaacatttcccagttcccagctcccttccagggtgtragatttcttcggtaacttacatctagctgttgcttcttgtttgctcatgtttagaaagaaagacaaaagagagtgagaattttctctcccttccccagtctccccacaactcacaccccaccctcagctccctctgtaataggaaaatctctgaactctctgtagttgctccagcaatcttttggaactttgcttctttcttgtgaaaaaacctcyccttggctcactttgcaccaggtttccccaaatgtgcttccaaccacaagcagaaatggagctgccagtaaccaggaagaaactgccgggggctgaggaagaggagagggaggtgcatagccctggatctcgcagggagaggggtgacaggatgagaactcaggttgctcacttgccatcagggtcagtcatgaatatagcgttcatgtatcactttttaaagcttttttggagggtaaaagtaatagttacacaaaataaaaatacaaatggtacaaaaggacttagaatggaaacatgtttctctcccgactccagcctcctgtttttcttcccagagactgaccactgctgtctgtctcttgccagaagggaaagggaggcaaggttagggcaggcagagggcatgtgcatcctttagagagagcttatgtctatacaagcaaatgtgtgtgttcagtcatcgctgtcttagttttctattgctgcataataatggtactaccagcttcacagctttaaacaacacccatttattatctcatagtttctgtggttgggagtctggacatagcttagccaggttctctgctttagagtctcgtgaggctataatcaaggtgtgggatggggctgcagtttcatctgaggctcarttggggaagggtcacttctaagctcatacaatattggtgacattcagtccctggcaggctgttgaactgagagcctcagtttcstgctggctgttggttgtagttaaccctgaattccttcccatgtgccctttgcaaagccatcaaggcagagagacttgcctagcaagtaggatattacagtcttctgtaatataatcacatccatgaaatcctctatatatcccatcacctttaccatattctgtgggttagaaacaagtagcaggtcctgcccacactcgagaagaccagatgacacaaagatgtgattcaaagtggggatcatcggggccatcttaggtttgtctgcagtgatcactgtgccatctctctctctctcttttttttttttttttttygagacgaagtcgtcactctgtcacccaggctggagtgcagtggcatgatctcagcttaccacaatctctgcctcccaggttcaaatgattcttctgcctcagcctcctgagtagctgggattacaggtgcccgccaccacacccagctaatttttgtatttttagtagagacagagtttcaccatgttrgccagrctggtcttgaactcctcacctcaagtgatccacccacttcggcctcccaaagtgctgggattacaggcatgagccaccatgcccagccccatctctctttaaaaaacaaacaaacaaacaaaaaacataaaaagaagcagagaacacatacacatctgcatcttcccttgtttacttaacaayagatcttggaagtcacttctcagtagaggctaggytgggcagagcattggattctaggccagtgagtttggacttgaccatggagacactaggaagcccatgaaggacagagagagatgcctcgaccctgccagtcctttagaaagatcacccagtgctttttrtataccaaaccctatttgaaatacttacgtatattaacccatttccttatcaccacaaccctgcgggaagggagataggcacttttattatcttcattttgcagatgasgacattgaggtccagagaggttatgtcacttacttaaggtcacacagccaggaagtggtagtagggactcttacccttgttttacagatgagattgaattatctcacraaaactcagaaaggttaaacaacttgcctaagtaacatacagctaattagtcgaggagcctgacgcatgttgctstagcctggtcacagttacagaggtggcaagcaatggcctgaacaggaygaacaaccaaatacccaggctggtggctcttaaacatggtggggtcagctaacgacagcaaccagggtgggcactggtgcccctcgcccccggctggtgccctaacatctcccttttctctaccagttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactgtgagtatcaagaggcctaagcaatggtaatctccactctccattcttcccctgtggccagacacttcccctggctgagtctctgggcttttatatcataggatgcctctaatggcaatcctgccattagatacacctgcygtggtgtatctgccaggtaggcaggctaggctgcagtaacamacaagcccacaatttccatggcttaacactatrggaatatatttcttgctcaygtaacaagctaacgtgaatgttgctggtttgtaggtggtttccctccctgtagaaatctggggagtgaggttctttccatcttgtggtgccrtcattctccmggacaaagattcttacctacttttgtgtcctggtttcctttggcagcctggtgaagcctatggacctcatttcagaatatttwtaaatacataaaatcccagcctgggcaatatagwgaaacccccatctgtacaaaaattagccaggcatggtggcatgcacctgtagtcccaggtactgggaaggctgaggtgggaggatcacttgagcccaggrgtttgaggctgcagtgagccgtgatcgtaccactttactcccacctgggtgacagagcaagagcccatctctaaaaataaataaatacaatgaaataaaataaaataaatagaactacagaggaaactaattgtattgaaatgcagttataaaacatttaaacacatttttaatctagagatatatgtgcttctttattaagatctataaataataagttctaggggtagctcrcataaatactgtaatttcaaagtagataagcataaataatactttatgatactgaaattgtgatgtgatatgagaatagctgtgagttttgttttgctggggacaggatcastgatgctgtcattactggggtctcttccctccattctttttttaaaattgtattttattttatttttaaaattttaaaataaatagagacagggtatcactatgttgcccaggctgcttttgacctcctgggctccagtgatcttcccatcttggcttyccaaagtgctgggattacaagtgggagccagtgttcctggycccttcctccattcttaatggaaggagatgctaggtgtgagaggttagggaaagtaaagatgtaatttctttcccatccaagttctcagacccctgaattctacctgcagccatgttggtccatcaaccccaagtgaagaatccctgctctagggccccaccattgtctgtatccagccagcagaagaggcgtgattatggagatcacatctgcttcttgaaagcagacagcccggaagtgggccgcatcacttcctctcaaattctattggtgaaaatggtcacatgactacacatagccacaaaggaggctgggaactttctcacttggaacstacatcccagaaacractcttttcagtgaggtatcccacaggtctttcgcagtagaaatattgattatctcacataaaatgaagtcttacaaatggacctactgggttttgtacagcagccaagtgatatctcttcccttctgctgtcttcccttctgccrtccttcacatggtggcattgtatccttagacttgccacccatgccctcaggttggccrttgcacaytrtcttacataaagcaggaaggaaaggaaaggctgctacgagagagtgtaccttgtgcatctcttttttaatcaggaagcaaacatctttctagaagcttccctagcaaaattccccttacatctcattggccaagactgttacatrttacatggttactgttattacttgctcattgcaaggaagactgggaactcaaatgcctggaaaaaggaacaggataatcgtgattggctcaagccttagggtgggcatggctccctgacaagggagagaggaaaaagctgttgagtgaagaagactgcttcagtttccccatctgtataatgggaggagtaagggctgtcgtraaaactcaatgaaagaagattcttcaacgtggtaggtgcagtggcagctggcagtaccctgaccctgccaccgcacagccctctcagcattgctcrtcctgcactgtggatatcarttgagccacgtgtctcctgccctgggctgtgagctccataggcagggtctccatggctgtatctccagaacccagcacagaaccaggtgcttgggaaagttttgaattgattctcatctgccattggcatggggaagggaactagcttgyatgaaacagataacaatgtatgggaccctcattcattatttcagcaaatatttgctgagttcctcctacatggctagccctgtgctagacactggggaatcrgcgatgaacaaagcagatagaaatccccactcttgtggagctgacattctggagggagagacaaaaagcaaacatataaagaaagaaagaaatcacatggrtctggatgacagtgagtgctgggaagaaaataaaagcagaggaaggggatggagcgatgggcrgggggcaacggtagggagggtgtcggggaaaactttttggagaatgtgacgatgaaagtgaacaaggagaagtcaaccgtgttgagatgatggcagctaatgatgtggacaggccactctgttctgagtgcattatctattgattcatcatgtcatcctcgcaacagccctgcacgatcaattctgtcattaaccccatagtacagatgaggatgcggaggcacagagaagataagggacttgtcctgtgtcacacagcaaggagccatccggctcctaagttggtgcatttgacttctgtgcttcyggaaagaaagagcagcaagtttaagatctggaggtggcactgagctttggaggagcagggggcaatgaggtggccggtgtgacgaggactcaatgtgcaagagggagagtggyggggagatgaggtggaggggtggtcggcggtcagatcgtggagggtctcggacgagggtcctgaccctgggtctccagtcctgggaagtggagcccaggctgtaccatggckgacctcagctcatggcttcccctcccacttccagcctacagggagcccttcgagcagcacctcctgctgggcgtcagcgtttcctgcattgtcatcctggccgtctgcctgttgtgctatgtcagcatcacsaagtgagtcctgggcccagtgctgccgagcagtccctctggagtgcagggtggcagggacttgcccctctagtctgcccctttgcagtcctctcagtcaataatacgyatttactgagcagctactacacaccttgagagtagagctgagaacatatcgacaaggaccccacttttttctttttttyttttttttttttttttgagacggagtctcactctgtcacccaggctggagtatagtggcacaatcttgcctaacagtaacctccgcctcccgggttcaagcaattcttctgcytcagcctccagagtagctgggattacaggcgcatgccactatgccyrgctaattttttgtatttttggtagagatggggtttcaccatgttggtcaggctggtctcgaactcctgacctcatgatctgcctgcctcagcctcccaaagtgctgggattacaggtgtgagccactgcacccaaccaggactccacatttctaaaaccgscatcctactggggagactgaaaatacatatcaatcacaaacaggtggttttccatagtgacccactctctgaatgcactagaccagggtgsaggccagagatsttctggggtgctttttgcaaggggsaccaggataaggctctccaaggagggaaaatttgaggggggccytgactggggagaatgagctggccagggataagcaagatggagtcatcccacatccccttacaacrctgggtgcctgggcaactgggggcatytgggggcatgtggtaggagccagaggaatttgcgacgattgccctgatggagtcaggagacctgggtttgaatcctggccttggagcttggtagctggyggccgacaagttgctgaaacccctgagcctggggttcctgctttgcagagtgacagtgatggtgagaacatatttcatcagccagaagaggccaaatcacagtaaaggctgagggaggagatgagtggcgagtggctgggaggtggtggaaggagcctcgtttccagagagctcttgccagcccttggaatcatggtgtctcagagcctcagtcctcccatctctgaaatgggactagcaagctcaacctcactaagtcaggattagaggtggctaaggattattaacatgattgatgaaagtgcccactcttggcccagcacacactaggtaggcagggaatgcaaattcccctccatatcttgtcactgatgcctccgagcaaccttggactgatcgccttgctctgagcctcagtttccccatcacctgtacctcttcccactccccatcactatatcccagcatgccagcctctttgctgttctttgtctttggtttcttgttttgttctgttttttagacagggtctcactctgttagccaggctgaagtgcagtggcgcggttacggctcactgcagcctccaattcctgggctaaagagatcctcccatttcaacttccagagcagctgggacaacaggygcttgccaccacacctggctaattttcttattttaatttaatttwattttattttttgggacagagtggagtctcaaaaaccaagctrgagtgcagtggtgcgatctcgactcactgcaatctctgcctcccgggttcaagcgattctcctgccttagcctcccgactagctgggattacaggcgtgtgccacgacacccagctaatttttgtatttttagtagagatggggtttcaccatgttggccaggatggtcttgaactcctgacctcaagtgatccacccacctcgttctcccaaggtgctgggtacaggcatgagccactgtgcctggccaattttcttacattttgtagagactggctgtcacttatgtagcccaggctgatcttgaacttctacccctttatctttattcatggcacttattaccatgaatgaatgacctcatataagcatttctttcgtttttttttttttttctttgagatggagtctcatgttgtcccccaggctggagtgcagtggcgcgatctcagctcactgcaacctccgccttccgggttcaagcgattctcctgcctcagcctcctgagtagctgggattgcaggcgcctgccaccatgcctggctaagttttgcatttttagtagagacggtgtttcaccatattggccaggctggtctcgaacttctgacctcaggtgatacacctgccttggcctcccaaagtgctgggattacargcrtgagccrccatgcctggcctcatataagcatttctgtctccatttatcatccatctttccctcttgaaggtcagtttcaccaaggcaggcatctttgtctcgttcactgttgtrgcctcagggccaggcacagtgagtcaaacatagaaggtgctcaataaatatgtgtttatttattgaaaccatgggcagaggctaattcagaagcggtctgaggaccttacctcccagtgatgatgcaccrtggccccaggcaggccaggaagagagaagggttgtgtttctccgtaggtcccccagcttcccaggccatcccaggccattccctggtcatttgccctcagctgctctgaaaaagggattgttgaggggaacctagaatcctctctctgcagtttgagtctttcctaatcccctggggtctcattcccactgaggacataggtggcctcctcaggaactctgtgctgggtaacagaatgcgggagtgtgaacctggctctgccacctaccagctgtcactccacctccttgggcctcactctcctcatctgtagaatagggttagcaatagaatccatgtcaccaggttagaatgatgagtcagtggtttgacctccagaaactaatcagcctgatctctgatgccaaataagtattggtgataacgaccacttttatgggaggagcgttcacctgtcaataattcagagatcaacaccttttccttttgtttttcaggattaagaaagaatggtgggatcagattcccaacccagcccgcagccgcctsgtggctataataatccaggatgctcaggtaggagtaggcgtggatgaggacatgtgggactgtgtacatgaagaagtgtggttcagaacacctgggctgttaaggaccttcactggcttctggaatggcaaatagacagtcaggagggttgcaggggagacagagrcagaagccgaatgaggtcattagcagaccagaggctttcccgcccttccccttggcaatcccagcctggggtgggcttctctggggttggtttcctgtttttttccctccccttgggagaatgacccttgggtcatcatcactgtgtcattccctggggaggtgccagtaccagggctagaggccagaaggagtggaggaaggagagggtgacaggctttctgtgtcttcttcttaagcataggaaactgcccccgaagcactagcaaatcccttccgggttctcattggcctgaaatgtatcccacccctaagccaggggtggagtcagcttccccaaggcgatggtcctgtgggtgagtgggtggggtttgcctgagcaagatgagagttctctaggtaggagaaagggggattataggtcctgtctagaagagaaggtctgagggtccttgcttttccagggactctggaatctagtggtgttggctttgaatcctgactctgccactcactggcagtgtggacttgagcaagttgcttaattctctgagcctcagtttcctcttgtgggttataacagtgtttacctggtaggacagatattggaatttattgagacaatacatataaagtgcatattccagcctcttgcaaataccaagtgccatttatgtatcagttagtgtttgctgtgtaacaaaygaccccgaaatgtagagggttacaacaactttatttagcttatgcttctgcaggctggcatttggggctgggctcagcagtgagggtggygggggaggctgggctgggctgggctgggcagatctgaattgagctgacccgtccccgtagcctccctccgtgtctgacagttggctttttttttttttttctttttctgagacggagttttgctcttattgcccaggagtgcaatggcrtgatcttggctcactgcaacctstgcytcctgggttcaagcaattttcttgcctcagcctcccaagtagctgggattacaggcatgtgccaccacgccaggctaattttgtatttttaatagagatggggtttcttcatgtyggtcaggctggtctggaactcctaatatcagrtgatccacccayytcagcctcccaaagtgctgggattacaggcgtgagccactgcacccagcctagttggctgacttttacctgggacagtgcaggtgcctgagccatgtgcctctcactctccagcaggccggcccaggcttgtttacagagtggctcagttttcaagggtgggaagtcccaaggcttcttgaggcctaggcgcagcactggcatgatatcacttccatcacattctatgggcccaagcaagtcccagggccagtgtagattcaagggatgggaggagattcagagcactcctctgtggccacttttgccatcgaccacagtccctgtaaatattaggacaatgtaattaattcccaggaatctgargctcagaaagcgtaagtgacctgttggacttctgatctgtgtgatgtcgaggcttgtaccccttcctgagcattgccgtactccaggccgggctgcaaggccactctgctctttcattggctgtctctgtattttaggggtcacagtgggagaagcggtcccgaggccaggaaccagccaagtgcccgtatgtatctgaacttaggtcacagcctgcatgcattgggaaggtgatagaattggagaggcaagcccctagctccatgtctgccttctcttccctgcattcggtaattgccctgtgacattagccttcaagggacggcaggaggaggggtgttctggaaacgtggactgctggccaagmcccctgagtttcactggtgtgtcaggtacatggtgataccccttgggagtgctgttatagttaacaaccagagcagccktgcctgttgttaaaatcttgaccyaattgtatacttgtcggcaaatagccactatcctgaacactcccctccttttttttaatatmcaggatctcactctgtggcccaggctggtgtgcagtggtgcratcatagctcactgcaccttcaaactcctgagctcaagtgatcctcccatcttagcctcccgagtagctgatactacagatgtgcattaccacgcctggctattttaaaaggtttttgcctgtaatbccagctactcaggaggctgaggcatgagaatcacttgaacccgggaggcagaggttgcagtgagcgcagattgtgccactgcactccagcctgggcgacagagtgagactcttgtctcaaaaaaaataataccaaaaaaagtttttgtaaagacaagctctcgctgtgttgccccgccactgtggcctccttagcttcttccctggggcctgctggacctttccatactccagaaactaaagggggtccaggaccctgcttcaaccctaggatcccgcatcttttttttttttttttttttttggacgcagggtcttgctgtgtccctcaggctggagtgcagtgattcactgcagcctcaaactcgtgggctcaagtgattctctagcctcagccttctaagtagctgggactacagtcatacaccaacatgcccagctaattttccttttttttaattcttgtagagatgtttgagacrgcttgggctctgttgcccaggctgttctcaaactcctgagctcaagcratcctccctcctcagcctcctaaagtgctgggattacaggcgtgagccaccgcacccggcttccatatcctttctaattggtcatgrcttgggataatggtgttgcttttaattatcatcatccataaagactttttcttactcaacagayctgagcttgtatttggtgcccaggacatgtgctgggttcccgaaatcccaaagacacagaccctaccctcagggatttctcattctagcaacatagactgatcaattactgattataacgttagaaggcatgtctgmagtagacagccatcaggacatggtgatttcaggctgggctttgaagaatgaataggagtttttcaagtgtcgaaactgaaccctgaccaamctttgcttttgcagacactggaagaattgtcttaccaagctcttgccctgtttyctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatygcctgagagcagcagggatgacttccaggagggaagggmgggcattgtggcccggctaacagagagcctgttcctggacctkctyggagaggagaatgggggcttttgccagcaggacatgggggagtcaygyctyctyccaccttygggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaacyccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcrggagtttrtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccycagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggkcctcgccccctacaacccccctgagggccccagacccctctccaggtggggttccactggaggccagtctgtgtccggcctccctggcaccctcgggcatcycagagaagagtaaatcctcatcatccttccatcctgccccyggcaatgctcagagctcaagccagacccccaaaatcgtgaactttgtctccgtgggacccacatacatgagggtctcttaggtgcaygycctcttgttgctgagtctgcagatgaggactagggcttatycatgcctgggaaatgccacctcctggaaggcagccaggstggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgargcccttgggmacctcgacttgtgaacgagttgttggctgctccctccacagcttctgcagcagactgtccctgttgtaactgcccaaggcatgttttgcccaccagatcatggcccacrtggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctrtgactaaagcagggacaatttgctgccaaacacccatgcccagctgtatggctgggggctcctcgtatgcatgsaacccccagaataaatatgctcagccaycctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctctttattttttatgtattaaccaaacatacctccagacactgctgtgagtgctgtgtctctgttaactcctggaattcacccatccagaggaaccaggatgcaagaggttaagaaacttgycrtctgggtttgggttccccatacaaggattcaaatagttgatttaggaagtaatcccgggaaaccctgctaaggtagtggggaactgaggcagggaaggacacaaaccaagaaagtgttacctgaaaggggtccagatgcagaccccaaaagagggttcttgaatctcatgcaagaaagaattcagagcgagtccatagagtcagtgaaagcaagttaatgaggaaagtaaaggaataaaagaatggctactccgtagacagagcasccctgagggttgctggctgcctatttttatggttattgattaattatattccaaacaaggggtggattattatgcctcccttttagaccatatagggtaacttcctgatgttgccatggcatttgtaaactgtcatggcgctgttgggagtgtrgcagtgaggacaaccagaggtcactcttgttgccatcttggttttggtgggttagagccatcttctttactgcaacctgttttatcagcaaggtctttatgacttgtatcggtgacgacctcctgtctcattctatgactaagaatgccctaacctcccaggaatgcagcccagtaagtctcagcctcattttacccagcccctcttcaaagctccagtttaaataaacctctgacaaaagggtgagttattcaacagatwaccagcatgagyaactgatgcttacctgccggggatctctggaagaccatgcatggcacatgcccagttatgcctgcaaaggagagggagctggggtatttgtccaccagctcccatctgtcattggctgagagctgcttccaggagcattaattctccagcacttccagctactccaggaaaaaaaaaattcttcaactgagagttggaggtgttgagagactctggcacaccaagaagacaggaacaggacaccaacagtggctgatgatacactgccaaggtcacacagctagttagcaacagatctatagtggaatccagacagtgtctccatcacccaggctctctgtagtgatctgcgcttcacatccgaggcaggcagagggatggtgtgggccttagatgggaaggctgggaacctgaagctcctatgtctgtatcacttttgcttctctgagtagctgccctgatttcacacttgaggggcttggccattttagattccttcctgctctaggagcctacatactacactggaaatgatggggagctctctacctcacatgcagcctgatgtttgttagaaacacctccttgcgccaggcatgatggctcatggctgtaatcccagcaatttgggaggctgaggcgggtgtatcacttgaggtgaggagttcaagaccagcctggccaatatggtgaaaccctatctctaccaaaaaataaaaaattagccgggtgtggtggtgggtgcctgtaatctcagctacttgggaggctgagttggtagaattgcttcaacctgggacgcggaggttgcagtgagctgagattgtgccattgcactccagcttggatgacagagtgagaccctgtctcaggaaaaaaaaaaaaaaacaaaaaaaaccttgttctaagccaaaatcaatccctttagctgcccaaatcacacagtttacagatggagaaacagttttagagaggaaaagggacttgcccaaagtcacccagagaatggcagagcctgaactagccttctggacttcttgcctccaaaagctctttataataaaatataattttaaataaaaatagttatctgtttagggccaagcaatatgctaagtgccgtccagccactgtgtcatttaygtctccaaacagctctagttgggaggctcaatgattatcccaattttacagataaggaaacaggtccagagaggttgaggattagcctagaaccacacagctaggaaatcctggagycaggatttgaacccgggtctgacctaagagctcccagccgccgtgatatatcagcttatgtcatcctgacacctacgcrgatgtcggctcgaatccactttgcctgagcattgtctcagagaaatctaatttaaaaattaggcagcaaatagaaaatatatttgactgctagagatgcaatgggactgggagcccaacaaaggatcttaggcaaaagaaatccaagttgttggcctcagcaactattactgaactggctgggctttgggaagctacagagggatgagaagacctggtggatcaggtgggcccaactcaggctggcccccaccctgcaggaagtaggaaaagtccagggtcataggcccagtgagatgccggctgcgggagtttcagcctccggggctggaccagagggcaggaggggacgcccctgggtagcagcgccagagtgggctgagtggcctgggcccctgcgggggagctttcagagatgttgatttgggggtactccctcagccctgcctttacacagaatttgtgggggatgaggggagggggaaaggggggaggaaggcagtgagtgcatctgaattttttttttttttttacaaaaagtggcttattgcatttttctgattactctatcagcacgtgcagaccttttcctattcagagaaagcctgaagatataaagaggaaagtgaagaaaaaccaccggaaatcccatccccgccccagcatctggcactgtgtgggcgatcacgaaatgagcgcttgtttttgaaggcgtagtatctccgtgaacatccggttgaacaacctttctgactttatttttcccacgaaagttattaattaaaaaacaaaaagcaaaacaccgaaaaaacaaaaaacccagcaagtgtttgagctcccaccacgagggaggcctgacgtcactggatcctcccggcagccgatgaggctgcakgggacttgcccacgatgtgctgttaccgagtggcatagccaggcttcaaaccagagtcctagctaaccgccctgtatataccatgggctcatcatcttccctggttccagctcagaacagagactcagaggaacaagggctctgcgctcaccctgcctggttaggtccagcctttccaattccaagctgtgtgaccatgggaaaagtgtttgcccactctgggcctaaatttcctccttggtaaaaggcacacaagagcagtactctgcacgccacagtggtggggtgagcagcagatgacgtggtgggtggaggccaggtgacaccaggctgctctcaagcttaacttgcctgtgatggtggcgggaccgtgtcagttcttccaccaaatcccacctgtttccacgacgtttattgacaagtcaggggcaccgccccgggtggagggggtgtgaagaggaagtcagctccctggtccctgctgccctctggtgaccacatcagcatcagcacctgctccatcccagcagctccaggtccaggccgtgcccagaaaacttggcctgggagattccccacccgccctgccccgatcccacctctcttccatctctgcattttccagaaattcccccagcaccagacaaaagagcctaatgtccattagatatgctgtgtggcgccaggccagcgtgtaacctctctgtgcttgattcgttatctgtaaaatgggaatcattataatatctgcctcatgtagctattgtgagaattaaatatgttagtacctgtgaggtccttagaactatgcctgcggctgggcacagtggctcacgcctgtaatcccagcactatgggaggccaaggtgggcagattgcctgaggtaggcgtttgagaccagcctggccaacatggtgaaaccctgtctctattaaaaatacaaaaatcagccagacatggtggcgggtgcctgtaatcccagctactcgggaggatgaggcaggagaattgcctgaacccaggaggcagaggttgcagcaagcggagattgtgccactgcactccagcctgggcaacaagtgggactctgtctcaaaaaaaaagaactatgcctgcaaatagttaatgccttaaaagtatttgctaacattcttcttcttcttcttttttttttttttttgagacagggtctttctctgtcacccaggctggagcgcagtggcccaatcccggctcactgcagccttgaacacctgggctcatgtgattctcccacttcagcctctcaagtagctgtgaccacaggtgcacacaccactaagcctggctaatttgttttttaattttttgtagagacagggaatcactatgttgcctaggctagtcccagactcctagggttcaagcaatccatccacctcggcctcccaaagtgctaggattacagatgtgagccaccatgcctagtctgctaacattatccttaatattacactgaatatgtctgtggattttgtgggaggtgagggtataaaacataattagaggaaataatgacattctaaatttaattygactttattacaaaaagggcagaatggagcaacagtaatccaggacaaaaaattgtcccaatcccatcattcaacccacttgtgtttgtatctgtttgtgccacttctgtgtgttgtttacatgcagagtcagtgtttgcgtatttgcggttttatatcattcatttctcatcatacatacatatatttatattcctgacatttttctagggaatatctttatattcctgacatttttctctttttcccttatgttcttccataccgggacttataggaccttgcccagactcaacttccctcttccccatggacccaagttgctgagcttccaacaggtgtttacagcaaaggagaatgagacagagagaagcagagatgcagagagaaagacagacagagaagactaaactgattgatcccaactccattatgatatctgactccaaccacagaatgaccctgatccagccacagactgacttctgatcctggccacagtccacctcctgtcctcagccacagaacagctctgactcaagccaggaactgagtcccgacccatgttactgacttactcatgatcctggttgcaggctggccccagccacatgctgacccctgaccctcaccacagatggatctttgatcccagctataggctgatctctgattctggctgccctgaaccaccactcctatatactgatgacccaccttagcgtgatcccacccaggaactggcatttcctgggacaggctcttggccacctgctgctctgccctgggcacaccaggccctacgcatcctcccccttccaccaccatccatgatttcctgatttctagcagcaaatttagcttgagttggtcaacatagctgggctgcctgaccttcctctctgccatggaaccacagagcaagtcagcagttctccttcctaatcaaaaagcagcatggaggagaaggctcctttgccaccttcctttctgctttggatggtgcttttgcaatcatgaggagacaagcctggagatgaaaggaggcattctgaatatggtggagtggaagaagaagaaggcctgcctggggctttgattacatcaccaagtgatcaaaccaaccttaaattcttaaataaactgtaagtgtgcttttctttaaaccactgtgagttttcttttgcagtcataaagcaaccttaaaaattgtagtaggtacaataatgaaccccccaagatgtccatgtcccaatccctggaacctgtgaacatgttacattacatggcaagggggggattaaggttacagatggaagcagggttgctaatcaactgaacctgagatgtagagggagattatccttaattatccagacaggcccaatataatcccaaggatcttca

SEQ ID NO: 13250 - DNA, 13806 bp, Homo sapiens
  misc_feature (1)...(13806): n = A,T,C or G, or insertion/deletion polymorphism (see Tables 1-2)
aggcacaagaatcacttgaacccgggaggcagagtttgcagtaagccgaaagcgcaccactgcactccaccctgggcgacagagtgagactctttctcaaaaaaaaacagaaacaaaacatagaaaaggtgcagtaaaatctggtgtaaaagataaaagatgggccgggtgcagtggctcaagcctgtaatcccagcactttgggaggccgagcagggtggatcacctgaggtcaggagttagcgaccagcctggccaacatgatgaaaccccgtctctactaaaaatacaaaaagtaactgggcgtggtggtgggcgcctgtaatcccagctactcaggtggctgaggcaggagaattgcttgaacccaggaggcagaggwtgcggtgagccgagatcgcaccgttgcactccagcctgggcaacaagatcaaaattctgtcttgggaaaaaaaaaacaaaaaacaagataaaagatggcatagctgtatagggcatttcccaggcatggagcttgcaggactggcagctgctctgggtgcgtcagtgagtggtgagtaaccatgaygctgtacacttaggcaacactaggtttataaagaaatattcttctttcttcaagaataaattaaccttagtttaacttttttactttatcaacttaaacactttttgactcttgtaataacacttagcttaaaacgcaaatacactgtacagctgcacaaagatattttctttatatccttattctatgagcttttttctaattaaagtcttttttggggctgggtgcagtagcttatgcctgctaatctcagcattttgggaggccaaggtgggcagatcacttgagatcaagagtttgagaccatgacctcaaaaccccaactctactaaaaatataaaaattagccggacacggtggcgggcgcctgtaatcccagctactagggaggttgaggcaggagaatytcttgaacccgggaggcggaggttgcagtgagctgagatcatgccactgtactccagcctgggcagcaatgcgagactccctctcaaagaaaacaaaaacaaaaacatttttttttttacttcttaaacttttttgtttaaaacwataaaaatatagcaaatacataaaccagtaacatagtcatttcgttcattaaaaagtactataggccaggcgcggtggttcacgcctgtaatcccaacacattgggaggccgagacgggcagatcacctgaggtcaggagttcgagaccagcctggccaacatggtgaaacctctctactaaaaatacaaaacttacccgggcatggtggcggccgcctgtagtcccagctactcgggaggctgaggccagagaatcgcttgaagccaggaggtggaggttgcagtgagccgagattgtgccattgcaacccagcctgagagacaagatcaaaactgtctcaaaaaaaaaaaatactgcacataattctgtgtgatagacttctttgtatgactggcagtgcagtgggtggctccaccaatgccagcctctccttcccctgccccatgtggytgggtctgcagcckgctcggcctcccctctctcagaccgggggagctgagggggtgaggtagagacggcccaggggcagagcaggggggtcgggcttggtgcacagrcagactctgcctttgctacttcctgcctctctctctgtgaccctgacctcccttctcccctgtcccaggacctctgggaactgacactgtcctggccaggccccagcatctcacccaggcagcccagctagagccatctgtccctcttgccctccatctgtgttcctgtgtctcttcctcctgaacacaacctgagggcctcacaaatayttagttacatgaacgaagcaggccgggcacggtgactcacgccttcaatcccagcactttgggaggacgaggcaggcagatcacttgaggtcaggagtttgaaaatagcctggccaacgtggtgaaaccccatctctaccgaaaatacaaacattagtgggtgtggtggtacatgcctgtaatcccagctacttgggaggctgaggcaggagaatcgcttgagcacgggaggcggttgcagtgaacagagatcgcgcaactgcatgccagcctgggcgacggagcaagactccatctaaaaataaataaattttttaaaaaatggaaaaagcagaggagccagggacccggcatccctctggcacgggaatgggaagacagcagaagaatctgtgggggcagtttccggaacaccrgtctcaggtcatctgctgaggagtggggaagcccagctgtttaggtctggggaacatcaggtgccccacagtggctgtggcctctgccatagtgtagttcttccctcctccctccagctgagtcctgagatgccaagtaccagtcaggctgcctgcctttgctcacatgcattggcatccctctggaggccttgtgttctgatgtcacactaagaatcatgcatgttcactcactccgtgactgcataaaagttcatcctgaaatcaggctggtaatgagctgctgttcatgtgtrgtcttcatggggggaacccagtcatgtgctccacacttcaagacacgaaggggaagatgggaggcagtaagcttgaccttcctgcaggtgctgagccagctcatgggggctgaggaccagggctgggctttacctgcctctgaaggggcttggagcagaggcaggggaggtgraagaataggaacctggggcagtgtccttcccaggcaggaggacacagaagagcaggcccctgccaacatcaagttgaaacagctgtaaaagtggcctgggcacaaagctggcaactgaagataaggctcaggacacagcgagcggtcaccctgaggctctcctgggagcagggagtggctgtctccggccatggtccacaaaggcaccaaccactcccctttgcaggtgtgaagcagcagctggggacagttcagcccggcttaggcatgacctctgttttcatctgcctgcgaggcaccaaggaggacctgcatctgccgtccaccaactactatgtttactatgacacggacatggaccaggcgtaaggtgcacgtgtgtgtgtggcccgtgcctccctgcttgactcagagaacgagcagaagttatggaatgggaggaagtaggcaatttccaatttgcacctggaagtttgtcacaccaaggctgtggctcagcttcacccctgtggggagtccctagggacgagcagtccttgcagtggttctggggttttgaggacaaaagcctggagatcgcaccacactcttgtcacacgcaggatggagcgctacatctccatgcccagggaagaggctgcggaacacatccctcttctcttcttcgctttcccatcagccaaggatccgacctgggaggaccgattcccacggggggctgcacgtcctgggtgagggggtggagggagaggccgggcagtagtaatatcagctctgatccccaggccggtccaccatgatcatgctcatacccagcacctacgagtggtttgaggagtggcaggtggaactgaagggaaagtagggcagtgactatgagaccttcaaaaacttctttgtggaagcctctatgtcagtggtcctgaaactgttcccacagctggaggggaaggtagggggtaaagtatttggggtggtgacggacctcatggtgctatttctgccctttccttgagacaggggaattgggccccaagacatgagccccagggaaggacagggcacccaaccccggagtcagtgaatgggaaagagyggaagagggaggggagccaggatctcacatgcctgccccaccctttctgccctcaggtggagagtgtgactgcaggatccccactcaccaaccagttctatctggctgctccccgaggtgyctgctacrgggctgaccatgacctgggccgcctgcaccctygtgtgatggccttgaaggcccagagccccatcaccaacctctgacaggtatactcactgccccatgttgtcaggacctgagaccctgggcccctgtcgcccaacgtcctctgttcctgccctcaggccctgctgtcccctgcagcctcccatcccctgagcagggctgcctgggcaggctgtggcccctgtctgattggagccagctctgggtggccctcatgtggagggaagagcaccaaggccccaccctcccctgggcctgcctgggtgcacgctcaggggcctctgctcttgcctcctaggccaggatatcttcacctgtggactggtcggggccctgcaaggtgccctgctgtgcagcagcgccatcctgaagcggaacttgtactcagaccttaagaatcttgattctaggatccgggcacagaagaaaaagaattagttccatcagggaggagtcagaggaatttgcccaatggctggggcatctcccttgacttacccataatgtctttctgcattagttgctttcacgtatgaagcagtctaatttgggtctgatgcctgaagagaggcctagtttaaatcacaattcccgaatctggggcaatggaatcactgttttccagctggggcaggtgagatctttcccaccttctataatatgccatccctactaataggatattgacttggatagcttgatgtctcatgacgagcggcgtctgcatccctcacccatgcctcctaactcagtgatcaaagcgaatattccatctgtggacagaacccctggcagtgttgtcagctcaagctggtgggttcagttctgtcctgaggcttctgctctcattcacttagtgctacgctgcacagttctacactgtcaagggaaaagggagactaatgaggcttaactcaaaacctgggcatggttttggttgccattccataggtttggagagctctagatctcttttgtgctgggttcagtggctcttcaggggacaggaaatgcctgtgtctggccagtgtggttctggagctttggggtaacagcaggatccatcagttagtagggtgcatgtcagacgatcatacccaattcatatggaagtcccgggtctgtcttccttatcatcggggtggcatctggttctcgatgtgccagcatcaaggcaccttcagggagctcggtacccgagcctcaatcaagccttatcctccaaatatgcagggaaaggtgacacagggcagggaagggtgacgtcaggagtcagggcatcgactggtaagattacttcattgtgttgaggcaggctgcagggcattccacacaatggcacagcagaggacagcacagggaggcaacagagtgttcccagcaatggcccagctactgaaagcaacacaggcagccaggctgggaggagtcaggtggcaagagagttggtcaggagcagaacatggaaagccagagaaagtgtgcaaagcccagaaatggcatctgcaatttactggtacatgtgtgtgttggatggaaggtgaaggaaggctcaaaaggcataaaaaggacctttcacttatgttaaactgacatgccaaaggtcttattggagttcatcttaatataatattaataaatttattggccgagcgtggtggcttacacctgtaatcccagcactttgggaggccaaagtgggcggatcacgaagaagagattgagaccatcctggccaacatggtgaaaccccgtctccactaaaaatgcaaaaattagctgggcgtggtggcacgcacctgtagtcccagctactcgggaggctgaggcaggagaatcgcttgaacctgggaggcggaggttgcagtgagccaagatcataccactgcactccagcctggtgacagagcaagactctgtctcaaaaataaaataaaataaataaataaataaatgtattaaatccattgctttaacattttgaaatttattttggtttctgttcaacaaaaccaaaccacattgggatggcatttacagaagctcaraaaaacattatgcactgaaaaatacttctcattagaccacaacaagctttaaaaaaataaaattaagtaattatagttaagttacaaaaagctgaaagtataaaacattgtggaaacagtgaccatctattaactgggaaaacacaaaagaagagaaacaatttcaaccattaatcatttatcaaacatgaagtctggtgcattaaaggaatatctatcagagggtgaggggctggcttactggcagtttgacatactayacagctcagacccaaacccttcacagagagactctaagtgtacatctgacttgcakaactagacgagttgagtcactgttagctctggatataccgttaaattaaacctcaaaatctctccccaggactcttgctcaagcaagtcacgccaaatccaaccttcctaacaggggttttcagaaaatggcctgcagaagcacaggatctggtgcctcacagtttcctccatgctgcaatgctctagttctcatcacgcccatagcatctggcatcaggttaccctgtacagtcaacggccatagaagtcgccagcagggaaattccagaggtttagaattctatcagcacatgtgtcactggaagccatcatgggagtactatgtcagagcgtatgtaactagctgtcaggtctttccccgttgcctcagcctttctacacagactggccttcaacttcccctragtccagaagtagactctttcagcaactctattcaggaatctgcagcaggaaaactgcttcctctattaacatctatgactgaagcacagatgtgtctartagaaatcacccttcacccaaaagctgggcgcagaaagggaagcccttagctgactataggaggtgcctcttgtggctccacgtgcttcttacacaccaccccccagcttgagcgatgcctcagccagctcaccctcatycacacaatcgctagaaaacatgcttcaaatattctatctttgaaaagacaccatgcagaaaataagctttcctctgatgtgcggtattttcttcaatgctatttctttcttttttttttttttttttgagacggagtctcgctctattggcaggttggagttcagtggcacgatctcggctcactgcaacctccgcctcccggattcaagcaattctcctgcctcagcctatctagtagctgggactacaggtgcacgtcaccatgcccggctaatttttgyatttttattagagacggggtttcaccatgttggccaggatggtctcgatctcttgacctcgtgatccccccgcctcggcctcccaaagcgctgggattacagggggagccaccgcgcccggcctttcttcagtgcaatttytaaagagaaacttaaatcctgttgtattctttcaacacaagcaatgatacttctcagagtctgctcaaaagctcagctctgtggactccgtgacaaaatgtacgcgtccactgccgaccctcttggtttctgaaaccaacctttcttcctgctctcctctttaagagcaaaccccaacatgtataaggtcacagcaagtggtagccaggaaaagctgtgggacccctcatttgagtcacatccatatggcatggagaaagaaaacctctctgccagaaggaactgaactctggaagtcctaaggaaggtcaccatgmtcagcagataggaaagcattgccaagggctgtccctcaagagcttagttttcttagggagaccagaaagacatcagatcctgactgccctgttttgctcaagttctgaaatgagtggcatgatgaagagctggtggagctgagggaaagagtcaaccatgtggggtggggtagtgaggaaggtgtatgaggaaacaaactgggccctgacgaaacaggcggattggggaaggagaaagaaggaagggagagaaacctaaccaaagaaacatgggaagctggaaagtcgagggcacagccggaataaaggcacagatgggcaccccacaggaggggccttggccaggttgggatgcagagaaaaacaggcaggagggtgtcaatctatagcatcctgaaccccaaaaggtctgtaactggattctctaagccttgagaagttcasaccaaagcttcagaccagggaaaatattttggaaagatcagtctttccaagaktgagctcctttccaagaagctggacaggaaacccaataaatgtggatctgaaaaaacaaaatccaagagagaagcaaaatgggctgggggtgtgcaataagagaagcaaggaaaatggaaagactgtagctgaggatcttttattaaaaaaaaatggatgggactttggtgatgagagagaaaaagggcaaaagtctgcagttaggaatttaggtgaccgaagactgtcctagacagttgggagggacaggctgatggacagaagagagaaattcctttcaatgacaaccaagctgaactattcgataccagcagaactgggttctttagggattaagccaagacaaagacttgggaatcactcactccgaggatgaagaatgggttaatggctgaggagacagtcaaaggaatagagaggcctggctttgagggcctcttcaccaccagcacaagataaggcaaaggaccatttgtcagagacaccaagaaaggggaatttccatttggatggtcaatagtgtccagttctgycaaggacaagactaagctttgagaaaaagccatggatttggtgattggataactggtaacctttagaaaagtttagttgacagacagagaccgaagtgagttagtaaagtcatgaagagaatgaatggcaacttaagggaagcaacatactggagaagttgagcagcgggatgaataacaaataggacagatgggaacagaaaaatctgggtgcatacgaaggtggatggaaaggagctggtacagatgggcacaaccagaaaacatgaggaggggaaaggaagggaaaaggaaggcaggcagggagagagacgtgaaatagccacagtcttaggggatgctagagaagcctagaagattcctcaggttggtgcaaagtattataagactaacgcatcagtacagagaatgacccaagaagggtaggagttcattccttaccttcataaagtaggctatccgccaagaatgaaaatgtcaactcaaagctatgggctgttttaagcaaggtggaagataatataagaagcatggtcctttcttcagacttactgccttgacagcacagaattcatcttatttccctcatctcccaagttatttgtatttccctgagatcagctcagaaacaactctctttaggctctctacaatgcggtagagcatgattagaaragataaaccttcaaacaatagtgttgtccaagacactaccctcacttatcccaggggaacccacggaatttcttcatttgtattaactcctgacatggcatggaagaagaatttttatcaaatacccttggcatcttatatcagattaaaggaccattaaatacactgaggtaaaattggcagagagtatagtttctattaataaatctaagtctattttgtctgttttaggcaacaaaggcaaaatggactttgtgggaaatgtatctcataaaagccctttggaaaaactgcagaccaaaaccaaaaccctccttcatgttttctcgcatgaaacataaacttgccctatttcaaaaagttcctactgagtatgattgtgtgaaagatcacactacttcaaatcatatttattttaaaaatctgtgatgggacagtggcctcactgccaggaagcccaagttctgttttatgctcggtacaactaagtggaagttgattcactttgtctcaagctacataaaataatcagaaaatcaagaagatctcatgctagacaggttagacttgcacccaaaaaagcatctttttttttaacctgctgtttwggtttgctgctgaagtctttgaagagaattatgtattcaaagtagctctttgcccattggcatttccccatcttctatgtcttctgtagggcacatcccccccaaagtaagaggccttagtagaaaagcacttccacctgcagttttcccctaggtctgcagagagaaacagtgcagagtgcaatgccacagtcaaggaccaactttcctacagagcccgggccccagggagggtggtcagcagcgcagsctgcccaggctgggatctccctttggtcayagccgtgtttccatataccyctccactcaccctcagaggaggaacggatggaagccaccagcataaataaagggaacacagaagaacaatgtcaccaaagtgcaggtgcaaagcccaaagcagccccctacctctgccagcccagacccgccactaaattctagaggagggtgtctctcaggtcacagtacttttttcttcatttcttttgatttaraaacaaatcagcagggaggacaaggttctcaaggacaaaaaaatcaaagctgaaacgagagcagcacaatccattgrtgacgttcatctttttccagaggaatataccattctgttaggacttrggggaraaaagatcttttaggaggtgcagggaaaacattcagaattaagacatactgacccaccaccacagaaacagcaattaattaaaatagcacacaaaatgatttttaaagtttgaaatgaaacctaacactagaaagatatacacttgatggagagagaggaatcctggcttctgcttcatactgttctgtactgttgtgaattatttacatgtgttttttgttggtggtggttttcttcttttttgagacggagtcttgctctgttgcccaggctggagtgcagtggcatgatcttggctcactgcaacctctgcctccgaagttcaagcgattctcccacctcggcttcctcagtagtagctgggattaccatgcccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtgtggggctcacgcctgtaatcccagcactctgggaggctgaggtgggtggatcatttgaggtcagcagttcaagaccagcctggccaaaagggtgaaaccccatctctactaaaaatctaaaaattagctgggcgtggtggtgggcgcctgtaatcccacctactcgggaggctgaagagggagaactgcttgaacccgggtggtggaggttgcagtgagccaagattgtgccactgcactccagcctggacgacacagcaagactccgtctcaaaaacaaacaaacaaaaatcataaaagggggaaaacccttaaagtcaattatctgaaaaggcagtagtccagagctaaattgtaaagctagcctactggactagttagcaaagatattctgagctcagtggctcgttctgtagctaatattgagttgtgcaagagaatcgtgttccctgcaggaagtctgggaacaattcatagttgggccaccaatggttctttgccaatgtcctggctgttgctatgctgaaagcagaaggaagggtgcatgctggtagcaacgcagtgagagtacagtcttcctgcttagacaggttgtctttagagagacccttgcttagctctgctgccatggggtggaaggagggcttatctgtctgacagaggaatggattggctgtactcaggaactccagcctacggtgcttaagccaggctgatgtggggagttggaggcctatgtgcttccaggctcgtgtttccagggagcayagtctagcactttaccacacaaagtgtggatccagtggcatttggtttcacctgggaacttcctaagaatgtagacacaggccaggcacggtggcttatgcctgtaatctcagcactttgggaggtcgaggcgggcggatcacctgaggttgggagttcgagaccagcctgaccaacatggagaaacccatctctactaaaaatacaaaattagctggacgtggtggtggcgcctgtaatcctagctactcgggaggctgaggcagaagaatcgcttgaacccaggcagcagaggttgtagtgagccgagattgcaccattgtactccagcctgggcaacaagagcaaaactccatctccaaaaaaaaaaaaaagaatgtagaaatataggctccaccccacatctaatgaatcagataatgctttttatcaaaattccccaaggtgattcaaatgcctattaaagtttatggagcgctggcagaatgcagaaagctcaggactgggagackagggagttgctatcaggtcctgagtttgccactaacttgcagtagaaacttagcggaaaaaaaaaaaaaagagtgtttctgcrtgggcctatttcctcatctgtgaagggaggtagctgctgtagagtattccaaggtctctgctagctctaacgtcacagatatgtgtatctagatgtttctagtttgttgtctaaaaagggcgaatgcaacagcaacagcaaccgcatccccagaatcagccactgctgcttcatggcaaatgcaagcccactactgggtccatctgacgttgcctatccctcctatccctcccatggacctggctcctccttccttaccttctggtccaaacgttggtagtcactggcctttggccgccgggtgactttagatctttttccttccaggacaaaagcaatgatctgaggaaaggaaaaagaaaatgattaacaggtggctctgtaatgacatagttcagtctctgaamtcagaggcagtcacctggtagcatatttgttaatgaccctgactgtagaaagagcagtacactcacagaggtctrtttaaactataaccattttaagaaagacagagcctaattacatcagaatcctttgtattgcttaataggaaataacaaatagaaggctgtctgagctctagcgtgtgggaggaagtctgtttgatttattcaaaggtacacagtcaaagatctatcawctccttcctagagatatctaggatataggacattcctttaaaaaaagtcataatcagaatttcctatctacaaatgtactttttcaccccacgatgctacatcaactacattctttatcaatctcatttcatgactaaggttaccctgcataatggacacttggacatagaataagaaatacactttttttttttcttagaggcaaggtctcactctgtcacccgggctggagtgcaatggcgtgatcatggctcactgaagcctcgacctcccacagtcaagccatccycccacttcagcctcctgagtagctgggaccacacacgtccaccaccacatctggctaatttttttattatatgtagagacgaggtcttgctatgttggccaggctggtctyggactcctgggctcaagcgatcctcctgcctcggcctcccaaagtgctgggattagaggcaggagccactgcaccgggccaggaatgcacatttttactaaaggtcttcccctttattctttatagccataggccttatggccagaattggactctccaattttaagcaggtta

SEQ ID NO: 13251 - DNA, 38023 bp, Homo sapiens
gagacaaggtctctgttgcccaggctggaatgcagtggcacagtcttggctcactgcagcctccagctctcaggctcaagcgatcctaccaagtagctgggaccacaggcatgcaccatcatgcccagctaatttttgtgctttttgtaaagacgggcttcaccatgttgcccaggctggtctcgaactcctgggctccagcgatcctcctgcctcggcctcctaaaaatgctgggattacaggcatgagccaccatgcttggccaacacaaagatttttaaatgaatataggaaggatcacttgctattgcacttacgttcaaggaaatttattgtgattactaatacatatggcaccaaacctaggtggcttatagcaaagtttccctttaacttccagtttgcagtgcctgtcacaggccaggttctcagctagcatttgtggagggatgactggccttgcccctcctcgttttgtgctcactaccttgttgacataaaaaatgttctcaagatcaggcgtggtagctcatgcctgtaatccccgcactttgggaggccaaaggcgggagaattgcttgaggttaggagtttgagaccagcctgggcaatayagcaagatcccatctctacaaaaaataaatattagctgggcatggtggcatgcacctgtagccccagctaattgggaggcgtaggcaagaggattgtttgagcatgagaggttgaggctgcagtgagctgtgatcaggccactgcactccagctccagcctgggaaacacagcgagactctgtcttaaaaaaaaaaaaaaaaaagaaacagaatgttctcaccccgtttttctccagagtttccaaacagcctgcctctgaagcagccctcttctcaagcatagtattatgggctgaattaggcccccaaaagtttgtatgttgaaaccctaacccctagtacctcagaatgtgactgtattcaaggtctgggtgtggtggctcatgcctgtaatcccagcattttgggagggcaaggcgggcacactgcttgagcccaggaatttgagtccaacctggacaacatggcaagacccagtatctgtaaaaataaaataaaaaacaacagccaggcatggttgtatgcgtctgtgatcccaggtagtccagaggctgaggtgggaggattgcttgagcccgggaggtgaaggttgccgtgagccaagatcctgccactgcactccagcctgggtgacagagcgagaccctgtctcaaactttttttttaattaaataaatgaaaaataaaaataaataaaactacaagggcaactgaaaccccaagtgagataatacatttgctcttcatggaagaggacaagtgagtaaaccctgctcttctgtggtggggaggccatagttagaattgaaggggccccaccagaaacagaaatggtgggaagtggtggcctctggaggcaaagctttgggggctgtggacatctgctgagaccctggctgcagacatggcttccctyccgagggagttcatgtgaaagtcgaggcccccaccggtattagaggagcagccatctcttttgctcgcagttaaacaagtgctctcgcagtaggataagccacaaaggagacactgtaggagaataaagaggaatccttctggaagccaatagaaaaaaaaaaaaaacaatgtggtcagccctcataaggctagaaccagaaacttagttctctgaagccaaggcactgtaatttccctccctctgatgacagtcacaccacagaaagggagctgtcgggaggaagaagaaggagcccagaggcacggctcatacctccctgctggaaggaggggtaaagggcacgaaagtcctttgagaagagaggaaggagaaatakaaatgaataagacagcaccctacaccaaccaacttagagtttagataggaatggagacatatttctgaaaatactggaaacaatcacagccaaataagaaatccagttcatttcaacactgaatagttgggcactgtagcgtattcaaggataatttttaaaaattaaaaagttaaatcaggctgggcgaggtggctcacacctgtaatcctagcactttgagaggcggagacagcaggatcatttgagctcaagagcttgagatcagcctgggcaacatgggaaaacaccgyytytacaaaaaatacaaaattaggctgggccctgtggctcacgcctgtaatcccagcactttggggggccgaggcaggtggatcacgaggtcaggagttcgagaccagcctggccaacatggtgaaaccctgtctctactaaaaatacaaaaattaggggagtgtggtggcgggtgcctgtaaccccagctactcaggaggctgaggcagaattgcttgaactcgggaggcggaggttgcagtgaggcgatatcgcaccactgcactccagcctgggcgacagagcgagactctgtctcggcaaaaaaaaaaaattcatattagcccccagagaaaccccacaccctttagctgtcacctacctaacctcccatgtggatttcacggaatcatacaatactgagtcctttggacctggctgattttayttagtaaacgttttcaaggtttatcgatgttgtagcatgtgtsamtacttcattcctttttacgactgaataaaactccatttggtggatttatgacagtttgtttattcgtgcaatggtttttaatggatggacatttgagttgttttcaccttttggttactgtaaataatgctgctataaacatctggtgtaagtttatacatacgttattaacttttgttttagagttggggtctcactatgttccccaggctggtcttgaactcctaggcttaagtaatccacccacctctgcctcccaaagtgctgggattacaggcgtgagcccactgtgcccggcggatttttgtgaggacgtatgttttcacctctttcaggtgttaacttaggcctcttttacggatgttcaacaagcaaacagcttttacacacgtgagtcaaggcctctctgtaagttctgagagctgttccccaggccctgaaccctgacccccaaatctagcaggttaagccaaaattctcctcaacttcaaggcctacttcattcattatgcatccactcaactcacatttctctatcctctgctatgggccagacaccctgcaatgagctgggatgaagcaggggaacaccgcaggtaaaaatgcttgcctgggtggggcttaagatccagtgagggcaggaaggaacatatacaagtaaatatgctgtatgttcctttctccatgaagctttcctggatgttccaggaagggacgaattctactctggtagtaatatatttcttttcttgtcttttgaggagtcttgcccatgttggagtgcaatggcgtgatctcggctcactacaacctctgactccctggttcaagggatcctcctgcctcagcgctcgagtagctgggattacaggcccgcaaygccacacccagctaatttttgtatttttagtagagacggggtttcaccatgttggccaggctggtcttgaacttccaacgtcgtgatccgcctgccttggcctcccaaagtgctgggattacaggcgtgagccactgcgcctggcctattkctttttttcttttcttttcttttgagatggaatcttgcccgggttggagtgcaatggcgtgattttggctcaccgcaacctccacctcccgggctcaagcgattctcctgcctcagcctctcaagtagctgggattacaggcgcgtgaaccaccacgcccagctaatttttgtatttttagtagagactgggtttcaccatttgggccaggctggtctggaactcccgacctcaggtgatctgcctgcctcagcctcccaaagtgctaggattacagtggtgaaccaccgcgcctagcctgtttcttttgtttcaaaagtgatttttacctctcaaaagtgatttctataatgacactgatggaaaattccatcaaatagccataacgcatgtcaagcactctgctctgcataccttctgtcacactctaaggatgagagaggggagagttatcctggttctggctgtgtcctccccattttggccatcttatgagctccttatagaggtctgaaatgatttggagtccagagtccatggctgtcaggatatgactagggtgagcaggcagttgggaccaccttgacctccagcctcctggtcctcagttcctcgggtatcccactctgctgggggcttagtgaccatgtttgggctccagagattattttttccttccactcctatccttagtttgttactaaccaggcgggagtacaggcatgtctctgaagacaggctcagggctgtgtgacagctgacgaccaggctgcagggaaccaggtcccatgcagtcctactgccttctttttttttttttttttttttttttttgaggcggagtctcgcttttcgcccaggctggagtgcagtggcacgatctcagctcacgggttcacgccattctcctgcctccgcctcccgagtagctgggactacaggcgcccgccaccacgcccggstaattttttgtatttttactagagacggggtttcaccgtgttagccaggataatcttgatctcctgacctcgtgatccgcccgcctcggcctcccaaagtgctgggattacaggcgtgagccactgcacccggctactgccytcttactgtcgccacagcctggataaaatacgattcttctgagccttttttttttttttaatacagagtttcactcttgttgcctaggctggagtgcaatagtgcgatctctggtcaccgcaacctccgcctcccgggttcaagcgattctcctgcttcagtctcccgagtagctgggattactgacacgcgccaccacgcccggctagttttgtatttttagtagagacggggtttctccatgttggtcaggatggtctcgaactcccgacctcaggtgactcaccggcctcggcctcccaaaatgctgggattacaggcgtgagccaccgaacccagcccctctgagcctcttgaatacaactggggtcatgcctgctttgcaggtttgtcttaaggattaaagctgtttggggagtgtctggaggagggtgagtcttgagccaacccctgcatctcccttccagggcctcccggtaataaaccccaagtaaatgtgcactttgtccgtcctctcggagcaggtctccgggtactcctgtgccaaaccgatttccgcccccaaggtccttctcctcttakaaatcctgacgcagctcctaggttccttcgcagtgacagccactcttttctatttgtacgtagctgtagtgttttgtgggtacgttctctgaacaacaaagtggcccttctaaaggctgttctgtggggtccacagcctcgccacccccagcctctgcagcggcttctgaatgaatgaaataagcgacggcgccctctccaccaccccacccccgccaactcggcaggcagggatcccaggcgcgggttctggcggaggcggtcccgcgaggcggggggacttttctaggcggggtgggggccttgggaccacctttaggggctttttccccatcccctggccccaattcgcagcgtttcgccacccagggcccgcagggctccaagcccytcttccccagcccgcgcgctcaggcccccgcccgcccccggcggtggccccggaccccgagcggaagggggcggggggtgtgcggggccgggaagcggggagcgcgggcggcggaaggtggcgggagggggtgggggctgggaagcaccgtgcgcrggcggcgggagggcccgggcggggctgcgcggtggtcacgtggggcggggccgggagggtacttagggccggggctggcccaggctacggcggctgcagggctccggcaaccgctccggcaacgccaaccgctccgctgcgcgcaggctgggctgcaggctctcggctgcagcgctgggtgagtgctggggacccggggccaccgcagcgtaagtgaccttggcggggacggtgctacccggccgccgagacgggttcctctgcgccctcagtcgggcccaggcgcggccccgcggcgtmcctgggggccggcggggagccgggaccctcgggactgtccctgacgggcgggctggggtgggagtccgcgcgctccgaagcgtcggcgagaaaagcagaaaacarctccgcccgccagccctctgccctccgctcccctccccgggctgtgcgccggaccccggccctcggagcggggacgcggccaggaccgccgagggaggcgcctgcgaggaagagctcggccgggtccggagactgctgcctgggaccgcgctcccagcgcctgggcctcggtgtctccgggccaaactgccgacataatcgcatctgccggcatctattttcggtttatttccccctcattgcgaaggatttgcctggccaactttctgcgcaagatcccacgcaattcctgggaccccagaagacaggtcctgttgaagaacaggaatctggcactgggtgggctggggaggaasccgcacggtgttaaatccataaacaggaagagaaaccagacagcgaaaccaagaggcgaatgggcgattggatgccggtggggagaaggccgggggcgcaccctgctcctggactccagtaaagggaggccgggcagagtccctggggcgccacctccccctcggttagtagccctggaggccggggggagttggcctctggggagcagtgggtgctgggtgtggggcgttgcaggcaggctggggtgggcgacccaggtggaagtgaattgcacttggcttcctggtgggcctctgtcayccccttcccaggcgctgagaaagccagcaggctggcaaagaaaaggaccctagcgcaggccccacactcctcctcctaacggacgagagaccccccaaacccactggagaagtgacgctgtggggttcaaatgcagacctggcacctttttgtagcctggaaaaacattcccactgcctgctgccggaggagaggatagctgagatgcactctctttgaatccaaacgttcaggaacgtaaggcgaagaggcctaagagggcgttggctggctctgtctctcaggctggagcacagtggcgcgatctcggctcactacaacttccgcctcccaaattcaagctattctcctgcctcagcctcccgagtagctgggattacaggtgcccgccaccacgcccagctaatttttgtatttttagtagagatggggtttcaccatgttgaccaggcagatcttgacctcctgacctcaggtgatccgcctgtctcggcctcccggtgagtcacggtgcctggccaagaactgtttcttgttggctctggtgctggtgacttagaacccgccagctcctggagaaaggggctgggccgcccaccctgtgtagctttcccaaagacagagtcaaacgtctcctggagaacagaggcttcccttcgtctttggtcatttgtcctctagctgggggtaccccctggtggaaaggcacaggtcccttgctccccaggtggcaacgcaggccagacacggccctggcacagctctcctgggtgttggctcaggacagccctgtttccaactggttaggcggtgaggggtggtggccctttggttccaggttgaaactgccyatgtggtgctgatttagcagactggggaggctctttttgtaggcaggttcttttctttccccagctgctggacctgggagttggaagagaagttgcacccattttaggggtaacagatattttctgttgctcttggttggattgggaagtgaattgaagggaggtcacgtttcaggggtgccttgggatgtctgtcagtgattttcttttctttcttaawttctttttctttcttttttttttttttttgagacacactccctctatcgctcaggctggagtgcagtggtgcgatctcggttcactgccacctccgcctctcatgttgaagcaattctcctgtctcagcctscctcccaagtagctgggattgccagtgcccatcaccacacctggcttttttttttttttttrtatttttagtagagacgggctttcaccatgttagccaggctggttttcgaactcctgatctcaagtgatccgcctcagcctcccaaagtggtaggattacaggcatgagccaccgcgcggtggaggggtaattttcttaaatctrgtaatgagttgtggttgtgtagagtaacataccgtcctttcgagatatggactgaaacattgagagggaggagttacaggtatgycgattcttcttttctctctctcctttttttttttgaggtggagtctgactctctcacccaggctggagtgcagtggcaagatctcagctcactgcaacctccgcttcctgtgttcaagccattctcctgcctcagtctctcaactagctgcgattacaggcatgtgcctccacactcagctaatttttttatttttagtagagattttttgtctctcctaaaaaaatccaatgtaaaaaaatcccaatgtgggggttttgccacgttggccaggctggtctcgaactcctgacctcgtgatccgcccacctcggcctcccaaagcgctgggattacaggtatgagccactgcgcccagtctgctgcctcttttcaatggtctggcctaaggaaattattggaaacatgtgcggttgagtgatatttactgggcacttccacatggtccatgtaaagggagatggttggggtgacaggcagttgagtctaggggaggcatgtacagatgtgctgtgcctctgggatatcagggtggcaggcagcagtctctacgtctggtcccaggctgcctgagaaagagcatgtgggaggcaaaccttgcgccctggcatggttgttaatgtttatatttaccctagcttgtgtggggtaggaggtttagggatcaaattccactctgtgtttagacatttttttctttctttttttttttgagacagagtttcactctgtcacccaggctggaatgccgtggcacaatytcagctcactgcaacctyacctcccaggttcaagcaatgttcctgcctcagcctccggagtagctgggattagaggcatgcaccaccatgcctggctaatttttgtatttttagtagagacctcaaatgatctgcccgcctcgcctcccaaagtgttgggattacaggtgtgagtcactgtgcccagccatgtgtttagacttttaactaatctcttttttagtttcaagccttatcgtccgcctctrtagaccactsctgtgcctgtttcctgatccttccaagggccattgtattccctgtctgctgcccctcttttggattctyctgcacatttttttgttcatgcattcattcatttattgtttgattaatgacagggtcttgctttgtctcccaggctggtgtgcagtggtgcgaccacggctcacggcagcctcagccacccagatgtaagcgatytggttcccacctcagcctcccgagtagtaagtagctgggaccacaggcggtgcccaggttttttttttttttttttttttttttcgttkgtagagacagggtctcactgttgccaggactgctctgaaactcctggtttcaagtgatccccttgcctcctcccacttaggccttccaaatgctgggattacaaggcatgagtcacctccaggcctttttgtacttttaaaactctgcatcagtgtataaacaatgttattaaagtttatatgacttcagttacactacatggatcctttttcactcacggttgtgagatttatttctgttgctacatccagttctagtccatttgtgttaagtgcccagtgtgtttatctactgagggacagttatgttatttcgtgttcactattatcccatgctacaataaatatcctgtgtctcccagatasttagaagagtttctgcagggcacatgtgggagagtttgtttctgggtcatgaggtgtgttcatcttccatcttgctagatgctggcaaagggttctccagtgtggttgcatcaatttactcgcccagcagtgtgcagagttcctgttcctcacatttaccaacactagatagtaccagactttgatttttgccaatctgatgggtttgaagtggtacccctgttttaatttcatgaccagaaattcaaatttaatctttgctgtaggacaacagtaacccacttatgcctagtgttccattattagaacgctaagcatgtgggagtttttacatcatactgctcaaggtcatcgccaaggtctgatgtttttactcrtgcaaaaatttaaaaaattgcaacctctggcataaatgggttgagtgacacttttcctgtttttattgttggtcagtgatggcatatttgctggktttttttgttttttttttgaaacggagtctcactgtgtcgccaggctggagtgcagtggtgtaatctcggctcactgtaacctccgcctcccgggttcaagtgattctcctgcctcagccccctgagtagctgggattacaggcgtgtgccaccacgcccagctaatttttgtatttttagtagagacgggatgtcactatgtttgtcgggctggtgttgaactcctgagctcatgatctgcctgtcttggcttccctaagtgctgagattacaggcctgagccaccgctagcctatttattttttattttaaattttaattttctatatagagacgaggtcactatcctgcccaggctggtcttaatctcctgggttcagtcaatcttcccaccttggcctcccgaagtgtcagaattatagatgtgagccactgtgcycagcccagaactgatgttttctaaatgctgggtgctgagaaggatgtgtggctggcagtcttgactgtgttatctgtctttaccaggccagtaacttctttggtctggtcatcaagataatctagcatcaccagcaagcatgcatggagaaggatgggcccaatgtggccaagatggtaacgggaccagtagagagccctgtagaagacatctagatattctgccctaagagcccggagggccgggctgtctcatgaccctctgacgtgctgacctggactctggcagaatgtgcacacacacagtcacacagcttcstggcttgcgcaagtcccaggagggcggtgccagccacaggcttttcccattcgagggttggaagcgtatcatcaaaccacatcagagtgctgggggccacctgccacccattcccaacccactcagccttcctggtgtttgggacatgctttgctttggcagtcaagacagcagaacaaatcaacttttaaggccttgtcactgatagtacaatttccattatttttcatccaaattaggatacttctgaaaatagaaatgatgactctgggatgcaaacgttggctgtcctatgtataaggagatggcttttcacgctcccagtgactgaggaagtttctcccagatggcgctgctctgagcctggtgcagggtaggcactttcaaaagagtgtctccttgtatcttccatcagccttgcgagatgggtatctgttcccagggccccaagggaggaaaacaggacctagctggatccaagagctaggcctttctttttttttttttttttgagatggagtctgactctgtcgcccaggctggagtgcagtggcgtgatctcggctcactgcaaactccgcctcccgggttcacgccattctcctgcctcagcctcccgagtagctgggactacaggcgcctgccaccatgcctggctatttttttgtatttttagtagaaacggggtttcaccgtgttatccaggatggtctcgatctcctgacctcgtgattcgcccrcctcagcctcccaaagtactgggattacaggcgtgagccagcatgcccggcccagagctagkcctttctgtggctggccttcgcgtcagcctcaactaccctggtgtaatctcgcctgcggttgaattagggaaccgccgtgttctgcaagctggagaggcagaacactaatgagcagaacactaatctcattgcaatctcaaaggatctctaaaagcttttataaagcaggcccaaggtcctttggtatccgatgcagacgtggtgaatgcattggctctgtcagcatctgagcaagtcagtaacagaaatggggagtaaaagctttcagaactttccagaatattgactaaattgtcttgtttacaaccaacaacgacaacaaaaaataactgctgagggccttcgtagtgtctgctrtttcaagtgtacagtagtcattttgtctgcaggatgtggggttgctgtggctgaccttgtacaatattccactcataggtgtcttcaggcctatggagagcagcttgcgtgggctgggcctgcagtacctggtttgcatagatgattggcaggtgggcagcacggggaaggacctgtgagtggccaacctggttcaggtgagggaggtggagtggggcttctctgcttcccctggttccctggaagcctccaaggctggtgagcatcactgctgcctctgcacacctgtgtgctgggtgggttttctgacaggttttcagttgcttcggggctacagctgcagggagcctgctccatgggacagatgggcctctggtgcccgttcatcaggggactgatgagaccgaggcctgagagccctttggattttgtttttgtccttaatttaatcataagccaagaatctactaaacacagttccattaggggcaaagacgtaacacatcagaggccacagcaaggctgtgattcatactcaraaaggaaaggtctctgggtcacaacagagcatagttgaggtcagcacactcccacccagtgcagggctgctccagcattgaggtgtgtctggcaggttgaagtaggggaagatgaaactcgccgaagtcttgttttgtggttgcacttaagtggtcaaaacttcaggagcaactgccgttattagcggtgagtgccaagactagtttttatagaagagaaagaaacaaagtactctgggaaggtcttactgagccttcacagtctccccacctttccactgttcccgtgctcttagccgctctgctggcctataaggcacagtcttcatttgtggcttctggcaaaatgtaagcacttgacttttgtttttgttttgttttgttttgtttttttgagacggagtttccctcttgttgcccaaggtggagtgcaatggtgcgatctcagcccactgcagcctccacctcctgggttcaagcaattgtcctgcttcagcctcccgagtagttgggattataggtgcacaaccaccacgcctggctaattttttgtatttttagtagaaatgggatttcaccatgttagccaggctggtctcgaactcctgacctcaggtgatccacctccttggcctcccaaagtgctgggattacaggtgtgtgccactgtgcccggccaactttcaattctttagagctgactatgagaggagccagcagtatagccacagcaccaacgaatgaggaagagcaaaatactgcatgacagctttgctaagaattctttcactttttttgtctatcagccaggagctagcaacttggcttatttggaaattttaagtgtacatatcctgtctccttaaatcctttamagatttaaagtgcagtctacctgagggctctgtgaccatgtaagaaagctttttctttctttttttttctctgagacagagtgttgctctgtcgcccaggctggagtgcagtggtgtgatcttggctcactgcaacctctgcctcctgggttcaagcaattttcctgcctcagcttcctgagtagctgggactacaggcagcaccaccatgcccggctgagttttgtatttttagtagagacagggtttcaccatgttggccaggctggtcttgaactcctgacctcgtgatccgcctgcctcagcctcccaaagtgctgggattacatgcgtgagccattgtgtccggcctttttttttttttttttttttttttgagacagagtctcgctctgttgcccaggctggagtgcagtggtgtgacctcagcttactgcaacctccgcttcctggattcaagtgattctcctgcctcagcctcccaagtaggtgggattacaggcacccaccaccgtgcctggctaatttttgtatttttagtagagacaggagtttcaccttgtttagtagagacaggctggtctcgaactcctgacctcaggtgatccgcctgccttgacctcccaaagcgctgggattacaggcatgagccactgtgcctggccagaaagccttctttattgagcttggtggcagcccaaaactgattctttaagggtgtcaggacttaacacctcctgtgacttagccgcacctcctctcctttgactttcattccacctccttccaggatcgcaaggtccctatttgtcctggaaacggcttcaaggtagtytagggtgccgtttgccgggggaggaaggtgctctggttgatagagtcgcctggccgcacactctttttggcacataacaacgttctacagagccggggtggagcgtgctttctcataagtgctctgcaggtttggagagagaggatatgaggagcacccttttctgttttttttaacmcaaagattagcttggaaaaggggcagaggggtgcactggaactcaggtctgcctaagcagcacagcagaccaaggtctagagatgacatctgctcgcagctgttcttccaccagcccgcatcctggaaaggggtcttgtggcacacaagagttcacatccttccctsgtgaaataaggactttgtgttcatcatctcttgtaagaagcagagcagaaagcacagaattaagaaataaaagggaagtgggtgcctatataaagggaagtgaaaatgggttgctgtcccatgcaaagaccctggaaagctgttaacagctcagcttgtcactttcaccatctgcatttgtccagagtgattgagatttgcgttgttgtggagagaaaggcgcctgttgcacaatggagtgagattgccactgctgtcaggacctctgtgtttggcttgacactttttgagttctcagcagtctcgggaccctcaagagtggaagcatttttggatgttaaatgctggggttaattgaagttaagagcttgttttactgggcatggtggctcacacctataatcccgacactttgggaggccaaggcgggcagatcacttgagtccaggagtttgagaccagcctgggcaacatagcaaaaccccatctctacaaaaaatacaaagctgggcgtagtggtgtatgcctgtagtcccagctccttaggaggctgaggggagcagatctcttgagcccaggaggcagagtttgcagtgagccatgatcgtgccactgcactccagcctgggcaacagagtgagatcctgtcttaaaacaaacaaaaaaaacaaacttgttttcatttaractcttcctggcgttggggacctattggaataggtttagtgtgaactgagagctagaagtgttagaggagagagggagggaacagagcccgctggagcgagtgcccttcctaccttatcactgcatgccaggcatgtgccggcgctttggtcctcctcatttcattcttgactgccacctgagacacgatggttactagctccattttataggtggtgaaactgaggcttggggaaggtcagaccccaagggtgccatttagtcagtggcagagccagatccaaatgcaggtctcctgactccaagtgcagggctcattttatcgtccggttgcagcacgctggcggccccttgagccccaacctggataccayaggggaggagcagagaagccaggaacaccacagccctgggccaaggtgcggggctgaaagaacttcccagcgctcagcctgggactagtggaatgggctgggccctggggctggcagcggtggccccggggagcctgggaatgagtagggagcacagggaggtgtgggagggcctgggaaccatgaaaaggagggcgggtgcagggaagtcgcctgctagtgaagtggcgagggggccctgtgggactccagggaatggccacggcaggttgtcctccaggagttgagagccactggacatggcagctgccwgtgttctcagccaccacagtaaccaaagaaatcttggttttaaaattcaagttgccatggaaacgctcccatcctcgacttggcttattatttaaaataacatctctacagcacaaagcccccgggtacatccaaggacactgctgtctgcccacgagacatgctaacctcacagtgtggaggctgtgtgggtcactgacatgcatggccacgtgagacgctgcctacccacgagtcacggaaaaggggaagattattaagaaagtcactaggggccaggtccagtggctcatgcctgtaatcctagcactttgggaagctgaggcagttagatcccttgaagccaggagttcaagaccagcctggccaacataacgaaacacggactatactacaaaaattagccaaacgtggtagcacaggcctgtaatcccagctactcaggaggctgaggcacaagaatcacttgaacctgggaggtagaggtttcagtgagccaagattgcgccactgtactccagcatgtgccacagagcgagactcccatctcaaagtcactagggaggaagcctcattggtgggaaggaagaccaaattggaaatgctctgaggaatcattaaaacaaatgtccttttatcagtttggtggctcagggcctttagtaatactgccaactatttttcctagaagaaacaaaactgaaataataggaacatactcacttttttttttttcttaaaagtaagggtatgttgtgaaaaaaagtctccccaccgtagtgaccgactgccgtrcatcttccttggcattttgcatgtagtggcaggagtgttcctacatgtgtagattgctgagagggtcagatgcttatggtcctcagtcacccacagcttgctttttccccacttaacattgggacttggggcatttttactctgttaatacaatagaattcacttcaactagttggttttttacttttattttattattattatttttagatgaagtctcaatctgtcgtccaggctggagtgcagcctctgcctcctgggttcaagtgattctactgcctcagcctcccaagtagctgggattacaggcatgcgccaccacgcctggctaattttttgtatttagtagatacagggtttcaccaccttagtcaggctggtctctaactcctgacctcaggtgatccaaccgcctcggctacaggcatgcgccaccgtgccccaccaactaaytgcttttttaatggttgcttcatattctatttaaccacttaccgtaatttaacagttactctgttattggatacttgattcatttccaggacatgcagatttagaaactggtgggcgttgctggttgatgtctcggtggttgtgcccacccaccccaggcactcattatcatgccttccgtttccccacttcctaagccctgcaagaagtgccaaactgtccagcccttgccaatctgatacatgctgaatacctccttgattttatctgcacctccctgaggttgaacttattttactttattttattttatttttgaggcagagtctcactgtcacccaggcaggaatgcagtggtgaaatcttggctcactgcaatctccacctcctgggttcaagtgagttgaagcaattctcctgtctcagcctcccaagtagctgcgattacaggcacctgccaccacacctgggtaatttttgtatttttagtggagacggggtttcaccatgttggccaggctggtctcaaactcctgacctcaggcgatccacctgcctcagcctcccaaagtgctgagattacaagcttgagccaccatgccggttgaacttatttttatctgtgttggccatttgtagtttttctattatgctggttccatttttctgactttgaagagccttttgtggaaacgaagcctaaagtatatgtgagtactgctttgtttcgtcagtttttgttttaaagagacttttcagtgtaatgcaagcattttcccttgaaggctgtgtttcctgtcaatcctaagctttcctccagcattacctttttaaaaaactttattttctatattgatggggtctcacaatgttgtccaggctggtgttgaacacctggcctcaagtgatccacttgccttggcctcccaaagtactgggattataggcatcagccaccgcacccagcctgtttttcaaagggcattgatttttttcataaaactttttaaattaagatctgtgggcctggtgcggtgcctcacgcctgtcatcgcagcactttgggaggctgagtcaggtggatcacgaggtcaggcgttcgagaccagcctggccaaaatggtgaaaccctgtctttactaaaaatatgaaaattagctgggcatgatggcacatgcctgtaatcccgctgctcgggaagctgaggtaggaraatagcttgaacccaggaggcagaggttgcagtgagccgagatcatgccattgcactccagcctgggggacagagtaagactccgtctcaaaaaaacaaaacaattctgtgttgcatgtggtactttttgtgtgtgaggagtccagtgtgaagattcagacttcaggcagccacttgtacaagcactgtcctgttkcctctctggcctcacctaggtaacgstgattcctccacggaggatgtgcttctgagtggtccgttgggtgctgtgctgatgagcatcacccagcattttacgacacatgtgctgccccagagggctgggctcccgtcagagctcttttccactggctgggtgcggtggctcacacctgtaatcccagcactttgggaggctgaggccagtggatcacctgaggtcaggagttcgagaccagcctggctaacatggtaaaaccccatctctactaaaaatacagaaattaggtgcgtgtggtggcgcacacctgtaatcccagctacttgggaggctaagacacaagaattgtttgaacctgggaggtggaggctgcagtgagccaagattgtgccactgtaccccagactgggtgacatggcccacagaccaagaccctgtctcaaaaaaaaaaaaaaagcttttttccagagccatcttgctgtcctcatatatttattctcctagatgaattgttgcttaagcaacaatgaagtttaaattgttcttcagatagaacccctaggtgccaggcagtttgttaagcactgacaccgcagtcctgtgactttcatgacgacctgtgacctgtgggaggtagaacacctcacccacccgtgggagcccctggagtgactgacaggaacccctgcctcacccagctccccgcgccgcggctctccccagccctggatgcaggcgcccaggagacatgtattgcttttgttgagctgctcacttaggagggtgactcagagttcaagctggaaagcactggcttgtgactcatgagccagtgcaagatcaaacggctggggcatcgaggtgagagttttccttctcagaagcctcatctccgcagccggaagcagagcccttggctgactggaaaaaccagagaggccccgggagtgggtggatggccagcccagccccacctctcagcstcaacctccaccagcccacaccgagcttgtttgtctgtgtcctgtcgaaactaggactcctggattgtaacttttcttacatttccctgtcccctgggtcctccacttagggtgtaatcacacagacaggctcttaactgtttcatatcactcacttgggaaagtgtctcaagctgttctacaaatccatgcaaaggccgtttaaaaatagcagcgaaggccctggactcggtctygtccagcacagccccttggctctctctctgggctctggccgcctggcccccggggacccacacgaggtcatggcgtgctkcgggcagkggggcggggatcccatagacacctcagctccttagagttctccgcctgggccaggacgagcatgggggtccccactgatgcccgagacrgtgcccctgtgtgtgtgagccctcgacccacataacagagaggtgtcctgatgccctctgtcctctccaggtgratctmggatcyggcttccaacatgtggcagctctgggcctccctctgctgcctgctggtgttggccaatgcccggagcaggccctctttccatcccstgtcggatgagctggtcaactatgtcaacaaacggaataccacgtggcaggtargctgtggggctgcgtcctatgtatgtcccctcccaggtcggtctgtgcacactgactccaggaatgggaagccagccctcactgtggcccacagaacattgtcctggactgttgaaaaatggccctgaccytgagtcatgtcggctctggaccacgcctccctcctttgtcccataccccacgtgtgtgcatgagtgtgtgtgcwtgtgtatgaatatatggttgtgtgcacgtggaggtgtgtgggggagtaagtgagcttcggaagtgttcaaaaccagctagcccctgtgacgcccgccgtggcacagtggcagtttatcagtcccgcccctgattccctttgtctctgcccagccctgaccctcggactgagaaccaagaatgaggagtgagccatgttgagggctggagagggtctctgattgtcagcaaatgggagcagatcaggggagacacccactytgcccgtgtgtcactctgggctgttccccagtgccccccaacccttgggcccttgaattgggtagggyctctggttttccctgggttgggcttcgtgtgtgggcagcgtgcccatccaccgccatcccgggagacccttcagtcagtgggtgactctcttccaggccgggcacaacttctacaacgtggacatgrgctacttgaagaggctatgtggtaccttcctgggtgggcccaagccaccccagaggtgagtgcctgctcctctgcaccgctgtaatgtgagtggcaggcgttggtttggggcagtgggaagtgggagagtgaaggcctctctggcgtccgcagggctcatgctgcccagggctgccgacaccgcttgaggtacagtacttgtttcttttcatttttrtattactttctytttttattttattttttccttctcaagttattagtagagaagatgctggtgcttttttttggtttttgagagagtctcactctgtcacccaggctggagtgcagtggcacgatcttggctcactgcaaactctgtctcccrggttcaagcgattctcatgccacagcctcctgagtagctggggccacaggcttgcaccaccgtgcacggctaatatttgtatttttagtagagactgggtttcgccatactggccaggctcgtctcgaactcttggcctcagcaagtcatctgcccaactcggcatcccagagtgctgggattaccggcatgagccacccccagtgttttctattgtgcttctccaaggtgtctcagccgcagatgtgacagacaaggtctgggtccccactatgtgggcagactcaatcttgagtaatttaagggaaatctaagaaaagccagatgaggccaagtatggtggctcacgcctgtaatcccagcactttgggatgccaaggcaagcggatcacctgaggtcaggagttcgagaccagtctgaccaacatgatgaaaccccgtctctactaaaaataaaaaactttgccaggcgtggtggcgggcgcctgtaatcccagctactcgggaggctgaggctagagaatcgcatgaacccgggaggcagaggttgcggtgagctgagatgatgccacttcccacgtgaggatggggtagttaagttgcacracactgccttctgcacaatggggatgatatgagaaatgatgagaggatcctgggcagaggttgaggcaggagagcagggcaagaaacactatctggactgaataaacttatttaaaaatgagtttataatttgtggataaattcatcttaaaaaatccattacataagcctagaaagaagcgtacaatatcgcaagtcaggccaggtgtggtggatcatgcctgtaatcccagcactttgggaggccaaggcaggcagatcatttgaagccaggagtttaagaccagcctggccaacatggtgaaaccctgtctttactaaaaatacaaaaattagccgggtgtggtggtgcatgcctgtaatcccasctactcaggaggctgaggcacgagaatcgmttgaactcaggaggcagaggttgcagtgggcagagatctcgccactgcactccagcctggatgacacagtgaaattctgtccactcccaccctcccgtcccacccaaaaaaaaaatcaaaaggtgcattgagcaacagaatttccttttgttttatgaaattaccaaggacacctgtctgcagccttcttyggcatgtcttgtgctcatttccttgttaggggagtgtggcccagccaaagtggcctttgcagggattggggagggagttgtgggatcagagcttgtaatgaagaccttcctttatccagagttatgtttaccgaggacctgaagctgcctgcaagcttygatgcacgggaacaatggccacagtgtcccaccatcaaagagatcagagaccagggctcctgtggctcctgctgggtaaggccctgctggctggyggggaagcgctggagagaaagtgggagcaacactggagagtcttgggggattcggggtggggacaactctgacaaggcaagttatagaaactttytgagtcccagtttccatcagtacaaaaatcacaatccctctggccatgaatgatggcgaggattaggtggagtggcgggcagagcatccagcagattgcaagtccacgtgtacaggtggcgaagcagctccctttccctgacatgctggcccgtccgcaaataccaggagctctcactgctactctgcttcaagaaagcatccctttagtgtcagtgagctgtcttaattttgtcatttaattgtggtaaaatacacgtaacagaaatgtaataatcttagcaatcttcttttgttttctttttctttytttttttttttttttttttttggagatggagtcttgctctgtcacccaggctggagtgcagtggtgggatattggctcactgcaacctctgcctcctgggttcaagcaattctcctgcctcagtctccccagtagctaagactacaggcrtgtgccaccacgcccagctaatttttgtatttttagtagagatggggttttgccatgttggacagcctggtctcaaacgcctcacctgttgatctgccttcctcggcctcgcaaaatgctgggattacaggcgtgagccaccgtgcccagcaactattttcaagtgtacagttctgtagcattaagtacattcacagtgttgctcagccaycaccaccatctgtcccccgaactctttttcagctcgcaagacagaaactctgtccccattaacaccaatattgtagcccctggtaagccccactctactttctgtctctatgaatttgactcctagggacctcatacaagtggatcacaacagtatttattttctgggtgagctgtgttttttgttaagaaaaaaacacagccaggtacggtagctcacgcctgtaatctcaacactttgggaggctgaggcaggcggatcacctgaggtcaggagtttgagaccaacctggccaacatggtgaaaccctgtctctactaaaaagacaaaacttagctgggcctggtggcaggcacctataatcccagctactatagaggctgaggcaggagaattgcttgaacccaggaggcgyaggttgcagtgagctgagattgcgccactgcattccagcctgggcaacaaaagtgaaactccgcctccaggaaaaaaaaaaaaaaaaaccacacacacacatacaaactaatactacacattttgcagatttcaraaatgaaccsagttyccaggcagaggttcacggkggtgcttctcttgctttaaaagctgagttgggcaratgttgaggcaggagagtggggcaagtggctcatsacgcctctaatcccagcactttgggaggccraggtgggcaaatcacttgaacccgggagttcaagaccagtctggccaacrtagcaagaccccatttctaccraagaaaataaaagctgagtttgagccccaggagcgtcccctggtgttgagagatcagttgcctacaaggtctgaggtgcccctgtggccctttgaggggactgctgcagagggcccagcccggacatggcagcctcacccggtggggctcgttcctgcaggccttcggggctgtggaagccatctctgaccggatctgcatccacaccaatgcgcacrtcagcgtggaggtgtcggcggaggacctgctcacvtgctgtggcagcatgtgtggggacgggtgagtcaggctgtgcttccacagcgggtttagtgctgagasaccctgggccscagcttctcagtggaggggactttgaggacttcctgggactgctgcgagtcagaagtgtttcggggagactccragagtctggcaggcagggcctggcaaggctgctgcttcctgggaggtgcctgaaccaaggctggcccggcagagctgtctgaggggtggcatcccagcaaaacagtcagtttcagaaaawgtggtggaatgtctggcccctggtctggtttgtgtcatcgcatgttcctttttcctgcttggggaaccagtttggggcrtttccttatgtgtagttagcggggatggctccaccttaacaacaaggtggtggcacagaactttctgctccagctgcctgcagcctcgccttggttccgcagtagcggtgttcactggcggctgcagatccgaaatgcctgagggcttaaaaaaatgcatgggcttctcccctaactagttaaatgggaatcactggcgattctcatttcagagaactggtggtgtttttaagtaccttagggaagtttagcgtctgctcagttgagaatcagtgttctacccggaagggcactcgtagcctggtctggtatggacatgaacaggagagcctcctgtcttctcccggatctttgtgggyaggggtggggctggcggttattccctgcaagctgtgcttatctagggagcgtcccttggagggtttggggtctgggaggtctgctcgcaccacttgctgcagctgggggtgggtccacgagtggcctcgggcacttgggtagcacacagtggtctggagagctggtggtgcttctctcagaggttttcattasaggctgtcttttcagctgtaatggtggctatcctgctgaagcttggaacttctggacaagaaaaggcctggtttctggtggcctctatgaatcccatgtaggtaagtgtgtccccttggccactttctggccagatggattgtttgagcaattaaccatcatggctttatttrcctttataaactgggggttgagacagaggggctgctgagaggtgctagycaggtgyacaggmctctggcaggacctgcctggcgtccatgctgcaggcacgaggcttgccttgccccaggtctgcctcgcscagctggggcttctccgtgggggctgtaggttgactccgctttctcccgsgtcccatcagggtgcagaccgtactccatccctccctgtgagcaccacgtcaacggctcycggcccccatgcacgggggagggagatacccccaagtgtagcaagatctgtgagcctggctacagcccgacctacaaacaggacaagcactacggtaaggggcctggggcctggccacggygcacgtggaggctggggagctrctgcatccctcctcacgctgcagcgaagaggtcagggctgaggagccttggggtcccrgaactctaggatagaggagggggagtgatgccctcttgccaggagaagcagcacactctccactttctgcctgttccaccctgaactcagcctcagcccttccaaactggaagggaccaaagccctccttttacaagggagtggcgtgtcctggagtcttgaggtatcctggcctcttccgggrcctcgtgctcattgctccsttctcccatttctgagcttccagccccagccctgtccttagttcttcaggggagccttccttgagctcccctggcagggcaagtccccttagatgcagtcttcccctggaggccaccagaaatcagtgactggctgaccgtggcgtgccacgaggcackgtcactgccctccccaaccccgagctcggttcattttccaggatacaattcctacagcgtctccaatagcgagaaggacatcatggccgagatctacaaaaacggccccgtggagggagctttctctgtgtattcggacttcctgctctacaagtcaggtgcgtgctgatggctgatggcaatagagggtgggggtcgggaggggagcctgggtgccaggatggttcatgttgaccaatagggctggattgggcaggcaggkgaggggctggggaagagggctgtgtggggccttccatataggctcactcctctgtggaccagcctggcacctgactgtctttgtccaggtgttgtgccaacacacasaattccagaggcctctcccagagcctctgggctagttccttcccatccattrgmgtccagctcatacatgttctctgtgggaacgcccccctccctggtggctggccacgcctgccctcgccttcctggctttgcattgctttaccagcatgtttctgttataatggcaggccgttcgtgtttgcactggctgacacattttcttcatctttctctttgcaaaggcctagatcgtgcctcacaccagtggatgaacacacagggaggaccttgccctgggtagtgccatagggactccaaccaaggaatctggacagtccccatccccaagtcctgtcttagaaatcccttgctccagatgaacagtctttgctgactgcatctatcccattaatattttgctagattggaaacttgtaaaacaacagtttgacaaaggaagatgattctggcaagaaaaagtttctgtgaagatggcacttcttagcatagtcctcrcccttattattaaaagatgcatttccactttgacagtgatttccccacccgagagcctggttgggcagccctgagccccttagccagtatctttcccatcagctagcattagctgccaccagtcctcccttctcctccctcacctcttcagggtgtacctggagcagctattaaaactctttaagccgtgtarcrctttygacaaacccttacttacatggaatcccagtataaagaacagatgaatcagtcatctagcattaaatgttttatcaattagaatgtattagaaattctatttttaaagccaacaagcacattttgtaggmatctatttcaatatttactcaacaamtttgagtgtgttgggccttcaaaaatatatttaattccccagtattgtgggaccccccctggagcctcctggtggarcagcaggttccctctggaagctgtttctccttcccggagcatgaccagctgagtgtggggggtgctgtggggcgtgggacagtsgcccggtctcggtctcagccagttcttcccttttcaggagtgtaccaacacgtcaccggagagatgatgggtggccatgccatccgcatcctgggctggggagtggagaatggcacaccctactggctggttgccaactcctggaacactgactggggtgacaatggtgagtggctgcccccttcctgccaagaacagtgaattgtgagccacaccccgtggccatctcggctttctctgttctacccaccgcacagccttaaaccctggacctacggccaggctgtsagctcctcctaagtgccaggcagtcaggagttcccttttrctgtgrgggcagactctgagcagcttcagagccaacgcctgcaacagttcccacagcatcgcgccagatcctgtgatgggaagggtgaccgggcagggggcttgcccgtggaggtgtgccccacggctyyagaagccttgtggtgttgaggactgtgctagtgggccmacagyaggagtggccagggatgagtgacttaaggtcttttaaggatgagtctgactatattggttgacccttgtcacactttaaaagcaccttactttttattcccaggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatsggggtagaaatgcattttattytttaagttcacgtaagatacaagtttcagrcagggtctgaaggactggattggccaaacatcagacctgtcttccaaggagaccaagtcctggctacatcccagcctgtggttacagtgcagrcaggccaygtgagccaccgctgccagcacagagcgtccttccccctgtagactagtgccgtagggagtacctgytgccccagctgactgtggccccctccgtgatccatccatctccagggagcaagacagagacscaggaatggaaagcggagttcctaacrggatraaasttcccccatcagttcccccagtacctccaagcaagtagctttccacatttgtcacagaaatcagaggagagayggtgttgggagccctttggagaaygccagtctcccaggccccctgcatctatcgagtttgcaatgtcacaacctctctgatsttgtgctcagcatgattctttaatagaagttttattttttcgtgcactctgctaatcatgtgggtgagccagtggaacagcgggagacctgtgctagttttacagattgcctcctwatgacgcggctcaaaaggaaaccaagtggtcaggagttgtttctgacccmctgatctctactaccacwaggaraatagtttaggagaaacsagcttttactgtttttgaaaaattacagcttcmccctgtcaagttaacaaggaatgcctgtgccaataaaagktttctccaacttgaagtctactctgatgggatctcagatcctttgtcactgcctatagacttgtagctgctgtctctctttgtccctgcagagaatcaygtcctggaactgcatgttcttgcgactcttgggacttcatcttaacttytcgctgccccagccatgttttcaaccatggcatccctcccccaattagttccctgtcatcctcgtcaaccttctctgtaagtgcctggtaarcttgcccttgcttaagaactcaaaacatagctgtgctctatttttttgttgttgttgtgactgacagagtgagattccgtctcccrggctggagtgcagtggcgccttctcagctcactgcaacctgcagcctcctagattcaagcgattctcctgcttcagccttccgagtagctgggatgacaggcactcaccaatatgcctgggtaatttttgtatttttaagtacatacaggatttcaccatgttggccaggctagtttcaaactccyggcctcaggtggtctgcctgcctcagcctcccaaagtgttgggattacaggygtgagccactgggccctgcctgtaytttttatcagccacaaatccagcaacaagctgaggattcagctcataaaacaggyttggtgtcttggtgatctcacataaccaagatgctaccccgtggggaaccacatccccctggatgccctccagccttggtttgggctggagtcagggcctgkatacagtattttgaatttgtatgccactggtttgcattgctggtcaggaactctagtgctttgcatagccctggtttagaaacatgttatagcagttcttggtatagagcaaactagaagaaccagcaatcattccactgtcctgccaaggtacacctcagtactccccttcccaactgaagtggtatgaggctrgctctttccaaaagcattcaagtttggcttctgatgtgactcagaatttaggaaccagatgctagatcaaataagctctgaaaatctgaggaacattgtaggaaaggtttgttaagcatctcttaagtgccatgatgagcataacagccggccgtsgtggctcrcgcctgtaakcccagcactttgggaggccaaggtgggaggatgacaaggtcaggagttcaagaccagcctggccaacatgctgaaacctcacctctactaaaaatacaaaaattagctgggcatggtggcacatgcctgtaatcccagctacttgggaggctgaggcaggagaatcgcttgaacccgggaggcggaggttgcagtgagccragacagtgccagtgcactccagcctcggtgacagcgcaaggctccgtctcaataattaaaaaaaaaaaaaaaaaaaaaaggccgggcrcagtggctcaagcctgtaatcccagcactttgggaggctgaggcgggcagatcacctgaggtcaggagttttgagatcagccttggcaacacggtgaaaccccatctctactaaaaatacaaaattagccaagcatgctggcacatgcctgtaatcccagctactcgggaggctgaggtacgagaatcgcttgaacctgggaggcagaggatgcagtgagccgagatcacgccattgcactccagcctgggggacaagagtgaatctgtgtctcaccaaaaaaaaaaagaaaaagaaagatgcttaacaaaggttaccataagccacaaattcatraccacttatccttccagtttcaagtagaatatattcataacctcaataaagttctccctgctcccaaactgagttgattcattccatgcgcactgtctccctcacctccatcrtatacgcacctgcagctccttgcctgcttctagcatggagscagcggggatgtgctggtgagtgacaaggaattgtggggcatgtcgacatcagcttaaggctttgttagaaacacctgccttgcagtgtttgtgactgggaaagagctcagtgttttaatacacctcagatcaccacattgatcataactttgtcacctcagttcaatagtttctcctggattcttgtccaagtgagatgacaggtggacgtaacartgccttttcagtctttacctagmctctccagagaatcactccagaatagaaattagagtataggtaggcagtccaacctctgcatttaaaaaaaaaawttttgagatgggagtctctctctgtcacccaggctggagtgcagtggcatgatcttggctcactgcagcctccgcctcctgggttcaagggattctcctgcctcagcctcccgagtagctgggattacaggcacctgccaccacacctggcctaatgtttatatttttagtagagatagagtttcaccatgttggccaggctggtctkgaactcctgacttcamgtgatccacctgccttggcctcccaaagtgctaggattataggcgtgagccactgtgcccggctgccactctttttaaagaaagcagtaatttgccctcttttattgtgcttcagccatactgaagtgrtccacagaccaggagcacggccgtcacctgaragcctgttagaaatgctcatcagagtgtcagagggccagacctctgaaccagcatttgcatctcccaagaccccaggtagtttcccaggtacattcaagctcacaatacctttccagctgctccctgattagaaaactgcatgagaatttaggaatgcaacctcttgggcaccccatcagacctactgtatcagtctctgttcccagcaatcaggcaattctgatataaagtctgagaaccacagccttagaactgtttccaaaactgccaagaataacctagaatgtttgttaacatgcctgactcgccctcttcctcctatacacacccgagcccctgggaaatggctcagtagatggaagaaggggccctccctgcacttgcccacagggatccggaagttcccatatgcagatataaagctcttgctcccaagcattctaattgtttatggtcctagattcacatgggtcagaggctcctctgaggaaaacaaaayattgcaccattaggtcggatccaaatagactgtatgccagagatgctataaaattatattagaagtggggagtagagggtagtgttgccagagttaccaaacagaaatacaagatggccaactacttctgaattttcagttatgcaagtttgtttgttttttgagacagagtctcactctgtcgcccaggctggagtgcaatggcgtgatcttggctcaccacaacctctgcctcaacctcttgagctcaagggatcctcctgcctcagccccaacaccctccgagtagctgagaccacaggtgtgagccrccatgcccagcatcccctattatatctggcaaccttagtagagaagatacttagaaggaaaacaagctttcaaagagcttcagaatggaatgagagcgratacctttctacaactcagtgagtagaaaaaagcacatagctttatagatagaaaaaatctgagatcacccaaaccacacagctcaggaagtggtcccacaggtaatgaccaagtcaggaaagaagatttccrcaggccccactcagaccaaatctctttccagcaggttgttctgtcttaacgtgaactttggcagaattaaatcttagatttcaacacacagatttttaacaacctaccctgaaatctcaaaccaagttttgaggctttaattccttggaaaatactgtcgagtctagctcagtggtccccaagctttttggcaccagggaccggtttcataaagacaattttcccaaggacagagggaggaaaatggttttgggatgaaactgccacctcagatcatcagggactagattctcacaaggagcatgcaacccagatccctcacacgcgcaatcgcacctatgagaatctaacgccgagtggagctcacgtgataatgttcactcacccgccgctcacctcctgctgtgatgcccggttcctaacaggccacgtaacagaaggtttagtgccggtcctaggcctgggggtcggggacccctggtctggctgtattccatgtggcaagttatcttggctggtgacaaatgagtccagggctaagcctcaaatgaaccaattaactgaagtctccctgggcccaaactaattttggtgtcagtggtcacagcaagaaagtgtgcttacaacaatgcaaatccaacgytgcagctcgaaacaactcaaattcaatgattaagccaccatccacgatgggctgcagaagagtagactttatgagtacctgtagcattaatggcttctagaaagtaccraatgccctartacaccaattctcaactcgagggtccacaggcctccttgctgcactgagcacctcagtgagagcacatcacaagctctgctgcactggagtagagaggaaggtgaaaccccgagcagaagtactgttctgcccccaagccaatcacctgaagacagcttttgcctttcttaagacctgaatatataaactgataactttagaaaacaaaaactgctgggggaaatttttttttttttttttttacaattttttcctttttttgagatggagtctcgctctgttgcccagactggagtgcagtggcgcgatctgagctcactgcaagctccgcctcccgggtttaagccattctcctgcctcagcctcccgagtagctggaactacaggcacccgccaccacgcctggctaattttttttttttttagtagagacggggtttcaccgtgttagccaggatggtctcgatcccctaatgtcgtgatccgaccgcctcagcctcccaaagtgctgggattacaggcatgagccaccacgctgggccatcaactccattcttgagctccatcttttccacagtcaggcaggctttcaagcgaactgtacttgacaaatgcagagcaattaaattctttattataaaaatctcaaaaatgtccacctttactggagaccaatcttctaaaaggtcaaaagcaatcctgctgtttctctctgaaagctaaactcctttaaatgagaatasgagaatacccagaattttattcccagcctttgtgtggaaaaggcagtttgcattcttaggaaacatctaactgttacctaaaccataaatatttctatctactccattcaacccaattaaagaaaacaaaatgatgagaaaaataggagccgaacagaaagaaaattcacatcattttctactaktacgaacattcaaatggtgcttcaaattaaatacttttaattatcattctarccaggatcatactaagtaggatctcatgacagtcacatatgcagcracttcacctaaaccgkggcactgaatgctctgccatgagccrcaagcakcacagtgatcatcacccacaaggacaggttgctgggatgaggcaccctttcctttcatgtttaggttcttctcacctgcatttcactttcctwaaggtcccagccacacagcgttcttttagggattaaagtagtaggaaaaaaataaagagaacacaacatccatccttaaagaaaaaaagtaaatccactttatggtggacttcagctatggacaaatttgggatcagtgttctccagtctgaacatagtcttctgttacctgggagagagtggtcaggtaytgccagctcagggcagccaaargcatgacaaacgacaggtagatgggggagtagtggcttcgggaaatcagctgacagttgggaagattctgcgtccggatggtggagatgatctgccttgttttgctagaagatgggtctgagtcggggattctatgataaatctgttaaagacacaggaaaaaatgrtaagtgctatgtgctttacattttccatggctacttacaacaaccctccactggcaggtattttatacccattttaccaatgaggaaagggaggctcagagaacatgaacataacttacccaaagccatcccaatgataaggtggggatgtcagccccagctcatctcaaagcctgtcttcctgagcaaacaggaggcacaggtgtgcatactgcacccagaggccctcgagagcagcrgctgagccacaatratcttcacatccccagcacctcacagtgccaggcccaataaacgtcaccatagttcacgtagacaggcacagactaacatgacgaaagggaaatgctggaaagactgggcaaaagcagcttagaaacaagatggaacacgcagtacagaccacagcttgacaaagggggacaggaacagaagcagggagccgtatgaaccaccctggagtcctccctgtgcctccctccccactcctccacaagcctcccaagtatgtgcagaatccatctcttcccctacatccctaaaattactgcctgagattaggccctgagtgcctctcagatgagctatctcagtctccaacgtgagtctaagcttaaattcccaaatctacctgtctgctctacactgtcaccaaggagatctcaaacctctgcttgatgcctcagtggcaccagccctctcacctggagaaaaaaagcctgagctctgtaatgtgtagcgcaaggccacccatggtccagacctactgcacctgtctagtgtcaccagcccttgcccacctccctctctayagtctagtaacagttgccgggccaggcacagtggctcatgtttggaatcccagcacttcaggaggctgaggcaygtagactgcttaagctcaggcgtttaagaccagcctggacaacacagtaaaaccctgtttctacaraatgtacaaaaattagccgggcatcgtggcatgcacctgtggtcccccagctacttggggactggggtgggaagatcacttgagcctgggaggtggaggttgcagtgatccgagatcatgccactgcactccagcctggatgacagaacaagacsctgtctcaaaaaacaaacaaaaacaaaagaacaactgtctactgttgtttcgcccatgcgatgctgctgcacacctctgttccagtctcataccactccttctctctggaatgcrcctcccacgtcccttcaactggctcctacctaggcccccaagtctsaacttcaggattatgccttctagaaaacctgtctgcagctccaggttcagccaggagccaccctattgtacatacctttacctttccacttacgtggaaatggaccatctgtagttttcaccctgactacaccgcacctacttactcacctttttatctccagcctagccctgtgctggcacacagcaagcgtgcatccctggctaatttttgcatttttaatagagacaaggttttaccagtgttggtcaggctggtctcaaactccagacctcaagtgatccacccacctcggcctcccaaagggctgggattacaggcgtgagccactccacccagccaagacttttcaatacaagcatccataaagtraaatatatagtgatgagataattctattagaagtcatccttctgcctgcccatgttgctttactgcttgtcttagccttcctcctaaaagcagaacctgaggcaaaagcttgcatgcagccatttatttggaaacgagtggagaagtgaaacagaaggcaggaaggcctatcaaggatgtgttgagttggcttgatcttgagggaccttcaaggagccttatgaaaggtggccctgaggagcagagaggtggccctcacctcctctgggttgtggggacccacgtgccaggcagttcctgcagctcgtcagaagcccaagggcaggaagcgagaggtctctggagcagaaggcaaggtccagccctacttggaaactggttgctacagcagtggccgaaggccaagatgagtggcagtgacacacagggtctcacacactactcttgtaaatgacctgagtgccctgatgccatcaaaagccataaaataggcattcactacaatgaccctgagaatagtttctcaggtaagtaatggttttggtatattgtagatttttttttttttttaagatggtgtctcgctctgtcacccaggctagagtgcag

SEQ ID NO: 13252 - DNA, 187986 bp, Homo sapiens
  misc_feature (1)...(187986): n = A,T,C or G, or insertion/deletion polymorphism (see Tables 1-2)
gtataacatctggaaatttttctatctcccaaggtaattaaccccttagtggccccatttggtattcaagtggaaaatccaccgaagtttaaaatctaggggggatgcctaaataacagggccattcacgtacaacttttcacaaagaccaataacattgtggtataaactttgacaatcaagtcttatttgtaccgaaatccccaggtgatggaaatcaggacctggtttgggaccaggcctggctcagtgatcatgcctggacatacaagccctgtgagtacagatttggaccatacaagtaaagtgtatgtagtagccacaccaatgtttaattatttttatttttttgtgatacagtgtctccctgtgtcgcacggtgtagagcacagttgtgatatcggcgcattgcgagctccacctctcatgtgctcaccattctcctgcgtcagcctctcgagtagctgtgactacaggcgcccgccaacacgtccggataattttttttgtatttttagtagagacggggtttcaccatgttggccaggatggtctaaatctcttgacctcgtgatccacaggcctcggcctcccaaaacgctgggattacaggcgtgagcaccgcgcccggccttgttctggtttttaaagggaaagtggcttccattttaccataagtatgaaatatgctctgtgtctcaggccaaggaccttcccttctttttataggttacttaagtgttttgtttacttgttttccataactgggtgttgttgacttttacaaaactgaaagcttttctgctttataatttaatcgtttttwaaaataaattttaagcttatattatgaagtgcacataaatctatagattccatcttcctggtgcattgatctttgtatcacctttttctactctttggtgctaatgatgactttgatcttaaggtccactgtgtgtgatagtggtataaaacgcttttccttggccatcacttgcctctcctttcttttccttacsgtctttgtgtgtttatattttaggactgtctcttgaacattgctggattgtgtgcctttttaaagaaatccaatttgataatctctacctttttattattgattattgatctgtttgaattttttgtactgttgcatttacattttatactatttgtcttgctttttccatttttctcctagatcaatctagtttttaaaaatttcttgttttttttcgataggtttrgaaaacatacattcaattctattctttcagtagcctcccttaaaatcttactatgcagtatagccttaactaagtctaaagtgatcatgacctgtttcttccttctgagccatrcaaggaccttaatacactttcactcctgtcttacatgtcattgctatctggtattttggttctaatttttaataactctccaacttatcattaccattgttattgttttatataatgactgcctgctcatatttacccccakatttactattttatttatttaccttttcttggcatcctgtttctaggctgaattttcttcttcctggcagggcgaggtggctcacacctgtaatcccagcactttgagaggccgaagcaggaagactgcttgagcccaggagctctaggagtttgagaccagcctaggtaacatggcaaaaccctgtctctacaaaaaaatacaaaaattagccaggtatggtggtacatgcccatagtcccagctactagggaggctgaggtgggaggatcgcttgagcccagaaggtttaggctgcagtgagttgtgactgtgtcactgcgctccaccctgggtgacagagaccctgtctcagaaacaataacaaaaaatgttttttctccctgaaattccttctttagtagtttcttcagaaaggactgttaatgttaagcccactctgtttttccaaaaaaaaaaaaaaaaaaaagtctatgtttcctcaactctgaacaataatttacaggtagaccagatgttacagtccctctgccacggccctctaaccccatctctccgtttcttctagactaccagtgtctgctcctccgtgcctgagggccagaagtgttgagggctgaatgcctcctgaagcagccttgacaataactgacaggaaggagtaagtgtagaaactcycctgctccctgacccaagagtgggaagattcagaggcatggatcttacattttcccagacttccctccagaaggaagctttcttgtccacttggtggctggcataataaacatcttttattgactgctttccctgccccgtatcacattcccacttccctgccgatgcttcctgtcctcccaaatcaattatctacactaaaatactcagggtctgcttctgggacttcaaactaagacacygcatatagaattctccacaaatggacttcttctctcagcacttctctttggatcttctaattctatcatgtttcttaattctgcctccatttttttttttttttttttttttttgagatggagtctcactctgtcacccaggccaaagtgcagtggtgtgatcttggctcactgcaacctctgcctcctgggttcaagcaatcctcctgccccagcctcttgaatagctggaattacaggcatgcaccaccatgcamggctaatagttgtatttttagtagagatgggatttcaacacgttggccaggctggtctcgaactcctgaccacaagtgatctgccttacttgggctcccaaagtgctgggattacaggcataagccactgtgcctggctgctcttccattttttcatctctatatttgagtgatttctttagaaccatttttcagctttttttttcccaaaaatatctggtgtttttgaatttttcaattaatttactatatacatttcttaaagttctttttttttttttttgggacagtatctcactctattggctaggctggagtgcgcgattatggctcactgcaacctcracctcctgggctcaaggggtcctccctcctacctcagcctcctgagtagctgtgaccacaggcatgcaccrccaggcccagctaattttttatttttattttttgtagagatggggtcttgctgtgttgtgtaggctagtctcaaattactgagcacagacaatcctcttgccwctgcctcccaaagtgttaggattacaggtgtgagcctccacgtctggccttaaagttctttttcaagttttcctcctgttctttcttttttttttttttttaacggactctcactcggtcaccaggctggagtgctgtggcatgatcttggctcactgcagcctccgcttcccgggttcaagcgattctcctgcctcagcctccagagtagctgggactacaggtgcrtgccaccatgcccagctgatttttgtatttttagtagagatggggtttcaccatattggccaggatggtcttgatctgttgaccttgtgatccacccaccgtgagccaccgtgccctgccttgaaaaaagtttattctttgtaaagacagggtcttgctgtgttgcccaggctggtcttgaactcctggtctcaagcgattatcccatctcagcctcccaaagtgccaggattatagacatgaaccaccgtgcctagcctctattataattttaaacactcatttttttctttttatctttctctgatgattttattatctgaaattcttagggatttaattcttgctcatggtagattgttttctcaagtgttgaaaaatttgygattttgaattcatcrtcaagagagctttatttgcatgagtgcaaaggatgaaaattctagactgggcgtggtggctcacgcctgtaatcccagcactttgggagaccgaggtgggcagatcacgaggtcaggagtttgagaccagcctggytaacatagtggaaccccatctctactaaaaatacaaaaawttagctgggtgtagtggtgtgtgcatgtaatcccagctacttgggaggctgaggcaggagaattgcttgaagccgggaggcagaggttgcagtgagccatgattgcatcaytgcactccagcccagcggacagtgcgagactccatctcaaaaaaaaaaaaagaaagaaaagaatattctaaaaaaagacttaattccccccsccaccccaccccaaaacaagtggagacaggcaaacttccttatcttctaggttgggggatggatttttttcctggtccactgtttggaagatgtttcccttcaaactttcagcttttgcagggatctccgttctagttctccctctgggtcaggcccgtagctgcactgcccattcttgtaatgtgcggcctccagtctggagggttcccagactggcctacgctaggccacccatgggcctaccctgcctcatgctcatttaggctcctcttcctcattgaccctttaagatattccttactttcctcccagatcaactgtggatttaaagaacatttgttgtatttagcacagcatttaaagatattttgtaatgaaagggttttcagattagttatttagtttttttaaataagagctggaagtggaaatcccgatggccttttcttttcttttcttttttttcttgagacggagtcttgctctgtcacccaggctggagtgcagtggctcgatctcagctcactgcaagctccgcctcccgggttcacgccattytcctgcctcagcctcccgagtagctgggactacaggcgcccgccaccrcgcctggctaattttttgtgtttttagtagagacggggtttcactatgttagccaggatggtcttgatcccttgacctcgtgatccgcccacctcggcctcccaaagtgctgggattacaggcgtgaaccaccrtgcccggccccccaatggccttttctactgtctcatgctgattctgcctctggtgccatttttcttccttgggagtgtgcatcttcctctcctggggcggtaaagggagtagcagagtgcgaggtatgtgggaagggaggaggttggaacctagtggtttctcaaagtcttagggcaggaggtatcatggagaagcagtgaggaggtcttccatacccagacatgcctcagggtgcttgtctcagtgcctggaatcccagcacgagagtcatcttccccccaccgctgcccattgcatcagttacttattttagtaggaattagtttagcagatggtgttgagaattaggcttttgggaatgggaggctgggaagaagaattgtgtgtgtgtgtgtgtgtgtgtgtgtgtgtgtgtgtgtaagatcagggtaccagaagtgggtggaaatgtccttgagaattagaattattagaatgtagcaacagtagaagtattagactcaaaccatcactccccaccttcaccattttacaaaggcttaggcttgtggccaagaccttcatctttagccgatccattcaaccctggccaggatccaaatggactgtttttgtcagggccaggaccggatccttcatacctggggtgcataggaagtgttagtactccccttcctccaaacacagcagcaaaattggctcaggttgaggtgtttttctcaacttccctggagtccagccctggaagctggatcaggaagctgtgttgttctactgtgattccccctggcctgtatcagcttgccctgaaacaaccagcattcctggttatcccacacaggtggggcactctaggaagaccagggatcaagtgtgggggtgtagggatagggggtgtttggggagggcaaggcagttaattaaggcagctgccaggaggtctccctccaaactctacaaagctttatcagcttggaggtacttctaataccatttcctttcattgtttccttttggtaattaaaaggaggccaatcccctgttgtggcagctcacagctattgtggtgggaaagggagggtggttggtggatgtcacagcttgggctttatctcccccagcagtggggactccacagcccctgggctacataacagcaagacagtccggagctgtagcagacctgattgagcctttgcagcagctgagagcatggcctagggtgggcggcaccattgtccagcagctgagtttcccagggaccttggagatagccgcagccctcatttgcaggggaaggtatggcctttggaaggagagctggctcagttgtgggaggaagatgcaggactgactgatccctgctcctggggagctggagttctctgtcgctggactagaagggctttgtttggaggggcaattcaattcagccagggatgatcctaatactccctcctccacttgcctctgagggtcctggggctgcttttcttcatgcagtgggttttactgtttgatagtacttcactcaaatgagttggaatgaagtttgccctcacctctgagaacctgggagcagctgaatgtacctgcgtgttaggactgggaggggacacctgcttggagaccgagacctggcagtatctgacatctcagtgttccttccacagatgtatcacagattggcttgatttcacctttggctggatgggaccttaggtaggaagggagtcacccccagtgaatctcaggcagcagattctgcacttcatttaacaacttttcccgaggagaggggctacagcaggggctctaagtgacttggggtacgctctgccagccaggatgaattgtccctctcttgggggtcacacagtggggaagtctgcctgcatccagggccgctggactcctgtccattttttcagatgaactcagcaaacatttgctggrcatctcctgggtgctaagcatcttgccaggtgctggggttggaggcaagggagacagcctttgctcttgtgaaggcacttgtggtacagagtcaggggccaacaagcaaaccgtcaagttggtggttcctgagcattctctatgtctgggctgctgtggtgggcacacaagtgtaagacggttcctactcgccagtttggatgcagaggcaggaaggaatgaggtgtgtgttagctcccagctgcttcaggaggcagggatgtgaggcccagcgggcctggagggaaggcagcgttttcctcctgtcttgggcctgggactgctgtctgtggaaaggtgcccacaggtcccagctcacagcgattgttacccttgggcctggcactggccaggggttttttcgggggccagaagtccatgttcaaaggggaaaagrgggtcacgaggatcaatcttttctcctgctttaaagaaatgtttttgctactgcatgccctgatagtygccacaccagcagccgcctacctgggcagcaatgaccagctcacgtctcttgcttctttgcagatgattcctgccagatttgccggggtgctgcttgctctggccctcattttgccaggtaggtacaaaagggcctccatttctcattcctgccccagggccatctggagtgacacctttccgggaatcagcaggtgtgtctggagctcacctgtgtgcccagccctaacttaggctgttggttgcctcctgtgaaggttctgcggagttcccacccttgacttgtattccagagaccaggtgcctgcaaatgccatctcctgttggggaattaagaagcataaaggtggcacagaactgtcctatattatgggggcacaggatgaggaggaaggaatccaagacttggatggattattagttttcgataagattgtggaggtcaccttgttgaacctcccatggtacaatgaagagactgagggtcagagaggagaaatgactgctccaaagtctcctagagccaaaatcagaggtcagtcttcctgggttccaggccaacaccctttccactgcactgcatcatactgctgcccttcccttgctaagattctgggtctgcaaatggcgggaggggacttttgaccttgggcgctttccacttagatctctcaggtcagcagcatccagctactgcccacaggtgagtctgggaaaaaaaatacacatttgtcacactctctgcatcttcctactaggtgggtcttttgccggggaacccagaacacttagagatttactgctgtatttccccacctgccgacacacacacacccatagtcagtgaaggagttagcctgtgacgccggaggakttcacacttcagagagtctatgtgtcaggcacacagtctgatctgtttaaaatttaacatgcccaagacatgctagtagatttatgtacaaagatgctcactgcaatctatctataatattaaaacatggaaaaatgctagaaacctaacaatagagggctatactatagacattcagatgcaaaatataatgcagccactaaaaaccgcatattggaagtatatacactagcacgacaaattgtttacaatctattgagaaataaacagaggttataggtagtttgcacaagttggtcaccaatttataaaaaacccacagctgtatatatgctatacaacaaaatggaaagatgaacattgaaatgttaactctaatcatcgctgaatgttgggttacagatggttttaacttctttgtcttttcttttctttttctttttcttttttttttcgagacagagtctcactctgtcgcccagtctagagtgcagtggtatgatgttggctccctgcaacctctgcctccygggctcaagtgattctcctgcctcagcctcaccagtagctgggattacaggcgcccaccactacacccggytagtttttgtatttttagtagagacagggtttcgccatgttgggcagrctggtcttgaattcctgacctcaggtgatctgcccacctcggcctcccaaagtgctgggattataggcgtgagccactgygcccggccagcttctttgttttcttctgtatgccccaaatttttaataatggacatgatgacattttaaatcagtaagtaaatgtcattgaaactaatggatttcctgaaaaactgttccttagttattgctgtgagtctggggtcatatctgggagctgaaagcaacagctttagtctcatttaggatggaaaatacctccccacagcccagtttctatcagaggcagtctaatttctacgaggccagagaggtttgagctgatggtcccagttgtgccctgagatcaccagcccaacctgtggcctctccctccagggaccctttgtgcagaaggaactcgcggcaggtcatccacggcccgatgcagccttttcggaagtgacttcgtcaacacctttsatgggagcatgtacagctttgcgggatactgcagttacctcctggcagggggctgccagaaacgctccttctcgattattggtgagttctgggcactgcagggaggacttcagagggagggctggctgagctyagccctggtgtgggggaggattcctgctctcaggacagtgtctgagcggaaaggtcactgctgagaacaaggagaggaacagcctttctgtgacacgtagcccctcttggctttccccgggtctctccccacgggagccgggtgggatggatgaagagagtcttcatctttggtagtccactgtgtccgttgctctggggcccggcgatgccctgggaactccacagcatcaaggcaaatgatgaactagagaaggtgctttggaacgtgtaaaactccttgccagagagaagactcgttgttgttttcttggtggcctgtggatcagaacatcagcttatgctgaggacttcctgtattcctgcagaagggctggtactgtccctgccatgtccctgcatccccacaacagccctgggrtgtagctgtagtcatcccagttttaccaatggagaaccaaggctcatgaaggttgcatgatccttccaaggcctgacagacaataaaaggtggagctgaggccgggcacggtggctcatgcctgtaatcccagtactttgggaggcyaaggtgggtggatcacctgaggtcaagagtttgagaccagcctggccaacatggtgaaaccccatctctactaaaaatacaaaaattagccgggtgtggtggtgtgtgtctataatcccagctacttgggaggctgaggcaggagaatcgcttgaacctggttgcaataagctgagatacactccagcctgggcaacagagcgagactccatctcaaaaaaaaaaacaacccacaaaaaacaaaaaaactggactaagcaggccaaggacagagcccaaggccaaggcttaatctagaagagggctcagaagtgccccactcaagtttggtcaaggagggagtctttggcaacacctggacacttacctgagatctgggctgtagggctcctggggtcattgctccatcagtcagcggggactgacacagggtcctccatgtgcccagcactgggctaggctctgtctagcacctggctatagctatgagctccccgcattcctgctttctccctgaggccatctttgctacctgccctgactctgctgggaaacttatcacatatgacttctgggcactgccatccttcccactcctccatgagctcctcagggacaaggagcatgtctcactcatctgtgtttcctggtgcttagctcaccgagttctctgttgtgctgaagattatgtatttatttatttatttttgagacggagtcttgctctgttgcccaggctggagtgcagtgagtggtgcgatcttggctcactgcaacctccgcctcctgggttcaagcaattctcctgcctcagcctcccaagtagctgggmttacaggtgccaccatgcttggctaatttttgtatttttagtagagacagggtttcaccatattggccaggctggtctcgaactcctgacctcaggtgatccacccgcctcagcctcccaaagtgctgggattacaggcatgagccaccatgcctggtctgaagatgtttacagagtgtgtgtgaggagccctagggaaggagctttgattggccagagaagacaggggagggtgctgcatgtggtggggacagcatgagaagtggggaggctggaaggggcatgtactcctgacatggagccctggggaggtcagtgtggctggagcagcagttgccaaactccaggctgcatcaggaccacccggagagctgtgacaaacagatcactgggccctgcccctggagttctgactcagtagaaatggaagggggcctgaaaatttcccaactgctgctgctgctyttagrgtgggtaaccagactttgagggtgcgggactggaggagagtaggctgggaggctgtaccatcgggtgaagctgcagtgtagggtcttggagtctgatggggactttgagtcgattccgcaggctgtgaggaactagtatagggtcttgtgcagcagggaagtggtgagaggaaactggttctttgccaagatggtcctgaaaaggagagaggtaggaggcggaatggccttggccgtggtaaccagggaggtagtgaaaaggccagaggcgccccagggcatgacaaataagaaagtcatcytcaacactgaccgtgagggtcccaacttgcttcagaggctgcagctggggaggagctggaagagcagctggagagaacccctgaacccctgcccctgggaagctgaaggctcatgccctccctaccttggtgaccccagattttatttaaagtggattttcccattttataaatcacggcagagctgatacagaccaytacctgtgatggctctggggttgtcagtgggaatggagggttagaagtgaccggaagaggccgggtgcaygggtgcaatggctcatgcttgcagtcccagcactttgggaggccgaggggggcggatcacctgaggttgggagatcgagaccagcctggccaacatggtgaaaccccgtcactactaaaaatacaaaaattagccaggcgttgtggtgggtgcctgtatcccagctgctcgggaggttgaggcacaagaatcacttgaacttgggaggtggaggttgckgtgagccgagattgcgccattgcactccagcctgggcacagagtgagactctgtctcaaaaaaaaaaaaaaaaaaaaaaaaaaaaaagtgaccagaggaagattttgatggagacactgcagtgcccggggtgggggcgggtggattgctgtctggactccataatctctgttagttcagctctgctctggactccctgccccgagacgggctggtaaacaacacatactaataccttagtcccaggcacagagttcatgttctgggctcagagagccaagtcagcatgttgaaaaagctcccttcccctatttgagcccaactccagacctctccccaagtcagggtagccctaccaggtggggacatgtagcgtgtgctggtgcctctgggctgtctcggtcacctccttcaggaagccctcttgcccattccacccgtccagcactgggctcatcaactcgtgctcactggtcggtttccgtcccacagaactgggtggctctgcccccagcaggaaatggaagcacagacagagccagagttgcagtcggaaaacccgtgttctcctctgctctccctcttcactgagtgttccgagggcagttgtgctgtcttagcctccaattcctcatcttttgaaatggaatctcrctcgtgttgtccaggctggaaggctggattgcagtggtgcgatctcggctcactgcaacctccccctcccaggttcaagcgattctcctgcctcagcctcccgagtagctgggattacaggcgtgcgccaccacaccctgctaattttgtgtttttagtagagacggggtttctccatgttggtcaggctggtctcgaactccygacctcaggtgatccgcccgcctcggccttggttcctcatctttaaaatggagatactgtgagcatcaagggagacaggttatctgaaaatgtgactgcttagccaagctgagttattgaaagcagccagcttaacatggggtgttcacttggaatcgccatgcagagacaggggctgctgggcccccaggcatttccacgaggtcagggtcacttgagtttcawctccccctcataatccacacaggtttgtgctagaggtctggcctctcgggccaccgttttctgggtttcagtggtcacagaggaatttgaagggccatggaaggcctgtctacctcaaaaccccttggtgggattccccaccaggtcattattcttttcttataagctgtttgcccttgtgaagtgtccattttctgggagattgtttgcctaaacaaggttatggatcaaacacactttaatgtwaattgatttcattttcaccaaaaccgtgctgctaacatcatagagaatgggtggctgctttgcctcttgttggtggtggtggcaggtttggggtgtgtgggagaagaggaagaattagaggggggtgggctggcattggtgcatcagggcagccaggggcactgggtcaggggagggagcccaggacttgggccctgcagtttcagtttccgtgcacatgcctaccttcttttccattgttctgcaatgacatcctgtctccttgaccgtaaatcgcacatccacattcctcccgagtgcctgtggaccttattcatatcctgggaaaagtgtttatgtacgcacacgaagggccacctggtgccaaggcgaggcccctgtccttgattctgtctcctggtgaggcaggctccagggttcgaggccaaggcgacacggctgtttgccagacagcacagaggccagagagagactatgggagtcctggttcctgctcctccgtagagactgctcttcctaagctacggctgcwggatctggctctcatacctgccaagagagagccatcaacaaccaacagcctgctgagtcacttcccccggggagccttagtttccgtggcatggtcagaccagacccctgttctcagtttggagggagggtcacctgcaccagaatcacgggcatagaaggtagagtgtttagtggaaatgcagatgagtgagttccacactaaagcctaagagagcgcccaggtctgacggtagttccagctcctggcctgcttctgaaggtcccaggattcctctcactctaatatgtgggctaggagcttactcctcactcagcgccttaatcactgcgttcagcaggcctggtgggagcctctgggagagcttcgctggcttgtcttgcctctttggggtgacagccagcctctcttttcctaagagttatagaaagtgctaacctggaggtctgtggagtgcaggggtctctcctgggctcaccggcgatttctaatggctcgttttcctaatggctgcacatcatctgatscccctgagttctgcatggagggaatgagggaaataaaatgcaaggctggtctggagttctccctgcattagtgattagtgcaatcctagaacactccgatgccctgttacrcagctttgtgttgcaaaaaggggatttggacagtcaaaaaagcctgagtgtaggctctgctccatttccacagtggaaaccaggggttctcagtcggggtggttttccccctgaggacattttgcagtgtctggagacattttgggttgtcacaactgtggagtgggtgctgctggcatctagtgggtagagaccaggaggctgctggttctcccaccatgcacagggaagtgtctggcgctgaatgcaatagtaatgcagtggagaaatcctgctgtaaacctaggccttcgtttctccgtctgtaaaatgaagtcagcctagatcattgttttctgaactgagtcatgggccatgggtcctaaaatgagttgagtggttataactagcatttaaaaagacagaaaaggttagaaaacatcagaaaatatcagagtgcatggcacacggcaagggtaaatatgatatgaaacgtgtgtgtgtgtgtcctgagtcataaagttgtgtttttactgtgctttctgagcaaaagagtttaagagccgcttatttagattcttcctgctgccatagtatgtttttctgaattataggcctagatcacactttgaaaaatctcattgccaggctggacacagttactcatgcctataatcccaatgctttgggaggctgaagcgggaggattgcttgagcccaggagttcgatgccagcctgggcaacatagcgagacccccatctgtacaaaaatatacaaaaattagctgggcatggtggcacacacctgtagttccagctatttgggaagttgtgacaataggattgcttgagcccaggagttcgagggtgaagtgagctgtgatcatatcactacatgtcatcctgagcgatagagcaagacctcaaaacaaaagaaaacaaaaccccaaattcccttgccactcccctgctccggctgtggactgactgctcttcaagccccctcagccatccagggccaggaattctccttgccatgcagttcaatcctcactgaagggcacgatgcagccccactcctgcccctagactcctgtttttggtttgtctctgggtggatgggggctggttaccagaacctgaatcatccccttcaggagccccagttcctgcggtaggtgaagctccaagggcagccagccccacgtcccctggctgcctggagctgcctcacacrggctcagccctgggctgccccttggacttcctgatgctggtctctccttgggctgcccagagcaagcccttgacatacttaaaacagcactcgcttgagtcccagctcttcatcactgactagctctgtgatgataggcaagttaccmcagggtytgccgcctggccagccccgagccccgcagcctgtgtggacaggttcctctgttatttactctaggagggctggggctctccttctctcccatacasttctcctggttctctcctgtttgatttttctgcttctgctgmattcttggtttattcagccttgcaggccttactttacaaacttatagccatagcgacctccgggctcccctgtggcacccgctcagctctgcctcctgtggaacgagtaccttgcttaagtgattttgcatctttggaagcctctaagagctgtagatcagcagccacagggccatgccaaccccaagctgcctggctgcctctgaagcgttccctacccattctccagccacagtccctgggagacttggtcccacccaccctttctgcatccccaggagaaggagaaacaccaaggaggggctcacgggggttcctttcccatttccaggagggagatgcctttggctcggaggtgacatattggttgagttacccagtgaagccgaggcagaactccctgtgagatgggatgaaaggaggattcactgatggggagacaggctcagtggtaatagggacacagacccctgagcccagacctcgtgggctcatttgtctgccatctggcaggtggaggcttctgctctggcaggtctccagtgaggagtgtgaagtgggtccctgccctgtcacatgggctcactctgggctgtgtgtagtgttcagagctccagccccagaaaaggccgagggagggatttggtcttgggcccagtgcaaatgcctagggccctggaagggagagggtgcaaactggaggttgttacctggttgtcccatttgtttggtttttcgacattttcttatggaaattttgaaacatacagaaaagttgaaagacttcaagatccatatactcctcactcagattctaccattactggtaaatacattactgaaaaaaagaaaaagttactttgcagggcacggtggctcacgcctgtaatcctagcactttgggaggcccaggcaggcagatcatgaggtcaggagatygagaccatcctggctatggtgaaaccccatctgtactaaaaatacaacaaattagctgggcatggtggcgggcacctgtagtcccagctactcgggaggctgaggcaggagaatggcgtgaacccgggaggcggagctkgcagtgagccgagatcgcgccactgcactccagcctgggcgacagagcgagactctgtctcaaaaaaaaaaaaaaaaaagtttctctacgcaatcacttttccagttgtttctttttctttggccaatttcttgctgtcagtaagtttgttcagcttctaaaggtttgcttgctgtaaaaactgttctaggtgggaatgcagagcaagggagacacctcagctcaaacaggacaagtcccctttcatttggcaggcatctccattttctcccagttgtgttgatctggagctccgcagaatgtggtttatggactgtgagtggtctgtgtgtctttcctggtggctgctgctgctggcatatcattaaaactattcctagaatagacttattatttacgtgggagagccctcactgaatttccaccagaaacaagtctattctgtagctcattcgkgttggtttggagtgtttgtgtgttccagggtgcatgctatgtgtgtgcatggtgtgtgtgcgtgtggtgtgtgtgtgtgtgtgtgtgtgtgtctgtgtgtctgtgtgtgtggttgtcctcctgcagcctcagttcagcccagagccctgctggggactcttcctctcctggctaggagtgaggagacctctgccccagctcctctggccatgacagcaacaccttgagtcaacagacctgccaggtcttctgggcttcgttccacggacatcttagcctcttcttgccaagaagaagcccacactcccctatcccttctaggagaagagagatttgctcatttttaagaccaactttacccctgagtcctatgccccattccttcaggacctcaaggcattgtgccccacacgtcagctctttgttttctctggctgcccctatctttcctatttccattaatttctcagtctccaaggcttgagaccagactctctattttcccttctgggtcttttgattcttatgaccaattagttatctttgaatatcaaagacccaccacgagtagcagttcttagaaactaggtgaggtttgctaagctttggtcacgctgtgaaaaatgtcttgcctgtgtttcctctttcatgctggccaccgtcccatcacccttgtcaccctgttcagccctcacaaccacaccattctcagagcctattttatcatgtgtctggatcttcagacatttccattgtcaaccatttagtgtgtccttattaattccatgtgctgtgtaaggcgtttgacccacacgatctgtaaactcctggataatcaaattcagcaaacttaggtggagctcatgaatctccattttaaacaaacagcccagggattctgacttgggctgtcctaagataccattttatttatttatttatttttattttttattttttttgagacagagtcttgctctgtcacycaggctggagtgcagtggcrcgatctccgctcactgcaagctccgcctcctgggttcacgccgttcttctgcctcagcctcccaaagaactgggaccacagacgccagccacctcgcctggctaattttttttttcttcatatttttagtagagacggggtttcaccgtgttagccaggatggtctcgatctcctgacctcgtgatccacccgcctcagcctcccaaagtgctgggattacaggcgtgasccaccgcactcgaccgataccattttaaatagcactgctaggccagagcggggtggctcatgcctgtaattactygcaccaaggagctcaagaccagcctgggcgacacggtgagatcttgtctctacaaaaagaaaaaaaaaattagctggatgtggtggtacatacttgtgatcccagttaccctggaggctgaggtgggaggataacctgggcccaggaggcagaaactgcagcgagccatgttcacatcactgcaccccaacctgggcaacagagcacaaccctgtctcaataagtgaatraatgaatgaataaataacactctcctagagcacctgttaccagtaactcacagtgttgcctttttgtttgctgccttacaatatactcaattgtcgcatgtttgtcttctatttatacgcaggttgtaaactcccagaagcaaaagatcatgcttttagatttttcttttgtgatgtttgagagcctacctgagggcaatgtatccagaagtcactcaataattatttttagatgaatggaaaaatgggtgagaaaatgagatttttagggagatttttgttgctcgcttgtaaagactttttggggcgttttctgctgagaaaaggttacgtagataatgattcttaatcaatgtattcattttttgagaggagtaataatcactactattgacttttttctctttcaggggacttccagaatggcaagagagtgagcctctccgtgtatcttggggaattttttgacatccatttgtttgtcaatggtaccgtgacacagggggaccaaaggtaagccaacaatgtctgagttagaaaggaccctagggatcccctgacacaaccccctcatttttagatgaggaagctggggcccagagaatggaagcaaatgttccaaggaagtsagtagcagggctgggtgagagccagctctcccgattgctgatctaggtcctcagccactttgcaycatgttctgaaccctacaacatggggttggggttagaaggtgggagagacatccagaaaatgcacaagaagcccacttctgaacttagcctttgccctccagagtctccatgccctatgcctccaaagggctgtatctagaaactgaggctgggtactacaagctgtcyggtgaggcctatggctttgtggccaggatcdatggcagcggcaactttcaagtcctgcwgtcagacagatacttcaacaagacctgcgggctgtgtggcaactttaacatctttgctgaagatgactttatgacccaagaaggtaagatgttctgggataccatttccctaaagtgtggccatgctttttatttccttgctcataaaccttcactaacatgccttccctggcattcaagcctcactgtgacctcacctcaatttatgttgccaaccttatctctttgcattccattccaatgcctagacctctagtgaaaccaggtcttagagctcctcaaagctgacttcgttcaactttgaattctctgtagcaacttgcacgtggcagatggttggtcaatgctgggtagtttgagtcgatcctcctcagcccactacagtggagtggataaaatctatggagtggtcggtcctccacaccatccaaaaaggccagtttatgtgtgtgtgcatgtgtgtgttcacgagcaatagaaagtaatatggataatgtgaaaacactaggctgggcgcagtggcttacccctgtaatcccagcattttgggaggccgaggcaggcggatcatgaggtcaggagattgagaccatcctggctaacatggtgaaaccatgtctctactaaaaatacagaaaattagccaggcgtggtggcgggtgcctgtagttccagctacttgggaggctgagacaggagaatggcgtgaacccgggagggagaacttgcagtgagcagtgatcgtgccgcttcactccagcytgggcgacagagcgagactccgtctcaaaaaaaaaagaaaacactaaagatgaatatttcaatcttctttaatttcaattacataaacattcaattagtgatgttcccttgccaaagctaaacacttacatatgttatctttcttccttatgacccaaccactttctgattagagagtaaacatgcagagaaacaattgactcttcctttcattggaatgtaccatattggaaaatagcatgatagtttattttttggttttctccagcactgattttattgtctgatatgtacatttagggctataaatttccctctaaatatcactttagttgcactctatatatgtgtgtgtgtttgtgtaaatatgtatatatactgtatatgtgtgtatatatgtaattatatatgtgtgtgtatatatatgtrtatatatacacgtgtgtgtgtgtgtctgtgtgtctctgtgtgtgtgtatttagagataaggtcttgctaagttgcccaaactgatcttgaactcttgggctcaaggaatcctcttgcctcagccttcctagtggaattataggtgtgtgttactgtgcccagctgtaccaattttgatatgtaacatatttcatgttttaaattttctaacttccattttgagctctttctgaacctatatacatttacaaattcaaaagtttgaatttttttttttttttttttgagacggagtctcgctctgtcacccaggctggagtgcagtggcrcgatctcggctcactgcaagctctgcctcctgggttcacgccattctcctgcctcagccttccgagtagctgggactacaggcacccgccaccatgcctggctaattttttgtatttttagtagagacagggtttcactgtgttagccagggtggtctccaactcctgacctcgtgatctgcccycctcggcctcccaaagtgctgggcttacaggtgtgagccactgtacctggcctgaagtttttaaagttacctatttgtaactaaattgatttctaaatttggttaaaaaattgtggcctagttaaaaaattgtagacttgtttgcagcctttttttttttttttacaagtgttctatgtatgcccaaaaataatgtattctctgattggtgcaggactctacctatacttcttgaattaagctttttaattgtgttttccagatcttctgtatgtgtactacttcttgtctgcttattaatgacccattactaaaagagctaaatttttctataatggtggtgaatttgtcactttcttcatgtaattctgtcaaattttgctttgtgtgtgtgtgtgtgtgtgtgtgtgtgtgtgtgtgtrtrtatatatatttctttctttctttctttctttttttttttttttaaagacagagtcttgctctgtcacccaggccggattgcagtggtgagatctcagctcactacagcctccacctcccagattcaagcgattcttctacctcagcctcctgagtagctgggactacatccaggtgtcaccacgcctggctaatttttgwatttttagtagagatgaggtttcagcatgttggccaggctagtcttgaactcctgacctcaagtgatctctccgcctctgcctcccaaagtgctgggattacaggcgtgagtcaccgtgcctggcctgctttgtatatcttgagcctttgttattagtgtttagaaatactgaatctttcggctgggtgcggtggctcaagcctgtcatcccagcactttgggaggccgaagtgggcggatcatgaggtcaggagatggagactatcctggctaccacggtgaaaccccgtctctactaaaaatacaraaaatgagccaggygtggtggcrggtgcctgtagtcccagctactcgggaagctgaggcaggagaatggcatgaaccttggaggcggagcttgcagtgagctgaaatcgcaccactgcactccagcctgggcgacagagtgagactccgtctcaaaaaawatatatatatatatattgaatctttctagggaattgttcctttaatgtaatgactctcatttttaccagtgctttttgccttcaatctgtctgatattagtatagctattccacctttcttttggttagtgtttgtttgatgtatctttttccattctttcaacctttctatgtgattttgtttcagatgtgtgtcatggaagcaccacatggctctattttattattgttctttcaaaagtcagatttattgaggttaatttacagacagtaaaattcaccctttcacatacagttctctgagttttcgcaaaagcgtagagtcatgtaaccaccacaatcaaactatagaacagttttgtcaccctcaaaatcaccatgctcctttgtagtcaaatcttcccccaactcctagctcctggtggccactgatcttttatctgtttctgtagtcttgatatttccaaaattcatatgactgtaatcataccctatttgcagtatttagtcttgtaagtctggcttctttcatttaacatggtccgtgagaggttaatccatattggtgcatgtatcagtagtttgttcctatttattgctaaggagtagttaccacaatttgtttacccattcaccagttgaaggatgctttgttgtttccaattatggaaaattatgaacaaagccagtgtaaacatttgtgtatagatttctacaccccgccgcattttttattgtgctatgatacatgtaacataaaatttactatctttttttttttttttttttttttkgagtcggagtttcactcttgttgcccaggctgcagtgcaatggtgtgatctcagctcactccaacctccgcctcccgggctgaagcaattctccagtctcagcttccctagtagctgggattacaggtgtccgctactatgtccagctaatttttgtatttttagtagagacggggtttcaccatgttggccaggctgctcttgaactcctgacctcaggtgatccgcctccgcttagcctcccaaagtgctgggattacaggcgtgagccaccgcgcctggccaaaatttattatcttaaccatttttatgtatatagttcagtggtatcaggtacattcatgtagttgtacaaccatcaccaccatccatctccagaactcttttcatcttgcagaactgaaactytatattcattacacaataacttcccattcttccctctgggctcctggaaaccatcattttactttctgtctatgattttgactactctaagtatctcatataagtggaatcatacagcatttgtctttttgtggctggcttatttcactttgcataatgtcctcaaggttcattcatgttgtggtgtatgtcagaattttcttcctttttaaggatgaataatattccattgtatcagaggaatttgaggaaaagaaaaaaaatttcattgtgcatacagaccgtacgtactttgcttatccatttatccatcagtagacacttagattgcttccacgttttgcctatagtgaataaagctgctatgagtataggtgtacaaataactctttaaaaccctgctttcaattcttctttattttttttgagatggagtttccctctgtcgccaggctgaagtgcagtggcctgatctcggcttactgcaacctccacctcccgggttcaagtgattctcctgcctcagcctcctgagtagctgggactacaggcgcatgccaccacgcacagctaatttttttttttttgtatttttagtagagatggggtttcaccatgttggccaggagggtctccatctcttgacctcttgatctgcccaccttggcctcccagagtgctgggattacaggcatgaaccaccgcgtccggctcaattcttttgagtatattcccagaggcagaattcctggatgatttctaatggcaattctattttcttcatatatttcatgatttatttttcaggtatgtgaaattttaaaatattccttttacaatatctatttctctttacttaaaaggagaaaaatttgatatgcaatttcttcttaaacattttttaaattttttctttttaaaaatttgtataaggccgggcgtggtggcccacgcctgtaatcctgtaatcccagcacttcaggaggccgaggtggatggatcatttgaggtcagaagttcaagaccagcctggccaacatgtgaaaccccatctctactaaaaatataaaaattagctgggggtggtagcacatgcctgtaatcctagctactagggaggctgaggcaggagagttgcttgaacccaggggacggaggttgcaatgagccgagatcgccccactgcactctagcctgggtgacaaagcgagactctgtctcaaaaaaaaaattgtataaatttatggggtacaagcgcaattttgttacatgcacagattgtgtagtggtcaagtcaggacttttagggtacaatatactttgtacccattaagtaatttctcatcatctgccccactcccactctctctcacctttctgagtctccaatatctatcattctactctttctgtctgtgtgtacacatcttttagtaaccactttttggtgagaacatgtcatatttgactttatgtggtttgtttcacttaacataatgacctccaatcccacccatgttgctgcaaaagatgcgatttcattcttatggccaaatagtcttccattgtgtatatgtaccacattttcttcatctaatcatctgttgatgggcatttaggttsataccatgtctttgctattgtgaataatgcacaataaatatactagtgcaggtatatttttgatatattgatttcttttcctttgggtagatatccagtagtgggattgctggattgaatggtagtcctatatattttttttttttccgagacagagtctcactctgttgcccaggctggagtgcagtggcctgatctcagctcactgcaacctccagttcccgggttcaagcaattctcctgcctcagactcctgagtagctgggactacaggcgcatgtcaccacgtccggctcatttttttttcttttgtatttttttagtagaggcggggtttcaccatgttggccaggctggtctcaaactcctgacctcgtgatacgcccgcctcagcctcccaaagtgctgggattacaggtgtgagccaccgcgcctggcagtcctattttttttttttttaaagttctttgaaaaatctgcatactgttttccatagaggttgtactcatttacattcccaccaacagtgtgtaagagttcccctttttcctcatccttgccaacatctgttattttctgtctttttaataataaccgttgtgactagggtaagatgatatctcattgtggttttaatttgcatttctctcatgacaagttatgttgaccatttttttcacattcctgtcagatatttgtatgtcttcctttgaaaaatgtctactcatgtcctttgcccacttcttgctgatattatttgttatttttcattgttgttgagttgtttgagttccttgtgtattctggatactagtctcttgctggatgaaaaagtttgcaaatattttcttccattctgcaagctgtctcttcactctgttgatgatttcttttgctgtgcagaagatttttagtttaatgaagtctcatttatctatttttgtttttgttgcctgtgtttttgaagtcttagtcagaaattccttgcctaggccaatgtccagtacagttttcccaaggtttttttctaggatttttatagtttcagaccttacattcaagtctttaatacatcttgagttgatttttttttgtatatggtgagagataggggtccagtttcattcttctgcatatggcaatccagttttcccagcaacatttgttgaagagggtgtcctttccctagtatatattcttgtcagctttgtcaaatatcaactggctctatctctgggtgtctattctattccattgatctgtgtgtgtgtgtgtgtgtgtgtgtgtgtgtgtgtgtgtatacatatatgtgtatatacacatatgtgtgtatatatatacgtgtgtgtatacacatatatgtatatacacacatatgtgtatatacacatatatgtgtatgtatatacacacgtgtgtatacacacacgtgtgtatacacacacgtgtatacacacacgtgtatacacacacacacatatatatgtatatatacacacatatatatatatattttttgagacggagtctcgctctgttgcccaggctggagtgcagtggcgtggattggctcactgcaagctccgcctcctgggttcatgccattctcctgcctcagcctccctagtagctgggactacaggtgcccaccaccacacccggctaattttttgtatttttagtagagatggggtttcaccgtgttagccagggatggtctcaatctcctgaccttgtgatccacccaccttggcctcccaaagtgctgggattacaggcatgagccaccacgcctggccgatctatgtgtatatttttataccagtaccatactgtttgattactatattcttgtaatatattttgaagtcacatattgtgatgcctccagctttgttctttttgttcaggattgctttggctattcggtctgtttttcagttccatatgaattttaagattgcattttctaattctgtgaaaaatgacattggtactttgataaggattacattgaatctgtagattgctttgggcagtatggtcattttaacaatatgaattctgatccattagcatggcaattctatttttaatttttttttttttttgagacggagtctcgctcagtcacccaggctgggtgcagtggcacaatctcggctcactgcaaggtccacctcccaggttcatgccattctcctgcctcagcctcctgagtagctgggactacaggcgcctgccaccacgcctggctaatttttgtatttttagtagagacggggtttcaccgtgttggccaggatggtctggatctcttgacctcgtgatccgcctgcctcggcctcccacagtgctgggattacaggtgtgagccaacgtgctctgcctgtttttgtttttttgagacagtcttactgtgtagcccagtctggagtgcagcagagcaatctcggctcactgcaacctccacctcccaggttcaagctattctcctgcctcagcctctggagtagctgggattacaggcacacatcaccatgcgcagctaatttttgtatgtttattrgagacagggtttcaccatgttgaccaagctggtctcaaactcctgacctcaagtggtccgcccacctcggcctcccgaagtgctgggattacaggtgtgagccaccttgcccagctgactgtaatggttttgaacatttttaatgcagctgctgttcaataaatatttgttgattgaataaaagaatcagcccttccctttctgagcacatgcagaatctgtgccttcttctggtttttaactaacacctagttttaagagagaaaattccgccctcccccataaatgtcatgttctgtctgtcatttggacatgacccaaaagcttaattttctaaaaagccaaagtgctgggattacaggcatgagccaccacgcctggccctgatgcttcctatctttcatcagatttagaacattttcagtcatttttttctcctttgggaactgtgagaaatatgttggattactttatttttattattattatttttttctttttgagatggagtctcactctgtcgcctaggctggagtgcagcggcgtgtctcggctcacagcaacctccgcctgccrggttcaagcaattgtcctgcctcagcctcctgaataactgggactacaggcgcccgccaccatgcctggctaattttttgtatttttaatagagacrgggtttcaccatatcggccaggctggtctcaatctcctgacgtcgtgatctgccctcctcggcctcccaaaatgctgagattacaggcgtgagccaccgcgcctggcctggatatttttatttcatcccttttttaatctttaccttacttccattttttttttttaagctctttatccctctgtgttgcttttttaggtcgtttgcttggctcaagtgttgtgctcatgctggttggtgagaattgattgtgtgtatctcttcccagctccacattcactgatatcacattggtagcttgaaactggccatggtaggagtatttacacgatggaaaccagcaaatgctacaaatcagagctttgcttttttcctggagaaggggattatcagctcatctctacttagatctatcttctaatccactaattctctctcaactgtgtctaatcggcaggtgatgtctaaccaccatcaatagaggtttctgttcatttcattaactatatttgtaattttagaaggtaaacctggctctttttctactctattatttttcttattatcttgttcttttatgaaatttccatttcttctttacaacaataattttaaatatgtttgttttataacctttatatagaaattttattatctgaagtttttgaagctctactcttgctatttctgtgtctttctttattattattattatgctttaagttttagggtacatgtgcacaatgtgcaggttagttacatatgtatacatgtgccatgctggtgtgctgcacccattaactcgtcatttagcattaggtatatctcctaatgctatccctccccactctcccaaccccacaacagtccccagagtgtgatgttccccttcstgtgtccatgtgttctcattgctcaattcccatctatgagtgagaacatgcggtgtttggttttttgtccttgcaatagtttactgagaatgatgatttccratttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacacacgtgtgcatgtgtctttatagcagcatgatttgtagtactttgggtatatacccagtaatgggatggctgggtcaaatggtatttctagttctagatccctgaggaatcrccacactgacttccacaatggttgaactagtttacagtcccaccaacagtgtaaaagtgttcctatttctccacatcctctccagcacctgttgtttcctgactttttaatgattgccattctaactggtgtgagatggtatctcatgtggttttgatttgcatttctctgatggccagtgatgatgagcattttttcatgtgttttttggctgcataaatgtcttcttttgagaagtgtctgctcatgtccttcrcccactttttgacggggttgtttgtttttttcttgtaaatttgtttgagttcattgtagattctggatattagccctttgtcagatgagtaggttgtgaaaattttctcccattttgtaggttgcctrttcactctgatggtagtttcttttgctgtgcagaagctctttagtttaattagatcccatttgtcaattttggctttcgttgccattgcttttggtgttttagacatgaagttcttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcccttccccattgcttatttttctcaggtttgtcaaagatcagatagttgtagattatttctgtgtcttttgactcttgcttagagtggactgtttcatcatgtttcataattttcrattgtgaactcatctttgaagggttttgtgttaatatttcaatatggagttactaaatcttataagaagtataaataggaatctcaaatccatatgagggctttcccacaagtacagatattgagggagacgtttttcctcacttatccagaacttagactaggttaacaaacttttgcttccttggtttttttttttttttttttttttgagatagagtcttgctctgtcccccaggctggagtgcagtggcgcgatcggggctcactgcaacctcctctgcccagttcaagtggttcttctgcctcagcctcctgagtagctgggattacaggcatccacccccacgcctggctaatttttgtagttttagtaraaacagggtttcaccatgttggacaggctgatcttgaactcttgacctcaagtgatccacctgcctcggcctcccaaagtgcaagaattatagatgtgagccactgtggccagcccattgtttcttaragtagattttttttcttgtgaactttctcatggagggtgttgtcatcctttaagggtcccagcttcacaatgggggtctcaggatctccttcctacatcatggagatccaaagctgttaaacccacaccccttcgttggcaagattgccacccttgccccgacttcaacactcaccaggtctgtttttcctttttctctccttatcctttccccctctttctttttgtcttttgaaatttctttttttttgagatggtgtctctgttgcccatgctggagtgcagtggtgccatcttggctcactgcaaggtccgcctcccaggttcacaccattctcctgcctcagcctcccgagtagctgggactacaggtgcctgccaccacacctggctaatttttgtttatttttagtagagatggggtttcaccatgttagccaggatggtctcgatctcccgacctcgtgatccgcccgcctcggcctcccaaagtgctgggattacaagcatgaaccactgcgccaggcttgtcttttgaaatttcttatacttttttgtgagattagtcatgaattcaatagggcatttgttcattgtagtggcacgtgtttcagtgttttctaatctgtcatgttgctagaaatggaagtcccagccctaaaatatctttcatattcccaggctttaaggtttaaaaactgaaaatgaagtctatactgtgttggtgtttgttggtaaaaattcaggactctggtaatatttcagaaaccatcctcaaaggactgggggtttagttgtctttggttgttaaagactcaacaatgtttgtccccaaacagttaactttccttcctgacttctaggaatctgctcagcttggcttttacttaggctttcagagagttttctctaagcaagaatatttgtaattccatctcttggacagtgtatgtctcgtttcagatctagcctgtaaagtttcacttcatagatggtcagggctaaaaacgaccctagaagtcatctagtctaactccttatttgcacataaggaattgggatcagcccagatcacacagggtcacagaggggctttgcccaggcaacaacatgaagcctcctctatgtcccttccttaatgtggtttattagaaagtgtcaaaacctgtgtgatatggagtgactgagtacccagagagtacctgtcacaatgtctggcacacagtcaacatgccacaaatttaagttctcttgcctttggcttctcccatgtatcagtttcctgtggctaccaacacattaccacaaactcggtggcttgaaacaactgaaatttattctttcatggttctggaggtcagaagtttgcaatcaaggtgttgggagggccaaaactccctccagaagctctcgggaagcatctgttcctggcctcttctaccatctgcagtcatacctgactcatggctacatcattccagtctctgcctctgtcttcacattgctttctcctgtgtgtgtgtctttgcccgtctccctctgcccatgtctttttttgttttgttttgttttgttttgtcttttgttttgggatggagtcatgctctgtcaccaggctggagtgcagtggtgcattctcggctcactgtagtcttcgccttccaggttcaagcaattctcctgcctcagcctcccgagtaactgggattacaggcacgtgccaccatgcctggctaatttttttgtatttttagtagagacggggtttcaccatcttggccaggatggtcttgatctcctgacctcgtgatccaccctccttggcctcccaaagtgctggattacaggtgtcagccaccgtgcccggcctctacccatctcttataaggatacaggtgattgcatttaggcttacccaagtaatccaagagaaactcttcctctcaagatccctaactcaagcacatcttttgccatatgagataatatttacatgctccagggattaggaagtgaatatatctttggtgtgggggggatctttttctgcctatcaaacccccacataccaactgactatattccaaggtctcatttatattttccttccctggggacagtttatttactatttgcaaatgcattacttgaccttgagacctacttctctcttccaggcctggctatgcagaaaactgctcatcccaatactgcaaaggtagtagtctcatactgcctttgtaatacagattacgcaattactttgcactaggccatgtaggtccacgaggccctcacagtctattgtgagtagctgacagtagcatgagcactataagtactaaagcacagatgctgtgagagcctggagtatgcagtgacttggggaytgggcttaggttccatgtcatattcttaccttcrttctgcaaaaatattttgagcattcgtaatccactgtataagaatttagagataagagacwcagcccatacccttaagtaaggagctcacagttgaatgggagatgaatatgagcaaaaagaatacaaaccaaaggtgatgagtgttttggtagagggatgcccaggtgccatggggcacagggaaggtgacacccatacaggctggggtgcgaaatgggagtagagctgttcagaaaggaccattcactcaccaggaccacacctggaggcagtggttcttgagctgcatcttgaagaaggaatggagatagttaaggcaataagggggaggagaacattccacatggagggagaaaggcacatgaaggcatggagaagtgacagggaaagggcatttcctcatcatctttcacctcatctccctcatcgtaattgtaaccgtccrtccatccatccatccatccatccatccatccatccatccatccatctatccatccatccttcttcagtctccaagcgtctgctgagctctgatgcccatgccctgtggtgttaggttgagcactgtatgcatgcttattgtttaatttaatacaagtttgattcaggtaaaaacagacctagagcctggtgtggtggcccacacctgcattcccasctactggggaggctgatgkgggaggattgcttgagcccaggtgttctgggctgcagagcactatgcatcaatatgggggcctcctggggagtgggggacaactgggttgcctgaggaggggtgaaccagccaagccagagatgggtcaagtcaaaactcctgtgctgctcagtagtgggattgcacttgtgaatagccgcgcactccagcctgggaaacatagccagaccctgtctctttataaaaaattaaaacaaaacacacaaaaccaccagcagacctagaattttcacccagaagttctgggacaggcataactgaagcattactttcctgaaactttcctccacagggaccttgacctcggacccttatgactttgccaactcatgggctctgagcagtggagaacagtggtgtgaacgggcatctcctcccagcagctcatgcaacatctcctctggggaaatgcagaaggtgggtgtggactggcctgggtgcacctggatggtgtgtgatttctggatctaaaagacagaaggactcagtctcatatccttccatctgggggaggaatggacttacgcagggccatttcctccaaaactaactgtggctagagtctaattctaatacatctcgagcctgaagctctaaaaatgagtctgggctaatgacttggtgtagtgtctcagtccatttgtgctgctataacaaatgcctgagactgggtaattttaaggaacataaattatcttttatagttctggaggctaggcagcccaaaatcaaggtaccagcattcagtgtcttgcaaggaccttcttgctgtgacctgaagccgggtcctgtggctcattcctgtaatcccagcactttgggaggccaaggtgggtggatcaygagatcaggagatcgaaaccatctgggcgcctgtagtcccagctactcgggagactgaggcaggagaatgacgtgaacccaggaggcggagcttagcactccagcctgggcgacagagtgagactctgtctcaaaaaaaaaaaaaaaaaaaaaaaattagctgggcatggtggcatgtgcctataatcccagctactcaggaggctgaggcaggagaattgcttgaacctgggaggtggaggtttcagtgaactgagatcgtgccactgcactccatcctgggtgacagagccagactctgtctcaattaaaaaaaaagaaaaaaagtacactgaagtgctctcatctgcctcttttatcagagcactaatccattcacgaaggcagagccctcaggacttcatcacttcctaaaaggcgccaccttttaatagcgtcactttggggtttaggttccaacacatggattttggaggacgtagacagttgaaccatagcaataagtaactatgcttttctgttttagactccagtgccctcttttgtccccaaatatctccatcatcacctgctaggtgtctgaaattttaccgatagaaaaaagccacttctttcttaagtggctgttgtaaactagaaataggagggaaagcctcctcttataccagctcagctggaaggaaaactactttatagttgcagacactgaagggagtctgagtgagaggctgtgcctgaagtgacatagcttggatgtcaggatggcttcctgaagctgctgtaacaaattatctcatactcaatggcttaaaacagtaggcatttattttctcccagttctggaggctggaggtccaaatttagtttccctgggctgagatcaaggtgttggctggctttgctccttccagaggctctaggtccttgcttccgtcatttttgggtggcagcggcattccctgtctttgggctcatgacttcaatttctgcctctgtggtcacatggccttctcctctcctgtgtgtgctaatgcctgccaaccctgrcaaggctgggaggactgccccaccccttccacagagccctgttgccacttacaaggtagccttgtagcagctctgtctgcatcagagttgccattcatgatctcactcaccaggacctcacactggagagaaggggaggtggggaggggtggccagaccacactctgccttcacctgccacaggtaaagatggtctttgtgcctctctgtgtgtgggtgtttggggcaagaatgctttatgtggggcaagacctcactcaatgggtaattccctccccactgtggaacaggctgayttgggctgaggaggtaggtgcagctgtgaagctggactccygtggggaacaggggttgttgcccttttgggattgtgctcagagactcatcatctgaggagcaaggttccttggtggtgctgtgagtcagcctccctgggcgggacgtttgtatgcaggaggtttactggggagctctcgagcagccttggttaggaagtgagagaagcagagttgggcagtgggagaagttgaactgcttgtgatagcaytgatagagcttcagcggggcctcagctgatccttcaaggagctctggaaggtggagtggcccctrttggtcactggatgtgggctgccctgggtaaggaggtggaactcccttgggctgagggccattcctgaggaatgactcagyggtgagcccttggcagccaacactggacagctggtggatgagtcctcgggctctgaatgggcacctacgctgtgccccgacacctacgctgtgccccgacaccctctacaaagctgctctgcttgacagcaccaccttcctgcccttatccagagagcaaccacactgtcaaaaatgtcaactgaagaatcacaaggttcataaacttagagaggagagcttttcttattcagagttgtggcctgcaggctggccatcctgcaggctgggaagtgtagcctctggtagaaactgaaagcaggcacttcaagggagaaaggggtggaatagaaacttattccaaaagggttggctcagtgtacatatttaacaggttatgggaggagctatgaatattcataatgggaggaggyatttgcatatacagtaagcaaacatacatgttacatatgtcccacattcattttgggatggagacttaacatttaaatgcattaaaattagcctctataggtcaaaaggtgaaatggaggacacagaggcatcttgtgcacagcctctgtaaatcagccagaaccattccgtggttggtggtctcttaccaggaaggaatgctggtcagyacacacacacacacacacacacacacacacacacacacwcwywctctctcwcwctcacwcactcactcactmactagctgggcatggtggcatgcacgcacgcacacacactagctgggcatggtggcacrcgcgcgtgmacacacacacacacasacaaacacatactagctgggcatggtggtgcaccagtaatcccagctaatgggagggctgaggtgggaagatggcttgaacctgggaggcagaagctgcagtgagttgagattgcatcactacactccagcctgggtgaaaatgtgagaccctgtctcaaaagaaaaaaaaaaacccgcaaaaagggaagggagwccctgctgggccagttctgtttaactcttaggaaagaaagtctaatggtggttagcgagggagagggtataaggaggggtgttcaacctcccatcctatcatggccaggaactcagttttaatatttctctggggtccctttggccaagggggagtccgtttagtcggtaggggggcttaggattttatttttttctgaaaacctacaaacatgcacaaagagggtggcccctgcctatacccaggaccatggtcatgatggacgcgacaggccacagttgcctttgtctgggcaygggccactctgcagagcgtgagtgcatgctgcagtcacccgagtgcgcagcccatcagcagagcagtagggcaggtgctctgtgattttgttcatcccatgagaaaacaagccataggaggttaagtagctgccccaagtcgccagctagcaaggtgcagagccaggactcatgccctgcctggctccctccctttcctgttcrggtcacattggttcaggctactcaagttatttctaccagtgggcccttgtgtttctcttggggagttgggctttgcaggttcttaaggtttctttaagttctaaaaccctttattagcctggtgcggtggctcatacctgtagacccagctgctcaggaggctgagkcaggaggatcacttgagcccaggaggtagaggctgcagtgagctacaattgcaccactgcactccagcctgggcaacagagtgagaccctgtctataaaacaaaaccaaaaccaaaactctttcattatgtgtttctgtggattgggctatagagacagtatataataggtcttaataaatattggatgggtggatgaatggaaattggtggtgtaatttwtctagggattgtgacctccacaataatccagactcctttacttgtagaaatctgatttatctaagtaagtacataagtagagaaacccagccctctcctattccagaaacaaaataaaacacacccacatctccctcctcccacccaccccccatcacrgtaacacgaggaagcttcsttttagctggttattaattcagtgagtcttcatcttcatggaacawtttgacctctgaccaaggagaatgtcagacccagaaaaatattctgagttgatgctaaatccagctgcctaaattgtgaacagacaatctccaccttataaacaagtacattccaaaagactttttcccttggactttggtggtgctaggtcctctggttagtccatcaaagtctgcatcacctggatcctagcccagtaccggcactaacaaaggcggactgagttctagcacgtgaggggagggtgctgtcttgtggaagggaggagtttcctcttctttgcagtcaaagttctaaatgcctgaaccatacccttgatagccccttgagtgtctctcaccctgggcctcggcgtgagcgtggtgctaagggtgtgggtttgagtcagctcacttactggctttgtgaatctgggcaagacaagtgcctttgcagagcctcagtttccacatttgtaaagcagaaatagtacctgctgggtcactgaaaaggtaagagagggataatatgtatagagtttagcccagtggggctcaactgttaagagccatgatgatgawgaggargaggaggaggacgagaaggaggaggaggaggaggaggaggagttgttgttagctggctccccatattctcccactgtcccgtgttttccgctggagtgcccctgccttgagaatgggagccggcagaagcaggacaagcacacgccgggctttaagcacaagtttcaacacgcattctttttctccttccccctcgcaactataacccattccttttgggtagccgagcacagcttgaggttagaaggaaaacaaggtgcccagatatctccacacctccaagtgggtaagtgacaggaaccagccttccttctagagcggtttgtgaacccagatggatttcaaattgagtgcactcgaggtattgtgtaagagaggacagattttcggccgggcrcggtggctcacgcctgtaatcccagcactttgggaggctgaggtgggtggatcacgaggtcaggagattgagaccatcctggctaacatggtgaaaccccgtctctactaaaaatacaaaaaattagccaggtgtggtggcaggtgcctgtagtcccagctactcgggaggctgaggcaggagaatggcatgaacctgggaggcagagcttgcagtgagccgagattgcactactgcactccagcctgggtgacacagcgagactccatctcaaacaaaaaaaaagaaaaaagaggacagattttcataatttctttctttttttcccaaacatasagttgtgctgttggcaggtgggtcaccctcggctgcccttcagtgttctccaggcagatgaaggggaggtggtgggtgcttcagtgggtgaggtggggtcagggtggctgtggaggtacctctaatactgaaacatgscttcaaagatttattatttttggtctcattttattttgcaaacatagcccagtgcagagtaagtacttgacaaatgttccctaccctcggaatacaaaggaatgatctcatttatccatactgagtgggaggtaaagacaggattctcaagtggagaacctgatcctgaggtcgggttgaggagggagactgggaggtttgtctcctggagacaaargggagggagaatgcaagagaagccttgtttgcctcccggggcacctttctgargctccagctgtaccctagctactcgctttgtctcctgggtgcattaaagtccttactaaccagtgtcctgggaacarctgaaaaaactgggtaccaggttcttcgtgttgggctgaggccacaaacacgtgagacctcccagaggcacaagctsctcccagctcagaactcccggtttcaggttgtttacctgagaagagaagactgctttgtcctcagccaatcagatagtgtttgcccacaaccgaggttttttcactggctcggaagcacaatgactcgtctcccaagaggtgattaatatggccttttgaattgttcacagcctgtgtagtcccgcagggcccccaggttcagaagtccggtctggtaaatgccgcatcatttatgagtgtctgctgttgtggctccaagggccgttcrgggtgrcagagtgttytgtgtgggagttcacactgaccttgaaactttccttgacagcctccagaatctacttccccaaccctctggtgctttctgtctttctagggcatagcaaggagtcagctcattctgagagccaggtcatattacttgttagttatacctagggaatgaatgtttccttgttatgccaacaaaacccaatgcctgtctccactgggactgataatggccttgtttgattgcatgcaaatttgcagttttttcagcttttcaaactgaaggcaagatggttggagtttggagccccaagctatgaacattcagataattgatgttcatctgcaggtaactatcacaaagtgtacctttgagaaagaaagacccttagatcactttaaaaaaattcgatcagactggggaaggccagcaaggactgaaccttacaaagggatcttggctttgtcctgtagtcctgtctgcaacaggaagcccaaggctccggggggctgggcttgggctgcatccagctcatagcatgcttttgctaattagaaaaaggcacccctttctctctctctctctcgctttttttttttttttagacagagtctcgctctgtcgcccaggctggagtgcagtagtgcgatcttggctcactgcaagctccgcctcccgggttcacgccattctcccgcctcagcctcccgagtagctgggactacatgcgcctgtcaccacgcccagttaattctttatattttttagtagagacgggktttcaccgtgttagccaggatggtctcgatctcctgatctcatgatctgcccgcctcggcctccgaaagtgttgggattacaggcgtgagccaccgcgcccggccaaaggcacccctttctcaagaaacttcaccaccacctgccgggaaacggccaagataaacataataactgaacatataatgtacatgtatatacctctacmatgtctaccatatgaacagtagtcacttggtgtgttgccactgtgtggactgtgtggcttgcatcatgacatgtgatggtgttggcctggcttcctcagggaggcacagtctctgtgaccatcatctcctcgctcaggatcacctcctcaaggcgatcagtctctattgagaaactgagtgcaccagttaccactctacctaccgtagagtggtgaatcattcagcagcagcagcaacctccgacagctgtctgaagtggaagaaatttcttttcatcaatgttaggaatcttaggctcataagaactcagagttggttgagaatctagcagatatctacttcaaccccctacctgccgcatgaatgctctccacaaactgtgtctgggtagacaggttatgctgtgaccttgactgtaagagttaaatcttggccrggcgcgggggctcagcctgtaatcccggcactttgggaggccgaggcgggcggatcacgaggtcaggaggtcgagaccatcctggctaacacagtgaagccccgtctctactaacaatacaaaaaaaaaaaaattagccgggcgtggtggcgggcgcctgtagtcccagctactcgggaggctgaagcaggagaatggcgtgaacccgggaggcgaagcttgcagtgagccgagatcgcaccactgcactccagcctgggcgacagggtgagactctgtctcmaaaaaaaaaaaaaaaaaaaaagagttaagtctttgagacacccttgctgggcgcttcccagccatcttgcagacctcagccctaggcagccctccttkactccctggtaaattccttctttcattgtaygcccgttcgaagctaaagccctgtccttccgtgtccctgaatactggagaagcaggtgctttgggtctggtttctcctggtctggctcaggagctcacrtcaattgcagtccygtcagtcactgaatagcctcagatttcctgttttccactggtctctgaatttggtgttyattaggtgaacacaagccttattttctttggccattcatgtcttcacattctctcgcktcctccattatcttgtagaactctttccgcctcctctgaaacagcatgcagttcacctgtgattcctcttcctcccagaaaatcacctgtcctgcttgagctaacattttaaacagtcatgttgactttgaataatcacagcatgcctcctcagtagcccaaagaggcacagaaaatacccattccrttagagacaaagcagttcactcttcatgttctcattaaatattgctcaagccttttatttgcaaaggacctaccagccctttctgctatttctgctcatggtgactctgaaagggaaattcacaggcatggagggaggcaatgtaagcccagcggacttgggtctcactgtctaggcccacttctgccttccctccttcttctccttgcctcttccattcacttaattggcagttttggtctggaatggacttttcttggagactgggaagaattttgttacattwgtttgcttggtagcatagttgtgattcatagagtmcagttgtcaggggagagcctggcccagagaaggtcagtagatctcaaggaaggacccttggaatgcaggatcccagagaagttagttgtcagatgatggccctggttttagagttggggtgcccacccactatgccccagtgacaccragctcagagctggggtttgcaataagtacacacgtgtctttccccgttttgatgagaactgctctctcaagtctctctttcttgagtcattgataggctaaggaatgaggacttatttcaagtgctttastgaggtccaagaatccagggggcagtccytggtttggcccaattctctgcatgtcctcgtgtaagttactttcctactctgcctctcartcttccctctctgaggtaaacagagctccacggaaccccccatggataggcaccctttctttacagcagactggctcacctgagtgcaggatgggagaagggcagggagccaatggttgtggtgaaacagtggtgaccttggccactgttcccttgggggtctagcctcatggcagaggtcagtggctaccatggggttttgcagatttcccttgaacttggcctttaaaaatttttttttaaaattttactttaagttctgggatacatgtgctgaacgtgcaggtttgttacataggcatacatgtgccatggtagtttgctgcacctatcaacccatcatttaggttttaagccccacatgcattaggtgtttgtcctaatgctcgctctctccttgcccccgccccccgcgccccccctccccgcccacaggccgtggtgtgtgatgttcccctccctgtgtccatgtgttctcattggaacttggckttttatgttgctcatttgacaagcccttgaggagagttggataaggacctagcacccaagcattcaattcaaaggcctccctaacataatgttcccaaaatcctttaacgaactatttctcaggtgggttcctttcccttttccttttccctggtgagsarcagaatggacaagaatctgatggtgcccataagtgcatattcactgagatgtttcatatggcttgcgtswtacaasgtagactaagggacaagacacgtaagagaaattaaaccatgaaagactgtctggggttagtaaatgacaaatcgccaagtgaatggtaagtgatagcgcarcttaggggaattagctcctgtcacagagctgatgcttttttcttgctgggagcaggatgggtgagtgattcagaaagggctgctttccatccccagagcttggtaggccctagactgggaaccagggaatggtgccccgtccttgtccatccagccagcatgccctaatccctagaagctgctcagatgcctccaggagccccaaggagaaggtgaggagggtcccttagagagstccatggccaagtctcctacttctcatgagcactggaccccagctatcttagagagaggwatgtcaagctctgcagaaaccatccatttggtggaaatctatcaacaggtttcaccaggtccttgtgagtcagaatcttggaatgcgggtgggaatcttgggccggccagaagttataaatagaatcagctaccctcccccacccatcattacagctgaccaatgagaaagtattccctgctgcagggtgaattcttgaacccactactttggagcagctcagactccaggcgcctccatacctaccaggggctgctgcagggcacccatcccagagctagaaagatcagggcttgtggaacaatattgcactctatgtattagactttcctttctttgttcactcagtcctaggaatgtccccctcccttctcctttgtcagctgcttgggagcaaacacaatagctaagcttcagatctctggctctgctttctctcctcctgctgcctgccactgagatgtgcttgytttccctcctcctcccctgcacccgcctgatgtctccagggaagatgcctggtcttctttaatgaactggaaatgtgattaagatgggccacaattgggcctgcacaccaacccaggcatggtgaggtcatggctggatgggctggggcagctgctctcccgcagctcctggcacsgccgacaggagttgaaagaagacaggagtagctgatgcagggccttggagccagggagatgctggaagtgtgcaaattagctggcccttgttttgcatccctgccagaatggtttagcagagaactgaggagccagtaccgattgcaggcaaatgagaatagttataagcatttgatttcctggtgtcatctcatttgatttcattttgcagaaaccatctagggtaggtccaagtactgctgtctgtgtcagttaggagtaggttcagctgtgagtgacaggacttatacaatctaagtttatttatctctyatgtaaagaagtttggggtaggatgtccagggccatgcaagatctcatggtgttgggatccagggtccctctgtcttatttctctgttgtccccagtgggggcttctaccttgtgcaccaaaacgccrgctcaagcttcaggcatcacaactacattcccgcagtagaaagagaagggactaaggaagaagcagtcccttattttgaggacacttggtggaggttgcacaagacccctctgcttatagcctactgggtattgcttagtcatatggctgcccccagctgcaagggaggctgagaaatggaatcttattcctagcagctctgtgccccgygggggtgggaaattgaaaactgaggattctgtgactaagaaggggagaatagctcctggacaactttcaacctcttccacttttcccctctttcacaggtagggaaatgaggatgcagagaggcaagataattttccttttcttttttgttttttgcgacggagtctcgctctcttgcccaggctggagtgccgtggtgcaatcttggctcactgcaacctctgcctcccaggctcaagtgatcctcccacctcagcctctctagtagctgagactacaggcacgtgccaccacgcctggctaattttggatatttttgtagagataaggttttgccatattgctggtctcaaactcctggactcaagtgatctgcccactttggcctccaaaagtgctgggatcaggccggttgcggtggctcacgcctgtaatcccagtactttgggaggccgaggtgggtggatcatgaggtcagaagtttgagactacccttccaacccttccaacatggcaaaaccccatctctactaaaaatacaagagtgctgggattacaggtgtgagccactgcacttggccaagatcattttcttaaagtcacacgctttgaaagtgatgggttgcgagaggcagaggttgcattgagctgagatcacgccattgcactccagcctgggcaacaagagcgagacttcatctaaaaaaagaaagtgatgggttgagattctagcccaaccatgcttctaaaacctgagctacagccactgtatgaccctgtcttctaatctgattgctaggaaacaggagtgggagggcaggatggaaaactgtaatttgtggtttggaatggactcaggcactcagggtttgcaccccatcactagtgttaaaagaaaaacctgagacaaattaaatttaacagggtttacttgagcaaagaatgatgcatgaaccaggcagcccccgaatcagaacaggctcagagagactctggcctgcctcatggtcaaagaagatttatggacagaaaaagacaagtgacttacagaaactggaagtgaggtagagaaacagttggattggctacagcgcaacatttgccttattagaacgtagtttgaacagtgggctgccccaagaggaggttacagtgtgtttacatctccagttaggttacagttcattatgtagggagaaacctttaggcctaacttaaaatatgtaaggaggcagctttcggctaaacttaaaatttaacgattgtatagcagttctccaactgtttaatcgcagggcccctgtatactcttaaaaaataatgaaggactttaaagagattttgtttatgtgggtcataactcttgatacttaccatattagatattaaaacaaatttaaaacattttttgattcattttaaaataacaagctcatcatatttaatgtaaagaacatatttttaggccaggcgcggtggctcacgcctgcaatcccagcactttgggaggcctaggcgggcagatcatgaggtcaggagttcgagaccagcctgaccaacatggtggaacccagtctctactaaaaatacaaaaattagccgggcgtggtggtgtgcacctgtaatatcagctactcaggaggctgaggcaagagaattgcttgaaccctagaggcagaggttgcagtgagccgagattgtgccactgcactccagcctgggcgacagagcgagactgcgtttcaaaaaaaaaaacaccatatttttaaataaaaagaacgataaattccaagccaaaaaataatttaggggaaaaatgacactgttttacagttttgcaaatctccttgctgtctggcttcagatacatcatctggactctcatatctgcgtctgcatttaaatctgttgggatatctcatgtctcatagcctcggaaaactgcactgcactctggtgaaagagtgagagaaaaaattgcaaatagcatcttagtattattataaaaacagttttgacctcgtgcactgctgaaaggatcttgggagtcctaggcgatccctggacctcaccttaagaaccactgacttaggccaggtgccgtggctcactcctgtaatcccagagctttgggaggcaaaggcgggtggatcacgaggtcaggagatcgaggccatcctggccaacatggtgaaactccgtctgtactaaaaatacaaaaattagctgggcatggttgcgcgtacctgtaatcccagctacttgggaggctgaggcaggagaatcccttgaaccaggaagtcggaggttgcagtgagctgagatcgtgccactatactccagcctggtgacagagcgagactctrtctcaaaacaaaacaaaacaaaamaaaaaacaccactggcctagtaaattctttacccactccatgcttcagtttctaaatctgraaggctgtctgtatcagcctttgtctgaggagagctgtgttctttggaggtgtcttcaggcctctgaagggcccatttgtggcatgggtgatgagatggtctctgaaagtactttaggtgggctaggagagaggtcagctgtggagaaggaggtgaggtttgcctcagcctttcctgaacgcaggaggatgggcggagaatctgtggagggccttctgggcagggagctctatgagccaatagccccccgtgactgagtggatggtaagagccagagatgcctggcctaggcatcccgcctggctcctgctgcccaccccacccactggtgtgcatgattgtgccaattcccacaggaaaagagggcacacggagccgtttctaagccatggagggcataacctagggggagtgagagaaaggggtctatgagaacttcgcgcaggcaggaacacacgcggaagggtctgagggcgtgggaacaggcggaaagtagacacctactcaaggagagcttggytgggtttggattatgatggggccgtaactacctgctaagagaagctgaggccacagacttggaacagcctctcagcgggcagctgtgcctttcctggggaatctgtcggcaagactgggctggagtcttagtgctcggctcagccgtggtgactctgtttcttctcctgcctgagcttatgccattggcttcacctgacatggcctccctcctgccctgcagcctaagtcctatgttgcatccagggccctgtgcagactgccttctgttaggcagccttccctgatgtctcagctgcaggtttcttgctgctgccattggctgcaccattgggaagacacctctaggtgagaaccaagtcttcaggctgttaggcaaacatccccatggaaacacccggttcaggtagattgaatgccagttaagagctggagggcatgaaaggcatgacttactcctgtctgcrttcatcactgttaggtttgattcagcatatccttattccctgccatgagtgccctgggaatacagctcctgtctttgaaaagcttgcagagaaatggaggagacggccacagaaatggaccatttcagtacaagaatagaggcccccagagggctgtgagaacacctaactcggcagagtggggagaaggacctgtcagagaagccttcctggaaaaggaggctcttgatctgaagtgtggggtgggagttagtgggggccaaagaagggggaaatgcaggagggcagatgggatgggtagagggcagatttccctgctgggctttatgagggggatctgtttgctttctattgcattccttgagcctggcacagtgtgtgaggtggggagcagggagggtgaggctggagagccaggctggggtcagatcatgaaggctgagcttcctggctttgctgtgtcctaatgagctagagctttgccctgtcagccagggtgggacatacatagttagacttgcattttatatgggcttggacaccctgctggagacccagaggccacactgctaatgcttgttgagtgaatgttttggtcactacctgcatcccagtgtctctgccacgagcctgagagtacaagacgccaactcctctttggacctatttttttttttttttcgagacagagtctcactctgtcgcccaggctagagtgcagtggtgcgatctcagctcactgcaagcgttgcctcccggcttcatgccattctcctgcctcagcctcccgaatagctgggactacaggtgcccgccaccatgcccggctaattttttttttgtatttttagtagagatggggtttcaccgtgttagccaggatggtcttgatctcctgacctcttgatccgcccgccttggcctccaaaagtgctgggattacaggtgtgagccaccgcgcctggcccttggacctgtttctgtgtcctgtctcaggacctggtctggtctggcagggctacctgtggcagaacagggaagctgggagcagcagagatagccacctaaacatgccatgtggtatggctgcaggtgagtgcggatccagctgcaagtcctgcctggctctcagctgtgcccactcaggtggaccaagttcaggccaagcctgaccagaggaagactgaaggacaaaatgggaggacagactttatcttttgtttctgctaagaaagaaaccctaggcagatttcagaagtttgtacagtggaggccaaaggaattgttctaagaagggaggtggctgtttctgcagaaatccactcccatcctgcaggcaaatcatcagaaacacccttcttgctaaggctttctataagccatttaatgcctccagggacctcccaggaaatgtgctggagtactgttcccattatccctctgagtgggaaaagagtgatttggaaatgctggagatgggccatgctgggctctgtctggtcacggctctgagaggggagggtgcctggattcctgggtctcttctttcccttggctggtactgtgtcctgctggtgagaatccctggttccttgtccctgtgcctgcaggaatcagtcctgtggtgcagggactgctccgagccactctgctacagcccaggtgatggcagcagtcatagcaatgaccaggaaaaccccagggagtgcatttttgaggttttctctagtttcaaattgtgggtggggaaaaggctagacaatagcctgagcacatgaccctctctgggacamcctcatctgcactctgagttcagtgacgtaattctctgaatgacatttttgatggggtaggcagcatggcagaatggagggaaagacacaggcctcagtctccttccctgagccccaacttggcagtgaggatgggaagttctgcctattgcaaagaagagaggttccctccctgctactagaaactcactttgttctggagaagtgtgaacttcccaaatgaaagatgaatacaagcagcccctctgttccctaaggagcacgcaagatactaggaagtgataatgctcggcaaccattcatctcagtatagcccagggtgatggagataaggggaaaaggagaaaggtgtccttctgtcctgctggggacctgctcactattctagagggtaagcctagtggccggagggatctctctggaggccaggagrtgatgaagatgatgatgatgatgataggggtcatcatttattaaggtaagtcttccgcgtgcatattccattcagtcttcactagtcttgtcccagaggaactgttactattctcccctgttttgcagaggaggggttgagtaaacagcttagctcacacgctagcatggggaagacgctgggctgaatctggggctgtggaagtcatgatgaggccaaggcaggcctgcccacctctgtcagtctccctcgtcattgctttcagaagcctcaggttccccttgtgtaaaatgctcagggtgaccaatggaaggctgcatgtaaccacctgagacctaagtggtcccgggacccacaacagtggcctgcattcatggctggcctacgtggtgctggcattgtggcatcttcacgtggccccaacrggccgtctgggactggtcatttccacaggtcattctcactctgggacactcttctctgaccaggtgagctgatttgcctaagtccccaccgccagtaagtggcagagctgggctttaaggcctaggcttktcatagccaygccgtgggtgcccgcccggcagaaggggattgggcaaggcagggccgtggaggggctgctgttggccccgagacgcagagcagctgatggctgtccccatgagcctacctgctgcacttctgcagttgagcagcccatgccggtgggtgctttcctaaggtgcagagagaacccggcttgttttttgagacagggtctcgctctgtcacccaggctgaagtgcagtggcacaatctcagctcactttaacctccacccctgccccgccgttcaagcaattctcttgccccagcctcccgagtagctgggattacaagcatgcgccaccacgccccactaagttttatattttcagtagagatggggtctcaccatattggccaggctggtttcaaattcctgatctcaagtgatccgcccgacttggcctcccaaagtgctgggattacaagtgtgggcatcttttccaggcctgcctgcttggctttgatggtgaagtgggtggaggcctagcaagcggcagggccctagcaccaggcattggggctagracactgatttccttaggaccaacgtccctgtgctgccggactggatttcgagaacggtgagcagatggggtcaggtttctattcctgtgggctttctgtggcgccgcaaaacaggaggcccacaggcctggcccctggccccgactgtagatttatacaggcttgctctggagacccttggtacaattcaagctgattgaatttccctctcctcaaaacgggtcrtttctttcctcttttttgctgtcccctttcccaaataccaactggctccagtttacccttcaggacccagtccttccattgagatattcttgcacttttttctttttagctgaagatcataagttttttcatgaacttgcagctttgtcagtcagagagtattgcattatgcatccaagaagttatgcaagaaagaaatcatggggatcatatatatccatgactctgtgttgtgccaaagctaagaaagacatcatggattctaagacacaccattgttctgtgtatcgctcagaaacaaaagcctaccaattcaaatatgatagccatcctaagacgcaatccaacttcagagatgttacactgtgggaaaaagrtgtatttagagtcattaacatacagaatggagagatgtttctaggtaaaacgtagggtcgttgatactcgtgagtgagcagaagtaggaaatgatgacaattccaaagctgcctgtgttatcaggttgagggcatcagcaaagtggtagaaccaagaatactcgtgcttgctgcagtgtgtctgggacattccacagaatcagcscatgctgttgctgatgggaactggtcccgtctggccccagcaatcwcctggggagtgtttaaaaaaaaaaaamtcttgctgatccccatcccaaactactgcattcagatctcctagggtgagacccagaaatctctataaagccccttgtcccatccccctcattcatagtgaagaagatcaaggtcagggaggggagctgaacaggtcagtgcagaaccgatgctgacagcattcctggactctgcagccacmcaggccaactccagggcgcatgctstttgtgcttctctccatcctctgtccgttcctaggacactgcccaccatggcaatccagggccttggactctgcatttccaggactcagtctaggatgtaaccttagccttggtctacttcacattgcacgggtccagcatcttttccttggtcgatgggctggtgcattgaacacatgcatgtgcttggtgccagcctgtcccaggtgctgagggagctgccttggtttccctagcagggctaagtctcagtgccacactcagggagacactaacggagcataccgctgaggcggcccctcttcctgcagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgccyggaccwgtgcccaggagggaatggtgctgtacggctggaccgaccacagcgcgtgcagtaagtcggccccctgccccgtcctgccctgccggggatgaacggtctgtcctgggtggtgtcccttagggtgcttcggggctgtgtcacgtatgtgcggctttaccacacccasccagccagtgactacaaagccacgtgtcccggacccatttcctgaatggctcctgccctctgtcaaacgggcttcccaaagccccgtgtcctgcccctgcctccgtcccgcccccacgcctcccctggcgccccctgacttccctcaggaaatccgacccctgcactcacacagtgttctctgcttcccaccaagatcttggcagttgcggttttggtttttgtcttcaccgcctgcccgccygaattgatgaggagcaggacgctgacctggctgtccgtgtgtggtgatctttgagagagcagaaagcattcattaagttcttctcttttattaaatctctctcctccaggctaatgaccgctatccctcctgccttactcgtgctgtgtgtttcatcttccagtctcaatgggtgcctagttatggtcactgtccccaaattatcaggattaagtggggacttctgaggtcmccttgcaagaagtctcctctttccccagcccttccagtgattaaaagccatgcagacggataagcagtctgtgatggttccacagatgagctgagccggccacatctttacactgcacacgtgtgtctcagtgtgtggcaaatagctgctgaattcaaactttctgcctgtggtgggggtgtgaggaaggaggatgctagcagctggtttcttctctgtaaagccgagtggctgtttttttttttttttttttttttaggtctgtgaatgtagggtaggggagataacctgatgtatcttggagaagggttaaggggcaatagtttggtgtcagaaagcccagaaaagagtgcttatgtgtttcggtctttcagtcagcctgaatgtcgctcarctacagggtagagagaggaaggaggagagcctgtccttgcagtgaggagctggttccattgggaagaacagagagtgcttaggtgatatctgtgaaggcagccttgtggcagagtggaaataaatatggaatgagtgtcaccatgcaggcaaatgtgccctgtgctgggtggggcatttgattggggccaatttcatggggaaaaggaggagggatgggatggagggcaccatggctccttgctttgtcgtargactccacttgttttgagcctagaggagtttggtgtcactctgaaagggttttaggtgaaggggaggaaagaatgccaagttrtacatggagagcaggcgaccaaggggaagggtgggggtcctgggtgcccccgatgggtcttggtaagggcctcacaagatggaagatgttcatctaagggaggggtggcctcaggggggcacgtggctcactgggggtgagaaggacctggaagcctgaagacagaggggagcagtcagagtgggcacgagaggctcaggctgtggcatggctggtgagatgatgcaccggtgggacctgccctgggtagacccctttgatgttccttttcaggcccagtgtgccctgctggtatggagtataggcagtgtgtgtccccttgcgccaggacctgccagagcctgcacatcaawgaaatgtgtcaggagcgatkcgtggatggctgcagctgccctggtaatgaacttcccactttatttacagatcaragaccttgccagcacccttggctttgggaagtgagatgaaggccacttgtgtttgctccccgttgctgaaatcagaagccttttattaagtttttaaatgtctttgtccagcgtgatcaggattgagctggtctttatttttaatgtacgttgtcctgttgtactgtatccatgaacgcacttgtgttgagggaaattggagggtggcctgggccccaacagtaactttgtttggggaactcgtggcccatctgagctgagctgttttctcaattaggtgtgtcagggaaccgatctgggaaaaagatctcctgggtttgtcatgtgagctcagctgaaaaagggctctgcactagaaagtcttttcaggggaggcttggtgggctttggggaaaacccctgtttaattactgagagcaaggctgggtgcggtggctcatgcctgtaatcccagcacttttggaagccgagatgggcggatcacttgagttcaggagtttgagaccagcctggccaacmtggtgaaatcccgtctccactaaaaatacaaaaattagctgggggtggtggtgcacacctataatcccagctacttgggaaactgaggcaggagaatcacttgaacccaggcggcggaagttgcagtgaaccgagatcgcaccactgcactccatcctgggtgacagaacgagactcggtctcaaaaaaaaaaaaaagttattgagagtgagtcctgtgtgtttcaactcatgacttctctactggaagaacttgaacaaaactcttgactcccttcatctgtggaatggtaatgagtagtcttctccctctcacgttgcattaatgtgtaagggaagcagcacacacattcttgagcttcctggaagaagccctaagcccagacttgtgcctcccctactggatgacctggaacaaaattcttttgctcatgtcttcatctgtaktaatggagatgaggaatttcccttccttatattgcattatgtgaaagataaacaccacagaacaagttctttgagcttcctggaagaaacccaaccattgtccctggggattctatagttgtgggatgagtgacgcaatgacaatgttgaggyctttgtcttgatgcccttgaccccagagggacagctcctggatgaaggcctctgcgtggagagcaccgagtgtccctgcgtgcattccggaaagcgctaccctcccggcacctccctctctygagactgcaacacctggtaatgggggctgcgcagcgtgctctgggagacctgcctgggggactggggagggaagctgggtcagcaggggtggtggcaggtggaaaagaacctggaccgtgccaagaaagaagagactgagttggaggctactggtgggggctagggacaggtgtggcaggcaatgayggggagcaaagagtatattacagataaataagccttgaagatggggaggtcaggaagggcaggatccttcacgtgcagacatcatctctagctgtccctccaaactatgctttcataaatgatcctttccccctggaggagggctgtatcactaagcagtacgtaggtccttctctccttgaaatctctcatctgctaggtggtaggaagttgcagtggccagtggaaactcacaccagtctgccctcccttggtccctgcagtaggccaggcccagcctggcttctgtcatctcaagaagcacccctggatgtcacctctggctggctttgccagtctcctgcacagcagggacaactcgtttggtccccaggcctcctccctttgctatcttagcagccttctgtgtgcactgagcccccaggttctcagtcggccaccgcccaccacacttctgggctgggagctacccatttccatatcgctctcttgctctctgccactcactgtgtgtggggtaggaatttgacttcttggtatctgagtagattttcagggggatcaggtagtttttttttctttcttctttttctctgttggggtttcttcccctgggtaatatctctaagattcctttgtggccaaagctctgtcctgtacaattttaaccctatgaakattctgctagcaccagctcttttcttttcccacatcccttcgtttggggactgtgataactaccawgagctctaaatccatttgcatacccttgtgtttgcagaaccaccaatgacctgtgctttttccctccaacagcatttgccgaaacagccagtggatctgcagcaatgaagaatgtccaggtaggcgacctgccgctcattctcttcctccttccctgaatcggggaggcgtctcctcctctcttaccagacagggagggccacaactcaaggcagcgagaagttgccctctctgcacaggttggctgcaaccacgtgaccccagctctggtttcaggtaccagctatgctaacccattcacaggccagaggtgggagccctgcaacagctgaaagcggagaatgcacctgcgttcagatgttattgtctgtccttattacctgtttgctgaaaggattaaggttgatgagctgtaaggcctgtatggtcatgattgactaaacaaagaggatacacattctttggaaaattaagaggtagaagggcctggtaattctttaggcttgaagggacagttctaatggaactttccagaatgcctaatatgaagaccatggcgtggtccaagagctcggaaaaccagrtcaccaaatgattcctcccatcctgtccctgccctggaaaatctgcttaggaaaaattattgagcaatctctgccatttgctttctcctctgtttggccccaactctattctatttactgcaaaccttgcccattcaaagctcccttctgccccaccttccaatgacctcagaccttgccctctgtgctcactcacgtggtgttttctatgtgctggccactgtgctaaacactttccggttacaacctgtgaggcaggtgcaatttattctcattttaggaaagcagaaacagacctagagaggttaaatgacttgcccaaagtcacacagctgctacgaggcagagccagggcttgaactcacaactgcctgacttcttactttttcccttccctttcttctccttcccagtactaacctttggtggcctgaagtgggttgagcttggatacctgggactgtatttagggtctgtgagttaaagactttaggatgactcaggacctcatccagtgtcctctacactggraaaattctggaactagatgtgggctagatcagttagtcttgcaaagagatggtcacccagccaggttatcttttgtgtaacccttaaagaaggcacgaaggagaaaagattgctcttgaaagggatatctgtgctccactgaacgtaattacaccatgtccaagactaaaggagctctttggaagacatatgagttgctgcaattaacctgtgaaaacacttttaacatttaaataataagcactcattgtatgagatctgtgagccacagtggatggaattaggaattcagtttattgtgtgtgtttttttagacgtttgtaaccaccagattaggaagttttaacaagtacttactatagggtgaatcttccgtccatcatccttccaactgtccattcatccaagtactatttgaacaccaactatgtacatgatggactgttttctggggcagacaatacagtcctctggtcttcaattcaaaatctagaagatgactttgctgaggatgtaagacattctcttgatgtcttgatgaaaagataaacagtgtcaattctgtctactaagtggtttgatattttgccaacaaaaccactacgctcttctctgcattctcaaagccctggctctgaccatctttttctagtttgggagttttgttgatcatcgcctcccggtccatttgcacccacgcacacaagcatatttccacaccctgccatgactcagcaggcagtggggctgtctgatgctcccagtgtgatgactgcagatagagcttctgatgggaagaataggcggtatggttctggaggggatatgcttggctctgcttgtaaagtgaggagcaggccggagcttctctgcagcccctggaggaggattagaatgacatcagccatgtgagaaatggtaggagccaacccgggaggcagttttaggtggcatcaagggctctgggctctgcagctggacagacctgcccgtattcagatccctgttcagtttctttgggaacttggatgagttgaacttctctatgcttcagtttcctcatctgtaaactggggataataatgagcacttcataggagcaatcaatgagatggtttccatggagcacttggaaatgtatcttatgccaggcatggtggctcacgcctgtaatcccagctytttgggaggctcagtgggcagagcgcttgagcccaggggttggagaccagcctgggcaacatggtgaaaccccatggctacaaaaaatacaaacattagccaggcatagtggtgtgtgcctgtagtcccaggtacttgggaggctgagatggggggatygcttgagcctgggagattaaggctgcagtgagctgtgatggcatcactgcactccagcctgctgggtgacagagatcctatcacacacacatacayacacacacacacacacacacacacacacrcaaaaaaaaaaaaaaaaggaagaaaaagaaaaaaaaatgcatcttgggccaggcgcggcagctcatgcctgtaatcccagcactttgggaggccaaggcaggtggatcatttgaggtcaggagtttgagaccaacctggccaatggtgaaaccctgtctatactaaaaacaaaaacaaaaacaaaaaacccacagaarttagctgggcatggtggcacatgcctgtaatctcagctactcgggaagctgaggcaggagaattgtgagagccccggagatagagtcttcagtgagccgagatggcgccactgcactccacgcygggcaacagagcgagactgtctcaggaaaaaaaaaaagaaatgcatcttgcacatttggtagagattatgttgcaggctttggtgacaatttgcatctggtggaagtctgagttgctttgctaaaggcctgtgggttgggcatttctgcagggaaggctttgggaggtagagggttgtggggctggggaaacaaatggtctggagcagggcagccgcgtccagggctcactactgcaaaccaaagggtttgtttagaagaggtaatgtgcttccattaggtgagaggttccgttttgttttttttcatgaggcaggatctttattcacatagaaatggatctgctttaacttctggatttttttttttttttttttttgagacagagtttcactcagtcgcccaggctggggtgcagtggcgtgatctcagctcactgcaacctctgcctcctgggttcaagcaattctcctgcctcagcctcccgagtagctgggattacaggcacctgccaccayacccggctaattttttgtatttttagtagagacggggtttcaccatgttggccaggctggtctcgaactcctgaccttgggtgctccgcctgtctcagcctcccaaagtgctgggattataggcatgagccatgacggcccggcctggatgctcttttttttttaaatgcagttttaggaatcacctgcctttcattcattccccaaacttccagtgcccatctccatctagtggtgggcccgctgttcgtcaggagctgcctgttgctgactgatggggaatatcctagtgtcccatcctgggtggaggatgggtgagcgtgttcgcatggcccatagttctggctgacgttctagctcccgtggctaacggctacctggcagctcacccacccattttcctgtgtttgtggctctgttgctcagttgtaccgaggagataagctcatataatatttagacttctgatttgcgagaaacttgggaacacaagtcagtgaaggtcagagaaggaaatcagatgagacgattagatgctggccctgaaagttttcctttcgaatatttgcacatttctcgttgacccttcttttcctgggtattgttaaagaagacagaagtccattttcttgcttagataagagtgctctgagaaaacacagaaaggcagggggaagaattcccacccatttttactgccctggggtcaagacatttgacacaaatgaccatattactgtgtttgtagaatgatgataatttctgaaaaatggtcagttcaaaaaggctttcctgagacctcactggacttgaaattacagcacatccagaatgggctgggacgatcctggcccctatcttgtggcctgctctgtcctccacgaacagtcactcctcactcccgctcttctagagggggcagcggagaaggtgggccatgctgatgggagtgatctggggcctttccactttctcctaatttcctctgggctggatgtgccctcctgacccatgctgtcctggaagggatccactgtcctggggaccaggcagagggatgtgtacatccctgaggcacctcatccttaatcctgccttcatacacatctcaaaggcaggcccacacctgggtccagkactgcacagtctagcctggcccctggctgggcctgtcagrgcacatgcgagcatgaagtgccagacagtgagggcctgtggagcttgtccttgacaagctagaatctctctgtgccttttggggaccccttggctgtgtgacagggctagcattagcccctggagctgggcccacataggatggtctgtaggaccctcttacatttgtctttccaacgttggtctagcatctgttccccaaagggggaacttcaggtggaggctgaggtagcgctgtagacagccaagcttccgctgtttggagggtctcaggggaagccctgtgcactctatgtgtcctcatctttgctttgatccttagagaaaggaactcacacatgcaccgtagagtgactgggtgggaaaagtcttcctccttcaccaaatggcaatggtgtctctctctmtatatatttctttttctgtagagtagatagcaaagatgagagcaggtggaggaaatatatagggcaggttgggaagggatccagatgyccttttcagctttgatgggtccatgtttggccctgaagatgggattgcctcaagccaggcaggttgatggagaatcactggagacattggcagaggcctccccctgccaggacaccttccaggatgtgtgatctcagtttggaggtgcattgggccacaagtatggggcctaggctggggcgtgggggagatggtgtgggaattagggtggggacaagctgagggctttgggttgcagggtgatgaaggggagtcctagtccccacccacagatrtgtcagcctgggctgggaagctggcgctgccgaggtcagcactgcctgggtggtggtgagatcatgggcagatggcctcctggttccccattggccctggctggagtcacagcgtgggcttgcccctctgaggacgcagaaagcaatggccttagagttgcccctctgctggtgaggaggatggagtccccattttcactgctgagctccaagactgtcctgcctcaccctcccacctcatcctgcctctgggctgcctactctgccccctggcctccagggactctccaggggtgacactgtttcccagagcctctccacactcaggttcagagaaccctgtgctattgggcagcctccccctggccaggcattccgctggcaccagtctgaggctggtgtggccctgatgccagcaggtagcgtgggacatggcagtgagctgtgagggaggaggggaggctgcagggagcctggaagcaggagygtgggttcctgcgtggttccaccactgactgagtgtggctctgtcaccttccttagttgccccatctgtaaaatgaggccttgacctgaatgacccagctctgacatcttgcagttttaggagcaggaaccgaattttctcgtagaacttgtttttagactggtttgggcaaaggacgtccatgcagttttggggaagggcaccctgcttgcatatgcattccaccttggccaccccaggggaagtgccctcacctcccattcttctcccttcctctgtgtctctccaggggagtgccttgtcacwggtcaatcmcacttcaagagctttgacaacagatacttcaccttcagtgggatctgccagtacctgctggcccgggattgccaggaccactccttctccattgtcattgagactgtccaggtgagctttgccagcccggctgctggtcgggtggtagcccaaggtgctgcatagctgctaggctgaatgggcagtccctggaaggcgtggggcattgctttctgtgcatgagggaggtctcttccagacttcagttagctcctcattcatccagaaacccagcccatcccctctctccctagatgctggcggaaggcatcctgccytgacaataatgcctcctcagggctggctcagctccccacccagtggacgcatcctgcttgggtctagcctgttgcccccataactaaccctctgatgtttggagctggggatggctggggtgggggcaaagagggctggtcttctcttctgaactctgtggtacatgtgtggcttcctttctgtagggatggaagcaaagatgaggacgaagagaatgcacagggctttccttgaggatcaaagtctttgattctctttggaacagtaggtccaaggaacacgatgaagcagaggcccatggttctttataagagactgggccaggctgggagaaggcgtgtgcaaggatgcacttagcaagccttcttgctgcacaactctagggggccccattcacatggagtattctgggagaatggagttgtaggttatgagaaggccagaggctctcgggttgaggcctttctctgattaagagggtcctgggctggggagctggataggcagggggtgcagcaaagtcaccctgtgttccctcttggcagtgtgctgatgaccgcgacgctgtgtgcacccgctccgtcaccgtccggctgcctggcctgcacaacagccttgtgaaactgaagcatggggcaggagttgccatggatggccaggacrtccagctccccctcctgaaaggtatgcttcgtcctgctccatcaggcctggggctggcacagcccatcccttagcaccctccttctcaaccctggccactgtccttaaggacctgcatgcctcttccatgggaatgtgatggagagttatttttggagggcagggtggggtgcttggcatgcatccctccaagaaaggaaggcttcctggaggaggaagactagagaaggaagcctatagatgaagaggttgctctagacctgggacagagtgtagatgggaaaagggaaccgagaggatttttatttggcttgaaccaaaggggcgagttgagtcttgggcaggtggttctggtttgctctggggtgggacaggggcagaggctgatgctgagagatcgggggtggctggtgatgtcacaccagaggatgccacttggggcgaggccaggtgaccctctggcctgtctagaggtagcaaaaaacctacctgtccagtatcttcacctgggttgcactgtgccggtcaaagcaaacctgcttttgcatggtaaagctcccaaacttcacactcaaagtggctctcagactcttccttcttctccacaactgctggccactttgtcgcccattatcctagcattgcacacagcggatgaacttgggctagtgggtacccagcacgtccatgggtgttatgctgtgtgtctccttataagatatgtttgttcccccagggcaaggggtgtgctcctatctgtcgccaccttcccacagaagcaacaattgctgtattcagtgtcgtacacagcatcgctcagacatgaggtggtgtgcagtggcagagtgtcccaggcacattcagatgtcgtggtgtcaatgctaaagagatccccctctgctccagggcacctgcctacagcccaggatgcaggagcctctgcctccctcctgtggcagtagggggaatggcaggtcatagcggggggtgcagaggcttcttcctgggggaccctatttgcgctctgtccaccttgatcrcccttcctcctgacacccccttaaacctcatggccaccccatctkcccctaagtcattgctcttcagtgctaccatccttttgagacaccccatttcctcccaaatacatctgcctgccaccaccctgtcctctccccacctctgcctgagtcctgtcctgcygggttccaggtgacctccgcatccagcrtacagtgacggcctccgtgcgcctcagctacggggaggacctgcagatggactgggatggccgcgggaggctgctggtgaaggtaggtgccctcacggggtactggctccctgcggcccgacccttacaaagtaccccttgtgctctgggtagaatggctttgtgtggtgggagaagaattcctttctcctcatggcctacacccccagagcragaaacaggcctctcttgtttatgaggctggtgtttgttttctggatgccccttcttggccctggggattcttcctgctgggctctgctatcccaagggcctctagactggggtgggctcttgtggggctggggaaggagcaggtttgctgtccaatctcccggctgaaacaaggcccgggagcaggggtgtctccctgggtgcccactgtgggcagtaagggaagagccagattggcactctcagctaagagaaagcctgcccgggaaaggttgctcargaaaccaccagattcttcccctggacactgggactctgcatgtgtgggccacttcctcttgttcttggtggtcctggaatcacactggatagcaatccatacttttcactgtttctctggaaatgaccctggcaggtggacagtgcaaatattactgccattttataaatgaggcaaccagggcacaggaagtggagggatggtgcmgcactccagaacttccagggctaggatagactcctctgatcagaggactgatcccactctgacccccaccaaccgtgtcatggcagagcgaggattagttctctgcctcatgcctttcccatcagaacaaaaagtggttctcgctttttggtcttgaatgcctttacactcttaaaaattattgaggacctcaagatcttgtaggaggattatatttattggtatttatcagattgraaattaaattagagacatttaaaatatgtatttattaactcattcaaaaattataataataaacccactacacattaatataaacatcactgttttggggaaaagtaactgtttgccagaacaaaaataagcaacaagaataataccactgctgcacatttctgcaaatttctttaatggctggcttaataggagacagctgggttctcatatctactgctgcattcaatcttttgcaatattgcatgtcatgtggcctctggaaaattccactctatacttgtaagagaatgaggagggaaaaggcaaatarygtcttcatagtattatgaaagtagttttggtctcgcagaccccttgaaagtctcagggacccctatgggtctcaagaccacactttgagaaccactgcgctagattatgcctgggatccctggagagcctcctcctgcctcctggggtcctgtattccacagggtccttgctataatcctgggtggcaggggcagggtggcaggtttcacccaggagatcctggcgtcctccatcctcgtgtggctatgttctttctcctgtcttagagctcctgagggaatttcaaactaactcctttttttttttttttttccttttatgaaaataaacctgcaaccacagaccataaagcaggaaggtctgggagatcctcttgtcaacctcccttttccagtaggaaataaagagccattatttctggagcaggagtaacttgccctaggcctcatggtcgtttagttacmgggcaaggaccagaactcgggtctcctggttcctgaccagtcttgcctcctgcaccccggtcttcaagggggtgcttcacgttagccagttcactttctttttgtttgttttgttttttgagagagggtctcactctgttgcccaggctggagggcagtggcacgatcttggctcaccacaacctcygccttccaggctgaagcgattctcctgcctcaacctcccgagtagctgagattacaggtgcccaccatcatgcccagctaatttttgtatttttaatagagatggggtttcaccatgttggccaggctggtcttgaactcctgacctcaaatgatccaccctcctcagcctcccaaagtgctgggattacgggcatgagccaccacgcccggccagccagtccactttctcagcatcttcccacctcacagagagggtgctctccacccatgcactttctccccttgatcagcagggccgtaacttctcatcctgggcagctgcccttcctcccctcaggtttctttggtctttgtctctcccctgaggagaagagaagccaacttctttctgtgggaggggatgtagggttatctttggggtgggtttgtgtcagtttagctaacaagaagacgtttccttggccaaggttcaggacagggtcagatgaccccatggcctatagaactgtctttttatatatatttttcttttttctttttctttacacagattcctggggctcrtggaaagggactatcttgtgggttttattatgaagcaggaaagggggtgtttgagttggggcaggaggtggggagcctcagaatactgacaccagggcttttggggatggaagtgtggaggcgagagctggagggaggccagctggggcagaggcggtgcaagaggaggtgcagctaggggcccccyggtctccttcccctgggtgtgttrtgtacgctttgtccccgtggggctggcggtccaggcagcaaggctccagccagcagaaatcacatcctctgtgtgctgyttccctgccctgctggctgccctgcagggcccagctctgccttaggcatagcagtgtggaaaagatccttgcacaggcttcatttagtcagaactgtcactgaccagaggtttatttcamatagtgagtgtcgctaagtgacactaagagagtctctaagtgtcgcccccactctcctaaccctggccgagctgacctccgagacaagccaaggggatgggagragacctggttttagagtgggrcatgggagtgatggctggcttggtgggggtgaatgaaaacgcctttggggagcatcaaactctgagaaaggagagagaaaagatgctgagaggcgggaagggagtggaggtgcaccaccagttatgccgccttgcccagggtgccctgactgcgggcattgcattccagcrcatcaggaggagaacctagtcattcacttacttattcattcatttgttcaacgattcattcattcaacaaacacttactgagtgtctgctggcactgctgtggactgaatgtctgtgtcctccccaaatttatatgttgaaatcctaacccccaaggtgatggtgttacgaggtggggcctttgggagatgakgaagaatgagatttgtgcccttttaaaagacctcagagagcttgctagccccttccaccatgtgaggacacagctagaaggcaccatctatgaaccggaaagcagggtcctcaccagacaccaaatctgctgatgccttcatcttggacttcccagattccagaactgtgggcaatcaatatcagttgtctataagccacgcagtctgtggtattttgttatagcagcctggaagggctaagacaggcaccattctggatgctgagattacagcagtgagacaaaacagacaaaaatccttgcctcatttagcttaagttctaatggagagagacagacaataaacaaagcaaacaagtaaattatattatagatcggaaagtgatagatcctgggggaaataaagcagagaaaggggcaggatgtgccaggattggggggatttaaattttaaataaggaggtgggagaaggcctaatgtgacaacatttggtatttgtcaagcaaacaaggaaacattactctgtcccctttcttaacagtgtttacttgggttcgatttctatgggcctgggaccttctactggattgttaaccctgcattttgttaggttggagctggaagctgaaaaggggctctaagagctgaccctagcccctgagggattcagaacgcagggaggtcatcccaccttggtaatgacatgcggagagggagtcaggactcctgggtcccagcccccgctccaccttcaaatcggggtcctctccgtagaaaccagcagatgcccccagctgtgtgggggaagggcgggctccactctgctggttgttcccgaatgtgcactttgggctcagaactttgttcagttctgagaatggacagtaaaccacatgctcatggcctggagtttgaactgtgccgctgctttgctgctgtcaccctggcaggctgcctcagagcctctgcagactcctactcctatccatcatcaccctcagagtcttctgtggctcgtggccctttctcttcagtgatgcccagggcctgagtggcaggcagcaggttgtggggaggtgtttcttgtcattaaccgtgagctcccggagggcttggaccacacctggcagcctgctgggcccacaccgagtgaccaacgcgaagtctttctatatagaggggccttgagtttgcacgtaactctgggtgggggggtcaggcccactggtgtggatggcacagagggcagagtgcttcgggctgggctcaacctgcctactcaccctagctccgccactacctccctgaccttaggcaagtcactttgcctctttgggcctcccttctccatccttagatgatctgataatttctaaaatctcttgtggcagtacagggctctgatgatttgggaacagggatggagctggtaaatttacactgcagttcactttcccccgcmcccccttttgcagcctagggcttagctgccttttattacattcatatttatgtttcacccggggaacttttttttttttattaaaaccatctcattagctaaacaactatgccgctgctttcgcggcagcggctccagagtggcctggtctctcctgcagctgtcccccgtctaygccgggaagacctgcggcctgtgtgggaattacartggcaaccagggcgacgacttccttaccccctctgggctggcrgagccccgggtggaggacttcrggaacgcctggaagctgcacggggactgccaggacctgcagaagcagcacagcgatccctgcgccctcaacccgcgcatgagtatgtgaacccgggggcaaggcagggacctcgcagaatctcgaggtctccacattagtgcagtgcgttccggaggcagtgctcccaccgcggagggcgggggcggggagcgaggaaaggggtcgggctttgtttttaccgtcagcacttgatcatctgaactgggccatttgctcttcaaagtccctttattgggcgcccgccacaggccaacccccgggaaagaaaaaaaaaaaaaaagtctaccgaggcgggaggatcgcttgagggcaggagttcgagaccagtctgggcaacgtagggagcccccatttctattaaaataataataataataataataataataataataataataataataaatttgccgggcgtggtggggcgcgcctgtaatcccaactacttgggagctacgtgggacggttgcatgaacccaggaaggcaaggccgcagtgagccaagatcgcatttctgcactccagcccgggcgacagagcaagaccgtgtctctccaaaaaaaaaaaaaaaaaattccatagtccccgtccttcgaccttcccagtctactgcagcagcagcttacaaactcagcgttagatgattgtaagataaatggacttgggggtgggggtggcatttgcagatttctctgcgtgaccttgcagccctctattagcagcactgggctatttccaggggagtgttgaccgggagggcgtggcccccactcctccccaccacatcccaggctcgctcctctcgccccacagccaggttctccgaggaggcgtgcgcggtcctgacgtcccccacattcgaggcctgccatcgtgcygtcagcccgctgccctacctgcggaactgccgctamgacgtgtgctcctgctcggacggccgckagtgcctgtgsggcgccctggccagytatgccgcggcctgcgcggggagaggcgtgcgcgtcgcgtgrcgckagccaggccgctgtggtgcgtgccctcccwgcccgcagycctccgggccgccccccaaatccrtccacgtgtgcttttcgaagccctttctctgcgttgtttcctgtggaaagagggcgtagggcattgtgacaaacacgggtggggaggacggttcatttgcacccacttttcccttccacctcccagcaggacaggcggtggggaccggctgatgattcgggcctgttccaggaagacaggttggctcctcctacctggaggcctagaacgtgggggtccctgcaaagcttgggtttcccgtggccgctgccacctagtgttcgttcagcacagaaggtcaggctgtggagcgaatgggtcccagatcccactgggtctccgcctcccttaagagtccgatgaaggcaagggaaattcacatacaaaccctttgcttgtaactccaggcaaaccaccgatggacaaaacctctggcgttgtataaagttacctaaaggtgaattacrtcactgtccccagttggctttagattctcactctgcactgttggattcctggcaccagaggtggtatctattgtgctcacttttttgtttttgttattgctctggggacatttgctgcatgcccagtgtggtcgggcaacagtgatgatgtggaactccaaacttactgttagagtcacagatggaaatggccgccctactagatacctatcctactaagtgaaaggatragtagattcagggcagggaaaaccaaggaaggctttctggaggacgtgtacttggctagggttttaaaaagctgctttcttggcagagaagacttgtttccaatggtagaatcatagtaggcatagaagtgacgagtatattctgttaagaataaggcatagtggatattctgttttttagggtaaagtagatgtgtttagaaattaaaatgtaggtgtagtcccagctacttgggaggttgaggcaagaggattgcttgagtctaggaatttaaggctgcagtgagttatgatcgcaccactgcactctgacctggccaacagagaaagaccctgtgtgtgtgtgtgtgtgtgtgtgtgtgtgtgtgtgtrtacatatatatatatataaagtagatggtcctgttggaagaggagttatgagaaacagtgaaaggaattagcatctatatttcaggagcagtgtaggcatggggaccctagaagtgctactattttgggtccaatgagccaactcatgttttgagttgtagaaatgtcatatgaaagaggagcagagacaacagtaaggacgaaagggacgagcacataatgcagccgttgtgccctccccattcctccagctctgggatgtcttggggagccacaggctaggggctgggacaactgggtctgggtccttactggcaactttcccgtgaggtaccagttatgggaccttgaacccttcacgtaacccctttgcacttcagtttcttccttagcatttgctatttagaaattggggaaagtaatgaggagtgaatgagatgctgcttgtgaatattctttgcttgtccaccartgttagaaatgatgcattatcagtatgtggcagcatccgcaggatttcttaatttaggacattctcctggaatgctaagggcccactgaaatattctttaatctgtcatgaacagccattcttaacctccactgaacagaacaggggaaatgggctgatgcttcagtagtggggataagattcagttaaagaatgtcttgactcctgaggcattacgatagggtagaaagggtggtaggaaggagctttccctggagactgttaaggacaagaggggtctgtctctgtgggtttatgtgacaagagactgggctgaccagatggccttgggctgtccctttgtacccaaggcagttgggtaagtctcctgggttcttgccccaatcttttcttgacttggagaagagctcaggctcagctgtcccctctacccacttccactttctcttccagagaaatgaacagagctccctaaaccagtgaatctattcgtaagaagaggtcacatcaattggagacactcagggagcacagacttaccatgtagctactttgtgggatggtgtgaggagattgatgagaagcacacacattttttttcctcttgcaaattggttgtgctccctttrggaagacaggaccacaggctttctgaaggcaaggaccagggctggccatctctgcctccctgggcctagcatagcccctggcatgcagtggatacacaagaagtgtctgctaaactgagawgtgcattgtttctttggggaagaaggctaaaggagaaatttaataaggctccaagccagcyctagagatagcctatcagaacaaagaaagttctcaagtctagctgctttttaatgggtaaaatgtgcccttgtcattgtaggctcaggtggttgaaagacatctccatctttattgtctaacacatcctgtcttaacctacactccctcagtattcatccaataatccaacctttccattcttgcagagaaaaatcaatgtctaataggattaaagaggccctcccttcccagctaccttcaaacaccaagttcagggtggttgtrggagcgggaggctgcagggtctctccagaggctccccactccattgttcaggctcacggccaaggcttacttttataacatctgtgaaatgccctgccagtaggtttctgctggagcaatggatttgaacagagaggggaaggattgtgatggtctcagaagaagcatgcccagggtgaggttctcatttcttgggcagcagctggtctgcacagggaaggcattttgaaagggcagaatgctccccacaccttccctgtcctctaccctgcccataaggaattttgtcaccagaatgccagagcttctgaggcctaggcctttctctggaacactccttccttcttgggaccgctgagctggggctgtttccttagcaataagaataataattattatcagtgaacattattagcagtgaacattctccacatgccagacattcttctaaatgtgttagctcattcaaccttcacaaagactgggtggatactgttattccatccagtgaggatactgcccaagrtcacacagccagctagtggtggacctgggcgtgaacccaggtatttgggatacagagcccgttcccttagctgcgttgccactttgctacacttcctyctggcttgtgtctcttgcagtatttttctgtgggaggctagggagggtgagggctgtgggcagatgggtgcagcccatttcgctgtggtaggyatgagtgtccctcctctttgggaccagcatgtcctcaaagggactgttttctttctagagagtaagggttatgagcatgagctttagggctgcagagagctgagttcaaatccttcctctgcttcttcctgtgaggtatacccctaacaagtcactcagcctaagtttcttgaaagggggtgatgagagctaactcggcatgaggcatagagcccacgtaagagcaaggcattcagtaggtgctccataaatggtactcattgttgtcacggggtatgcccttgcccgtcattcccagtactttttaatattcacagcttcaaaacctgccaggatttctactacatcctaggctttgagaattcagagatgactaatgcacattccctgtggttgaggaaaggagaaaatgtgtgcccccataattataatacatatctgcatgctgaaaaatacacatttgctcatagtgggaaaggaagttgatgaccatacagatataattgggggtcacttggggaaaactgggtaaagggtacatgggatctttctgcattacttcttgtaattgcaagcaagtctacaattatctcaataaaaattttaattaaataattgggggtcacagctacaaggggtggcaagtcctagaaccacagtccttgctgtccaacattcccgctgaggccttacttcttctcctctctcttctagagctgaactgccygaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggccyagtgcccctgttactatgacggtgagatcttccagccagaagacatcttctcagaccatcacaccatgtggtaagtgcaggcagcastgtcagggacctctaaaacagcagagctggggaggaaaacgggacccccaagtcctttacttcatggatgggtaaactggggcccaaggaaggaagtgacttgtccagaactgtacagcaagtcagaagcggagctgggatttggtccaggtcttctgacttccttactacacagggaactgggattcctggctggcagtaggagttcttgagttttattgccaactgttatgtgttggcccccatttctgggctttaggtctcagttttccttttctggaacaggaaaagggagatctgcctgtcaccctcctttccagcctgctttcagtattctcaagctgaagcatttgagcaggaagaacatggaccactgcagcgctgcctccatggggcattgctaccctgacctgcttcatgcacttccccaaaatagctccaaatcatgcttgcttcctgcagctctttgcctaggccttctgtgacagtcggtttcaacagggttgccatgagcgtggaagaaatttacaacaggacatttgttgagcaaacacttacctgtcacctgttctgtcttagttctggctaagaattggtggtctaaagatgagccaggctggggcagtggctcacatctgtaatccccagcactttgggaggtggaagtgggaggaatgcttgagcctgrkagtttgagagcagcctgggcaacatagtgaggccctgtccctaaatacaaagaaaaaaaaatagttggccatggtggtgcatacctgtagacccagccacttgaaatactgaggtgggaagattgcttgagcccaggaagccaaggctgcagtgaactgtgatcgcgccactgcattctagcccrggcgacagagggaaatccagtcaccagacacagtacctgatagtctactagggaagaccagttagaaacatccyrattggccasgcacagtggctcacgcctgtaatcccaacacttagggaggcygaggtgggcggatcacgaggtcagtagatcgagaccatcctggctaacacggtgaaaatacaaaaaattagctgggtrtggtagcgggtgcctgtagtcccagctatttgggaggctgaggcaggagaattgcttgaacccaggaggcggaggttgcagtgagctgagatcttgccactgcactccagcctgggtgacagagcgagactctatctcaaaaaaaaaaaaaaaaaaaaaaagaaaaaaagaagtcctgattatggaaaatttcagacagacattaaagtagagagaatagtataaggagccccaacgtatccattcccagcttcaatgattatcagcactttaccattcttattttgtctattgactcctctgctgtgtggctggaatagttttttaaaaaagctgtaaatattacatcatttcacctgcaaacacttcagtatgtatttcaataaataaaygattaaaaaagtaaaggtaccattattaacctgaacatgaacaataattccttaataacgtctaacattcaatccrtgttcacttcttttttttttttttgagactgaattttgctcttgttgcccaggctggagtgcagtggcacartctcggctcgctgcaacctccacctctgrggtycaagcgattctcttgcctcatcctcccgagtagctgggattacaggcacctgccaccacgccccgctaatttttgtattttagtagagacggggtttcgccatgtcaggctggtctcgaactcctgacctcaaatgatctgcccgcctcggcctcccagagtgctgggattataggcatgagccaccacgcccagcctggaggattgttttgaggtggagcagaagtctagggactaaacgcacaaggtgtactccacaatccccaaggtaagtcctctggcatgaacgcatgctatatgaaggaagactaagactggagggaagttgggatgaggttcaggggtcttcagaagtgagggggtgagcactgatgctggagcagtaggaatggggcccctggaaggttcttagcagggagcaaataggatccaagagtaacttcagggggtgggttttgggagctgcatgaggtatgatggcagggagagcatctgcaggaaaaygttgacgttgaccgataagaaggtagcgaggccttggatcaagcgatagcagtagaaatggagagtggaagccagaagccagagacgctgggaaagcagatggactagtgggatgtttgagaggaggaggggctgttgcagatggccctggagttctgaacttgaatgcctgtgaggacagtgacgcaagaacagcaagagggccctctggaggtagagggcaagtgatggctttggttttggccttaatgactttgagttaccatcttggtgaacaaatggaatcaacagcttgaaatgggtctggaaggtgagtgagaggttggggtggagagaaagacgtacatggaggtgacagtttcagccatgagagtagcgaggatccctaaggggagtgggccagagggcagaaaagaggactgagtcagaacttgggggaatgttcagagggcaagaggaagaaaaagaggattgcatgagagaggccaaagrtcaaaggccagtaaaaagggcagaaccagagcagtgccatatcatggaaatgaagggcagaagggagtaaggacctcctctgcaggactgctgacttggccttagcccagtgctgttttactacagttgtctggctatagtttgccaggagtttctctctgggaccttaaaacaacactgttgggcaggcatgacttgcttttttagtaaagaatttgaggcttagagagactatcactttcctaaatcagccagcaagtgactagagcccagggattcttgaactctccttattacagtgagaatagacggttgaatttggggatcagaaggtcatggtggcctctgtgtttcagtggtaaggatagaggctagactataggaagttggtatgacttgggagggcagcaactgttgctggctatttcactaaaacagagaaggtgggagaaggtgcgccttggcccctgggtgaacagggttggggagtgaccctggctttgggctctttttagggtttgacatcagcgacctctccatgtctgcgtcctccttgtctctcttttaggcaccagggctgaaagctattcagcagcttgtctttccacttcatttagaaaattgggtttcacggagaaggtgtgttggaaggacctcggggcctgtgtgccgctgtttatttttattctttagacaacacactggagaatgagcctcgctggagcaggtgctagtggtggtcgtgaaaaggtggcaggagggtgaaatgctgtggcctggaggttctgcagaccgcgtgcttggtcatcccagcggccatcacaatggagtatttcttcttctgcagaccaggctcagggccaggagttgattttaaacctatctttgaggctttttagaaaattaagcttttgggtcatgtccaaatgacagattgaacatgacatttacgggggcgggtggaattttctcccttaaaactaggtattagttaaaaaccagaagaaggcacgggttctgcaygtgctcagaaagggaagggctgattctcttgttyattcaacagatatttattgaacagcagctgcattaaaaatgttcaaaatcattacagtcagctgggcaaggtggctcacgcctgtaatcccagcactttgggaggccgaggtgggcggatcacttgaggtcaggagtttgagaccagcctggtcaacatggtgaaaccctgtctccactaaacatacaaaaattagctgggcatggtgatgygtgcctgtaatcccagctactctggaggctgaggccggagaattgcttgaacccgggaagtggaggttgcagtgagctgagatcatgccgctgcactccagcctgggcgacagagtaagactctgtctcaaaaaaacaaaaacaggcagggcacgttggctcacgcctgtaatcccagcactgtaggaggctgaggcgggtagatcacaaggtcaggagatcgagatcatcctggccaacatggggaaaccccgtctctactaaaaatacaaaaattagctgggtgtggtggcacatgcctgtaatcccagctactcgggaggctgaggcaggagaatcgcttgaaccagggagtaggaggttgcagtgagccgagatcgarccactgcactccagcctggtgacagagtgagacttggtctccaaacaaaacaaagcaaaacaaaactgaataaaattattacagtctgagaaatgcaaattaaagcaatgagtatgacttcatactagactggaaaaattagacatctggataatgcagagctgaggggcatgggggcctcatctgcttttgtaaggcatagactggttgagtcatctaggagagtacttggcacatcatgtgcaggtcaggtattcacacctgctatccccgcccttctgcctctgtgcagatagactaaaatccttatacacattcattargacacatgtctgcagatgttcagcacagctttgtttgtggtggtaaggagcargtgacaacctatgtcaatcactgggacactgagtgggtaaaaggtgtattgtgcaacagaagtcacagacaagtggtccgtgtcttcacagggatgaatcttacaaacwcggtgctcgatgggaaaagcaaaacacagcatgctatgtgataycatttatacaaactaaacatacatacaaagcaaccacagacgttttataaaaatatgcagtcagttaggagacttttacatagtccaggcaagaggtcatagtgtcttgtctcatgacagtggagataaagtggatatgaatttcagtggtatgttggaggccaagtccaagggcttgatgatgaatcagatacagaggatgagggagaagacagtggcagggatgatcytgggtttctggttgcgaagccagatggatggcgtcaccattcagtgaatcagccctggaggagaattggctttggtcgggggatcatgagtttagttttgaatatactgagtttgaggtgtgtttgagactcactacattagtgagaccatgtaggcrtttgagtatatgggtctggggttcaaaggagcggtccgagctgctgatgtagatttatgagtcatgtctgtgattggaactggggatggcagcagagtgtgagaagaggagcgagcctaggacagagcctggggaaggccgatattgaaaggccaggcagtgggggcacatgaaagctgaggctgagaaggaggaaccaaggaagtgggaggaaaacctggagagagaaatattttttttctagaagagtggagtgttcaacagtgatgaataatgttgaatgggatcaattaagcaaataactgaaaaaagtcccatgggatttagtgacgtggggatcatccattggtaacgttagcaagctgtgcttcaggaggggttatgggactgggacctggttggaaggggcagagagtgagtgggaggtgaagatgtggaggcagcgagtatagacgagtctcgtgaagctcggctatgattttcttctctgcagctactgtgaggatggcttcatgcactgtaccatragtggagtccccggaagcttgctgcctgacgctgtcctcagcagtcccctgtctcatygcagtgagtactgtccccctggaaggcccattgactccatcctgcccagattcctcacgtgtggaatggcgggagagagctgggtgacaccgtcagatgtgcgtgtgcacccaggcatgggtctggcttcgcccaggatcgccttcatttctgggtttgtgtgagtgactttcaggccaaggcatgtctttgcatgtgtcaatcccgaccattgaggcaaggagtatttgatttcgtgtaaggggaaagacctgcagataaattctatgagacccctattttgcccgtggagaccttaacccagtggatagctgtgagttggtggccttgattgtgatgacagtcacccttctttgatggcctmttgtttcctatggacatgctgatgaagacagctcttccttgagaaagcttcttggatgggtttgaaagagagaaagagaagggttgggtccgttgctctccattcgaaggtcctaacggtggctgcactgtcttttttttttgagagtctcactctgtcacccaggttggagtgcagtggtgcaatctcagctcactgcaacctctgcctcctgggttcaagcaattctcgtgcctcagcctcccaagtagctggaattacaggcatgcgccaccacacctggctaattttttgtatttttagtagagayggggttttgccatgttggccaggctggtcttgaactcctgacctcaagtgatctgcctgcctcggcctcccaaagtgctgggattacaggcatgagccaccacgcctggcctgttgtactgtttaaggaccaggcatggaagggagaaggggctgacctggtactgggggtttcacatttacatttatggattgcagcacccttatttgcttccagaaggcttatccttgcttagaaaggactcttccagtgggagagagataaatggctatcttcaatctccagcttgactgcttccctctctgcctctcactttccacaaggctccttctgtccaagggacccagttctgtgccatggtgtttgcttcctggcttgccctgcgtgacaggtctggctcctggcgtgaccgactggagagcgtctctcagcctagagctggggcaagatcccgagggcatgggtggctcaaaggttgagaccagaacttgtgacctcaagatcactccatccttctgtgtcttcttctgtccctctcagagagtttyccccacacccactctctgttgcattctgcctctcagacctaccttccgtgcttctgctcagaatcttctagtctggtcactggaaaatgtaatatttttcaaagtcaggaaactcctgggattctgtgcagattgggaaaagccgtttagccttttggagtttcagttttctaacaagagtttccatataaaaataaggcyagaaattttgactgttttgcccagaggagcgagtatgtgatacaaatgctattaagtgcacctgggctttggaaagaaaggtgctgtatcagtcatctgctgtcagtattacccaattagccattgatacctactaattgccacgaagtaggatatgtcaatgcgcaaagtagatagaaatccctggcttcatggaacatgcgttctagtgggcccagtggcttggggaggacagtaaacaagtaagtgagatgtgtagtatrtcagatggtgagaagaacatatataggatatcagaggggaagcagcagggaggggagattggagtgtccagggatggagtgttgcgggtgttgcaaattcgcatggagtggctgggcaggggctgacgcgagcagagatctcttttaaagccattgtggtcagatggccttctctccccacattagttgtaaccatttaggaatgattctgttgggtccattaaaactcctttttagcwcccaaactcaggtcttttcaagcctgggtctggaaatttctgcaatgcatcctgattcaatgtaacctgctatagcaaggttaagggtgatgacaagtatgggacattagatgagagctggggtcagaagagctgccaccaatgtaagccagaggtcagaagcccaggtgagaagatgccctcccagtcccacacagggaccctggctcaggcagcygctggtccccrygagtgggcaactctgagtctcttgaatttagtcacagactctaggggaccaaaggacagtgtggaaggtaggtccattmtctccttcactaatcatctctttgcttttcctaccttcgaggcaaaaggagcctatcctgtcggccccccatggtcaagctggtgtgtcccgctgacaacctgyrggctgaagrgctcragyrtrccaaaaygtgccagaactrygacctggagtgcatgagcatgggctgtgtctctggctgcctctgccccccgggcatggtgagtcaccaggcacagagctggtgcctgcccttcagttttcttgtaggcagggatgagtgagggggctgtgcagccagagagaggaagaaacaagggctaaacacggatagcaatggaggtggtgctggtaatgggggcatggaggaggggaggctcttctgtctcctccctgccaaagtcagggagggasttgttaggaaaatgcctggggttgatcctcacaggatctgacaaaaatataagaacttagcttacaggagtgccataggaagcaaagaatttccagaaaatacgtactagtaaaaacaagcattcccactagaattttcccaggggccgccttccatgctatgaaaatggagggacacatatatatttgcatatgattgacgtatatgcatataattttctatttcaaaaaaagacattgatggccctgccgtgtcactagcaagccatgggcccaacaagtctcttycccacaatgaaacttgttttcctcatctgtaatgtgagtcgtgaggtcttggccagcccttaacattccatgactccggtgctgtgcctgaaacaggcatggaggccgtgcatccaaggccgtgctggtttgcgactcctggctcctatgtggatgttctgctgctggtggcaatgatctgagcatgcctactcctccttatctccctcccaagtctaatcttagccagcgttgtattaaatagattaygcatacatcctgaaggatgcaacttccagatgtttctctttcaaaatgcatcctgtcttcttgttttccccaactccaattccttatacccaaagtgaatggtgaggagttggggcagaggctgtggaggccagaatgggagagggtggctctcagatggctttggaggggacttagtgttgcccaggactctgcttgaggggaagtgtcctggactgtgggacctgtcaatattctgtagagggaatgtggactcaattaccagtgtctctcaggaaggctgggattgcagtgtgtgaaggacagatgcttacttttctacttccccttcaactctttcttctcccaaacagagagaccaactcttgttaattctctcctcctctgtcttagcctctgagggttttggaactgtcttttctgatgaggagagctagcgattggccaatgagcacctttgaactggaagggttgtttggtgccttagcagaaggtggatatcacgaagggtctctaaggtggggaatctcagacctgggtaggaacaaaaaataggagagggcaggggaatcttccttattgctcttctttatccctggggcctcttaggtagagtgtctcagagctttggtgtggggaaagcatagatcattgtctcttcatcatactcagcaggaaaaggaacatcactcagaggactatgtcagcatcggatatgctttgaaacaaacttttttgtcatgaaggaaaaaatacagatagccttaaatattagtaaccacaataattatattatgaccccaaatccaaaaaagaggacagygrgacctcaaatacaggctgtggctrtcctrttaggcgctcatttcattcctgaagcrctgggcatgcattctgaggacagcacttggatacctgtcacgtgacgaggtgactcgcacttcagccacaggggattctaacttgcaggttcatattgtaagagattyggttattttcacaactgcttccttacgatgccggcgagtgtgcaaattattgcggccagattcgagasagcagagaagtccgtgyaatttattaagggtgcgcagcgtgccgcctgcagcacgggacacgtgttcttgrcyataacacaaagaaaatggrgctgggcctggaaacaccctgtttgggcccatctgatggtgcagacatcatccctyggggtgttcctctgtccagtctgtcccttgtgaaggggcagggttgtgggatgtcactaagggcttggggaaggggtcacggattctgcattcttctgaggacttgacaggggaaagggaagtggctttttcccgggggcagatctgcggggggcwgaaagagcaggaatggggtgcagagggcagacccgtcaggccaggcttccctgctttcccactccatgctcttgtgcaatccttcagtctttaccggaagcccagtcacctcatgtgttacgtagacaccgaattcctgttctgcctccatgatgcatggctgtgggccccaaggagatgtgtgtgaaagcactttaaagccagagagttctacagaagtgtaggaatagctttcattgttgtttctgtaactatccaaggctgtctcagaggctgcacccatcagttcttcctgctgtccataggagagacctgtaaaggatgctttttcttagatttccascctgctgtggacccatgcttttgtaaatacaataaaaatgaattctcataaaaataaaacaaaagcaatgacaaaaataatatgatcccacccaactaaaaaatattttcagctgggcgcagtggctcacgcctgtaatcccagcactttgggaggctgaggcgggcggattacgaggtcaggagatcgagaccatccyggtaacacggtgaaacgctgtctctactaaaaatacaaaaaattagctgggcgtggtggygggcgyctgtagtcccagctacttgggaggctgaggcaggagaatgccgtgaacccaggaggcggaggttgcagtgagctgagattgcaccactgcactccagcctgagcgacagagcgagactccgtctcaaaaaaaaaaatttcttttttttttwaaaatttttttgagacggagttttgctctgtcacccaggctgcagtgcagtggcatggtctcggctcactgcaacccccacctcccaggttctagtgattctcctgcctcagccttctgagtagctgggattacaggcgcacacgaccacacccagctgatttttgtatttttagtagagatggggttttgccgtgttggccaggctggtctcgaactcctgaccttaggtggtctgcctacctctgtctcccaaagtgctgggattacaggtgtgagccaccatgcccggccttaaaaaatgttttctttcctttttttcatgatccctaaatctaaactcttacttcccactttttatgacatataacagacataacatgactctgccaaatttccctaagattttctaaacactttctcttagtttctgtgcttgcgtcctcacaggctggccctggcccagggaatgcactttgagcagccctgttctcagccgaagattgtctctcctcctctaaggtgcctctcagtgtccaccrtatgcccagaagcacctgtttgaaaatattggcgggggcagagaaagaacccctctctttctggtttgtcccaggcctggcacctgcttagagcagaggttttctggttgaccccacaagctgcaggctgtatctgctcctgccatcgtgcaaaggtctcctggcatgggaatgaggaggatgggggtccctttgctaagtggtccgcaccgtgataaatgaagggcagagaaaccgcctggaaacggcatggtatcggaacctcayacttccaggtttgaatcctgcctcctaacatctacttaagtgagtggcaagtcacttaacmtcttggcgtcttaattttcttatctgtaaaaytggcttgcaggctgttgggaagactggagatgagagcagcgagcacatgggaggtgcttagtgagtggtggtttaatgaccactaactattacagtaagttcgtggtgggaaacggtgaatcctgccatgaacagagatgctgcagggaattagcacacacaggagcatctttttagatcccagtgttcactttctgagacctgccggatcgataaaatgagggggttgtgctggaagatctcccaggtatttttctctagttcagaaattcttggagccatgcttgcctgaagcatccatctctttaagttagaatattacctgctaccaccactaggtgacagcaaagcacaactcactgccctgctcacccttcctgagtccggcggcaagggtaactctgggagcatcgtagagggcrgagaagaagaaaccctgaggtcccattatgtcagccccttctatcacacgggaggagactgaggacagaaagggaacagagccgggtcaagccttcatagttgtatagtggaaattctggtctcctgactctgagaccagggctcctgtaatctgaaacacttaggcctctgtctgggagatgctgacttcccgtttgaaacctagcagctacatctcccaaactgctggtattaggagsctcttggtggcgagaagtgtggttatgtccctgatcccaggatgtccagtttcctcactggccccatgtgaagactgaaggagttgggcaccacttcttaaagttcagagcttgggttcaagggcccatccagaggcggcctcacatgtgggcgttgcacattttaaaagatccaaagaagggcctgtttcagaaatatctcctacatggtccatgatttgtcactcagtcgggcttactgaaatataataagcaaaaattcattttggttaacaagcgagaggtttaaaaaaagcggaacctcataagtcttcataggaggagtcatcacgctcagcaggagtgctttaatcagatcactctcctcctygcaagcttctggctgagttcagctgctttggcctgaaagtactgatggggtaggagaatgaacgagaggcagttggaaggtaaaaaagattctggagagtgggtcacgatggtgttcaygtatggagagttggggacaatggggccttttcagagaaaggtaacaagaccagtattttcctactttataattttcttggagtggaccaacacgtaggaccacgttctcagcctgacccctttcggactgaagatgtcatgagttggtgagtgatgggacgagtatttttgccaggctttcttctgaagtcttcaggggacattcatagactttatcttagtagccttytgatgtcccgaagggasaaacactagacggaggtggttctcttcattttaactgtgaggtttaagtgacttgccacaaaatttggccagggactgytgtgctggcctgccccgcctctctgcacagctcccctctgggtccaatccatcccctaaattacccctttatttccaggcctatctacctccatgaatttccacctccctgaatgtctttgccactttgggattctctgggtgtttttagctgggctattgttacctgctcttctctcccaagtcaggaagtctcatgctgtgtcctggaaaccctttcctctcrttgaagattatgttttgtctcctctccagctctcttatgacctaactccacaccactgtggccttcatagcagtcctcacttaatatcaaggtcctattataatattgctgtccatgaattaataacctcctcttgctaacacgagtcggcagagagcagccacgtggtttgcagtgggtgctcagaaggaggaggaggtggcggctgcagtcatggcrttgttatctcacacctgagctgggactggagtgttctgtccgctggaggagggctgggcttccatagacccacacctgggtgacaggagggtctccctgggccrtgaacgcatggtgggttgtcccatgggttgaatatcatggcgagaggtaaaaacatgcagcatgcagaccaagaggcctgggagcccccarcccggcctgcccaagggtgaggggcaacatgtgctgctgaggtaaggggagcctggctctgtttcctggagtccgtccctgcacttctgtcccacatggtatttgccacaaggaggcgtattatctggtttccgttgactgtaaggcatccgtgggatacctcagtcattcttatagcagccactaggtggtgggcctcaggcttaagtcagagctgacactggacggggcgatgtggacatgaaccctaattgtgacagaggctttgaatgctctgctagagagaggtttttcagccctgccagctcctaccaaggtgccatcttccctactgggtgcttaagctcattccctcccaagaacagtggttccgggaggtaagagctaccaagagtggggtcaacctgcatcttatgccctgcactgtcatcctgacccatcagctgggcttccagagatgcgggaacacctcctgaggttgggtgaagatgrcattaagcrgtggaggattcttcctatttccctccccccaaccgccccaacacacacatgctyacatacgattctagcctgggtccttgaaagccctttgttcarcccaasattgccctgttcccagggatttgtccagctccaggcctgggagctcagacttgtctggggagtgactgggtcacgtggagctggaactgttcagaccaggagcttctcgccctgcagggagctctggagccaaggtgccacagtccttcacctgggggtgacccrggcctctttgagaacccccaaggctaggccacaccaggacaggcacccagggctgccccttggagtcgggacagaagcgtgtctgcatgttgagctcagagtgggtttggctgactcttctggggctggtagttcttagttcttttattttctcagccccaacagaccggaggaatacaacatgctcacgaaagtagtttcccgaggggtgasgacggggaagtagagcataccccatggagagtgaaccgggatacgggagactgggcaggagggggcctgtggcttggaccagcccccagactctagttctgatcgatttctacttatgcccartatttggccctcacctccagagtrttaagtacatattaattttattcaatatagtgttcattttctttaattataaacataatacatgctcattgaagaacacttggaaaaaaattttaaaactgaaaaagaaaataaaatcctcccactcgcctatcccagctcaccacctggaggcagattctgtatttccttctagtcttttgtgaaatatatatacatttggaaccatatgtatatacagtttttcttcctgtgttaaaaattaacagcataagtatttctcacttcatttaagattcttccaaaggaccattgtaatagcaccataggatactggcgcctggtgattcctcartggatttagtcattttcctattaagtgtttccaatttttttttgcaatgataaataattctccatcaatctttgtccataattctatttccctcagagaaatcctttccttgggatggctaggtgtaagaatatgtgcatttcaaggcctctggacatgattttttgaagtacctttgcaaaaatgtccaggttacagtgycccagcagggcacgagagggcagagggcagtcagtgtctttagttgacagggaggagccatgtagatgggaacccatgtttgccaagccctggcctgggcataggatccctgtcctggcttggcctgcagtggaagctgtccccctggctcagccctggtcctggtgccagtcccagtgctgggcttacccgtaggctcaagtctcagacaacacttcctggagcgggctggaggagggctttagatcagtcactgtggccctgaggacttttggattcttttctcttaggtccggcatgagaacagatgtgtggccctggaaaggtgtccctgcttccatcagggcaaggagtatgcccctggagaaacagtgaagattggctgcaacacttggtgaggctcagtgaggggctgcgcyggggacccaggccctgcgggtggagtgagggtgcacgcggccacaggaccttccgcacttgcctccagccccctgtgggaacctggttactctctgcctttcctccgtgcctgtgtttctccatctgtaaaatggggagaatctttttcatcacctgtgtccatcctgcatagacactattcaacaggttagtacagtagcccttatccgaaatgcttgggaccacaactgttttggattttggattattttggactttgaaatatttgcatatacataatgaggtgtcttagggatgggaccyaaatctaaacatgacatttatttatggttcatatataccttatacacgttgcctgagggtaagtttatacaacattttaaatatgtatttaatgtgtatttagtatttttaatgtwtgtgcatgaaacaaagttttgtgtacattgaaccatcagaaagtaaaggtgtcaccctctcagccacccatgtggtgtcatgttggtgctcaaagttttgggtttcagaacattttggacttcagagttttggattaggaatgctcagcttgtatttctgttcagggagatgggccccagggaagacagggacctcgccccaccagtcattrcatttgggccaagctgccagtgggcacggggtctggagggtcctttcgttgcaggccttacactgcccatgagcacttcgtgagtgtgcttgcagtggcgtggtttgaggtgagggtggctggttgccttctcccttttccttggccatcctgcacgtaacccctcaccctgctcattcaccctgcctttgacttggtggctgtgcacagccttggaaagaggcctactggacagaggtagagagggctgtctcttgggcttgaggtctgagcttaccacctctgacgcacaagtgggcttcttgatgtcagctctggttacgggtggtggcagggagggacacgtggcagtgggcagatcactatagattttaacrtgtagctacatacatcttaacgtgtagctatgcacacaggactgctcctggcagaagtgcgtacttcatcactcttttctatactctgggctttcccactgttctgtcttgtttttcccattagcctcaggctttcaacatcagtgtgtctgttttacagacaccctgtggccaatctcaggtagatgtggcttycagggtgaggctgagcgaattcataacaggaggcctaaagagcatccgggcctcctccctggctgcctggctcactttggacaaccccttcccttctttgcctcagtttcccccttttagggacagccactaggcttccctgtctcctgctgggcmccatrctgggcctatgaagtccacactccaygctacaggtcctcaacttccttgggcttcctggagggttgggaggcacccagagtattctgtgttccttcattgcctccatggcccagatgggcccctcaaacccaaggtgcccaacttgtcatctctgccatgactgctcctagtgtctgtcrggacyrgaagtggaactgcacagaccatgtktgtgatgccacgtgctccacgatcggcatggcccactacctcaccttcracgggctcaaatacctgtyccccggggagtgccagtacgttctggtgcaggtgagaggtggggagatggggagagggtgctgtttctttctaggaggggtgggaggtgtggcctcaggttgggttctgtggatctgtctgcagaaacaactctggggtctggtttctactggagtacttcccagtccttcacagaagtgcctgaagcggtaggggatttgaagctcaaagtggttgtccattttccctctgctcacctggggacttataaaacgagacagaagcttgtttgttgttgaggattggtgtgggagaaaggctactgctagtccacattagcacagatgtggaattagaaaaagtcatctgttccttctggtagacacagcctcagtcagggtgcatagcttagggagtgggttgggctgggaagtcagtcccgctcagcctcccttccagcaccctgggcagtgcacagtctgcaggtgttgtgcagtggccctggacagggggatggttgaaatgacccctggagtttgcttcccacgrtatggctttgtggaattctccgccattttaatgtctaacttggtacaattcagaatgggaggagtgggaggatgggacacaggaaagtcatcctgcccagcagatgagagcgatccaggaatcctcacggtgagtgtgggcagcagcccctctgcctcccactccccactgcgtggattcttgtaagtttctctttctggttgacatcaactgtgtaagcaaggaagtatgagtgcttttctcaccagagctgaggcactgtactctgtgaagctttgaacaaatatggtccctctgtctccattcccaggaggaggaggggcgggagcttggtgtggtctgaatggaagaccacaaacccataggagccccagccccagaggctgagttgcaggagctggtgagtcaggcagcgtgggtgactgtggaccgaccactcgtgtagagcatgctgggcatggggcggagccaacagcagcctcctcagtccccacctcacacccgggctggcccasagaggcaggcagtgtgctggggacacagggcatrcagaccaggcagggaacctatgatccggggggatatgcgcccctttagagctttcccagagattctatatggaagtttcccagcctcagcagcaaaagagagggcgacaccagctttgcagaacaactrcccagcccatttcaaatctgaacatccaggaaaaaattaattcagtgcagcaaggaccagacagctggtcagcatctgctgctcccagcccttccctgcccaggccagctttcccaagtggaccagttttaaagactccccctccaaacggtgccccttgtgtgtggcttgttttcctttcctacagctggttctgttgtcttctgatgcattgtcctggggcccctcccctttctgccatcctcctttggggagtatcatcaagacctaactccctctttcagaaatctcagctgaagataaggacaaataaaacacctacacccttgtttcctcttttaaccttcgccatgcatcgacctaacacaaagccatttaacctgacaattccattaagttgaatggaatcttagaggtcagattgtgtgtgttgtatggacatatgtatgcatgtatgtgtgcatgtgtgtatgcatgagcatgtctgtgtgggtgtatgcatgtgcgtgtgtgtgggtgtatgcrtgtgcgtgtgtgtgactgtgtatgagtacatgggtgtatgtgtgtgtatgcgtgagcgcgtgtgtgtgtatggctacgtgtgtgtatgtatgtgtatgcygtgtgtgtgtgtatgagtacatgggtgtatgtgtgtgcatctgtgtatgtgtgagcaygtgtgtgagtgtgtgtatgagtacatagatgtatgtatatgtgtgtttgagtgtatgcatgtgcctgtgtgtatttgggtgtatgtgtgtgtgtgggtgtgtgtgtcagaaaggtaagtggtttgctcagtgttaccaataagtggcagaatcaagattcacaccttgtttttattttttctttttttttttgagacagagtctygctctgtcacccaggctggagtgcagtggtgcgatctcggctcactgcaagctccgcctcctcgattcatgccattctcctgcctcggcctccctagtagctgggactacaggcgcccgccaccaygccyggctaattttttgtattttagtagagacggggtttcaccgtgttaaccaggctggtctcgatctcctgacctcgtgatccgcccgcctcagcctcccaaagtgctgggattacaggcgtgggccaccatgcccggcctcttttttcttttcttttcttttttttttttgagatggagtctcgctctgtcaccaggctggagtgcagtggtgcgatctcggctcactgcagcctccgcctcccgggttcaagcgacacactctgtttttctaagttgaacattttatctttctttttcatcacatcacaataatagccaccatgggggaggcatttgccaggaatgtgtccccttttgcttaattttctatgcaattgaccaacaaggaccagagctccttatcctctctactcatctcgacttggtagctcaggacccatggagctgtgtcaaaccatctttggttccatttctgggccagcagtgcagagggattcaaccagaattcagagccacaaagtgccctgtggtcaaactgtcccagttacctgggtgggactctaggcaaggctccagtgggactctaatgggctctaggcaaggcctttgagcctgatgcatccatcgaagcaggccacatgtcaccttccttccctccccctccttccccacccccaccccactcactgcaggcacctggctcatctgtcgtgggcgaggttgacacacctgagggcattcacctgggcatatcccccgtcccccagacacacacagaggcacatatgcgcagccatggacgtggcaagatcctgtgacacgtactcaaaggcctgtgatgaagagatgccaatcttctggtctggtgagagccagtggggataatggtcttctcctggcactcctctttccccaggattactgcggcagtaaccctgggacctttcggatcctagtggggaataagggmtgcagccacccctcagtgaaatgcaagaaacrggtcaccatcctggtggagggaggagagattgagctgtttgacggggaggtaagtgcagcctcatctccaccctcatgtcccgctttgtgcttctgccacttaataggaacattttccaagcattcatttagagctcgtgtgaatggaataacgcacagccattaaagaggatgaggcagagctattgcaactgaccgtgacgtattattttatgagaagaacaagtggcagaacaatagggatgacacaatcccattttagcgacagtgcagagtgtgtgtgaaggatgtgcacatgtgtctgcacaaacgtgggaagaaccagtgctcacctctagagtagggtggggactggagggtagccgggtttctttgtgtgtgtgtgtgtgtatgaagtgatgatgttatgggatatgtttcatatgtttttctgttcttttcagataaatactttatttttttgagatggagtctygctcttttgccyaggctggagtgtagtggtgtgatctctctgctcactgcaacctccayctctagggttcaarcgattctcctgcatcagcctccttagtagctgggactacaggtgtacaccaccgtgcccggctaatttcttgtatttttagtagagataggatttcgccatgttggccaggctggtctygaactccagaccccaggtgatctacctgccttggcctcccaaagtgctgagattacaggcatgagccaccatgcctggccagaaaggagctcaaaagaggagtaaactaattcagtcccctgtgtactaagaacttaaaaagtagttctcataagtgtacacaagactcccttaggagatcttgtttaaaatgtggctcctrgaactccatgctgagattctgactcagtaggtctgggtggggcccaggaaccygtgtttaaagttgcaggtcatccccaggccacagttttggatcckctgctttgactatgtggagtgctgtggagacccaggctctgggcacaaacttgtcctggtatcttcattttctcccatggcctcagcctgcagctctgccttcttccaaatacccaccattgacagcaggggatgggaggtgaattcttcaccattatggaagaaaactgcttagcaagcataaygtattaactgygagtcagcagtgtcaactscatttcaaagaacagctctatttagggcagagtggcggtgatgatgctgaacaggaggtgtgcagacatgtgagggatagatttgcacatgtgattagctctgcactgcmtgtgatatgttactaatgagaggacctctgcaaagggatgatggcagttctcagcctcagcctcagtctgatgaattggagagtccgccacacatgctgaaatggkcctccagggtacagcactggcagggattgggctaagtcagaggctcaggtcagagcccttcttgaacctgcagtgtgtgattcccagcactagcactgagcacctcagtttccttttycttcagctctgtctcctgatgacagtggctctggggagggggaggtggtgggatacaagaaaggtgagagtctactgcttatttttatagaggaatagatttttaaacaatcaactagagatgcttaaaatcattgccatgttgaaaacctatctaggagaccactatatttaatgactaattgtcaataaaatacctgctcattggtttcatagtactttaatttcataatcatgattttgctgctacctctgttaccgtctcttggtcatggatgcctggagagtggtggtggtgagatggtcacagacatgtcctggcgtggggctggccctgcaggggtgcagtggcaggtggggtcctggaggggtggcagtgcctgcactcgtgggcactgaagacagatgggcaggtgtagagtggagggaggatctggctgtcgagcctgcccttcatcctcctggatttcttgctttgtcttcctccaggtgaatgtgaagaggcccatgaaggatgagactcactttgaggtggtggagtctggccgrtacatcattctgctgctgggcaaagccctctccgtggtctgggaccgccacctgagcatctccgtggtcctgaagcagacataccaggtcagtggctttcttgcttcatcttgttggggacttggcctttggagtgttttctgctccctgatcgtaggtctctaaggacttgctttatgaatccrggtgctcctgtgttgggtgcatatrtatttaggatagttagctcttcttgttgaattgatccctttaccattatgtaatggccttcttttgatctttgttggttcaaagactgttttatcagatactaggattgcaacccctgcttttttttttttgccttccatttgcttggtagaccttcctccctccctttattttgagcctatgtrtgtctctgcacgtgagatgggtctcctgaatacagcacactgatgggtcttgactctttatccaattggccagtctgtgccttttaattggggcatttagcccatttacatttaaggttaatattgtcatgtgtgaatttgatcctgtcattatgatgttcgctggttattttgcccattaattgataccgtttcttcgtagcatcgatggtctttacaatttggcatgtttttgcagtggctggtacyggttgtttctttccatgtttagtgcttccttcaggagctcttgtaaggcaggyctggtggtgacaaaatctctcagcatttgcttgtctgtaaaggattttatttctctttcacttatgaagcttagtttgggtggatatgaaattctaagttgaaaattcttttctttaagaatgttgaatattggtccccccctctcttctggcttgtagggtttctgccaagagatctgctattagtctgatgggcttccctttgtgagtaactcgacatttctctctggctgcccttaacactttttccttcatttcaacctggtaaatctgacaattatgtgtcttggggttgctcttcttgaggagtatctttgtggtgttctctgtatttcttgaatctgaatgacaatatcaacttttctttaggtttcttaacctacagcagcaaaccaatcatgcacaatattagtataacactgcagactattctagggtgttkccttatcattsagtcatgggccagcatgttttgagagctatttgtaaaattgctaataaccaacttttgagaacggttccactatttagggtccaacagtttgttggaacttgcatgatttctttaagtggcatgtatgtgacaagtggctctggctactctagccactggtttagtcaggcaggaatgrcctccacagcatccctgataacaccatccattttcagcttgtacaagccagtgaggcagcactgccctcacttctctgtggcagcccatctcagtcccagaaagcattaacaattcattcattcatttattcaacaaatactgagttcctgtatgtgtcaaacrtggtcctaggcgctgtggatacagcaggggaaaaaagtttttttgtttaggggtgtgtgkgtgtgtgtgtgtgtgtgtgtgtgtgtatgtgtcttccatgtatttgtttttttattgctgctataacaaatcascaaaaacttgatagcttaaaacaacacatttattatcatatggttctagaggtyggaaagctaaaattggtgggcagggctgcattcatcttagaggctctgagagaggtcccttttcttgscttttttacattcyggaggctgcctgcattcttggcttgtggccccatcctccatattcaacgctggcaatgtagcatcttctactttttttctccttttctgcttctgtctgtcacagcaccttttgaactctgaccctcctgcctccctctgatcagaccctgtgatgacattcagcccacacagataatccaggttaaactcttcatcycatgggagccactgttttgccttccataatcctggtgcagattatatcctagcrggaatgttactatagatagtttgggctgatgagccctgtgragaggggatgtaagagcagaatctttggggaagggagggaatgagtcatgccagtatctaggsgagagagtttaggcagacggaacaagcacgtgccgaggccytaaggtggtaggtgtctgcagccgttgtacaaggaggtcagtgtggctrcagaggagggacttgggggtaatggtagttcacgagggcagggaggggcagtagccataccatgggggctactaggccatgggaagatcgttggccttttgcccaacagtgagaacattcttcctctatgtttcctggtgacttacaccccttgtaccaagcygaatgcagcttattgaagcaagatagaatacattttttctctttgtctcaacatcagggctctaagtatrttgtaaaagtatagcaccttttcttctccaggccaaatatttccagttttttctgtagtttttttgttttattattatttttagttgacatttaacygtatgtatttactggtgacagtgtgatatttcagtacatgtatacagtgtgtagtgatcaaatcasggtagttactatatctgttccctcaaacatttaccatttctttgtgttgggaacattcaaagtctgctcttccagctacttgaaaatatacaataaactgttgataattatagtcaccctgtggtgctaccgaacactaraacttatccctcctctttgtgtagttttcacttgtttctcactcattcgtaactactttttcagaacttgttgcatgttgcactccatgatgggtgaacatggagacaggtgagacatatcttcctgattacatttatgagagagcagaattctgcccagcctrctctgaacaggctgcacttctccaggcaaggggactcaccttcccagaggcaggcagttctataactttccctccttggacccctacacctccattggtggagcagtgtacctggctcctctctctgcttctatgcttgttggggacagtgatagttcccaccagtgatctcagggccaaggctgcctgattcccacctctgcccttggctgactatgtgacatgggcatgttgcctctctgtttccatagctttaaataaaatggggccagcaaggaagctcaggaatgggtcttggcaatggcaaggctttgctgctcacctcgggcctcctctgagtctctgtccygctcctcctcctcttcctcgaatgccctctgcctccattgccgccaggaatgttcccctttcccctgagccrgagagcatgctcctgggcttgacggtgctcatccctcaacttgtctctcaaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtacgtctgggtctctgtgtggacagagccctagagcttgcttcctggaatgtccctctgtccccattgtcatgggggctggaaggggggttgtgggtggtatgacctccaggtggctgcagggtgggaaggagggtctcttggatccttctgggctgaataaccccagtttgaccagctgacggctggcctatctcttgcctggttcccaggtgcctctggactcatcccctgccacctgccataacaacatcatgaagcagacgatggtggattcctcctgtagaatccttaccagtgacgtcttccaggactkcaacaagctggtgaggaccttgagggtagtgggaagcagacggtcccaaggcttggcctggtggtatggacacagagtgtgaccttctaacgtggacactaccctcgtgtcttgacatgatctgcaccaagacaccacttcggctttttttcttggctttcaatctgggaaacaaaaagtaaaatcaacagtttctaggggaagcaatgcctggcaaaacatttccttctgcatgagaagtaactccccttggcatgtgccaaygcttctctttcagccccagtcttaggatttgttctcttattgaagtatcttgttttcaacaccagagccagagatttccttttcctgtcactgctgcatttgtccagaccaaaagaccttcctctcccacccccyaaaaccccttggtgcccatttcttgtctcacagaaattcttttctggccttaattttggtgattttgagtcctcgtattatgacttatttktgtgtcttcatctctaatgacaaggaggaattccscaaggttaagtgcagttgtctctctcttttttttttttttttgagacagagtctcgctctgtcacccaggctggagtgcaatggcatgatcttggcttartgcagcctctgcctcctgggytcaagcgattctcctgcctcaacctcccgagtasctgggattacaggcacctgccaccacgcccagctaatttttgtatttttagtagagwcaaggtttcaccatgttggtcaggctggccttgaactcctgactcaggtgatctacccacctcggcctcccaaagtgctgggattacaggtgtgagccaccatgcccgaccatagtgcagttgtctcttatctgctgcatgtatgtgtgtacacacatgtggacatgggcttgtacatggacatatgtgactacagaagtctgtgtacacacacagccatgcacacatacatgctgctgtgtaacaccaccaatgtgggagagactggttgaaaacatggatctcaattctctttctatctatgcagtgattttcggtctctgaggactccaaaggatacttacattccctggtttggtggaaatcctgggcatctgagttggaagagtgaggacaggggaggagttggggacattgagactgttggaacgtcttggaaacaatgacccactcagtgtctgaattcattttctgtcataactgccctgaaaaagtccagtgtgtttagaggcgtgttttggggatgaggaagggttggaactggttgaactggatttggaatcagagtctaggccctattgtcctgcatacctgccccatagcactgcagtgaggcagctgcagggcctgatgtatttccccattctcyttgctgaattgaggcaaagaaagacagtgaccagcacatatgtgtgtttgtgtttttgtaaaagcacccacatgctcatgaggctaagagtgggttgtgaggacagatgggtggctgagcagggaggtaggcagagggacagagggaatgttcttctggaaaatcctcaggctcattgtgttctgcagaaggccagcagcactgcattattcaactcttcttgctggaatgcagattagaaactaagaatcttgccttcccactcattccctctttgagaccattgagctrcatttctccttctacctggacccccttatccttaaattgaccatcagaacatttgcacccagactaagagccagagttcctgacacctggccataggcctgggccacctgaggctgcctttgcaggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgccrtgagtactgacrccctcatgttctcagatgccctcccttcttcccatgtgtctatgcttgaagaccttgtgagtgcagggggatatcttcatgggcgagagaagacagagtgttagtagggactggatggccaagggctaaggagggttaagacattggctgtgtaagaagtttatattacgggtgaggtgggacatggattcaaggcatgaacatgtggagacttttcttctggagagattctggcaggggagaagagggaatactgatgaaaagaaggaagtcgatttatgtctttaattaggcgtgattatatttgccaatatgagtgatcaactcatacattcatgtctatagaatcttgcttctttggacagaagcaacttaatgtttttatgtagaaaactgggccrggcacagtgactcayacctgtaatmcctgtgttttgggaggctgaggccagaggattccttgagcccaggagttcaagaccagcctgggcaacatagcaagaccccatctgtacaaaaattaaaaaaagaaatgaattcagaaccaatagattctggtttaggtgcttcaacaatccagaagtctctaatattggtgacgcccatagtcccctagttccccaacattatctccagatgsygcaggccatcaccacatgggtctgcagtcctggaggctttgcctgttgtggccacagccttgtctcctgtctacacagcccagagctkcgaggagaggaatctccgggagaaygggtatgagtgtgagtggcgctataacagcygtgcacctgcctgtcaagtcaygtgtcagcaccctgagccactggcctgccctgtgcagtgtgtggaggkctgccatgcccactgccctccaggtgaggcctctatccctgggggtcrggctggtgggatgggatagggatggatggaaaggtgcttctaggtcttgcttcatctcagcctccacctgccacgtcctatctctgacctgcaaggctgctgcaggttccgtgggttctttcatcagagtcaggmcagtygtgatttttctcaagtcgagctcctccaaaatgcttttctgtgcctatttrtggsattctcayctaaagcagcccctgccgatagaactttctgcagtgggggaatgttgtattgaatgtaactgtgacgagtgtgtctgaggaactgaagttttgaattttattgaattttacttaatttaacgtaaatagccacacgcagtttgtgacgatcctatggtacagcacagctctagagttactgaaggtgttattcagaagagcagaaagagccccggagataagatttcatttgtcctgaggcttggggaggtgaggtagggtgaaggaatccccgctcccagttttgcagagggatcaatcaaggcacaagcaggagagatgctccttgagtgatggggtgacccctgggagtgcaggcaggaggagttggcttctagggcaggaggaggagttggctcctcccttttagttaaaaatgaggcttcctcgtgggaaaggggagcgttttggttcctaatgagagctttcttttgcagggaaaatcctggatgagctkttgcagacctgcgttgaccctgaagactgtccagtgtgtgaggtggctggccggcgttttgcctcaggaaagaaagtcaccttgaatcccagtgaccctgagcactgccagatttggtaaaacagattcctgggttgtttgaagtgatgaatcttattgcttctccaggggccagcttagagactaggttttgggtaaaaagtcctagccacatgagttgagagactgagtttattttatttgtttatttatttaattcattatttaatgtagtttattgttttgtttgttcctagggtttgcttctttttctttagggatggactagactgcttcctccacatatattcctccacagtgtttttgctcttaataggtttttaagtcctaacaggtttttgcttttctcactgaaggtgggggtatggtcacttattgtccttgtaggtcatgactagtctgagcacaggtgtccatatactggaggtggggactcaggagaggaaagtgagatggaacccagggccctcaggtaacatgaacgtcgtgggggccatagtcaaggtggcagggtgtggctgtcataatggggagggaaggtgctcgttgctctcaccctggcttctcactggacttgcctctgggaaactggcctttggggaggtgagaaggagtcctcagggtgagctctgagccctctgaagtcctgctcataagtagggagcatttattaaaatccagatctattcaacaccactccctgacactaatcaagccttctgggagcttaaacttgagaacgtaaattcgctggggaggggctatggtcacagctgctagagtcagatcctgccgccaccatctgtacaaacaagaatgaacactgcctggggtgagttttctagcaaacacaggaaactagaaagtatgtcactcatgcactgttaaccaaggattgaagcaataaatcttgtggatcacgggaaggaggaattaacttcctagtaagactctacctgcgcacactctttatgctgaaacagagactgtagggagcaaaggactgggtgattctgatgctggcttggggttctgtgccaaaagggcatgagagcttcgagccctctccccacctcctttgctggcacacgggcaggggcagctgccacggtgcacgctgaagctgcaagcagtgtgtggacagaagtcccacagcaggctggtggcatcacctggtatcaagccrcagggggacacttcccaggctcagggcgctgccgccttgtcagctttactgggagtgctgaaggccaggtgcctccaaggctgagagtccaaagaggagatggtcctggcccatattggtctccaccacacggycacttgatttcacctgtgggctggcaggccgtgccactttccgggacactggcaaaaaggtgatgttaccagcagagcctggaaatttggcatrgtagtgtaggaatttgtgtgtggggggccactgctctactacagacttgtggtgtgtgcttggggctgggcacagagcctggccagtacctggcacatgagaggtgctcaccctatgtctgctggaggaatgagtgaatgtcttttcctakgcctgacaccgtggagacccctgtctgctactcccaaataatttgttctgctagataaagctggggttttgaatctttattcatctttctacaatgtttttgctccaattttttctctcttcgttagggcccaacatatcaaacatgttttaaaactcatgcaatttacattctgttagaatatgtactgtaaagcatttatcttcaacagaacatgtacaaacacaggttagcgtctacattttagtaacatttgttcttggagacacttgtaagaaggcttggattataaytaagtattcatgttgctaaagatgtaggttgaaaagaaatcagctttgagtggttgtgtggatggcctagaacaacgagtatattttttcatatcctaggatgggctaaagctttggtttctagaatcaaaggaagtcggctatgtgtgtgttttgaaggtggggggcatgctatttggggacagatgttaaacaatgacatctcacttggatgtggaatggtccatgggatctcaagttcaggtggaacagaggagattctgtgggaatatggaagtcrttgtacactgtagggctcagaagtgtccacaggttcttcctgaaccattttaatttcttcgctcttttctgcagccactgtgatgttgtcaacctcacctgtgaagcctgccaggagccgggaggcctggtggtgcctcccacagatgccccggtgagccccaccactctgtatgtggaggacatctcggaaccrccgttgcacgatttctactgcagcaggctactggacctggtcttcctgctggatggctcctccaggctgtccgaggctgagtttgaagtgctgaaggcctttgtggtggacatgatggagcggctgcgcatctcccagaagtgggtccgcgtggccgtggtggagtaccacgacggctcccacgcctacatcgggctcaaggaccggaagcgaccrtcagagctgcggcgcattgccagccaggtgaagtatgcgggcagccaggtggcctccaccagcgaggtcttgaaatacacactgttccaaatcttcagcaagatcgaccgccctgaagcctcccgcatcrccctgctcctgatggccagccaggagccccaacggatgtcccggaactttgtccgctacgtccagggcctgaagaagaagaaggtcattgtgatcccggtgggcattgggccccatgccaacctcaagcagatccgcctcatcgagaagcaggcccctgagaacaaggccttcgtgctgagcagtgtggatgagctggagcagcaaagggacgagatcgttagctacctctgtgaccttgcccctgaagcccctcctcctactctgccccccsacatggcacaagtcactgtgggcccggggctcttgggggtttcgaccctggggcccaagaggaactccatggttctggatgtggmgttcgtcctggaaggatcggacaaaattggtgaagccgacttcaacaggagcaaggagttcatggaggaggtgattcagcggatggatgtgggccaggacagcatccacgtcacggtgctgcagtactcctacatggtgacygtggagtaccccttcagcgaggcmcagtccaaaggggacatcctgcagcggktgcgagagatccgctaccagggcggcaacaggaccaacactrggcyggccctgcggtrcctctctgaccacagcttcttggtcagccagggtgacbrggagcaggcgcccaacctggtctacatggwcaccggaaatcctgccyctgatgagatcaagaggctgcctggagacatccaggtggtgcccattggagtgggccctaatgccaacgtgcaggagctggagaggattggctggcccaatgcccctatcctcatccaggactttgagacgctcccccgagaggctcctgacctggtgctgcagaggtgctgctccggagaggggctgcagatccccaccctctcccctgcacctggtatgctggcaccttgtgtgcaggtgggagggctgggcgagggctggcatggccttggtgctacatgcatctgccaagatacgactcgggttctaatcctggcttccctggtctgtgtggccttggttgaaacttgccttcaaagggcctgtgtttcctcacctccctggcagggagacaaactgtgatcctttttcgggggaagatcttttcttattgtgtgtgcttctataaattcaaaggtaatggaagcctattgttaacatttaaacaatgccaataaggagtaaaaaaaaaaaaaaaatgcaagtcttactttatcacacagcctcttccccacccaattccaccctctgccttcaaggtaacctctgttaaaggtggtgatgataagcttcattttgaccacactgggtgggtgaaattattccgagtagctgacattcttcagggcaagaccaggatgtcaggtgtcaggtagcaggtgcagtcttcagacactggagtcagactgccttagtttgaatcttatctctgctacttgctagctgggtaattttgggcaaatacttaacctctttgtatatcgtctatacaaaggatraggcaaatacttaacctctttgtatatcatctatacaaaggatacacatctttgtgtatcctcatctataaaatggggataataatagcacctacttgmttaaaatagtatctggcacatgacaagtgctcaaaaaaaaatgcttgctcccactgctgttactactaccttttactgacactggcgtctaatccattcctagttcctgaacatctttattcggtgtgtttgggaccatcccagaataataagccttcttttagtatcttttgagtcacacacttgtcagtacttttgtttctttgtttttgtttttattcacggccatagatttatttaaattcttgtaatatttctgctgaggaaaacaacaattacatcatttcatcaaatctcagatgtgctcagacactaacaggagcactaggcatttatagctggaagaatcacagtatgttcacctgccctgcaagatctgaggacacagcagctcattgtccagggaggggctgccgctccatttccttttgcagtctccttgtattgccaggccagtattttactcatttctagaagaatggtggccccttcttaccgaggaagcctatgcctgctgcttttatttgtagacatttaaacttcctttgggtagaattggagtcttctcagtgtctctaaatctgaggtagtccggacccaggaactccatctccccatcccctcctccctggcccacattgcccttgtactcacgaaggcaccccccgccccccttggtggtgccacgtggtcagcacgccctgcagatcctattggatgtcaggttgtargcctggtggccattgtccctgctggcacctgtgtgctcaccttcctggttgtctttgcagactgcagccagcccctggacgtgatccttctcctggatggctcctccagtttcccagcttcttattttgatgaaatgaagagtttcgccaaggctttcatttcaaaagccaatataggtgggtgagcgaggcacctgaagcagcaggtgacgaagaggctctttttgtggctctacttgattcaaaataatccgcattttctcgttccgtttagggcctcgtctcactcaggtgwcagtgctgcagtatggaagcatcaccaccattgacgtgccatggaacgtggtcccggagaaagcccatttgctgagccttgtggacgtcatgcagcgggagggaggccccagccaaatcggtaacgttggtgccacaggctggatgcagaagctgcattctggttcttatttttggcataagtgactgtgtgacctcggccagtcactttgctccttggccttagtttcttctcctggaaagtgaggggctagatgctcttccacgtctctccagatctcaactgggtgttccttggagtttctgaatcattcagcttttaagtgacttaaggatccaccgttaagacagggtgtcgagccgcagtcagtactgacttggcgtgatctgttctccatcctcaggggatgccttgggctttgctgtgcgatacttgacttcagaaatgcatggtgccaggccgggagcctcaaaggcggtggtcatcctggtcacggacgtctctgtggattcagtggatgcagcagctgatgccgccaggtccaacagtaagaatctggtgtacagtcctcaattcaggagagcgagacttcagaaatgatagaggattaaaagtgggctggggttacttttggatgttgtggctgatattaaatatgctcaataccaacctctgtcctggtttcaaacagcaggaaattatccaaccacgatgtgattaggaaaccaaacaataaaaagtgtgtrttgatcctatatctttataactaattataatctttaatttctccacattttccctttgtgtccaggagtgatcatacctctatgccctttctttctaaagtaggattcgtggtctcttactaaaatgtcatgtctgaggccagagtgattcattgtagggccttgagaaccaatgggggctttcatgtatttagagtcctttcctggtaccaggtaatgggcttggcagggttgatggatgagagacaaaggatcatgctgtaggaaagggaaggatccagatgtccagccttgtgctccataagaacatgtgcttatcatgttcttaatatcaacaggatgtgagctgggacaggtggtagagtctagggaccacctcccagctgaagraggtctgggtgagtggagtgacattgagtcccctcgtggccacctggagaactgttcatctttcagaaccctgcctaggagtgctgtcagaaccctgtcttttctctgctgtcttcctgatgttcttcctgaggaagttatttgctccgttctctatgtcacatatgagctactcaaaatgtgcaaatcgtattgtattgtattgtatttgtaacatatctattccttgcaaaaaactgggagttctttgaaggcaagggaagatcttgcttatttttgtatcatctgtgtatgatgcacaaaataggtgaccatttaaygtttgttgagtgaatgaatgtgacatgtttatgaaatctatgattttagggtaaaggacactaaaarggaaaggatatatatttggatratataacgaacttacaagagctgaaaagctgctaatagaaaatccgttccaacctgaagcacattgcaaattcctagaactttctggagagctgaattgaggaatttcaggatggagattttttcyccttcagtatcaagaatccaaagaaagattttcactgggaaagraagcagttgtggtcttgaagcagatatgatccagagcamgtcatttaaccgtccaaagcctcggtttctcatgtgtaaatgagcatgcacattctctgggctcagccctgtgatattttctcttctcttcttacatatacccccttggtggtctagttcagtgtcatgggtctaaatacatttatacatctttgactttgaaattcgtatctccagcctcacctcaactcagtttgcatgctctaataggcaaaactaaactcctgattttcacatctgtctttcttatcttagaaaatggcaattccaaccttccagttgttcagttcaaaaagctcagcatccttgattcttcttccttttccctgatacctccatgcaagccacgaacaaactatagctccatcttcaaaatacttcgagagtcacacctccccacaccatgtccactagggtcacctcaatccgagtccccatcatctctcacctggactattgaaatagctgtctaactggaaccccagcttccacctttgtcccctgcagatcattctcagcacagcagctgcagtggccctttaatatcaaaatcagctcctgtccctctgctctgtagtcttggctggctttgtttcattcacagaacatggtgagcccttactgtggccaatggagcattgcctgatccatgccctttccctctcttgcttgtccctctctccccagcccccgggagcatgcagtcacatttctgctctggggcctttgcactcactcttctctctgcttgggatgtccctccctcagacatcctcttggctccttccatccttacatcaggtttctgctcagatgccatcttttcaccaaatgcttctccaactgccatatatgcaacgataacccacacctcagccctgggcattctcatcccccttatctcattttgtttttttcctaagcatttatccacatctgaaattctatatatttactttgtttgtgtgtttgttgtctatctctccatgaggacgggggacagggagggactttatgtgcttggttcactgctgtacccctattgcttacaatagtacctgacacagagtagcagctcattaatatctgttgactgaacatcttcctcatagggctgatgtatgtgaccagcctggaaaacatgaggctgtattcagatgctggatataacgtcaggccagtccattttgagccttcttgcccacagatcctttcttgtctctttgctaactctaggagtgacagtgttccctattggaattggagatcgctacgatgcagcccagctacggatcttggcaggcccagcaggcgactccaacgtggtgaagctccagcgaatcgaagacctccctaccatggtcaccttgggcaattccttcctccacaaactgtgctctggtgagtcttataatacctttcttacttccctcaaaaaaaagttccaaaataaacccgccaaagaaacaaaaatagtattcaagagaccccagggtgcccatgcataagatttggccttgaatgaagattattatatagaccaggacctttaagtttctgttcatgggaggtgtataccacaagcccccatggggccagcagaaagctttctgtgtatggtcctatttccactctaattgtccatgtgaacttggcagagagagcctaagcttatttgtgtagagggatcttggacaaaagaatcagaagacataagcaaggaaccccagcgttccgtaggtatagtcttcttccccatgggcctagactaactctcaacatgggtataaagggctttagaaatacgataacacggagactcatatcaaagtaccatagtttaagttgattttaggttagaaacttaaaaaatatgcttttggccaggtgcagtggctcacgtctgtaatcccagcactttgggaggccgaggcgggcggatcaygaggtcaggagatcgagaccatcttggctaacacagtgaaaccctgtctctactaaaaatacaaaaaattagccrggcgtggwggcgggcacctgtagtaccagctacttgggaggctgaggcaggagaatggtgtgaacccgggaggcagagcttgcagtgagccgagatcgcgccactgtactccagcctgggcaacagagtgagactccatctcaaaaaaaaaaaaaawayacacacacacacacacacacgctttttttgtggcgggggcctgggtttgtatattttcccgttactagatgtaagtcaaaacctgcataaagctactgtccttcgggggaataagtcaatgcaagtttgcccttaaagggcaataactctatgcaagttttgacttatagctaataacattagctgtacagagagatggcagctctcctggtaggaatcttcaagtagatctctttcaggtttccaggatcttgcttcatctccccaccttccccatccctggcgtgatctacatgtgaaccaagataatgacagcgtaagctgtagttattgccatattatcgctgttgttggcatcataattattaataactgcagagcatgtctgaagaaccacaggatgaccacctcagcctcatgtccctatgtctccactgttaaccttgttcagattcttttcagagttgagttgacttcaaaaactagaccaggttgcttaagcagacattgtgaatggttcagaatttctgggtgaaagatgggaactaaggtcttatttgtgtctgttgcaggatttgttaggatttgcatggatgaggatgggaatgagaagagggtaagttcctttctgttgactttgaaagaaaggttagagatgtgtttggggctcttgttcccactggttaatttttcctcctttggtcttagtccagtgcttccttttactattatcttgtttttgcgggtccatctgtacatcttgtgttttgcttcctgtctcatgtacaggrggcctccttgctgtgtaggcctgtgttcaattctaggggtcagttgtctggcagatgggcttagagttggagtacctcatcttattccctgcctgaatctgctgttttcttctgcagcccggggacgtctggaccttgccagaccagtgccacaccgtgacttgccagccagatggccagaccttgctgaagagtcatcgggtcaactgtgaccgggggctgaggccttcgtgccctaacagccagtcccctgttaaagtggaagagacctgtggctgccgctggacctgcccctgtgagtcctttgcttctccagccagggcagcgtcaaaggggcagtgcttttagcttggctgtgcagaaaagtagagcaggcacccaccagcccagaagtaccctttccctcatcaccacatgcacagtgctaccttcactcaccttcctttcctcctgtgctctttggacatgcatgcagccagtctcagggatcactgccctctttctctgtctttggaaggcacttccccagattatgcataactggaaggaagaattgcttttctgaggtcaatgctcagcttggctgttggcaagtcaacctttaggaatctgtgtattcagggtatagcagtggaagtatagcagtragagagacgcttccagaaaactctccaaccacacctatagcaacagtacatcaccaaggcggcctggattaagaggaggaaatatttaaagtccatctcatgtacacttgtggagagcatgtcatccatgggctgggttagccttctgtctcatgtttgggagcaatgactgcttatggtgaccatgactcagcagtggattgtaacctttatgctgaacaggcataactggtgggatgcaatcaaaactgtatttatagctcattccccctttagaatttatttagtgagataaatttccctcttggtctaggtgaaaactccaccagactttaggtttcttctgtttattcataaagaattctatagttactttgtcagaagacaaagtctcagttgataactagatacccactcttgcgtaataatcaaaactttgaatttgattagagttaaaacacctcccagttccaatttaggctgcctgcctctgggaaggagggtatggtcagctttcctctgtacaaagagctttgccttttgtgattaaaagcatatcctggaaattactcgatgtcatttcaaagagagcttcctaatacttcactgtgtaccataggttacccaactgttcttctatggatgtgcgtttaggctgtttccagtgttttgtaatgacaagcaatgctgcaatgagtaaacctgaacatacgaacgaattttcatatggttggaggtgtgtcttcagggtagattcctagaagtgagattcttgggtcaaaagataagtgcatatgaagttccccttagacattcccagattctcctctaacaggtgagatgtggttgtgcaaaactggaatgtccatcagtttggttttcgatcagcgaggtatgagagtgcawgcwtctccacggccttgctgagtgtgttgttacagtttttatttattttttttgcaaatttcttacttttcaggaaagaaatagtatctsagtgtacttgaaattcatttctctaatgatgagtgaggttaaacattttatcatatgtttaattgccattttttggtctaattttrtgaattttctgctcatgccttkccccatttkcccattagaaragttgtgataaraaacacatgagatctaccctattaataaattttccagtgtacaataccatattgttagctatttgcaagttgttgtacagcagatctctagaagtttttgttttgtgtgrctgaaactatgcccactgaacagcaacttcccattttccccttcccctagcccccgcaaccaccattctgctttttgcttctatgaatttgacgattttagatacctcctgtaagtggattcatgcagtagttatccttctgtgactggctcatttcacttagcttaacatcctccaagttcatctatgttgtggcatatgaaaggatttccttctttctaaagactgaatagtattccattgcatgtatataccacattttctttatccatttgtccactgatgtgcatttggattrtttctaactcttggctattgtgaataatgttgcagtgaaygtggaagtgtataagtayctttttgagatcctgatttcaatgcttttggatgaatacccagaagtgggattrckgggtcatatgctaatactagttttaattttttgaggaaccttcttactgttttctgtagtcgcgacaccactttacattcctaccatcaatgcacaagggtttcartttcttcacattcttgttaacacktggtatttcctggtgtgtgtgtgtgtgtgtgtgtgtgtgtgtgtttgataatggccattctagcacgtatgaggtratacctcattatggttttgatttgcatttccctgatgatcagtaatgttggatattttttcatataattgagtttttggatgtctctttggaggaatgtcttttcaagtcctttgctcatttttaaattgggttatttgcattttttttttttttgctattgagttgtatgagttcctaatatattttggatattaaccctttatcaaatgtayggtttgcaaatattttcttccattctgtaggctgcctttttattctgttgattgtttctttggctgcacagaagctttttggtttgmtgtagtcccacttgtctatttttgcttttgttgccttgtttttggcaatgatatccaagaaatcgtcgccaagaccaatgttgcaaagttcttgtgttttcttttaggagttttataatttcaggttttacgtatcagtgtttaagtttgattttgggttaactttgtgtatgatataaggtaagggtccaatttcattctttttcatgtggacaggttcattgttagtgtattgaaacaaatggttttgtatgttgattttgtattctgcaactgaatttgttttaacttcgctgaatttgctaacaaatttttggtgaaatctttagagttttctatgcatatgatcatgtcatctgcaaatggagataattttacttcttttttgatttgggtgatgttcatatcttcttgattcattgctctagctaagacttctcgtactatgttgaatagaagtggtgagagtgggcatcyttgccgtcttcctgattagaggaaaagcttttagttttgcactattcggtgtgatgttagctgtggtattttcattaatggcctttattttgttgaggtaattttcttctattcttagtttgttgaatgttttaatcatgaaatggtgtttgaattatgacaaatgctttatctgtatctgttgacatgatagtatgatttttatcctttgttctgttaatgctatgtatcacctttattgatttttagacgttgagccattctcctatctgagggataaatcccactccgtcagagtgtattatcctttgattgtgctgtttaattcagtttgctgtcattttgttgagaatttttgcatctgtgttcatcaggaatattgacttgtagtttttttttaatgtaaagtctttgactttggtatcagggtaattctggcttcataaagtaggtttcccacttcagtgttttggaagagtgtgagaaagattggcattaattcttctttaaatctttggtagaattatccagtgaaagcatctgagctcttatttattgagagattatgattaytaatttcatctccttactaatgatggggctgttcagattttctgtttattcatcattcaggcttggtaggttgtatgtttcagggatttattcatttctttaggttatccaatttgttagtgtgtagttgttcatagtagtctcttactaacctttttatttctgcgctatcaattgtaatgtaagctcttctatttctgattttatttatttgagtcttctctttttstcttggttaatctagctaaagctttgttaattttgttgacctttaaaaaaccaattctaagttttattgatattttgtattctatatttcatttatttttcctcaaatctttattatttccttccttctgctaacttacggcttagtttattcattttctagttcttacattgtaaaattaggttatttgtttgagatctttcttactgtagacatttactgctrtaaactttccttttattgcttttgctgtttcccataagctttgctatgttgtgctttagtttttgtttttctcaaaatattttctgatttttcttttgatttcttctttgactcattggttgttcaagagtgttttttaatttccacatatttgagaactttctgaaattatttctcttagcaatgtctcattttattctgttgtcagaaaagatacttggtatgattttagcctccttaaatttgttaagatttgtttcgtgggctagcatgtgagctattctggagactgttctatgtgtgtttgagaagaatgtataatttgctgttgttgggtagaatgttctgtatttgtttgataggtccacttgggccatagtgttgtttgagttctctgtttccttattgatcttctatctggattttttatccattattgaaagtgagatattaaaatctctcactattatgttgttctatatttatcatcacttctgtcaatatttgcttcttatatttgtgtgctttaatgttgggtgcaatgtacttatatcttcctggtgaattgatgcatttatcactatataatgtccgtttttttgtctcttgtgaccatctttgacttgaagtttaatttctctaagtatggctacctgtgctgtcttttagttaacattggcatgaaatatctttttccatcttctcactttaaacctatgtgcattcttaaatctaaagtgagtctctctcttgtagacagcacatagttggatcttgttttatattttatttatttatttacttaatttatttagatggagtcttgctctgttgcccaggctggagtgcaatggctcgatctcggctcactgcaacctctgcctcccgggttcaagtgattctcctccctcagcctcctaagtagctggaactacaagcacgtgccaccatgcctggctaattttttgtatttttagtagagacggggtttcaccatgttagccaggatggtctcgatctcctgatctctcaygatctgcctacctcagcctcccaaagtgctgggatcacagacatgagccaccgcacctggctgttttattttatttttaaaaattcatttcagccacttcatagcttttgattggagagtttattctacttatacttaaagtaactatggatagggaaggacttactgttgccattttgtaattattttcagtcagtcttgtagcttttttgtccctcttttctactcttactgcccttctttgtgtttcattgatttttttgggtaatgatgagatttgactccttcctcatttccttttgtgtatcttctatagatattttctttgtggttaccatgaagcttacataaaacagcctatacttataacagtctattctaagcttataacaacttaatttcaattgctcacgaaaactctactcttttactgcctctcccccactttayattattgatgtcacaaattatattttttaatgttgtgtattcattaactgatttttatagtgatagttatttttataagtttgtcttttaagtactataccagaattcaaagatttacacattgtcattatagtattaaaatattctatatttgtttatatatttacctttaccaggaattttacctttcatatgttttcatgttgctgcctagcattcttttatttcaacatgatggactccctttagcatttcttataaggcaggtatagtggtgatgaactctttcagcttttgtgcacatgagaaagtctttatttcccctctatttttgaaagacagttttgctagacagagtattcttggctgcccgttgttttcttttgaatagatcatccatctcccttctggcctgcaaggtttctgctgagaaatttgttgatagtctcattgtggcccccttttatatgaaaagttgcttttctcttgctgctttcaaaattctgtttttgtctttgacttttgacaaattgattataatatatgttgtagcggacttctttaaattcattctagttggagtcttttgggcttcttgaagctggatgtctattttcttccctaaatttrttcattatttctactttccattgggttttaatcttattcgttattttaaatatttgaactattagctcattatctgtgatataggttgcagtactatttattgacatgttaatatttgccccagtggtgtgagataagaataataatcataaaccaaattttcatatgtgcatgggcttatttctgaactttttttctgattccacttgttgtaagctattcatataccaaaaccacattgtcttaattaccacactgtcttaattaagaggaaatacctctaatattttgtcattaaaggctttatggtatgttttattgtctggtagcactagtacctccacatagctttattctaaaktgttttcctggctattcttttatgtttgttttttctgtatagactttagtgtcaacttgtttacctccataaaaagtttgttggtatttttattggaattgcattaaatttatacattaactttgggagaactggcatttttatgatgttaaatcatcctatccaagaacaagtttgtccacttattcaagctgacttgtctgtcttctagaagtgttttcaggtttattcatttgggttttgcatatttcttgctaagtttattccaagtattgaatcttccttgttgcaattgtaaatgagacttttttcttctccattatgttctttaactacttattatttgtgtatataaagggtattgatatcaatatatataacatctatatatctatatataacctatatatatctgtatatgttaattccatatcctatagctttactgaattcttttattattgagttagttttatcatggattctctagggttttctgggtatgatggtttgtcatttgcaaatagaattgtttttcttttttgtcaatttttgtgcctccaattaatttctcttgtataattccattaataaactttttagtacaatgttgaatagcagtggagtatcttgcacacacacacacgcacacacacacgtgcacacacatatcatgtattttatattatgaaagtatccctcaattctcatttttgagtgtttttttgtcaagagtgattgtggaattttggtgttggtgaaggctttttcagcatctatggagataatctcttgattttttttctttaaatatattgatatggtatattatttgaagraatttcctaatgttgatcccacttggctatgctttgttattttcataatgtggtgttggattctgtttggtaatattttatttagtacgttggttttgacattcataagtatttttggtcagcaattttaacactacttatttaaattttcagtaatatacatataacataaaatttatccttttaactatttttaagtatatatccagtgacattatcatgaatgaggtcaggagattgagaccagcctggctaacacacggtgaaaccccgtctctactaaaaatacaaaaaattasccgggyktggtggcgggcgcctgtagttccagttactcgggaggctgaggcaggagaatggcgtgaacccgggaggtggagcttgtagtgagccgagatcttgccactgcactccagcctgggcaacagagcgagactccgtctcaaaaaaaaaaaaaaaaaaagagagagaaagaaaatccacattgttgtgcaaccatcaccaccatccattgccagaacttctttcatcttgtgaaactgaaatgctttattcattagacaatgataccccatttcccccttcctccagcccctggcaacaaccattttgctttctgtctctctgaatgagactactctaagcacctcttttgagtggaattatgcatttttcctattgcgactggcttattctgcttagcataatgtcttcaaggttcatccatgttgtcatcctttgtgtttggttgatttttttttttttgtagtgaaacattttaactcccgtttcctttcttttgtgtatattctataactattttctttatggttaccatggggattacatttaacatcctaaagttataatgctgtactttgaatttataccagctcaactttggtaacagacaaaactctgctcttatacagctctatccccacactctttcagttattgatgtcataaacattacatctttatacaytgtgtgttcaaaaacatagacgtatataaattttaatgcattagcctcttaaatcatgtagaaaacaaaaagtgaagtcacaaactaagattacaataatatccagaacttttttggttcctttttatgatttcaatttctttattgaaatttccattcggttcatacatcattttcttgattttgtctacatcttcttttagctctttgataatttttaagacagttgttttaaagtctttctttagtgagtctaccatctggtctttctcagggatagtttctgttgatttactacatgagacagattctgccaatgctattgttgtctaggtggggagacagatatttggtgcttcttactccaccatcttccccgtctcccaccctgtaggttttttgttttttttttgtggtgggggaatactgtcttgatctggtttagatattggtgttaaaactggtttcattaaaagctttaagaagttttctctccttttcagtactctggaacaatttatggagcatcggactatcaggtctttggaagtttaggaaaatttccttgtgaaatcatttggggttggtattttgttttttgtttcttttttttggtggagtaactttctttaattcctactaacttactctaattcttccatgtaaattggtgtgcttaagatttgtcttttatctacaggagttaattttgttaatctccattttcctagaaatttatccatttcatctagattttcacatttattgtatagaggtcttgaaagtagtcttttttttaaactaaaattttgtttattgtttgtatatactctagggtacaagtaaaattttcacagtaatcttttataatatcaaaaattctttttaaatagcgattttcttttgtcatttgttaatttatatacatgtytattatcttttttcttgatcaaattaactcatgatttgtctttctggayttttttaaaaatcaagatttcaatttatttattatgtttactgtttttatattctctactttatkgatttctgcttttatccttgctattttatgacttctttccttgaattttcttttagtttaccttttgtgcttttctatttaattggaactgggaatttcattcattttcattgttttatttttattgacagaaatgtttactgttatgaattttcctaggatcactttatatgtatcccaatgagtctgatatgtagtgtatttattatcattattttctaaagaaattctgtactatctgtttttattgtccctttcacccaggatttatatcataaattaaaaaaatttccaagtgtaaagatctttttaaacaataattaaaaaatttttaattttactatactctgacgagagtatctgtaatagttctactttgtggaagttaccgttattttcttcgtgatctaatacatgatcagtttttgtgaaggtgtattctctattatcagggtgtagagtatgagatccctcgctctcttcctgtcacccctccatgagaactacatattttgattttaatgtttgtcttctatagtcttacttaccttttccccattttatctatctggttctgaaagggatgtctaaaagtatcctgttattagtttgtctaccaatgtctccttgcttctcctatagtttttgctctatgaagatgttgtctggtgcatagatattcacagctgttatggcttcattgtgaattatactgttcagaatgctcttattagtcacatttaatcttttttttggctagaattttactttgtctgatatcaaaatctccatccctgttttcttattgtttgatatcctttgtctgtccctttactttagcctttctgaattttagttatatagcaatagttgggtcttgcctttgagccgaattgaaaacctttttgttttagtagacaagttaagcccattctcatttattgccatcttgtgtttgatcttctttcgtcattatattttataattgtttgttatatatttttcatttataaatgtggtgatacgttaaggtgtctaggaaggtttatgcttttgttcctgtcattacctttgaagttatacctttctaaaatgccttcaggcccatatttttaaatttaagcattcattaatcagtttttcagtttttaatagcattctttaacttctacctgtggctatccaacaatcaatgaggttattctaacttttcttgttccctcccctctcctcccattgtcgagttctattatttctactgtcacagcatataacatttgcacattagtcttccattcttcgttttagttttagatctatgactatataaataaaaatgctcactttagttgttttgttaacatttcctagtcatctcttagttggaggaaatgttctctagtagatttctttttttttttttttttttttttgagacagagtctcgctctgtggctcaggctggagtgcagaggcgcgatctcggctcactgcaagctccgcctcccrggttcacgccattctcctgcctcagcctcccgagtagctgggactacaggcgcccgccacyacgcctggctaatttttcgtatttttttttttgtagagacggggtttcaccgtgttagccgggatggtctccatcacctgacctcgtgatccgcctgcctcggcctcccaaagttctgggattccaggcgtgagccaccgcgcctgggtctctagtagatatcttaagaagggcttatgtgtacagaattccattaattcctatgtatttaaaactgtttttctatagcattgatgctagaagggcaccttggctgaatacagaattcttgattcacattttctttcactaaatttctgaaaaatgctgctccattgttgccttgctttgtatattgcttttgaaaattctgataccaatataattmttttgtccttgtaaattatttgatctttttgcctgaaggcctggaaaattttttctttatgtttgaagtctaatagtgtactgtaatatgtctcagagttgactgttttgggttaatttttccggacatctggcacatgactcccatacatagatttggttcttttttgatttccagaatgttttcatgagttatattctttaagtgttagttctgttccattgttttgttttctcttttaagagtccattttttctcctgtcttacattttcattactgtctctttgacctttatactttcttcattaactcattttcattctcttgattggtttttttttgcttttctctgatgctctttattaaattyttattttgatgtcatcttccttgggtacttataatttagtctttatttcagagttgactttgcacttttattacccacccccaccaagttcactgagttctatttttatttattcttgtctttgttcatttctcttcttagtttttgaaattctgattcaaggtggttttcatttgtgcagatgtttgagtatatttaattcagtttgagtattgtctcatagttttcttctatgtcataacattttgttttttgttttttcctttttgtggaattttcattagatgaggagtgttggttctcattttctgatcttttgaagaagcttttatggacttgcttaatctgttcattttgtgaattttgggttttacaagatttctggttcagtgaccctcctttctattagtatagaaaagtcatttccttagtggtgtgtgtgtgtgtgtgtgtgtgtgtgtgtgtgtatgtgtgtacatgtggatcctgaaggattgtgtggcctctgatttttcaggtttttctggaccctgactttcccgtttgctttatttttatgtctccagtcactttccaagcacctttccatttytttttgctcccagtccccttgaaactatgcttttcaggttgtcaccaaatattgcgtgtgtttttagcacctgctctggtctgttgggatacttcaaaatatttttgcccttaggataggcttttctttctggtggtagtggtggttatagagaaattttaggcttgctgcccactctcttctctcttcttttcagttctccttggattgtccttgctcatgacaaaggctaacagttagaggatgagggatttttgctgggtgggatttggtgttttttctcttttactttatttacggctattttaaagtttggatgtttttggctgggtgcagtggctcacgcctgtaatcccagcactttgggaggtcaaggcagatcacgaggtcaggagttcgagaccagcctggccaacatggtgaaactctgtctccactaaaaatacaaaagttagccaggtgtggtggcgcatgcctgtaatcctagctacttgggaggctgaggcaggagaatcgcctgaacccggggaggcggaggttgcagtgagccaagatcgcgccattgcrctctggccttggtgacaagagtgacacttctcttggaaaaaaaataaaaataaaaataaaaataaataaaatttgggtattttcttgttttctacttatgctgaaagcatgcttttttcatagtaatttaatttgttcttattgttcttcactgtgttcagaggatatatatctccctacatatttatttgccttgtagtttattttattctcatgaccgttggggctggctccttgacttgaccatatatatatatatatatatatatatatatttwtttttttttttttttttttgacggagtctcggartctcggctcactgcaagctctgcctcccgagttcacgccagtctcctgcctcagcctcccgagtagctgggactacaggtgcccgccaccatgcctggctaattttttgtatttttagtagagttggggtttcaccatgttagccaggatggtctcgatctcctgaccttgtgatccgcccgcctcggccttccaaagtgctgagattacaggtatgagccactgtgcccggccaacttgacaatattaatagctgaagtattagggcccactttggctacctggacgtctttttgaacatttgtgttttgctaacaattcactttagtatctgatatcattacattttgacaatcagccaaaagttttaatataatattcaatcacaaatatttgtattgtcacttggaaagataatgagtaagaagatgttgaagaaaaggagagagatgagataaaatgatttcaggagatatttatgagtgatatactttactctgtgataatattttataactgtgcagtaacattttgttatataactctaatgtattaatttttaattggttcggcctaactttctctatgtcctgaacattggaatgtgttaatatatatggctcattaaaactaatcactaaactggagtataatgtgatggtttgttgggaggtaatttggtattctggagatggaaggacctcaagttttactatacctacaatacagcaatttacaaactattgaatttattttgtgtcttattcataaagatttggagatctgtttgttaaacatgcacatgtgagtcatgcactattaggtaggcatttcatctatattgcaactaattctcacaagaatactaaaaggtatcgattataggcctattatgcagaggagataggagaggatcagtaaagttaagtaactgatccaaggtcacagtgcaagcaagtgaaacagaaaccaacccctagtttctctggctgtaaagtacccattacacagtcacagttcatcttagggtgggcagagccattctcactaacttgccttgtgtgagctaagaccatttctttgccttgtgatttattccatccttatggcagttgggctgactccttgacgtgacaatatcaacagctgcgtgttggggatcacttgcagcatggatgttagtaagccagtagtattcagtactgtcacttggaaatgactgactgctcaaggacataggggatttttagtagaacttctggggaggctgcttagctctgatggtgcttccagacccatcatttgtcagtggttgtgctgcttgacagtaacccccatagggagaggttggctcaggcttgrctatgagtgagggatgttagtggggcctccctgctccaccgaatctgtgtctcagctcttgggcatgtattcacctgccattgtagatgtggtcgtggtttgtctggaaagcttatctccaactttacttaggtccaagattagctttcaaatcatttatggtggtggtgccttcaatgtgaggatttttaccaaatcatcttatgtaggtgcaaaatgatcagtattcaccaatartgttttaataggaatcttgagaatttgccaattatgtgaatgactcagggtcaaatgagggagcattgagactcaaccattttttttttttttttttttttggctctggaaatatttctcctgtgcgatctcttaagggattaagtcaacatggtcacttgtaccattaccttagtcacttggcagctgaaaggacacgtgtctttaggtgaattttctttacaatgagatcatgagctcatagcttgcttagcttttcttaatttccacgagtcataacacccctggaacttaactttgttttctgggccaaggcatccctgtagaatggattattcacactgtacatttaaattttttagaagtgtggttctataatttgccacattttatgtaacaggaaaatatttaatggccaagtgttacttacctaaacctctctacctctcagagccccagtttcctaatctgtaaaaaaaggaggaaattgttctatatgacctcaaagggcctgttccrttctctactgtatttatctgtgtgcaacttggtcacacctgcctgtctgcatgtagtaggcatgggggtttggataacgtcgcatccatcctctgcttctctstgtccaggygtgtgcacaggcagctccactcggcacatcgtgacctttgatgggcagaatttcaagctgactggcagctgttcttatgtcctatttcaaaacaagkagcaggacctggaggtgattctccataatggtgcctgcagccctggagcaaggcagggctgcatgaaatccatcgaggtgaagcacagtgccctctccgtcgagctgcacagtgacatggaggtgagaagtactttctgtggatccrtggtaaggcaatagaatgtcaggaaaaccacctggacctggtggcagttgcttttagttgatgctcttgttaggagctctgccttctgcttaagtggaggagaggagtaccactttcttagaggggtttattgccatccccttgtcttggcgtgatttcatgttgttccgggctcagatttgcaagatggaatcacttttagatagcataaaattgtgaatttagtgccagtttctggcactggtggagaattgggattggcatcaggattgttyactcggaaggtattatgagtccaatgcctaaaccctgtaagctttccaaagggaaacatttatggcctaaattaggtcttttgaaaatatttaaggcctacataaaacgtcaggctccaaaatttgaaaagaaaactgcaaaactgatatatatatatataaatgattgattaaatgcttacaaaaggttacactatgccaacttctttacttgttcgtgtagaaatcataaatatttcattgtgtgaaaacaacttgtaagctagattttctcacttcgcaagaattcctgaatttgaacaataattgcagaraaatcttagtcatatatcaagtgagtaactcatagccaaaaattaaaaaatcaaaatgataaaaaatccttccaaaaattttacagcaaaattatattcattgtggaatgtgagtacattttaatgtgtttgatatgatatatggtggggctgcccaagaaagagcgtctagtggcacacatacacacaaagaagacttaaagtggtcccattaaaacaccagtgtccaaccttttggcttccctgggccacactggaagaggaattgtcttgggccacacatacaatgcattaacactaacgatagctgatgagctaaaaaaaaggtctgggcataattttctgatatccaccaccacagagaagcaaaaatgtccttgcattcaaagggttggacacagctgctagatgctcttggagacactgctctgatgagttggcaataaggcgactttcccagcctgtcttaaaggcattgcccttccctgttgagtcacatagactcaaggttccttttaatctccaggcttttaggttcttggtgcatggccacccrtacagtattacaacagcctgttttctggtcaagctctgtaaagtcaagctctgttttctagtcaagctcttctttatcttagaagagctgccgacaaatatcaaggtttgtggctgatgttgcagttgagtgtgatgaatgtgcaggaactctcggtaacttccctaaaaacctaggattcctcattgctaggactacggatgagctctttcttctttgtgcaggtgacggtgaatgggagactggtctctgttccttacgtgggtgggaacatggaagtcaacgtttatggtgccatcatgcatgaggtcagattcaatcaccttggtcacatcttcacattcactycacaaaacaatgagttccaactgcagctcagccccaagacttttgcttcaaagacgtatggtctgtgtggtaagaacattttctcaactcctcttctccccctgctatacatttataaaccttacttgctctactctgaggctcttggatgcttatatttcagggtctagtagcgagggtcagattctggtgaggatcaagaatggcctgtctctggcatcaatgtttttgtacccagggccactcagtttatcttttttttgtttgtttgtttctctagggatctgtgatgagaacggagccaatgacttcatgctgagggatggcacagtcaccacagactggaaaacacttgttcaggaatggactgtgcagcggccagggcagacgtgccagcccatcctggagkagcagtgtcttgtccccgacagctcccactgccaggtcctcctcttaccactgtttgctgaatgccacaaggtcctggctccagccacattctatgccatctgccagcaggacagttgccaccaggagcaagtgkgtgaggtgatcbcctcttatgcccacctctgtcggaccaacggggtctgcgttgactggaggacacctgatttctgtggtgagtctccaagttacctctgaaaatcctggagaccagctaactgggcttgctcagcctctctgtgccccagattctttatctggctaataaggatgaaaatccctgtatttcgtatgayctggrattccagttaggatcaaataagatggaagatatatatatacatatacatatatgtatatgtgtgtgtgtgtgtgtatatatatatayacacacacacacacatatatatgtatatatatacacacatacactctgcaygtagaatttttatgtaaattaatgcatggtcctttccattagtatttctatagttcagacaaatgcgattttaatgtgttagacacatataggcatctgtaaagggctgtgtaaccagtcacattgaatttgaaattccaccaagctttagcacacrcttacagtgtagtccatgcctgagcaggattttgaagtgcaagtagaatcattggttgccaagagtcttctcagttataaacactgcaggattgctagtgcagacagcccctccccaaggtcagcttccctacctggacttggcatttatttaaagtacaggggaaactgaaatgaatcagatatggctcctgtccctcaggggtgctggagtgaaaagaatactgaacttgaaaccctcagtcatcaaatataatcctcgactatttttttgagggaaatcaatatgtacatgcctgttagagcctcagagtttatcatcatggaactgtcagcagctctgagctgggtctggaggacttgggcatcctagtcccagctcagctggtggatggactgttctcttagtctttctggacctcagtttctgcatcctagaatgagatagttggcctagataacctgtaggttccttagggctcygattttctgaggccatgtggatgatactgcctcctcccaatcagcctgcaaatcaaggggcaaatgttagtttctaagttactggaagcactttctctgcatactgatttctttgtgtacctcctggttatttactgtgcacacagagggaaatctttggtgctccaaatccttggaaacttcgtccatcacctgcctgccttggtgccttgaggatgtgaggaagttgttgagcgaatcagaacgagggaaatgaatcaccttgtagcttctctcccaaggcagttctaagctgtgtattcctaatttaaagatgcttttcaagcataaaagacatatgtattcaaaaaaggacaacaaaacctactaaggacacacaggttcacaacatttgttaggactagatttggctgctagtagcagagaattaaaattttctgtcatacaactgatcggaggcggtggctccagctgattctgggcctcaaactggattctagttccttgctctgccctcagttgggtgtggtctttttcttcatggtctaagatggagttctagccatcacattcatgctccaaggaggaagctgagggaaggagggaagagggacaaggagcatgcatagctgtcttttaaaatggactcctggaagctgccatgggatactatactttcttttacagttcattgggcagaactagtcatgtgactacacttagctgcaagaaaggttgggaaatatagtcctcattctggtggtcatatgcccagcctaaagttctgtttctatggaaggtggggaggatgaagattggtggaaaatagccgtctctgccctggcaagtttgtctgatgattaaccatgttgaatcagctgtgcccatttcactctggctggtgtgggcctttgcaagtgacctccttctctgtctacagctatgtcatgcccaccatctctggtctacaaccactgtgagcatggctgtccccggcactgtgatggcaacgtgagctcctgtggggaccatccctccgaaggctgtttctgccctccagataaagtcatgttggaaggyagctgtgtccctgaagaggcctgcactcagtgcattggtgaggatggagtccagcaccaggtaggagcctgggyctttcacttcccatggggctgcttccctcttgggtcaaaagggagatatgttcaccagtgattggcctcttccaactgtggcagcagggttgactcttacggggatcattagggatagggaggcagtattgtgtaatggccttgcattcagatagctcttggttcaaatcctgcntctgtcatgtattatctgtgggattaaacatcaaagtgttgttaccacattattattatgattgttattactattgtctttatgattatagtcatttaagcagaatgatacagaaatccaggagggaaagggaaaagaatattttgtgtcataatgtctgccattgttaagagagattatgtacsttgattgtgctaaacmcaatatattcattatctyagtgtttttcaaaggtgtattttgcagggtattaacagttacttgtggtcaagtgagtttaaagaacaccagctaaccatagttaaacaggyttctttattgcagaactctttagtctttttaatatactactgtaccttgcagatatttaagagagtttttgtttctcaaacttatttgatcatggagcgtgtgtgtgcrtgygtgtgtgtgtgtgtgtgtgtgtgtgtgtgtgtgtgtgtgagaatcccttgggactgggattccacagaatacattattgtatcctgtgtcactcataaatacaaaaatcctatgaagaaactaagacctaaagagctcagtaagttacccatggaaacaatttataagtaatggagttgatctcagaatttgaagctctatgtgactccaaagatctggctctttccactatatgaaatggcccttttgctgcatcttttttgggctgatttgcttgggagtcactgagtcatcaaawttttttttttttttttttttttttttttttttttttttttagctctwtgggagttattgagtgtattttgaaagcatatttaccagactcctccgtcttggcctaaaatggctgtcatctctcttcaaagttgaccccgtgtatatttgtaggatctggggcagtgtgtgtctgtgcacatgtgaacgtgtacatgtgaatgtgtgcagtggccctgtccttcatscttgacagtgatactacagaccgtggtagagatagaagcatatttggcttctaggaaaggagaatgtgttttgtgatcatggactgcactcaagacctaatgtcttcatcgccaaggaggaccattcttgctaagtggaccaagtagagtgacttaccactatgttcaaccacgaataggagaactcatggtaaatgtagctaaccagcctgcagaatagtgaaaacaacatttcagtaactacactattctgtccctgatgttataagccaggatagggaccattttatatgattctccccaaagctctrtagggtcataatcgcacatcctattgaatggatgagactgaggctcaatggcatgaggtgataaagctgggatttatattcatarcatcagtcatcctatagtgtcctagccctgccattgacctcactggaactgtgagctgaactctgggctaactcatgttcattggagcatgggtatccattagggctattacttatagtcacttatagtgatctcatctgctctagtttagttgttgggctttgtcctagtggatccaatttgtcctcaccgtggaatagatgagctaaagtcctactctactgccatatttcaacttgccaagttaagtaattgcctgttctgtgatattccctaaatgagttgacaaaaccttatattcctctccttgatttgtatagctcctgagctcctgcagggcttgaatgatgtggaccaatttacatatggggctagaaacctgtggtaatttcagaccggttttactagtagtggcaaaatgcttgctctcagaaggagacagaaatgatcttttccttggcgttctgtgatgagaagtgagctcaagtttgcagcatttctggctcatgagtgtcaaatgtctgcaaggtcctgagagcaggaagactgtgaactttatcttagtgtctccaaacccctatcctttgcttctcctytctggtgctattttcccctttcactgcccgcctcatcttcagtccaacacattagaatatgcattcaagttgtataaagtttccatccaaatattttggatgtagaaaccgtcttataaatatattttaaaatcaggtaaaataaaattagttaattgaaaactttgaaaacaacacagccacttttagtgatttcagaaaatacagtttaaatgaatgaaaacaaacatcatatccagccacgtgcattttyaactttgactttcaaagcagagaaagaataaaaacctaatgtgaagaacatttccattaaagaaacttttttttttaaactgaaaaataaagcccagaaaaccttttattaagggaaataaactagggtataaaactattgtagtaatttcrgaagagcaaaatattcactagttttcatagctcttgtttattttacaaaacagagtctaaagaggtgagtctttggagtaggatcagaagggaccaagagcctgcacaggctgtccctggctcagtggagctgctggtggtggtgggtgctgtagtgacaggcacaagtttagcaggaaccttgtccatggcccagaagctctggcccgtagcctccttccctctcccttagtctctgctgtccctagctgggctcagtgtttgcatttcatttgcatcccccatcacattggctggtggtgggtggtgcatgatgaattgcttgtgtccttctttgaccttgggccttgaaaatgtcagttttcccaccttattctctgcaggccgatctttgtcaccttcattcagactttaactcctgctggctctcataccggttctggcctggtgatagtcacgcctgggccctggaacctggcgattgcractgcctgcstgcagttgkcctgggcttgtgcagcagtgccatctgccggccgcgttgctgcatagcctsgccaggcctggagagccactacggttgcttttagaagcttggccttagcttgttttttaaatttttwatttttattcttttccctgccttgggcaggccttaagcttcctgggaaatgaaaatccccagcggaggaggttggacacctgcttttggtcatctgttgtgtgttacccattctcaggatagttggaaaattgtgtgatttattcttgagtttaaatatctgaggtctgcrtttaaaaggagagaaaaaagaacactgaaacatatacagaacatgactctctccttccgcatcccctcatgtctgccaattcgaccccctgccccagccctccgaggccagcgccctgggcccctccctccaccttcccagctggagtggcagcygctgtgtcttttctggtttttattcctagtccttcccttttccrtcctgcatgctgtcgccagggttgtctttatttagctcttcyctgtgaggcagggcctcctccattgtcttcagccacctgcctcacctgtgatgccgggcactgcgggagtgttccttcktctgtgcctttgttagctgtttcccacctggaattcctcctcctttcccctttgcccaagtcttcctgtgcttcataggtgcacccttgtgagactctctggagtgcccaatcttagtggactctccttttgcactcttactgctcttttattttttatttttacaaatagctttattgagatataatttacatgccacaaacagcacatatttaaagtgtacaatttgataggttttgacatatgtacacacctataaaaccattgacataaccaagataatgaatttccatcccccaaaggttagcttatgcccttttaaatatatccctcaaccctagacaactactggtctgctttctgtcactatagattcgtttacattttctggaatttcacataaatggaatcatgcctacgcacttcttttctgcctggcttccttcacccagcataacgcttttgggattcatccatgatgctgtctgttttgatagttttctccttctcattgctaggtrgtattccacggtgtgtgtgtatcacaatttatttttctcattcagattttcacgaatgagtcttatttcctcaacctgactgtcagccattcgagggctaggayggtgtgttcagacctgcccaygatgggcactgtgtytgytgatgagaagcagttgtrctgcaagaggctaggcctgtggtgtctggggccagaatgctaagttcgaagcctggatgtgccacttggtcaaatttcttaacttcttggtgtctcagtttcattatttgtaaatatagatactactacttatctggtagtgttattattaggaaaataaagtacataaatgtaaaactcttagaaaaatatcttgaacatatttattattagttacctgtgggaggcagcagagcatggtggtttaaaaccatggatttgggccgggcatrgtggctcacacctgtaatcccagcactttgggaggctgaggcaggtggatcacttgaggtcaggaattcgagacccagcctggccaacrtggtgaaatcctgtctctactaaaatacaaaaattagytgggtatggtggcacatgcctatagtcccaactatttgggaggctgaggcaggagaatcacttaaactcgggaggcagaggttgcaatgagccgagatcatgccactgcactgcagtctaggcgagagagtgcgactctgtctcaaaacaaacaaacaaacaaacaaaaaccaaaacataaaataacaaagaaacaaaccatggatttggattcaaatcctcactctgtcgctgtgcctgtgggaacctagcaggtgccttagctttctcattggaaaagtgagggcagtggtaaaacatatcctcaccgtaggactgcagtgaggattacatgagtgatttaaataaagycctcaacacagtggcacacagcaggtggcatctgaatgttagctgctatcatttattgagtgagtgaaaggtgtcaagggcaggaccagaggrrttaatcctgaaggagggcagggcactttgggggaagggggccttacttgkgggtatttgatcttccttcttagctgactgattgctgactgtggaagtaataagtaagaccttcttgacctgggaacttcttagaggcctttgagctactggataagaatgtgtttcttcaggggcaatttcacttgaatttaattttaagtttaaatttaactttatggctgaatccagagggagactgagtcctggctctgcttcttattagtggagctctttgctgtgtaccctgtgctaatcacagtttctcactccttacaacagtcctgcaaggcaggcttgagtacgctcattttacaggtgaggaaactgaggcacagcggaatgcagcctttgttagagttcaggagttcctgacttcaaagccttgtgctgtggggctgtgtgtaccttcgagaaggctgctctctgccctgggccgtctcccatttgaaaaatcagagaactgcactcaggcctctaaagtcactgcgggcrtcaagaatgtgatgctttcaagagttttgctgtcctccccaccgctcttcctaccctattgtctgaagtcaatttcagaaataaatggatttttttccccaagcaacaacccaatttctcctttggcttgagaaatgactagcagtgcgatccaagaactctcatttttctttctttgcttggttttagcactgccaacagagaaggctgtagtgaaaatttccgcatgttagtttacaaagcaatgtggcaaccacctttctgaaagccattagaacctcacaacctcctttcagcctgcttttgtttgcctgtgaggctctgtcagagggctggstcagggactggcccttgccggaggcagggagagctgacctctgtgaattctgggcttcgtacctagaatgtcctgtgccctttctgaacctygctttgccctcagttcctggaagcctgggtcccggaccaccagccctgtcagatctgcacrtgcctcagcgggcggaaggtcaactgcacaacgcagccctgccccacggccaaaggtgagagtcctccyctccctggtgccttcatggaggaacaagggcccctgcaaggccccccagccacccatcttcacctctggcagagcagactcaaacactggcacctagagtcctagagtgggtgggcttccttgcccagcctgcatttcccatcactgggcctgggagccccattytgcacctggggtcgacattctcagattaaccctcgcctctggtccccagcaacgstcagacttaagagtcccctggagggtaaatgtgagggtgtcaacaggaacatggggacactcatctgtcagaggtcccgtggcctggatccttgtgggatgacsrtacagaactcctactagttttcagtgagcaagaacatttcaaatccctctgaggctgtcccaccactaatttctctgacttttgtggccgttcctctcctctagctcccacgtgtggcctgtgtgaagtagcccgcctccgccagaatgcagaccagtgctgccccgagtatgagtgtggtatgtgtcccaccagggggatgtctccagggcccaaccctagccccagggggcaccaygttgaaggtgctgaaaggtgtctctgttctcaggcacagggtgtgtgaaaggaggtgggtaaggaccgaytggatactccaaaaaartggaaagggttacctctggagaataggatttgcttcctagaagaatctactgtaaattactaaacacaggtttgacaggattaatacaagaatggggtgattactggggactrtggagatatactgaagaaaaggtcaygccaaagcaacccattttcattttcaataagattttgaggctgctagatatagagaagaccacacactgggcaccttgagttcagcaggttgtttgctagaggttttcatgctagccttgcaggctgctctgtgaatagtgggctgaataatggtataagtccgtgaattcagagctgatggaattacggttagcatggcaggaaatcattagtrcctttgtcccagtcctgtccagtgtgtttattgcttgtacagatgaagacctaaagcacaggcttgtacaatttgcagtgatgcagatattgaagggagagcagatagatcaggggacagtccaaggaactaaaagaaaatcatataatcggagaaacttatttgtactcrtgaaattgatcagaaataaatagaagtcctgtaggggagggagatgtggcttgrgaacaattaatgtaaaggaggtcttagaatgttagcagtagagagaactagagggatcatttacttcaagcccctcattttatagacattactagtctcctacaatgtgccgggcactttgcccttattattttgtgaactcctcagactgatcctataaggtagagttcccaccttccagaagargaaacaggtctaraggawccaagttgacttggctgagatgtgaaagccctagtggatgataagaataatcagtatgtgacttggattgatctatctgtctgtctgtctgtctrtctatctatctatctatctatctatctatctatctatctatctatctatccatctatccatccatcctatgtatttatcatctgtcctatctctatctaacctatgtatctatttatcatctatcctgtctctatctatcctwtgtatctatcatctatcctatctctatctaagctatatatctatttatcatctatcctctatcatctatctatctatctatctatctatctatctatctatctctattgtatctagttatctatcctatatctatgtatgtatctatctgtctgtctaatctatctaacctgtgtatctatttataatctatcctatctctatctaacctrtgtatctatcatctatcctatctctgtctaacatatgtatctatcatctattctatatctatctgtctatctaccctatgttttatcatctatcctatctctctctaagctgtgtatctatcatctatcctctatctatcatccatctatctatctatctatctaatgtacctagttatctatcctgtatgtatgtatgtatgtatgtatctatctatcaaatctatctcatgtatctagttatcattctatctatctatctatctatctatctatctatctatctatctatctatcctaacycatgtaatctctgtctccatcatcatcacttacctaaaacagtagaagtctgcatgaataggaatgtagcatcccactcacaggtaataaaagagtaacctttctgaactctgcatggaygtctctctttctggccctcagtgtgtgacccagtgagctgtgacctgcccccagtgcctcactgtgaacrtggcctccagcccacactgaccaaccctggcgagtgcagacccaacttcacctgcggtaaggcctctgtggatgaggaggggtggtgtggcctctctctgctggtgtgagggaggccatcctcctcagggacctcttccaagatcacgtcatttcctgttttctacctagctgaatctgggttgggagtacatctggaacagaggggttagggtcacacctgcacggaatccttccggctgcacgctgctgaaggataccaggtgtgggcacagccacaggcacctccgtcttgggtttatgaagaagcagctggggctgagatgaggaggcctccraatctaatctttatttmtgcccatcctcctgtatgtcatcaaggggagggaatgtttccttgacttcccctcatcattggatcttattcccaaacaaatttatagtttttygcctctgaaggtgtatatatgtaatcactatatactgtaacttaaacatagcgatggactaaaataagacacgacaagaaaccaaattctgtatttacctcccgagaatccccactctaactccgttggcgttcttgtcctgctgatgtggacactcacccgacttcctagatgtgagacttcaaggtgggaggagagcacattgtgtttgaagggagctggaaacaggcaaaggacacagggacaggatttggtcttttaaaagtgacattgtggctttgacaagattgctggcaatctttcattccacactgattgctggcggacctaaagtgtagggtattgttctaggtactgaggtggggataggatcacagaagctcctggcatagaacagtgcttagcagggcgtggtgtacccagacctactggacttagagattctacatctgacacctctgagaatgaaggaacccgccccttccagatgtatgtgggaaagtgatagagcagggattgagcagccttcacttctmctccattagagttcctagcttcacatttccctttttgattaatgttcatatttttctgcagatggactgcttttggtaacattgaataactcccagcccgtgagcttggccctcacacatttctgacttaatcttctgagtctaaagctccctggcaccctatagcatagctgaatacttacragccctggctgggcgcagtgctcagtgtggccttgtcctaycctcagcctkcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaacygccaccaatgactgtggctgtaccacaaccacctgccttcccgacaaggtaaggactgcttggctattaactatcagttaatagtttactcatttatttattgctgtyagtttatccttctatccacccatccattcatccatccacctacccatccaatatttgctaagcaacrtgtgctcctcatggaagatttgcatcctacccagcattcccttcttgcccaaaccaagtgctacaaggcttggttggggggcagtcagcattccagctcagcctgagtggaaatttagttaactcaggagrcatttcttgtgagcctactatgtactaagcatggctaggtgctgaggttacaaataatgtgcaggacatggtctttacctttataagcttattttaggttagctaaggaaataacatgattgcatggattatttagagatcagttaatagttatayatacatgttgagatgaggtcttgctatgttgcctaggctggtcttggactcctgggctcaagtgatcctcccacctctgcctcacgagtaggtgagattacaagtgcacaccaccacacctggctacgagcagttaatagtttactcatttatttattgctgtcagtttatccatctatccacccatccattcatccatccatctgcccatccaatatttactaagcaactactrtgttctaacagaattggcactgtgctaggtgctatgggagaaatgttaagatgaagttcctatgtatgcccttgttagtatatatgacaatagtctataaactgaatataataaagtgtcaacgaatggtacagattttcattacaaacagcagtcttataggtgaaagagccaccaagattagctatcattaaagatttaattgatggagtgggaaagtgaagggcgcgaaagtggcggagtgagaactgaaatgagccagaactgcagcaggaagacctgagcatagttatagctgctgcattgaggggagtcctgacatgaatgacagacaagctgcagtcatctctccttggagcctrttagggctggaacagatctttatttgtctggaatgcttaagacctctcttcccctctggacgctcttccagctcagggattctaagcacgcagttttggagaagcgggaacaagtctaggaggctacagttgctgctgctgctttcttatatctctgttctccttctcgtcttcctgcccacccctcctgccttgctgtttttctattaatgtttcttgtgtgtctttaatctatagtaatgccactccccatttttatgcctttgatttgttggggaagctgggtcatttgtcctgtagaatgtcatgaattctggatttgactagcagccaccttatggtattgcataatgtgttcctctatcccctgtatttccagtagactagaagttagacccaggggattcattacattcaaggtcaatgcagtagggaggcaagaatacctgatcaagggtgccatgtgcatcacacccagaggcacataatgtccagctgtcctcctccctccctccctccctccctccctacgtcacttccttccytccctccctccttccctccctccctccctccctcactccctccctcactccttycttccttccttccttccttccttccttcctttctttcttttctttctttctttcttttcattcgttcttcttttttttttttgagatggagtctcgctctgtcgcccaggctggagtgcagtggcgcagtctyggctcactgcaagctccacctcccgggttcacaccattctcctrcctcagcctcccgagtagctgggactacaggcgcccgccaccaygcccggctaattttttgtatttttagtagagacacggtttcactgtgttagccaggatggtctcgatctcctgaccttgtgatccacccgcctctgcctcccaaggtgctgggattactggcatgaaccaccgtgcctggcctcgtttttcttttttttttgagtcgctctgtggccaggttggagtgcartggcacgatcttggctgattgtagcctcgtactccctggttcaagcgattctcttgcctcagcctcctgagtagctgggattgcaggcgcayaccaccacacccagctaatttttgtattattagtagagacgggatttcaccatgttggccaggatggtctcaatctcttgaccttgtgatccacccgcctcgacctcccaaagtgctggsattacaggcgtcagccaccatgcctggcccagctatcccactttgagagataggactgattatgtgttcrgatgaagcracctatttctgcattgtgaagtttaccccatcaacaatttatagttttactatttataagtgtttgttgtctaagatttattatgtcattaggagtttcaaaattgtgacttttctctacttctatcatactgattgcatttattaactggaattctcccgtaagaaagaactttctcccaactgctttcagttaccctgaaataaaattactttagacaaagtagaataagtgcttgattttttcttttccagttttcatagccatgagttgatgctctagcaactgtcaaggacagcgaaagaggttttttgtttttagcttcattatgaactcatggattcttatgtgtttgatgtgtgttgattcattgtaaactttatttttttttgatattcaagttgtcctccctggggtaaatgggggctcttttaagttggctctggagcctgttggcatggcctcatgagtctttcgtagctktcttgctttctgaaacaataaggcgtgctgggctcaccctgggcatttcctgccctagtccttggatctgccattttgacaaaagtccccctaccttttagtgaaagtggtatttaggcggtatgatctgggtgccaagaatatttatggctctgggttgccattgccttcagacctttttggtgaacagagcttagaaatgcatattttaagagaggataaaaactcgtaaatttgtagtggtatttctgattcaaatgaaattacaggactttacttccttgattttttgcttgtatcatttctcttctaagttgaaaattctggtttcctaacataattaactacttatttgctttatcttgcaatatacctgtaatagtttcaaaactaacctgtaatcctagcactttggsaggccaaggtgggcgggttacctgaagttgggagttcaagaccagctggccaacatggtgaaaccccatctctactaaaaaatacaaaaaattagttgggtgtggtggtgtgcacctgtaattccagctactctgtaggctgaagcaggagaatcrcttgaatccgggaggtggaggttgcagtgagccgagattgtgccattgcactctggcctgggctacagagtgagactttgtctcaaaaaataaataaatacataaaatttcctttcagttcttctagtcctaaaaaaaaaacctcattgggggatatttgtgtaaatactaggttttgaagtcatttgaaataactattataattatattatgatgtaatatatcatataattattataaataataattatgtgccactgacgatatctagttaatatttcaatttgttttccatttttagggattgctttttatttcttttaaattttaaaattactatggtgtaaaacacttaaatgattttaaaccccaaattataaaacaagacatattcccaggagtcttactctgtgttttctctaccttattccwtcctccaccctataatttatatatgtgaatatatataatatataatatatatatatakagagagagatagggtcttgctctgtcaccyaggcacaagtgcagttatgcgacctcaactaacttcagcctccaccccctaggctcagacgatcctccccctcarcctcctgagtagctggaactacagacatatgccaccacatccggctaatttttgtatgtttttgtagagacaaggtttcatcatgttacccatgccggtctggagcttctgaactcaaccaatctgcccgcctcagcctcccaaagtgctgagattacagacatcagccaccgtgcccagcctttataatttttattagtttttctctttttgaaaatataactgaattttatacatgtatatttcttcccatttctcatagaaaggaagcatattatgaattatattttaaattgttctttctcatttaacaatatttgatggagattattctgtatcagtgtgtagagatctgccttattctttcttatagctgcatagtactccattgcatggcagcaccatagttttgtttcaacaagtcccttattggtggacatttgagttgcttcagccttttgctattacaaattgcagtaacaaacagccgtgtgcatctgtcattttgtggtcttgccagtgtgtctttgggatagattcctggaagtgagattctgggtcaaattataaatacacatttacttttgctaagtattgctaaacaattcttctccatrgggatggtaacattttcctgcaggccttttaatagaacaaggggtctcattcartaagttcattatacagaagctagaagactgagaagataaatgataatggtttcaaaatgtttgaactgctattatgacattcacagggtggagacccgttttgcataactttggagggcatacttgggattaatttcaaaactgtcattaagtcccgtgatcaaacagcttccttagctcctcattccaacaaaaggatgtccgagcattgtctgtggcgtgcatcccagactttccacgtttccctttcaaccagcctttttcatctgttttcccacatctctaccagagcctattgttcttcccaataggatcccttgtctctcaaacatatcccctgctctgtgtcccagagtctttacttgttatgttcctagtcactcgtgggcaaggggacatgcattcatagcccctgcccaatttgctcgtaagtgggcagagggctcgatgaggatgggctccaagtccaaggacattactgggtctgggcatgtgggtacagcttctcggtgacataggaaggagtgaagtgcagttaaggcaggaagaagggagaccaaggcagccagtgtgttgtattcaagtctgtgggaccatgaaggcctcacgaggggccacccctgagagactggtcatagcttttctaaggctggtgggcagggaaaggaggaggacraaatctgctttataagcagccctgcatatgggcggagaccacatttggttttatttattgccacattctcagcacytagagcggcttctgtgtagtaggtgctaactcaccgcttgtttcaatgaaacaaatgagttcactyaygaaaacttatgtctacaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcggtgagtggggcaggggctgggcatgcctgcagctatcagagcgggaaagtagaggagggcatcttaggaagggtaagaaaggttctttttttttttgaaatggagactcgctctgtcgcccaggctggagtgcagtggcacaatctcggctcactgcaagctctgcctcccgggttcacgaggaagggcaagaaaggttctttagtgacctctggttcaaggctaggggtgaggaagagggagggggttagggctgggtaagaagaaaaagcatgagcaaaggatttctgcgtcatccttctgcagttcagtccttggctaatggtcacgtctgttgtatggccttaagtctaaagtactggtggagtaggtttgagcagagacatggggaggactaaatgcctagaaaagagracttgaagttttcctttttcttccaccctcatgtatcaccttcgcctgtccctagaacaaatgtatgctctgaattttctaggatcgtccttgtttcagtttactctggtgtttccacatagactgttgattttcagaccatgtttataayttgaggtacggaaaacatgatccctgtttcccaaatccagttcgtggtggctgcccctgaggctcctgtgtgtgctggggtgccctattcttgcatgtttaggatggatcagactggagaaaaagggagcaacaatctgcagggaggactgtgggtaaaattctgcttgctggtttaatgcgattattattactacattattatcagcagataatgatgttaagagaagaggtgccagggcaggcgagcacatccatcttgtggttgcttttgcaaatgtcaatggcagtgaaggcagagttcctgaaggtgttttcgaggtgaatggtttgacggaggagggcctgagggcaaatcccgaaacccaggcccttcacctgctattctacytgcatttgggtactgagagtgagcggaggtgctcagtacctttgggagaggatgacgctgtggtatccaggtgttcctgtgggaaacactaagttttggaaaccctttggttttcttctcctctcacaggcsatctgaggccagggaaataacttgctgtcaaataaagagagtgctgcttagaggtcatttttagaaaattgacaaccaatatatttcgtgtttcagtggggagttttgcttgcaaagaatagaacccattcaggctagctacaataaaaggggatttgtagaaaagatacaggaggatctttcagacaggaagtgcaggatttgtaggtgggcaccgtggtcctacagcatgtctctccatttgtcctaagagccggtatttctgtccgtctgctccagctcctcactgcaggccagcttcctctgtgcagaagttttgctttctcacacattttgtttacacacagctttgttaaatctcacttcaactccacacagcttttcagatccgtggttcatccctgtccagtctgacttagttggtctttgtgtttcatggatcaacttctcaagaggaaagttgacaggcccagctcagcccttggatcgggtccgctgtccagttcatgctctggtccagtcaactattgggggagctgcaggtcctggggtataatcctggctgcgtagaaaagctgggggaagtttcaaaaagaagatgagtagggaggtcagggcaggagtggmggaggaaccatgtctagaactcttgaccgtgtgattgctctagggaatcgagtgccctgtcttagaggctgaatgttcacatcttctggggaggagaagggagcctcatggtttaaaatctcaggggacgtgggaggctgggcttcgatctgtactgtgttgagtgaggtgggagcttaagtaagttacagatggtctcagacttcattctgcaaagagggtagtattgttagcattattagctctggtccgacctcagaggcacttgggctcatatatgccggtccatgtgttgtctaggttgtgacagaaaagaaagaacaacactaccatcatcaccctgaagccacagtctgcagaaacacactttccccaagctcctccatagttctctgctcttcgtgtcagaggaatggtggcaggcaagcaggggcattggcggcttctcaggaatgttctaagcgggcctcaggcgatggccttgcttccatgtccatagtgagaggaggcctgcacctctgtacaagcctttgaggggattttccatgaagcctgatggccatctgactcctcaccygtaggctcctgaatgaggctcagtcaaggtgtaggaactgtattctgagaagccaaaggaagtccattagatattatttactctgtgatactcctcaggaagaagaagagggagggctgttcttctcagtatcagacaggaaacagggccaccccagggaatggggttggccagaacctctgtagctyatatgaagcctgtggacactggagggtcctgacccgagcccagagcycgtcctgttaggctggtacaacccgcaactccagtgttgcaagggccagtctgacccaggaagtcagcttttcaaactgtgctcctcagattgcctcagaggggacaagtgaccagagcttggcatctaccacctccatttcagttatagcaattgtgcttaaaggattgtgctgctagatacattcataattwatttttcagtgcatatgttttcaggttgggtggctagtagacctacttagtttcattcttatttgggaaaccaatgaaaacagggtggagaagagagccaggagaagggcctgggatgtgtattttgatacaagatatcaaatgtcgatataagcgagggaatttgttggaggaagggaaaataaagaattgaaaaatataggttggaccctggttgtgcagccagaaaacagggttgctgtggggtatggaggggaatcttagaaagatggaaatttggagggatggctaaaagtgtctgggtttgagaagctagtggggctgtgggaacagacatctggcctgggagccatccgtaatattgacactgtttgcccatggtgagaggcaacaggaaacaaaaataatatgcgaatctcgatcattcagccttctagagaggcgyacgagaatgacagcagatccctaaaggtattaattactgtcttctgtgttctttgagtctttgtttctgaccccctgagaccttgttttttttctttaatggcattttgaatgttctgctgtatcttggagggtgtgtacacagattgaggcatcctaatttgttgyctcctccrtagtacctagtacatcataggtgcacagtaaatgactagaatcttggctgataaaagcctggagacagctcactgcacactgctgggaggtgggcggtgatatcagtaggtctygtggagactgggtggggttgagccaagtctcaggagtgttgagaccgtccagagagaggcacacgtgttgtgcatcttcagattcggccctgctggggagagtgcttggggagcagagcaggctgccatccacacccgtcctgaacagctgtggttactctttctctcttaaggacacagctccaagatggaacgtagtcctgggttcttttctcttggctcctgggacaaacacactgtcattgctttgactattctttctatagacttttcagaggagggtttcagtccatgttcatgatgctttagccagattggaggaccttctagaggcaagatgggctgacaaacttccaggatgctggtctccctggcatgctttctggggaagctttgtctgttgctctctcatctcacttttcttttgtaaagaacaccgtacsctataaattactaggtaaatgtcaagtaacctcttggggaagcccaaatctgcacgttggtgagcagtattgggatcgagtgttcgtcttgtatgggaggctagccctgcgagagtggagactggatcccagtcatcctgagtgtgcctcccggtcagtgagggtccctagagttggccatgataagggccagattagtaagctgctgctaagggaactctgggctgtctttaatgctcctatggactggatcatggtctctctcaaagtgggatctttcagggggcagaattatatctctgcagctgatgtaagacttcgtttagtgacctggtggttgctgcttcttggcatggccctgaggctggttgacaacaaagatgaaaatgcccagaccagtgatcacttggcacaaccccagggctcagtacgcaggaggcgtaggtaagagcccctgtgtctttgctgctggcctgtccttactctgttttttctgcttttccagggcttcacttacgttctgcatgaaggcgagtgctgtggaaggtgcctgccatctgcctgtgaggtggtgactggctcaccgcggggggactcccagtcttcctggaagagtgtaggtccaggcccccgggacggggaggagggcagattggggccactccagggaccagcgttgaccttggtttcatctcattccctgccctttgctttccccactgggcatttyacccagctgttggtgttatccagatgccagctgggatgacctgccccttaggaasyagttaagacggcctcagscttcccattttgtagattttgggagaagcccagggccctcccrgggggattcatgctctctcattcacctgtgaatctgaggtgctgtggctgaggggctggttttgggatggcctcaccacccctccaaagtgccacaggctgcaagtactgttctggaccacatcaacccaggcagggtcctcagaccttttcactgatttctactgaaacctccttggtggttttagggaggtggaaacctttacaacccagaaaaggaacagtatttcccacagtccctctgytatttctgcaggtctggctggggcatcttgccagccccccattgccccactcttgtcctctcctggctggctcacccccgccagtcccttcttctaacacagagcagttcagctgtcccccatgtgctgccaggttctctcttagactctgatgctcatcaagccattttcttaaacacagaggattccgtctttggcrgttttagtccagatgctaggagaatcacagttctttcagtctggtcagaaggataaggtgggtggtgccaagtcctggcagccttgggagctggtgctgggaacaggtgaactgcccatatgggccttgcctctgtcttccccagcaagaccaatgcgcttcccttcgagaggaaggccaaaggtctgctatcttgtcctgagcctttccmatctcctacccaggcccattgcctttctcctccccagtgataacagaatgactcactgggctttttcaggtgagtttccacctccccctctagtccgagttgcctatgggttctcttccctgtgttctcccctccccaccttttagtgcttctgctcccatgtgccctggatggaggcaggttttgtttcttctccccagggtcaaggtccagctcagatcaggggctgccccatcctggtggggctgagagctggtccctttgcgctcagtattcctgcccctttccccatctctcatctcccttcaaggcctaccccaccctgcccctcatcagtgtttgcaaagcataaggtgacctgggcttctctcctctacctcaagtctccatcttacctaaaagacttgggtgttggcaawggctttgctgctgaaccatgtcaggggtcagcggggggtggtggcaatgggtcctcttaatgagccagtggccaaggctcagtgagtgagtaatcagaggagggagaagtctggagggtggaatcaggcctgcrgtgggaagatttggccacagggagtcaggagtggggggtgaagagaatggctgcaagtgtttggcattttctacacctcatctggaaggagaagaaataagcaggcaccaggagaagtaggtcagggcctgagatggcggcagagggcacctagttacatatctgggtgctggccgacacagagggcactcggagtgacattttctggggaagatcctcctggtgacttttctgaaccatggtcttgggccctttcagcttcttgcccrtggtgacaacccttggggtcaggctacccatgtgcagtcttcgtggacagattgcagggctgcaggggtcccaggccagccttcccgggcttctgccagctccctgtctccccttaccaygggaagtggcaccagcctgggaaatgggttgagcttcccggctgcaccttcccactgatggcccacagtgctgcttcttggccggagtatctgagctcagctcaaaccaatgctgaggaagggagggtgagtcccctggcttctccaaggtgcttgcctgggtgcctcagtcaggtgattttgacccaaactgtttgagtggtgctcactgagacgagccccactcatcccctccgtgggccctaccctgtggtgggacttacatgttaagccaggcttcacgtctagaaaccaccttcctgagagaagagcacattcccamtgggaccctgggctccagccctgccccagcttgttggactaactctggtgccctgcaggtcggctcccagtgggcctccccggagaacccctgcctcatcaatgagtgtgtcygagtgaaggaggaggtctttatacaayaaaggwacgtctcctgcccccagctggaggtccctgtctgcccctcgggctwtcagctgagctgtaagacctcagcgtgctgcccaagctgtcgctgtggtaaggcatgcaggctggggctgggctggaccgggcaccacctttaagcctctctttccacttttggctcctgaattctttgcctttttagcaacttagggaaatggataggaccgaaatcttcccatctgctcctactgcttttatgagaaagcaaattaaatgggaaaaccataggaatttcctgaagatcactacatggcaagactgggattcggccctaggcttctctgatttggagaccacctttgwaatgctgtgacgtttcacccaggggaaggcgttcaacttgccaccccaacgctgccaacaaacagaaaaatggcaacaacaacaaaaactagttctttctaccatatcctgctctgaattttatttatttgtttgtttgtttgtttgaggcagattctcactctggagtgactggcgctatctctggataggctagagtgcagtggcactattttggytcactgcaaccttggcctcctgggttcaagcacttttcctgcctcagcctccragtagctgggattacaggcgtgcrccaccacrctcggctaatttttgtatttctagtagagatgtggttttgctatgttggctgggctggtcttgaactcctgacctcaagtgatctgcccacctcggcctcccagagtgctgggattacaggcatgagccactgtgcctggccactgaattcttgaaactgaaattttcaagagtagcgtttcrttgtttcataaacccaaacatcctcccattcatcccatctcttaaatgtaaattcacataagcaagcgctgtcacttggagaacgtacggggctcttctcattgtgggctgcatggggaagggaggccgctgtgggctccagcagtaggacccccagcgctgggttgtggggtggggggaaagggccgaccgatacaggagggaggcccagacacggaggaggagccccaaagagagcagcctgctcgccggtctcaccagggtgtgttttgcccactctcactctgcacttttctctcccccagagcgcatggaggcctgcatgctcaatggcactgtcattggggtgagccgctgtcctcttctccagagcaagtggtggggacagggaagggggtactgtgggaaggggagcaggcaagycattgtaaagcagaaatgaaggaaaccagagagacccaaccccagctttccactgcctgtgggacgtgcctggcatcatggagcccaggctaggaccatcttcctgactctccgggcctgtctcacactcacttcctggcccccacctcaggcacctgtgcatttcttctgtgtgcagagaagcactctgaagtcattgtgcacgttttagtttgtcccctctgccactacctgggctgcctctttggcatgaaagttctcactcttaccatctygatactggaggtgggaggacgggaaggcagtgggccataggagacaggaggagcagcagagcgatggctcatgggagctatgggtgggtgggcaggagacagggtatgagagtgaggtgagtggggggttgggggatgctggggggcctgaccctggtgyctctgcttccagcccgggaagactgtgatgatcgatgtgtgcacgacctgccgctgcatggtgcaggtgggggtcatctctggattcaagctggagtgcaggaagaccacctgcaacccctgccccctggtaagagaggctcaatggggaccgagggcatggactggacgcgtgtgggacccaggcagtgggacctcactgcggtctttaaataaataaatctctcattattttctgattataaacaataattgacaataataaagaagagactaaaaatcacccacccaaactgcatgcctcagaaataattataattttagttttataagttgcaaacattttcttcctgagttttcagaataaacacagtatttgccaggcttatgatactatgtttacaattctgtatccctttatgtattttaagaaacagcaccaccgttctttgaaaatattaaaaattagtcaacaaatatttatcagacacctcctatgtgcaaggctctacacaacattcctttgaatggatgtgcctcgtgtatacaaccaagctattattgcgggacatttggatggtttcaaatatttcaccctgtttttgccaggccatgctgacgatgcttgttctgaatacttccttgaggtggttctgagaggtggactcctcgttcctagtttgggagatgaaactggcattccgtgggtttcagctgtgacttttagtaacacctcactgggaagttttgagcccatggcggcagggcagggcctgcaagctcaggaggggccttggcttcttcctcaagctcccttctggatgtggggcttctgctgttttagaaaatgccattggtcagaggagtctcttgtgagctagatgcatgaactatggcgatggctttctcagagggtacagggaagtgcttgtctccctcagctcggtgagacagtcggggctgcagcaaggtggagaggagcctcttataagcaggcagcacagtggccagaggggagggggtgggggccaagaggtcgtgcaggtgcgttttacactgttgaggacaagggacaggtagatgttctacatctgtgttcttcatggcaattagaggtatcatgctcaaagtatgggcttaataaaagaagtatggagcggatgggtctgtaggagacacagctgtttctgagagaatgattcagagagagcattccttaattaggaagaaggtaagtatgtggttttccttttgcttattttttaaaaatcccagttgatgttttaggatttggggcccagttgtgtgcacacgtgtgtgtgtgcgtgtgtgtgtgtgtgtattgtgtaacaaccctcctagaacacatctgggcttccatatggaacgaaacaatgctgcctggagtcgtgtggcatccctttttcctgggatgtccactgaagtccaatcagggcagtcaggagacagcaggccgcccacctcaatgccagcctgtggagacggcactgcagcctgctctctggagggcaggcccgctcactccctgcagtgccctctggtgttcagagggagccacagccgcttcctccgtatctggagaaatccacctttagaatccagtctcagatgtaggtttccaaatactcaaaaatccatggccccatttggcctgtgtattcttcttctttttctccagaattctggtatctcccaggggagtgcaagccacctcctctctcttgagatcccttagattcgccctccctctatgcatctctcaagccttgctgaatccggcctctgctgatcccgttctagctcagcgtcctccgctagtcttactacgtcttctgccacgaagggtctctgggacacctcctgggttgggggtagctgtggtgaattaggtctaggtaggtcggcttgaactgcccacgttgggctgaagtgccagtgttgcccgagatgtgagtcttccgttgcctcccagggaagccagtgctcttacctaaagggagagcagcaggaggcagtttgtgctgacaagtggttgagatgaggcttgacagctgactgctcaaagaaagcatgaggaagagaggtcactctgctgtggaaccctggaaaggcrtcccggaggagggcaaccctgagtggaccttgagcaatgaatgggttgaatgtcgaatagaccttccagggaagggcatggtgaatgaataaccggcagccagaagccggggtgagaaaagggaaacacggggagatggatggaagggctgcgagccgtcgatgaaatacatggaaaggggccctgaggggtgtgcaaggcagttttaggaggacaactgtgtgaggaaagcaggactaattggctgctcagacctaaacaagtgaactctggggctggctgggaacttgctcagcaggaggaggaagaggctgctcctgagaaggatgtttcctgcggtgatcaaatgttctggggaaaacccaaagggcagctctgccctccccttgaacggggaaatgtggaacacatacccccagccagcagcagccaggaaatccagcagtgcccaaacaagtcctgtccatcgtgtgcagctgtggtctggccctgccgggtaggagacatgctgcagagcaggctgttccctccattcacttccatgctctctcctccctcccttgcttcttccaagcccctgccacacccttaacactgttgcccccttcggcttattttctgcctcctttccctyttcttccaaatctttcttctcgcataactgccctccacctttccttttcttggcctaactttgccctctgcctcctgctgtggggattttgcctccctgactgccctgtcctcactggcttttccttctgcctgctcctgaagacacgccaagttcatggcttgatttatgagagcaaatggtttaaattaatctctgagcaagcttactgactcctaaccttgaccttgggacaggtcgtctgtctgggtgctccaaattgacttggtgattcataatagaaaagcctcaggaccccaatgaatggatctctgaatggtgatcactaaatgtggcaaaatgagaaaaagaatgacaacagagttggtttctcacaaagctaaattgattctttaaaaaattctgggattatgtgattacgttctttctgttttttgggggtacgaaggtggaaagggtcaaaagaactataatttgtttttcttctgaaagcaamgctaataatttttagggaatgatgagacagtagatggtagcttggtagctttttgtatgtatgtatgcatgtatgtatgyatgtatgtatgtatgtatgyatgyatgtatgyatgtatgtatgtatgyatgtatttttagacagagtctctctctgtcgcccaggctggagtgcagtggtgagatctcggctcactgcaagccccgcctcccaggttcacgccattctcctgcctcagcctcctgagtagctgggactacaggcgcccaccgccatgcccagctaatttttttcttttttttgtatttttagtagagacggggtttcaccgtgttarccagratggtctcaatctcctgacctygtgatcygcccaccttggcctcccaaagtgctgggattacaggcgtgagccactgcgcctggctgctttttggtttttattttattaaaattgtttaaaacactcttactttgcaaaataaaaagttgccagccctgtttttctcccagtcctgtgtctcgaagctgcttctttgtccgatgcagatataaataaggcgctcttaccttatgccgcttcaacaagtccctagctgcgctgagctatgattgcaccacttgccctccagcctgggtgacagagcgagaccttgtctcaaaaacgaaacaaaacaaacaggaaaacaagttcctagctgaacttacctcctctgtgagtgtaggggtgccaagtaggggccagatgctggggatacaagagaacagcagagacacaatttgcaacttaccatgcttctcagggagaagttttttccagcattctatgggagttccagttacttcctcaccaatgcttggtattgtcatgcttttcaattttagccattgtgaagtgatatcttctagcattttttccttactgcttctctaatttcagaatcttctagtattttaaatttgcatttctctgttggctaatgatgtggagcatcttacatacttattggccatatcatcttttgtgatgtgtttgttcaagcttttggccatttttaaattgggttgtttgccctttaatgattgattatgagtttttttctgtattttggatactagtcctttataaggtatctaatgaaatattttctttcagccagtggctcagcttttatttttcttaattgtgtcttttgaagatcagaagtttaatttcgataaaattcagtttatagatgtttttcttttatggttagtgctttttatgtcctgtttaagaagtttttgtccattctaaggtcatgaagatagtatcctatgttttcttttaraagcattatagtttagttttacttttaggtctatgatccatgaggaataaattttaaatgtggtataaagtaggggtctcccatgtggctatccagtgggtccagcaccatttgttgaaagatgatcctttcctcattaaattatgtcggtgcctttgtaaaaaatgaattgctggcygggcgtgctggctcacgcctgtaatcccagcactttgggaggctgaggcaggtggatcaccaggtcaagagatcragaccatcgtggctaacatggtgaaaccccttctctactaaaaatacaaaaattagctgggggtggtggcaggtgcctgtaatcccagctactcaggaggctgaggcaggagaatcacttgaacccagggggcagaggttgcagtgagccgagattgtrccactgcactccagcctggtgacagagcgagactctgtctcaaaaaaaaaaaaaaaaaaaaaaagaattgcctgtgtatgtatggaccaatcgctaggctcctttttttctgatcctttgtctatccttatggtctcaccactgtcttgattactgtaactttatggttagccttgaaattagataatttaagtttttcaactttgctgtttttcaagattgttttgggtatttaatgtcctttcaatttctrtataaatttagagtcatcctgttaatttttattaaaaaaatgtttaaagtgtgccggattatattgaatctataggttaatctggagagaagggatgtctagacaaggttgagtttttcaatttatgaacatagtatatctcttcgattatttaggtcttgctctcagtctgtgctgctgtaacacaatacctgagactgggtaatttgtaaagaacagaaattaattttttcactgttctggaggttcaagattgaggtaccagcagatttgatgtctgatgatggcctgttcctcataggcagtgctttctcatggcatccacatgtggcagaaggtggaaaggcaaaaggcactagggcattccctttgactttttttttttttaaataacagcacaaattcactcaggagagtggagccctcatgacttaaatcacttaggccccatctcttaatatcatcagttgggagtttaaatcccaacataggaattttgtagggacacacacattcacatcttagcagtctcctttaatttttctctgcaatgattttttttgtgtagatgcacaaattttgttacacttattacctagtatttaaagtttttggacgatattgcaaatggaagttttttttaaattttatgttttgtttgttgcttttayaaaatyagtttttatattttgatcttgtattcttcagccttgctaaattcacttattagttgtagtaatagtgttttttttttttttttgagggggcagattcctaaggattttcttcataagcagttatgacaccttcaaataaagacagcttttacttcttcctttgaaatctttatacattctgttttgtttttcttgttatcaaactggctaatataatcagtacaatattgaatagaactgatgggaatattttctttctgatcttagagggaattaattcattaagtatgatatagttgtgtgttcaacagcagcagtgcccaacctttttggcaccagggaccagtttcgtggaagacagtttttccatcgactagggtcagggggattgttttgggatgagtcagatgcattatgtttattatgcaccttatttctattattattgtattgtaatatataatgaaataattatataactcccataaggtagaatcagtgggagccctgagcttgttttcctgcagctagatagtcccatctaggggcgatgggagacagtgacagatcatcaggcattagattcccataaggagcacgcaacctggatccctcacatgtgcagttcacggtagggtttgggctcctgtgagaatctaatgctggctgctgatctgacaggaggcagagctcagttggtaatgtgagtgatggggagtggctgtagatacagatgaagcttcactcattggcccactgctcacctcctgctgtgcagcccagttcctaacaggccactgaccggactggtactggggccccctgtcctatagcatattgaagaagttctcatctatttttttagtgctgagagtttctacaatgaattggtttaaattttgtcagacagttttgctgtatattttaagatgaccatatggttcccccttaattctgttaacatgaggaattgcatggattgatttcaaatggtgagccaacctttcattcgtttgatgaatcccctttcttcatgacgtgttatcctgtttcacatccagtgctagatctatttgctcatattttgttaaagattttaatgtttatgttaagagtgttaggtttctaattttcttctctttaatgcttttgttagattttgatgtcagggttatgctagatccaacaaaatatggtggtgttttctaaagagcttatataaaattggtattatttcttcctaaaatgtttggcagatttcatcagtgaagcttactagacttgaagcttttcatgtggaaaagatttatatataaaattcaacttttaaaataaaaaaacggattttctatttcttcttgaattagtttggtaaatcagtttttcatggaacttatccgtgtatttaagttggtcaaatttagttacacaaagttgtttataacatttccttattatacttttaatatctgtggaatctgtagttgtaaaccttctattatttctaatattgataatttgtttctttttattttcttgattaatctagctagagattttcttattttgactaatttgtctattatatattaattattattatattatatattattatattattaatctttcaaagatccaacttttgcctttgttgttttactttttatatttttcttttctattttattgatttctgcccttatttttattatgtcttgtcatttaatgactgggtctaatttgctcttcttttactagcatcttaatatggaagcttagctcatgattttctaatacaaaatttaaaatataaattttccttcaagaactgtttttgctgtactcctcagattttgatatattgttttttattaccgctagttaaaaatatttattttttgatccatgggttatttaaaagtattttatttaatttccaaatatggtggtgtgtttttcaatactttattgttgctaatttcaatataatttcattatattgaaattggtcatagaatataatctctaagatttcaaaatcttgacatttatttacttttttatccagtctctgtttatccatgtttacatttttatggcccacaatttggtctgtctttgtgaatattctgtgtgcatttgagaagaatgtatgctctgcagttctggaatgtaatagtttattatttccaactaggtcatattggttcttacagttttccaaatcctctatatcttcatttgtctttttcctacttgtttttatcaattactgagagaacataaaaatcactgactaagattgtggattagcctatttctccctttagttctatccatttttgcttcatatattatgaagttctgtagatgcatccctcttaagcattcttatgtcttgatgaatctattcttttgtcattatcaaataacctcctttattttttatttatttattttttgagataggatctcactgtgtcgcccaggcctggagtgaagtggcacaatcatggctcactacagccttggcctcctaggctcaggtgattctcccacctcagcctcccacctagctgagactagaggtgtgtgccaccatgtccaactaatttttgtggagatggagttttgctatgttgcccaggctggtcatgaattcctgggctcaagcgatcctcccacctcagcctcccaaaatgctgggattacaggtgtgagccaccgcacccagccacctcctttatttttggtaacattcctcatcttaggctgtctctagtcctatctaagcttggcaacaatggaccaagataacaaactaagaattacagtcagttattcactcattcaacatatatggtatctactatcatttatccaagcagagggatcaaattagtgaaagaaaacaggtaaaaatcctttccctgcttcccctaagtgaagagtaatcttttatgtttatttatttattttttgagacagggtctcactctgtyttccaggctggagtgcagcggtatgatcatggctcattgcagccttgacttcctgggctcaggtgatcctcccatctcagccttccaggtagctgagactacagttgtgcaccaccatgcctaactgattttttgtattttttgtagagatggggttttgccatgtttcacaggctggtcacaaactcttgggctcaagygatcttcctatctgggcttcccaaagtgctgatattacgggcatgaagccacctcactggccttgtttggtattaatacacctatatcaactttcttattttgactaatttgtctattasatctttcttctcaacctatctatctaaattaaaagtgcgtctcttgaaaacaacatactaattgaattttgctttttaaaatctaaaggtgacaatctccatttaatgtaattattgatatggttggggttaaagctattcttctgttattcattttatctgctgtcttctttgttacttgttctgttgttaattcttttttgtcttttggttcaactgagtttttcttttttttcttttttttagtactatatctctttattggccttttcaytgtatttcttcatattactattttagtggtygctctagacttatcacagtacactttgattgaataatataacatttcatgtacaacrtactttttccataatttgtacatttgttgtcatacagtttacttctacataagaagagagaaattccacaaggtattgctattatttttgctttaaacagtcatttgtcttatatggaatttaaaaagtgaactgaaagtggtgatttatatttacctacatatttataattttcagtgctcttccttcttatatatctgaatttccatattatatcatttcccttcagcctaaagaacttcttttagtgcagggctggatgacaacacatttctaagatttcatttatctgaaaatgtctctattctgccttcatttactgaatatagaattctaggttgacgggtttgtttttaaatttcatcactttaagtatgtttcttagtctttggcttgtgttatttctgatgaccagtcagccgccatttttattgttgttttcctgtatgcatttccccccttctawtggatgctttaacagtttttctttagttttcagaagcttgagtatatgcttttgtgtaattttcttcctaccttttctattttggattcatagtttcctggatttgtgggttgattttctgatcaaattgagaaaaatttcagttattatttccttaatttttttctgtttcattttgttttactgtctttctgaaactctaattacacgtacattcacgtgttgcttaacaatggggatatgttctaagaaatgcatcgttaggtgatttttgttgtgcaaagatcgtggagtgcacatacgcaaatccagatggtatggtctactayacaactaggttatgtggtataacctgttactcccaggtgacaaacctgtatggcatgttactgtgctgaatactgtaggcaactgtaacacaatgrttagcatttgtatatctaaacacatgtaaacatagaaaaggtmcagtaaaaaatatataaaggataaaaatgacatactgtatagggcacttaccaagaatggagcttataggactggaagttgctcttggtgagtcagagagtgagtggtgggtcaatgcgaagacctaggacattgctatagtctataaacattgtacacttaggctaccctaaatttactacaaaatatttttctttcttcaataataaattaactttagctcactgtaacttttttacttataaagttttaaaattttaaaagctttttgattcttgtaataacacttagcttaaaacacaaacacattgtacagctgtacaaaaatattttttctttatatcctcattctaaaagctttttcctatttttgaaatttttaatttgtttaacttcttttttttttttttcgagacagggtctcattcgtcacccaggctggagtgcagaggcattatcatagctcrttgcagcttaaactcctgggatcaactgatcctcctgcctcagcctcccaaacaggtggaactataggcatttttttatctttaaacttttttgttaaaaatgaaaactcagcacgcacagtagtctaggcctacgcagggctggaataatcaatatcagtcttctgcctccacatcttgttccactggaaagtcttcaggggaaataacactcatggagatgtcgtcttctgtgataacaatgccttcttctggaatactcctgcaggacctacccgaggctgttttacagttaactttttatatttttaataagtagaaggagtatctctaaagtattcataaaccagtaacatacattatcatcaagtacataattgcatgtgctatacttttacatgactggcagcacagtaggtttgtttayacctgcatcaccacaaacatgggagtaatgtgttgtgctatgaagtcaccaggtgataggaatttttctgttccattataattttatgggactgttgtcatacatgcagtctgttgttgactgaaacattgttttttggcccatgactgtttattattaaaccattgatactgttccactggtccctggggctccctatttatattttttacatctttattcctctctatgcttcagtttgggtaatttctatygatctgtcttaaaattcaaggatcttttcttttcttgtgtcctgtctgcagttaatccaatccagtgagtttttgatttagagtattgtgttttctagttctaagatttccatttgatttttttcctaaagtttccagattgttcctaaaattccctgtctatttttccattatatctgtcatttcctctagactctttaacatatttatcatagttattttaaagttcctgcctgctacactagtcacaatagcaaagacttggaaccaacccatatgtccaacaatgatagactggattaagaaaatgtggcacatatacaccatggaatactatgcagccataaaaaatgatgagttcttgtcctttgtagggayatggatgaaactggaaatcatcattctcagtaaactatcgcaaggacaaaaaaccaaacaccgcatgttctcactcatagatgggaattgaacaatgagaacacatggacacaggaaggggaacatcacactctggggactgktgtggggtggggggagtggggagggatagcattaggagatatacgtaatgctaaatgacgagttaatgggtgcagcacaccagcatggcacatgtatacataygtaactaacctgcacattgtgcacatgtaccctaaaacttaaagtataataaaaaaaaarttcctgcctgctaattgcaatactggggccatttctgtgtctgtttatattaagtgataattctcttggtatagatcaaatttttctatttctttgcatgaaatttttttttactgtgtattagacattggtggaagatatgttgaagagactcttaattctgttgtttctttataataaaggttaagtttggttctagaatgtggttagattattggtggttcattttgaactatagaagtcttgatttttaaactacattagggaaggtctatttcagcatttttcttagccctaggctgaatattttagtcctgagacacagtgtttactgtgaaggcttgtcccttatgaagttccagtagaaacccaggtgtttacccagcccctccaactcgttagaattcagacrgcaaactctctcccrtgtggtgtgtggtaactgaaatttctgctcaggtgtttgagctttccagctgtygttttgtctctgggctccttgtaggctctcctatagatgtataattaagggatcaaccaaagagttcagaggagtttatttgcagatttaggggcttcttgtttctgacttcctcttttctgacattttccctttagtttccagctattctagcagttccaaactgtctgctgagtcctcaggcagatacaactacagttttctgcttgagttctggctgtccagtgccatacagacggccctcatgggaaaagccatttaaacatgaatcttgtccattatggttccttttttcaaggatcaaataatctagactttattcttgattttggtcttcttccagtgcttttgaacagttggctttaaatatttcgttaattgtttataatcatcatctgcaggaaggttagtccaatacaagccactgtgccgtaactacagccagaacctcatcaaaagtttctaagctgaggagkcacaagagtagacgtaggctttaagaaggtcattctggcagatgtgtggtaacctgtagcaggggagcaagaatgaaggtaggaagacaaaataagactattaccagagtccctggtagatgatggttatttagactcaatgatgaaagaggagactggtcatgacaagcaatggatgagtttgagatacatttttggcaagatttggtgataagcaggggatgagaaaaaaggggaagtcaaggataactctcagatttcttktttgaaagactgggtgattaacrccacttaccaaaatagggaataccagagaaagatgagatttgggacaaaaatcaaatttccttttggatgcaagtctcaagatgacaatagaataattgtccagtaaacaattgaatttgtaagtctgaagctcagggaaaaggtctcatttaataggwctggctgctacaacttgagtgagatgtgcacatgcagagtgaaggaatgctacctaggggactgagaactgacaaaagctggttggagytggaygttgactttcygaattctaggtgaaactactggatragagagatgagaggccagcaaaatcagcctacttacaattgggatgttttaaggaggttaactatggctgcttttyccccctctggatgcagggttacaaggaagaaaataacacaggtgaatgttgtgggagatgtttgcctacggcttgcaccattcagctaagaggaggacagatcatgacactgaaggtaggagcaagctgaatgcagggctccctcacatatcaccatcttgcttccttttttggaaatttttcttcaaggaagaggggctaagtttggttcagtattggcttctttttctatttctttctgattatataaagaaaagatagatgacttattgcaggcacagaattttctcttttatttagttattttgttgctcttcttgacaagagtgtacttggtgtagggcctcacaatttggagttgattgatcttttttttttctttcttgagatggagtctygctctgttgccaggctggagtgcaatgtcacgatctcggctcactgcaacctccgcctcctgggttcaagcgatttccctgtctcagcctcccgagtagctgggactgcaggcacgtgccaccacacccagctaatttttgtagttttagtagagatgggatttcatcatgttggccaggatggtctcgatctcttgacctcgtgatccgcccacctcrgcctcccaaagtgctgggattacaggtgtgagccaccgtgcctggcctggaggtggttgatctttaagattttctctacccttgggcgtctgtaagactggacaggccatcagcgtgaaacaaactctggtctatgaagtccggactagctggtggggctgggaggtagttcccttcgttcatctctagttcagttatcagctagccagtttrctgttgctatatctcaatccttcaagcatttaactggtcggaagagtctacatagcagccctgttcataggatacaagctgtaaaactgggactccacttctggtctgtgttctgggtgtgggggctttattatacactgtcttcttgtttcatggttctgcagattgtttcgtcatctccatggagtcaagctcatggtttgaagtggctttgtgaaccaaacactgtctctgactttacccactcctctttccttccagcgtgatgagacgctccaggatggctgtgatactcacttctgcaaggtcaatgagagaggagagtacttctgggagaagagggtcacaggctgcccaccctttgatgaacacaagtgtctggctgagrgagtgagtactcattctgctttcctctttactgtctcaatctctaagaacaagattcttctgaatagygtgcatcccagctccggcataatttctcagtgtctgaggcacatctctggcctagttgaagaatcagtgagattacgaaatcaaagcctacggagagataaaattctctgcaatataggatgttttaaaaaaatattttccttaagggargctgagtgtgtgattcttgaataaaatgtgagatcaaactgatttttagtctccctgggaatgaagatcctgatgactcaactggaagagaattcagaatcatcaaaattgtttcagcctggtcaggtagggtggtcaagctgctcacatttatgataggaaagcatagtttacatctgggcacttaagcacagggctgtgagttcggagctaaaaattggcccggagtgacctgaaagctgtctactctgtactgtttgtgcctaacctgmaattttgctgttttcttagggtaaaattatgaaaattccaggcacctgctgtgacacatgtgagtgcgttactaatatcttgtcccttgaaacccatcagagcaagtcyaggggctctttgcagcttgctccttgaaacccattagcaagccgcatgactgttctttggagtaagctttatttcagaaagatatttcgtgaccactggtcagtcattatgttcagtcttgcagggagcagcctcccctccttggatgtcatcagactgccctcttgaactcccttttagatcccatggagcaatctctttccccttttcctgcaaactccctcctgtctccagcttcttatgtgccttttccctcataggatctttgattgctcatagtcctatcctgggacgatatgttccctctctaaccaaagcttcttgaagacaggcaccttggatctatgatcctgacagagtagactctcaacacatatctattcatgagtgtgctaaagctatctcaaagagaaagcgaagccaccagctggctgacaacagcccacatgtgctgtgggggctggtctaagtttatcaccccctcttcttcactctgagctcctctttacctcgtagttatgtcctactgattggttctcattgctcacagcagcagctttggagacgagacacaaatctgcacatcagacagtgttcttcccatacatgcttgtgtttgtgagcacaaataactttcaggatcccaatgctaatgccataatttctgaatatagaattacttgcctggactaagattttttgttttagattagggtatttcttttctgccctgggttcacaggtccatgcttgtttacagatagagaaaggaagagtgaaaacatgaatactttcagtgttcaatcattcattcttgacagcccctgcaattgctgtaaccaaatctcagatcgaggaagcactctgaaagcatgtctttctatgattcccatttgaatggtttaagaatgtgaagtcaggaaaccatcagagaagaagaattctctctaggcacactgcacgtggaatttgattaggagactgttacctacaaaaccaccacaaagggtctttgttggtcaactcattcaagaggcttcgagatctttaataaggacaataagccaggctcagggccttaaatccacagcaacatagtatagtatgctggtctaaatgttttttttttttaattcatcctcttaatgtaattggcaggctttccctttacaatgaaattatctagaaattaggaggcagactaatatgtagttagggttgatttagatttcgagccatcyaaggacagaaaactcccagtgttcagactggaatggtgagctgggattaaatttttgaattcccagtgggccaagtagagattcagatctgaatgccactaacccctgtgtgaaaggaaacccccatgtcagcaacctggagtcagcagtaccygaagagaggccttcacaaaggtgcctagggatcttctcggtccccagagaggcagggtatgcccttacatcaccatkacttcgcctttcctcttaccccaaggcaggaatgaagagatagtaattatacttattgactacttcattgcccattagcttctgaatgtagttacaagcacaagagggttgctttagccatgtggtttttagagtctacaatgatacaaaggcaagtcttcctcattttacatcaccatagcacagtgaatttaggctcttcctgcaattaaaattgtaccattaagtgagttaagtccagcaataactatatctctgcatatttcgggccaggaacagctgaggtgaaccaggataactgaattccctccctgtggctggctttatttggttactgtgaaagggacctatttccagcccagtgagggcactggggctgaagagtgttctctagaaccccagccagtcctcaagtttcatctctcacctgtcctgtaggtgaggagcctgagtgcaacgacatcactgccaggctgcagtatgtcaaggtgggaagctgtaagtctgaagtagaggtggatatccactactgccaggtaagggctctgcttcaataagggctgggtgyggagggytgagcctccgtgttcggatacctatccttagttacattctagaaggatctggaaaattcgcagggaagagaagggaaataaactggaagcatttttttttaagcaaatgttttattgaagtaactggaaatttttgactccaggaaaaaaacaaaaatggaggaaagactcagcaahtcctttacagaaaatggagagttatttatgcaagatgggggccacaattcttgaagatcagtcaaacatatataaaattttcctgcataaaacatgcataatcaggcataaaacattttatgcattaacatgcataaaaattgcagctagaggggtgtgggtatgatattattaccatagagaagaggacatgtcagacctatgatcttcctttacaaattgcctagctgtcctgggtgcttctgggtgagatcagacctgccttgcttggagggggtcagggagaaagcaggctgccccagagccctgcctaagccaggacttcccaccatygtgaagctcccatcttcctctgctttcttgcagggcaaatgkgccagcaaagccatgtactccattgacatcaacgatgtgcaggaccagwrctccygctgctctccgacacggacggagcccatgcaggtggccctgcactgcaccaatggctctgttgtktaccatgaggttctcaatgccatggagtrcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgcaaaaggctgctggtgcactgtgtcgtagggctgagatggcaacggtgggcaggggctgagttctgagacyggttctgaggaaggaagcacaggccccatctgcaagcctcagtgtcagtgtgagatactgccaacytctggggaagagtgatgtctttgcctccaggggtgggaaaggcatagcatggggtaggcctcttctgaaactcagcacaaagtaaaagggattttcccagcaacactggattctccagtctctgaatggaggggcttctgaacatagcagaggggtgggtcctggagccaggctcctgctgagatagatactattgttgtcacatggctggcagtgtggagaaggtgtctgaccaggtgtgcaaggatttctctgagcccgtggctcacagggttcctgtgtacccatagtggcccctgtgggagggagaggtgctgaygactgatggggacctggaaacagggtgctggcaggtgcagtagtgtggtcacccaactcagcctgaggccatgagccccagatttggaggcagacctgggctccacacatggccctcgctcagctgtgtggcctcaaacaagccccttggtggttctcagactcagtttcctcatctggaaaacaggagtgttgttctcactcataaggtggtaaggataaacaacctcagcctaaaatagggcctgcaagtccttaggtaactgtaaattgctctgtaatcatgtaagaagtggcgagaataacaatggggagatcaaggctttcggtagggaataagagactctaatgttaacagcagagcattagagatttcctttgtggtgagggctggaccggctgggtttctatcaggctttatgcttgatgccaaggtcctacatactccagacatcctwcagtggaagaggaagtggtgtagataacaccaaacatcatccagtccccaaatcactamctggtactgtcacttgcagttagagatggtccttccttaaaatgtatggaagaattttcatgtacatgctggcaagatggtggggactcttgctggggagaatacccatgagaaagaaggggatgtcctggattacaagaatttgatgaagaattgattttcattccaaatacttttgacacaggagagactcagctcattgaaagtactggataatggaatcaaaagggacttagacatcatctagtccactgtccctcctccactcctttacaagtgatgaaagcagctcagagaattcaagtgacttgccaaaggtcataactgctgggtggcagggccaggttcagaacccaggtgacttgacacctgcataagaactcccaggccaccccatcagagccacascatccctgttgcttacactcctcccgtgctgacatggggaccagtgactgctgcacccttaagttcccaccacttctgttactgcctgagcttaaccttaagagaagccacattacaggaaaatggcatagattatgctgagtaggcttggtggggagtttagtggggcagaaggraggaagaatggatagaagttttatgtaactactcagtaattmaaaggttactgtctctccatccatcaccccactcccaactttgggtagcctctaaggtctctcttggtaggaaaccagatccagggacagggaattaactgtcactcttctgactgatcgcctaacactctagctggggacaaggtgttattggaggcatcagctctggagaaattcagcaggaaggctaggctaccactgcagcataggtggttgattttccaactgcctgtgtcttgctagcttgaacttctcatgtttactgatatgtcattttaccgtcaagaaaaaagctgaatcggaaaactgcatgttttgattatttwaaaaaaacccaaaacgatggaagagagctgggtaaaaaggatgcaagaagagaaacttgtggggctagtgtgtgcggagcggtgtctcggcagtcttcttttatttacaggtattccaaaggcactatctgtacctggtttcagggaccctcttttttactcaccctcagaccaggcaagacagagtgccccaaagtggatgttttaaggggagtctcaaggaaggagtatatagacactaagaaactgctggagggaaagaagaaagggaatgaatgaaagagcaatggtgaccatttttcaatcgtttggggattgaaaagacdtaacggtccctggaagtagacagggagaaaggggttgttagggacagaaaggagcagaatagcagagtgttatgccacagactccagggcaggctgcctgctttggaatcctaggatcctcttagaggcaagttacttgccatttaacactgcagttctctcatctgtaaaatgggcacactgcagtgattgcctcatatacttattgttaggattaaaataactaccatagggaaagcactgagaagggtgttgggtggagaggaagtcctgtagaagcattagctggtagtacttgcagtggatggaataaaggcctgggttgggacatcacatcttgtggttttccttctgctctgccctcgactgtggtgtcacttactcccctttgcttccccaggctccttctctataaagtggratctatcatgaccagcctaccttatcaatataggagagaaaatcttcatgcctgaaggtcagtgatcacaaatggcatacttgaccttaacatagtacttcttcattttgggggtccatggtattaatgaacttgttttacttctgtgcatcttggagttgcagattccatcgtgcagaagggccctttggaggtcttccctcccatccccctgcccaggtccgtgaactgtcccggggagmtggcactcctcttcccctctggggatggagcttccatcatctactccctcaaccttccttaaccctcctagcgtctcatgggagagctcttrtaaaatggacccctcctcctgcctctggcagcccctcctgttttgcggtcccttgtgcacttactacctgcctcttctcccttttgttctgcttaacctagggsaaggtgaggacagctggtctccacctagtatggagacaggtgtgggagatccgccgtccaggggctcgcccccactcccgccccagggctaactcttgggcagtggatgaccctttggggcggcrggaagaaggttttgctggcaggattggaaactaatcagccagacagttcatgagataatccgrctgaatttttacactcgaagcaggttgtggggcgttgccccggctctgggggagcagggagcgtttactgtctcgcccctcagccccacggacccgagtgtgtcctggactcaacccggccgcgggaccgcgctccattctcgacgccccgctcccagcacccgggcgcccagggcgcagcggggagagctgggctgtggctgcgcggcgccggcggccgggagggatgggggaggaggaggcggcagccggcgaggggcgggcgcgccgggacggagctgagccgcgatggaattagccccgcggcggcataagcctgcccagaagcgcgcggccgcgggccggcggggtcygcgtccacatcatggcgactcccgggccgcgcggtgagttttccggctggacctggtcctggtctcctacaggtggtaggagggagggagtgaaggaggcggcatccgaactcccacycttcgggattggggacccccaagggagcctgggcagggtggtgcgggaagttgaccccgtttttccagggtagggactctgagggacgtctatgtaatttccgagacgttttttgttttttgttttgttttgttttttttttaactcaaggagagggaaggtaggacaacagaggtttgggcggccgcttctctgtgattggttaccaatccccacctctgtgatgttgcctctccttgttacaagtcctggggacgtttagcctacagcatctgaaggtaagtaaacaataagtaaacaaccagccggactgggtttaactcagcaacggtccgytgaggacagagcaaatttgactttggcatccctggagtggcctctcagtttcagaagttttttccagtgtcttacccaaaaccgcattcaggaagggttccaagatcaggcatttacaccccaggctgcagggaaacacagctataccttcccgagggacttttcttagaagaaaagcaaattgaggtggagtatggagaagaaagacgttattttattgcttttgggcaggactgactttgcctgggacagggactttgtcggctgttgtgtttctggtaattcttgagacaggcatgaagagggaggtgcccgctcctttggcatgaacaatgagctgagtgcactgggaggtggtgtcagtcacagtcctgatactttgtgagcagatgtggagaaataccaccccgggaccatgtggaacctcgtctgggacagaaggtcccactgagcaaggtcgggtctcagcccaaaggcaggtggcaggtggagggaggatcttagacaaggtgaaggtgcttccagaggactgtggtcctcttggccctccacctgccgagcctttgtccttggaacctggcatcagagcccctgcccagtctctctgtcaccctggctcagctgctgggcatccagggctcatttgctcctctcagtgtgtcttaacgtgcacccgtcatttccggagccaagcacctgattcgatcctttccagcaactgcttctgctgtstgagttgcctctatgtgggtaccagagccactctgctggttgactgtagagactgtgtgaggggtaagggtgggatccaaacacacrcctcaagttctagtscagtttccaggtgtgccatctcttcatcttccattgtggggcaaggctgcagggtgagaggcatttgggcctactggggagtgtgtctataattttctgtaacaaagacctaattttctggaaagctacccattctgtgggctgagagaagcccatcccaccctatgtatgacgttgctagagcacatgcatagcaggtatttggctgctagggacggtgttattgtctctagtacacrgtataatccatctgtattgtttaaaaattgttttaaaaatgtcagtagtttttagggtacggggttttgcttttggttacatgggtaagttctttggtggtgaattctgagattttagtgcctcctcacccgagcagtgtacattgtacccagtatgtaatcttttatcccttatccctcctcccacccttacccgctgagtccccaaagtccatgatatcattcttatgtctttgcatcctcatagcataactcccacttatgaatgagaacatatgatatttagttacccattcctgagttacttcacttacaataatggcctctagctccatccaatttgctgcaaaagacttattttgtttcttttcatggccgagtagtattacacacacacacacacacacacacacacacacaaacacacactcaaacacagacatcccacattttctttattcactttttagttaatgggcatttaagttggttccctatctttgcaattgtgaattgagctgctataaacatacatgtgcatgtgtcttttttatataatgacttcattttctttaggtagatgcccagtagtgggattrctggatctaatggtgttctacttttagttctttaaagactctccatactgtttttctatagtggttgtactagtttacattctcagcagcagtgttaaagtgttcccttttcatcacatccatgccgacatctagtaaaatttttgacttyttagttatagccattcttgcagcagtaaggtgggttatctcattgtggttttaatttgcatttccctgatgattagtgatgctgaacattttttcatatgtttgttggctrtttatatatcttcttttgagaaacgtctattctccatcactattcgtaactaagtggttagcgaaggcctctcttaggagatgaatttgaacagagattgcattaaatgaaggaacaagccatgcagatatctggaggattgtctagcaaaggaagtaaaggca

SEQ ID NO: 13253 - DNA, 103660 bp, Homo sapiens
  misc_feature (1)...(103660): n = A,T,C or G, or insertion/deletion polymorphism (see Tables 1-2)
gaccctgtcaaaaataaataaataaataaaaaggaaactgtaactataaaggtagtctgtctctttgtaggaaggctgaaaatacttgtttgtacatagtgctagaagagccttactgttggaatttacagagggagaagctgagatatttgctcaaagttgcttgctactcaatgggaatggtgtttgggctgaaacgcaagttttttgggggcaaaaaacttgcggtgagcactgtagcctcgacctccatggctcaggtgatcctcctgcctcagcctccccagtagctgggactaaaggcatacttcatcatcacacctggctaattttttttatttgtggagacgaggtcttgccgtgttgcccaggctggtctcctgaactcaagcgatcctccctccttggcctcccagagtgctgggattccaggcatgagacaccatgcctggcctactttatatattttcaatgtactatttctgcattacatattttatgtactttttaatatcaatagtatgtctgtattagaartaacaatgtaaaagtgaaataagcactgggagcgtccaaagctattttaaaggtgttgggggtggccaggtgcagtggctctcgcctgtaatcccagcaccttgggaagctgaggcgggtggatcgacttgaggccaggagtttgagaccagcttgggcaacatggtaaaaccccgtctctactaaaaatacaaaaagttagctaggcatggtggtgcacccctgtaatcccaggtacttgggaggctgaggcacgagaatcacttgaacccacgaggtggaggttgctctgtctcaaaaaaaaaaraaaaaagcgtttaggagaagctgcggctgataaattacaaatagatgggttttcgtctgacctgctaatcttccactagatggcgtcattgtcaagtgtctgtaatttcaaaagcgctagggaggaaagactgcccattaattgtttatgccttaacacttyatttttattttcgcttgtttttcttttgagtcacttgaaattaaagaaaaaaaagctgaggccaggcacagcggctcactcctgtaatcccagcactttgggaggccagtgaggaaggatcgcgtgagcccaggaattcaagactagcctgagcaatatagtgagacctcgtctctgcaagaaatacaaaaaattagccaggtgtggtggcgcacacctgtagtctcatctactcaggaggctgaggtgggaggattacctgagcctgggagatgaaggttacagtgagtacagtgagccgagatcacaccactgcactccagcctgggctacagagcaagactctgtctcaaacaaacaaacaaacaaaacaaacagacaagaaacaagttgaagttcccttcagaaataccctcctgcttcaagcctatagagggtaaaccaaatgaggtgctcgttaaaagaatttagtccttacatgaaaaataccatcaaatgtatgtagagtttcttttagtcctgcagaaatgcatamctgataccttgattatcacagagaaaaatgtttttggctactttaaaatgttccataattctgagcaggctggcagtcctaccttttcaccatcaaaamccccccattatttttattatgtatttatttattttatgttttgaggcagggtctcrctctgttgcccaggctggagtgcagtggcacaaccatggctcactacagccttgaactccagggcctcatcctcccaactcagcctccctaatagctgggactacaggcatgcaccaccaagcccagctaattgttttgttttgttttgttttgttgtttgtttgttttagtgatggagtctcactatgctgcccaggccagtctcaaactcctggactcatgtgatcctcctgcctctgcctcccaaagtgttgtgattataggcatgagccaacactcctggccccttcattatttgtattttataaatctcattattgggaatattttatccaaaatagyattaactaagtagtcaatgatttttctatttgtatttatatgtatatttgattaattaaagtccccagtagataagggacaaccttgctaaattgataaaactccatccctgccgggcgcagtgactaattcctgtaatcccagcactttgggaggccaaggcgggtggatcacttgaggtcaggagttcgagaccatcctggccaacatggtaaaaccccatctctactaaaaatacaaaagtaagctgggcatggtggcaggtgcctgtaatcccagctactcagcaggctgaggaagaaaattgcttgaacccaggaggtggaggttgcagtgagctgagatcacaccactgcactccagcctgggtgacagagcaagactctgtctgtctcaaaaaaaaragagagagagagagagaatgcatctccttccttcttgaaatgcccagattgccgtggtcatatcattgatgagctaagtaatgggattcttgggcttataagtttacagtggctgaagcctccactgtatggggcagtttttgtgaaatcctctagtaccggaatggcaccatggaagtggaaggaatagagtggaatgtcattgagtcttcctcattcaaaaaaaagagcccctttgcagatatagctgtccatatccatgggttccagattcatggattcaaccaaccgtggatagaaaatattcagaaaaaaattccacagtttcaaaagttgaaacttgaattttccacgtgctgagtactatgttgaatcccccacaaacgaaatgatgtgcagcatcttatgtggttttataagtaatctatagatgatttttttttttacttctccttatggagcagagctaactcataggcagtacacctagagttggccataagtaatctagagattattttaaatatacagaagggtgtacctaggttatatgctaatactatgccattttacagaaaagacttgagcatcctgagattttggtatctgtgggggtctggtacaatcccccatggatatcgagggacaacagtattcacaaagaaaaaagtttaattacaccaacagcacatgtaattaagtctccaagactccatctccgatgaggtgaatttaaagaatgcgttattatgattttggtagttggtcagaatttcgtatctggatagctgagagccagacctactagcaagtagctttgtgttgaccatggacaagtggaactgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttcctattggccgggcgcagtggctcacgcctgtaatcccagcactttgggaggccaaggcgggtggatcatctgaggttgggagttcaagaccagcctgtccaacatggagaaacactgtccctactaaaaatacaaaatgagccgggcatggtggcccatgcctgtaattccagctactcgcggaggctgaggcaggagaatcacttgaacctgggaggcggaggttgcagcgagtggagatcgcaccattgcactccagcctgggcaacaagagcgaaattccatctcaaaaaaaaaaaaacgtatttcctaccttggtggcttctatgggttcctgggaaggtgggatggtttttgcagttgtattttgctagaggtgacagtggggaggaagtgcatggarggtaaagctgggggtttttttgtttgtttgtttttgttttctttgagatggagttttgctcttgctacccaggctggagtgcagtggtgtgatgttagctcactgcaacctctacctcccgggttcaagcaattctcctgcctcagcctccctagtagctgggattacaggcacctgccaccaggcccggctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaccataaaactcacccattataagtgtacaattaattcagggtctcttagttaggcttgcacataaaatacaggatatccagttaaatgtgaattccaggctgggcacagtggctcacacctgtaatcccagcactttgggaggcctaggcaggcagatcagttgaggtcaggagttcgagaccagcctggccaaagtggtgaaacccccgcccctactaaacatacaaaaattagctgggtttgtgttgcgtacctgtaattccaactacttgggagactgaggcaggacaatcgcttgaaccagggaggcggaagctgcagtgagctgagatcgcgcacctgtaattccaactacttgggagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggtctcgaactcccaacctcaggtgatccacctgcctcagcctcccgaagtgctgggattacaggcgtgagccactgcgcccagcccagcaaatactttcttagtgtaagtatatcccatgcaatatgcaaggatgtcccatctgagacatacttatattaaaaatagtatttattgcttatctgaaatttaaatgggcatcctgtatctttattgacgaaattcgggaaccctacaatttgtgaagacagagttgtacaagcatcaccacgatccagttgagcacattttcttcacccccaaaagttccctcttgcccaatggcagtcgtcctccgatccctctccaagtcccaggcaacctctggtcggcatcctgtctctatagatttggagaagactgtatttttaagtggagagacttggctgttacataactgtttagcacccgagtatttgcatgaagagtttcatttcattttttcaagtggaaccatggaggagagtggctgcccaaggtggggtttgtcttttgcygtctgagtggcccctgggatgcaggtatgtccattatttaaatctcttggtgtttacagaccacatgggtaacccctgttgtggcaaggctgagggcctcttcacctgtcactgagtgtggggactcttttcaggcctgggcagggcaggaagtctggaggggatatcaggtgatcagagggccattcgagaatgctgcaggctacagtgacaaaatgctggtcctgggctatctgagaccagtcctggaatgacttaactaaattaaatcttatgaatcaaggtgcctagcaccgtgcctgttgcctaaagtgtagctggaaaatagtctcccacgaatccagagtgacatttgctccatacccagttgggcctaagcctctagatctagagatatccatgaagaatggctcttgctttaagaacttaattctttagtgactaatgtttctagagcattaaccgcaggcaagcattttctaagagctttacatatgttaatgtccaatcctcacagacacactgtgaggcagatgctcgcattctctccatcttgcctatgaagaaatcaaggctcagagaagttaagcaaatccyctgaggtcacacagctagtctgggcctagaagagccttttctcctactattactctgtgttgcttcataatatggtgtaagttctgtgggagcccagaaagcaaggcatctgagctactgggaaggagggatgagacaagtaccctgaggagttagctgaccaaggaagcagggaacagcatttcaagcagaaggaacagcacatgcaagggttacaggcaagagaccgtggcctgcataaagagtggctgatgacgtttgggataaacgacttcccagaacatttcaaaaaaactcaaatgttttctttggggaaaatagtctgattttggcaagagaaagaatctcagaagagagccttgagaccttcaggagctattgttaacttggtgaattgtctctggtgcatctctctccctcacaaggcctgtttgttcttctgtgataaaagggctaatagcacctgtgctgtgggctcatttaatagaacacagtcgtgtgtagggcgtaatagaagagaatggaatggaataatgtaggtggcatgcatcgagagcttcgcatgtggtggccacccaggtgtggcacagccctgggccccgacgcatccgctcgggcacccatgccttactgacacattgaagaggagctgggaatttgttttccatctggcagagccccttccgtcttcctctacctgcggttctgggggctcagtctggagaggcgccaggcggctaactgactctggcattgggaatgcgtttgcagggagccaggggaagggagaagtcttactgccggctccctccaggctcccttcctcgtgatttatcactatggaaactgagctcctttcctcttcgcgctgccrgctggtgggggtgcacattgttgatgccgttgccccacagatcagaagttccttcctctttcctgctgcagaaatgccacagtaacctacgtggcccaagaactgcagctcacacctgaagagcccagtcttgggaaaaacaatctcatcggattccccaggggttacgggggccttctgggtaagcagagccggcctgagaacaatgtcaggggagaacaatgcagccagcgggctgagctggtggccctgctgttcctcttccttcagcttccctagttgggggttaaaaatggatttacaggcagtcgcaagtatatcatgttaggcggcagaaaactgaaactcagagtctcttagtgtgggcaaagtctcccgcgacaacccacttgctgcaggtgcccagccctgcatatgcccacccatgacatatgcccacccactgcatttgcccactcactgcatatgcctacccatcacatatgcccacccactgcatatgcccacccactgcatatgcccacccactgcgtatgcccaccccctgcacatgcccacccactgcacatgcccacccactgtgtatgcccacccactgcgtatgcccacccactgcacatgcccatccactgcacatgcccatccactgcgtatgcccacccacagcatatgcccacccactgcacatgcccacccactgcacatgcccacccactgcatatgcccacccactgcacatgcccatccactgcatgtgcccactcactgcatatgcccactcatgacatatgcctgtccatttcatgtgcccacccatgacatatgcccacccatgacattcccacctagtgcgtgtgcctatccactgcatatacccaacccctgcatatgcccacccattgcatatgcttgcccattacacatgcctatccactgcatatacccatccactgcatatgcccacccaccgcatatacccactcactgcatatgcccatccactacatatacccactcactacatatacccactcactacgtatacccactcactacatatgcccacccactgcatatgtcctcccatcacatatgctcacccactgcacaggcctggtgagagctggctctgctggacttggtctggccctccgtaaccattccttagaggccagtgcctggattacagcaccctgggcatggcatcacatgtacctgtgccaggtcctagactcaaggacacagggcaaggggggattccagagacaacaaaggaagctccctggccaggaagtcctgagacactgccaggcccagcagtccccttgctggccacacagacaagacatggccaacctcagggcctcagggtccttctctgtaagttgacctaagggattcctctgtagcctcatcctatgggggatgggagagagggagctaagagcacctcctacttgcccatctctctcttaagagaggttcatctaagagtagctttctggggaaactggccttcaaacgacctgggagaaaaacatttcatttaggagctgaggcttgtcaatgcatctcacaatgatttgcagaaatcccctttacctccctgaatatacaagatcttttctaggtgcaaaatgttcctgtttgttttccgtttagaatttccccttattgggagcatattttctccctctcaccctcagagaaaatttccaggttccttccacattctaaagagcaatgtgaaaattcaaggttttctgttttgttttgttttgttttttttgagactaaatctcggtctattgcccaggctggagtgcagtggtgcaatctcrgctcactgcgacctccacctcccgggttcaagcgaattctcctgcctcagcctcctgagtagctgggcccacggmacgtgccaccacacctggctaatttttgtgtttttagtagagacagggtttcaccatgttggcaaggctggtctccaactcctgacctcaagtgatcctcctgcctcagcctccaaaagtgctgggattacaggtgtgagccatggcatccagccctattttttaaatagaaatatttttattgagataatagtacatttgcatgcatttgcagtaaataatacagagatatgtgccagtttcccctaatggtaacattttgcaaagctacagtacaccatcacaaccaagttttctgggttttgtttatttgtttgttttgtttttgagacagggtctcgctctgttgctcaggatggagtgccatggcccaatcatggctcacagtagcctccacctcccgactcaagcaatcctcccacctcagcctcccgagtagctgggaccacaagcatgtacccccatgcctggctaattaaaaaacaaaattcatgtagagatggggtgtctcactatgttgtccaggggggtctcgaactcctgggctcaagtgatcctcccgcctcagcttcccaaaatgctgggattacagtcaccagccatagcgctggctgcaactggtccatttttaaaaagctctaattaaagcacgtccttgacatttgggaggtattcatccacaagcccagatgtgttctcacattctgagtattaggaatgtttacacaggctcctgacgtggtcctaaatcacatgaatctcatttctgtctagaagcaccatttcctgtgcatattctcataccccaacttggctgcctttttgatttttacgtatctatttatttcaattgtgtttaatcaggtaatgaagctmtaaagaaacaggaaacatggagacagtggtatagaacaaggtgaaggattacatccttgcataaccttggtgaatacatatgttacattcagtgtatttcaactgtttcagactttgatcccttccatctttgttctagaccaaagatttttctattgtggagtatttcaagaagtcctgaaatgtttttctttctgttttgtgtttttttttttttttgagacagagtctcactctgtcacccaggcttgtgtgcgatggcgtgatctcggctcacctctgcctcccgggttcaagcaattctcctgcttcagcctcccgagtagctgggattacaggcgtgcaccactatgctcagctaattttttgtatttttagtagagatggggtttcatcatgttagccaggctagtctcaaactcctgacctcagrcgatccacctgccttggcctctcaaagtgctgggattacaggtgtgagccaccgcaccgggccctgaaatgtttttcttccagaggccctgtgtgaggaattagggctcagggctgaaggcaggcagccagcatcaccacttcagctgtgggatcgtggacaagagtactaacctctctgagagtcttgtttctctcttgtaaaaagagggtaataacagtaactgactcataggattaaaggaaacgtgagaaatatgtaagcactcaataaatattagttattattatttaaataaaagctccatagcggagtcttataatttttaggagtaaaatcataactctcatgcaaatataatatgaacatgtgtcaaatattttatttaacttatcaattaatgagtgaaccagtgaaatgctataacttactcaaaggagaatcaaagaggatatgtatatatgattagattgattgaccaattgatcattagatatgcagatatctaccatcagggatgctaaaatgagttggcttaaaagatgtaaaactggttgggtgcggtggctcacggctataatcccagcactttgggaggctgaggcgggtggatcacctgaggtcgggagtttgagaccagcctgaccaacatgaagaaaccccgtctctaccaaaacatacaaaattagctgggcgtggtggtgcatgcctgtactcccagctactcgggaggctgaggcatgagaatcacttgaacccaggaggcggaggttgcagtgagccgagattgtgccattgcactccagcctggacaagagcgaaactccgcctcaaaacaaaagatgcaaaattgctcaatatcattaggggaattatcaactgcatcatccccactggtcacaacttgcatttctctggacaacctggaaaattataagatatctcaaagacaatgaaaggcacagaaacctcatagagtcagataagctggaagaatgtgctagattgcctctactttttgttgaagacacccaggaatgttttaggcctatttcaaaccctttcacaatttttcctgatgcttgttcatttgatatgaggtcaaaggacaatacttaacgtgacccatatccctatagagttttatgatattgaggcccgcagtggccttatgaggagcaatctacaggctggtgagctgaggcttggtagacttggctcacatgagttcagaagtccacaaacctcccccagggcagctcatcctccctttcttttttcttttcttttctttttttttttttgagatggagtctcgctctgtcacccaggctggagtgcagtggtgtgatcttggctcactgcaacctctgcctcctgggttcaagtgattctcctgcctcagcctccctagtagctgggattacaggtgcctgccaccatgcctggctaatttttgtaattttagtagagatggtgtttcatcatgttggaccaagctggtctcgaactcctgacctcaggtgatcctcccgcctcgtcctcccaaagtgctgggattacaggcgtgagccaccrcacccygccagctcctgctccctttcatggtgggtggtgcaaagcaggattgctcttggcccctcaaggccaaactaatgaaactgtgctacgtgcaactgatgcagggcaggtgaactccagaattggggcttagcctggcagggttcttggctttgcccaggaaagaattcaagggcaagctaggggagccggtggtgttagacagcaacttttattgaagcggcagtgcacagcagcagcagacagactgctccttgtggagcagggctaccctataggcagtgtgcccagagcaccagctcagggcagttctgcatcatatgtgtgcccatctagttatatgcaaattaagggccagactatacagaaatttctagaaaaagggtggtaacttctgggttgtcaggtcattgccatggaaaggggtggtaacttccggtgttgtcatggtaacggtaaactgacacggcacactggtgggcgtgtcttatggaaagctgctttctctcagtccctgtttagctagtcttcaatttggtccagtgtccaagccctacctttggagtygagttccgccgcctacctcagaacatttgtagagccatttaaaaaggaaaactctctaatgtgaccctttgtagatccactttatgtctgataaggaaaggttggaattctttctgctgtgtaggcacaggttcagggccacacagcccttcccttctttgaacaccggattagtgcatcagggagccccggcgtggtggattcaggctcaaacactggaaacagtccagcaaaaccttgacctatagagagtgaagggcacagggccaggggaggggagctctttgcggacacagagtgacttctttctctaacctgccttttgggtttccttggcttttccttcctcctcctctcggatgaacttgtgagaatgaaggtgcatgtctgtggcccatgctgggtcctccaggcatggtgggctctgggagggccatggctgaggagcccaaggaagccaggcccgttgctttctcacctgaggattcgtctcagaaccatgacacagtcaaatgagaacagaaaccccactctaaggccgggggcagtggctcaggcctgtaatcccagcacttttttgggaggccaaggtgggtggatcacttgaggtcaggagttcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctcaaaaaaaaaaaaaaaaagaaaaaagaaaagaaagaaatcccacttcaaatctctactagaggttgcttgaaggttgctggaagggagatgtgagagcagacttacaccactctgcacagagaaaaacccatgaaaaacttgtgtctccctcagagtcatggtagtggccccagcgtccctgacacccctcccaaagtcaaccagtcagtctctccctgtttccctcacccccagatcagctcctttctgcctcatcctgggccttcatccttctgttgtccccagacgaccccaccgcccctggggatagactaggctgcattttgcttttctttctgtttttggggtccctgtcattctaaagtttgtccagccaatctgcttaggtttccacagtgggaacacagacacctttttttttttgagacggagtctccctccgtcacccaggctggagtgcagtggtgcaatcttggctcactgcaacctccgcctcctgggttcaagtgattcagcctcttgaatagctgcgactacaggcttgtgccaccacgcacggctaatttttgtatttttagtagacatggggtttcaccatgttggtcaggctggtctcgaactcctgatctcaagtgatccggccacctcagcctcccaaagtgttgggattacaggtgtgagccaccgtgcccggccagatgctgtttttttatgttgtctgggcagtcatttgtgcgctccatgaacagttgcatggtcctttttagcatcagactagagctatgattcccagcccacagtgacagaggccacctagccacctttgcaatggcaaccacattgacgatgacagtcttccttccttttcctttgtcttcagctgtggcaatcagcgggacactgctctgacccctggcattggttttgacaaatacttggctccttgttagctttattaataagatgaagagatatttgacagctacattctccccctaaaagaagaaggagtggcccacatggcttctggagttcttgggaactgacacaaaacttgcctcttggtggaggctgggtttgcctcaggtgggcccagaggagactccgcagctttaggaatcacctccctctctctcagctggctttttcttttttctttttttgacagagtctcgctctgtggcccaggctggagtgtggtggtgcaatctcggctcgctgcaacttccgcctcccaggtttactcgattctcttgcctcagccctctgagtagctgaaactacaggcgcatgccaccacgcctggctaatttttgtatttttagtatagacggggtttcaccatgttggccaagttggtctcaaactcctgacctcaagtgatccacctgcttcagcctcccaaagtgctgggattacaggcatgagccactgcgcctgacctttttgtatttttttaatagagacagggtttcgccatgttgcccaggctagtctcaaacccctggcctcaggtgatccgcctgctgtggcctcccaaagtgctgggattacagacatgagccaccatgcccagtctcatctggccttttaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctttcatataaaacaatgcaattatttaggctgtgcaggatcggggtgtcaggtacttttcaggtctgaggtgaggccgtgggcagggcagcttctacccacctcatctcaactctcccttttcttgctcagtgtcacatrtaggaccagttacataatttgtgggtctagtgcaaatgaaaattcaaaattatcaggaatttcaaggtggcgacagcaaggcatcaaaccaagcatggcagcttctgagcacagggcccctgtgacggcacgggtcacacatctatgaagctggctctggtctcatgactcatgtgtgtcaggtcagggactgggtctgagccttctgcccagaaaggtgctgtaaaaggtcagtcacagaagccttgtagcaagccaggcagacacaggcaggcagatgtggtgctgggaacttggttgatgtttcacctcctggccctcagctccccatctgtaatatgggtcatgatacccctgtggtaggctgctgatgacccccaaggatatcaggccctgacccctggaacctgtgaatgttgccctatatggtgtcttagtttgtttggactgggtgccttagaaacaacaaaaatgggccgggcgcggtggctcacgcctgtaatcccagcactttgggaggctgaggcaggtggatcacctgaggttgggagttcaagatcagcttgaccaacacagagaaaccccatctctactaaaaacacaaaattagccaggcatggtggctcatgcctgtaatcccagttactcagctggctgaggcaggagaatcgcttgaacccgggaggcggaggtttcaatgagctgaaattgtgccaytgcactccagcctgggcaacaagaatgagactccatctcaaaaaaaaaaaaaaaaaagaaacaacaaaaatgtatttctcacagttctggagtttgggaagtccagcatcaaagctccagcagctccagtgtctggtgaggcctacttcctcatttatagatggctgtctctctgctgtgtcctcacatgatggaaaggactagggaattcttttcttgccttttttttttttttttctgttttgagaaggagtcttgccctgtcacccgggctggagtgcagtggcgcggtctcggctgaccacaacctttgcctcctgggttcaagtgattctcgtgcctcagcctcccaagtaactgaggctacaggcgcgccaccatgccagctaatttttgtatttttagtagagataggattttgctacgttgtccaggctggtctcaaactcgtggcctcacgtcgatctgcccaccttggccacccaaagtgctgggattacaggcgtgagccaccgcaccgggcctagggattttyttatggtccctttcataagggcaccagtcccattcatgaggcctccaccctcatgacataaccacctccaaaggctccacctgcaagtactatcacactggggagttggttccaacatgtgaattgtcgcggggatgcaaacattcagtttgtaacatgtgggagaatgggatttgcagatgtgattaagttaacagttttgagttggggagattatctggatgggctccaaatgcaatcacaagtgactttaccagagaggcagagggaggcggggcacattggtttatgcctataatcccagcactttgagaggcccaggcaggagaatcccttgagctcaaaagttcaaggccaacctgggaaacatagcgagacctcatctttacaaataattaaaaaattatctaggcatggtggtgtgtgcctgtggtcccagctactcaggaggctgaggtgagagaatcactggtggtcaaggctgcagtgagtcgtgattgaaccactgcactccagccttggaaacagggtgagaccccatctcaaataaataaataaataataaataagggagattagacacacagaagagaggtgatgtgaagattgagcagagatttgaagatgctggccttgaagactggagtgatgcacccacagaccaaggaatgccagcagccaccaatctgctcctgtaagaggccaggaacagattctcctcccgcagagcctctgcagggagtgtagccctgctggcagcttgattttggtccattcatacttattctagatccagaatggggaaagaataagtttctgttgttttaagccaggaagtgtgtgggtatttgtcactgtagccacaggaaatgaaaacataccctctaaaatttttaaaataacagattcattgagatatagttcacatgccataccatttacctatttaaagcgtgcaattcaatggtgtttcatatattcagagttgtgcaaccatcaccccaatcaattttagaacattttcattatcycaaaaagaaacctgtattctttagctatcttgcctaatcccccagccctagccaaccaaactactttccatctccatggatttgcgtattctggacattgcatagaaatggaattatataatatgtggcctttcatgtgtagcttcttccacttagcatgtttttaaagttcatctatagtgtagcatgtatcagtatttcgttccttttgttgttgttgtttagagacagagtctcatgctatgacctgggccagagtgcagcggtgcaatcctagctcactgtagcctcaaagtcctgagctcaaacaagcctcccatctcagcctccagagtrgctgggactaccggggcacaccaccacaccaggctaatttttaaaaattttttgagagaagttggtgggaggtgaaaaaaaaaattttttttttttggtagagccagggtctggctatgttgcccaggctagtctcaaactcctggctttaagcgattctccagcctcgggctcccaaagtgctgggattaccggtgtgagccaccatgccctgcccagtactttattctttttattgccaaataatattccattatatggctataacacattttgtttgctcattcatcagttgatgaacatttgtgttgtttctatattttggctattgtgaatactgcttctataaacatttgtgattttttttttttttgagacggagtcttgctctgttgccccaggctggagtgcagtggcgcgatctcggcttactgcaagctctgcctcccgggttcacaccattcttctgcctcagcctcccgagtagctgggactacaggtgcccaccaccacgcctggctaatttttttgtatttttagtagagacaggatttcaccgtgttagccaggatgacctcgatctcctcacctcatgatccacccgcctcggcctcccaaagtgctaggattacaggcgtgagccaccgtgcccagccctataaacatttgtgtgcatgtttttgtgtggacgtgttttcagctctcttgactatatccccaagggttgaattgctgctggatcacatggtaactctatttttaattttggggaaccaccaactgttttcaaagtggctgtatcattttacaatgccatagtagcatatgggcattcctgtttctctacatcctcatcaatatttgttgtctgtctttttggttatagttatcctagtgggtatgaagtggtatctcattgtagttttgatttgcaattccctaatgactaatgatgttgagcatcttttcatgtgcttggggtcattttttttttttatcttcttaggagaaataatctgctcaaatccttttttttttttttttttttttaagatggagtctcattcactctattgcccaggctggannnnnnnnnnnnnnnnnnnntctcattcactctattgcccaggctgggagtgcagtgacatgatctcagctcactgcaacctctgcctcctggggaacaagcgattctcctgcctcagcctcctgagctcctgagtatctgggattataggcatgtgccaccgcccggctaattttttgcatttttagctgagatggggtttcaccatattggcccagggctggtcttggaactcctgaccttgagtgatcctcctgcctcaggctccccaagtgctgggattacaggcgtgagccaccacgccctgcccctttgccaattctttaaaatggttgtgtttttgttgttgagttgtaacagttctttatatattcaagatcctagacccttatcagatatattatttccaaatattttctcccattctgtgaattacctttcactttcctaatgctatcctttgcaataaaaacatttttaattttaatacagtctagtttatctgtttttgttattttgttgcttgtgcttttgtggttttgagaacagaatgcacaaacacctgttttggcttcagtgcctgggacatggtggtgctcttcccaggccagcggccaggccactcagggtggaagacagtaggtcccttaaccccttgggctgttgtgtgcctgatctgttgtcaggcccttcttcattaggtttagaagatacagtcatcagaagaataaaaccactgtctaggtaaaagaaatttttaaatatataatatgaatatcttcttatttataccagtacagtttcaaaatgtaatttttttttttttgtggaggaagaggtctacaaaggcaaaaatgcctatggttatgagtcataatacaaccatgtcagccaggtgcggtggctcatgcctataatcccagcactttgggaggccgaggcgtgcaaatcgcttgagctcaggagttcaagaccagcctgggcaatgtgacgagaccccatctctacaaaaattaccaaaattagccggatgtggtggtgcatgcctacagtcccagctactcgagaggctgaggtgggaggatggcttgaacctgagaggcggaggttgcagtgagctgtgatcacaccgctgcactccagcatgtgcaacagaacaagaacctgtctcaaaaaaaaccccaaaaaatcccaaaaacaaaacaaccatgtcccttgtaactggagggggcctcctgcaggggatggaatagcacagactcctccacaatgtccctgcctgcctcccttttgcccagctgcccaactttgtgaggggccagaccggggtggtgagggcagcatatggtgggtgtggaagaaaaggcactgagcgctgccccttgggttcactaagtcagctgagctccagagcagcgattcagatgtggcaggcccagccaaaccagatcaacaactgttgttattattgttcaatcataactattgttttttttaaactttttaattaattattattactttttgagacaaggtcttgccctgttgcccaggttagagtacagtggtgtgatcgtggctcactgcagcctcaaactcctgggcttaagcrytgctcccacctcagcttcacgagtagttgggaccacaggcatgcaccaccgtatgcagctattttttatatttttttgttgttactatgttcttactgtgctctgctggttaaatgtgctttcaaaggctagctcttgtttgatcttcctaacaagcctattcaatgggtagatgggcacattattcccattatataggtgaggaacatgagcctcagagcatttaagctattaagctgcagagaacagacagggaacccaggcttctgatttacgcattagtgcacgttcactcccaggctggggtgtgtcccaaacccagtggatgggggctgttgagtctggctcatcaactctccaagactaatgagatctgaggctacaggtgggggaaatggaacggccggtgaatctcatttccaatcaccattgtcatgaaataggtggttggcctgctgtgccctccgacatgtctgttgcccacctgcctccgccttcctccccccactccacctccagttgctcagaaaaaccacttcctgaagtttattccagcagacagctttttctgtgcagttaacgagtcgctatgtttcggatctgcgttacttccccggtatttgaaggcaggagcactgcaggtaggaataactgtgtgtctgtcctccttcaattctgcttggctgagaagaagcgaacaacaccatgggagaaacagggtcctgggtgagtttgttaagcctggtgggaactcctggggtcccttggttatgtaggagtcagtctcttgatcagttaccaagaagccaaagccgtgtgggaacctttgcctcaacccaatcaaggaatccaccaaggtcaaggggaagaagtgaggagaaaggagaggcccacaaacgaataaaaacccattcaatttactatattgaaaaaggccaggccaggcatagtggctcatgcctataatcccagcactttgggaggctgaggctggaggatcttctgagacaagaagctggattccagcctgggcaagaccctgtctctacaaaaagtaaaaaattagctgtgcgtggtggtgcacacctgtagtcccagctacttgggaggctgaggtgggaggattgcttgagctcaggagtttgaggctgccgtgagccatgattgtgccactgcactccagcctaggagacagagtgagaccctgtctcaaaaaaaagatgttggctgggtgcggtggttcatgcctgtaatctcagcactttgggaggttgaggtgggcggattgcttatggtcaggagtttgagaccagcctggccaacatggtgacatcccatctctactaaaaatacaaaaattagctgggcatggtggtgcacacctgtgatcccagctactcgggaggctgaggcaggagagttgcttgaacccaggaggcagaggttgcagcaagccaagattgcggcactgcactccagcctgggccacagagcaagaccctgtctcaaaaaaaaaaaaaaaaaaaaaaaaggccaggcgcggtggctcacgcctgtaatcccagcactttgggaggccgaggcgggcggatcacgaggtcaggagatcgagaccatcctggctaacacggtgaaaccctgtctctactaaaaatacaaaaaataagccaggcgtggtggcaggtgcctgtaatcccagctactccagaggctgaggcagagaattgcttgaacctgggaggtggaggttgcagtgagccgagattgtgccactgtgctccagcctgggcaacagagagagactctgtctcaaaaaaaaaaaaaaaaagaaaaagaaaaaagacacaccaaagataatgataataataataaaaggtacatactgtatgaatctttacaaaattccagaacatggaaactaatcagaaagcagatcaatctttgcagtggggagggtgcagagggcaagggagacgaggggcataggaaccttttgggggtggtggatgtgtctgcttccttgattgtggaggttgtttcatcagtatacacatgtcaacacttttctgagtgtatactttaaacacagcttattttatgtcaattatataatacttcataaagctgaacagaaattcaatttcttaattaaaattttaaaggtaatactgccgggcacggtggctcccgcctgtaatcccagcagtttgggagaccaaggtgggtgggtggatcacccgaggtcaggagttcaagaccagtctggccaacacggtgaaaccccatctctactaaaaatacgaaaattagctgggcatggtggcacatgcctgtagtcccagctactcaggaggctgaggcaggagaatcacttgaaccctggaggtggaggttgcagtgagctgagatagtgccactgcacaacagcctgggcaacagcgcaagactccatctcaaaaaaaaaaagaaaaaagtgaaagggtaatacagkcacatgatttaaataacaaaagtacagaaagctttacaaagaaaagtccccaactgctcagtttctgccacccacccctctgccacagataataagaatcctttgcatccttactgactttctacaagttaatgtttaccctcccctactgattgtaaagtattctagtctactgtaaatagcaagtcaaacaaacgttaataaccttagagtgtgaggtaaaccctggacaggcatgcagtactcatttttgcctatttccaatttcagatactttttcttacattatggaaactatctgttcatattctttgcccatttttctattggattgttggtcttttctttttcttcttctcttttattttctttcttttaatcaggcagcctcccaagccagagtagcttagacagactcccgaactttttcttcttaatttatgagtgttcttcacacactagggaagttagctctttgtccgtgatgtgagttgcaaacattttttccagttagtagtttttctcttgactaattttttttttttttttttttggcaaaacagaacttttttttcataaagtacaatttatcaatcaattttatggcttctggattttaagttttagttaaaccagcctctgccattcaaggttgtaaggacttcttttcttcttttgtattttcttctagaactttttttttttttttttttttgcgagacagagtcttgctctgttgcccaggctgaagtgcagtggcatgatcttggctcattgcaacctctgcctcccaggttcaagtgattctcctgcctcagcttcccaagtagctgggactacaggcatgtgccaccacgcctagctaatttttgtattttttagtagagacagggtttcactatatgtgggccaggctggccttgaacccctgacctcaggtgatctgcccacctcggcctcccaaagtgctgggattacaagcatgagccactgtgcctggccccttctaggactcttatgggtttatttgtacattcatatcactggtccatttggaatgtattctggtacacagtgtgaattatgggatacaatttttcaattttctaaaaaaaacatttatttttgaaataaagctttattttatcatggtatcctgaaaatattagaatcatttatgaagcaattgccacattttagaaatttactttggaacttgagggcacggggtctggggtcttggcatttatcactatcatttgaattgttgctctgcaaaaggtgcttactctgcagtgtctaaaaattaccattgaagccaaaatttattttattaatcatggtgtttccttttctgttcccacatcaaaatttggtagatgggtgagggtaatttccagtaggttgccaaagaagatagcttatagtggggaatggcgagcacaaaacaacagcaaataacgcaatggaaaacattcctttagaaataaatgggtaaagtgtgtattgctgttcaaggctcttatcaaaacttccactgaaccataggtcagagagaggaattgttttctagctggaagccattacttcttggttcttgccctgaggtagaggaatctggttttgactgtggccagtttgtatctgtcttagctttaccatggggaagtcctagagggtggcatttcagaaacaatatggcaccctcaaggcagtgatcatctgattcagacaatacagtagtttgtcttcatccatctagacaatcatccattgcactaatgctttttcatcatctactaggttccagacactgtccctgtcatcaaggagattgcagtccatttgggggaggacaggccattatgacacatcctataataaaagtgtctggctgggcgcggtggctcacgcctgtaatcccakcactttgggaggctgaggtgggtggatcacaaggtcaggaggtcgagaccatcctggctaacacggtgaaacccgtctctactaaaaatacaaaaaattagccgggtgtggtggggggcgcctgtagtcccagctacttgggaggctgaggcaggagaatggcgtgaacccgggaggcagagcttgcagtgagccaggattgcgccactgcactccagcctgggcgacagagcgagactccatctcaaaaaaaaataaaagggtccgacagctgggcccggtggctcacacctgtaatcccagcactttgggaggccaaggtgggcgatcacctgaggtcaggagttcaagaccagcctggctaacatggtgaaaccccgtctctactaaaaatacaaaaattatcygggcatggtgacgcatgcctgtaattctagctacttgggaggctgaggtaggagaattgcctgaacccgtgaggtggaggttgcagtgagccaagatcacgccacygcactctagcctgggcgacagagcaagactctgtctcaaaaaaaaaaaaagtatccgacagagggaaaaccagggaggtaagrgggttgcagaggaagggcagctcagtctggggaagacgaggaaaaattctggagaaatggattcctgaactgagttaggaaggatgggtaggaatttgcttggaaagaagtggggaaggcattccaagtaggggagcagccccgacaaaggcacagacagatgaagagtgctaggaactagaaattctagcagccataatgtaggtgcaaggaaggaagtggtgagagactaggcttgaaaggtaagcaaaggctgtattatggcaggctgtaaattgactttttctggtctcaaacagaggagtgaaaggaaatgatgtatatcttttttttttttgagacagtgtttcactcttgtcccccaggttggagtgcaatggcgtgatctcagctcactgcaacctccacctcccaggttcaagcgattctcctacctcagtctcctgagtacctgggattacaggcatgcgccaccacacccgattaatttttgtatttttagtaaggacggagtttctccatgttggtcaggctggtctcgaactcctgacctcaggtgatccgccygcctcggcctcccaaagtgctaggattacaggcatgagccaccacgcccagcagaaatgatgtatatcttaggaagctccygcatagtggcccagtagagtacgcatttgtttaggggtgcatgctggggaggggcctctcatagggctgcgtatgtcacccacaccaaaagctgaggagagcttcctagttctgttaccagatggtgccgcgcagctccaggctgttggtgccatgaacaaagaattggacatgacacacgtacaaatagcgaagcagcaaatgattaagcacagcgacactctcggagaggggtgagtgggctgacctgtgagtggttatcagtgccggtttgttacatttcacggccttttacatgtttttcctcacttgcttaatgtcacttgcctttctcttatagtgccttcaccctactttatttcttgtaagatagttgttcaaccttgtttacccccactttacctcttctgaccaaattgcccatctttacttttattttttgcgaccaaatagctactggaagtccttccaacttacttctcttaccatgtcccaacttactgcttactcccttatctattatattactttttgtggcaatatttgattgatgttttaaattacagactataaagaaacaccataaaatattaagacagtctgagagattttgatgtgttattaatatccacatggtttgcttcttttccaaagcatcccataacgtttgactctatgactgtaacaagttagatttttagaaactgatgcaaaggatcagattctagtagtttctttctctttttttttttttttgagatggagtttcacttctgtcgcctaggctagagtgcagtggtgccatctcggctcactgcaacctccgccttctgagttcttctgcctcagcctcctaagtagctgggattacaggtgccggccttcatgcccggctaaggctaatttttgtatttttagtagagacgggtttctccctgttggccaggttggtcttcaactcctgacctcaagtcatcctcccgccttggcctcccaaagtgctgggattacaggcatgagccatcgcgctctgccagattctagtattttctaccatcaaaatatctattacccaatgaaaagtctaaaggccaatcttttttttttttttgagacaaagtcttgctctgtcaccccaggctggagtgcagtggttcgatctcggctcactgcaacctccgcctcccgggttcaagcgattctmctgcctcagcctcttgggtagctgggattataggcgtgtgccaccgtgcctggctaatttttgtatttttattggagacagggtttcaccatgttggccaggctggtctgaaactcctgacctcaggcaatcctcctacctcagcctctcaaagtgctgggattaccggcatgagccacgactcccggccccaaaggtcaatcttaaagctacaaggtatcttttaaaaggagtaggaataacgtattttgaggcttaaaggagtaggaatagtgtatttttagatttgaagccatcttctaaagggtacgatatttggttaacatgtcactccttatcgccatggaagaagttaattctattcttttttttttttttttgagatggagtctcactctgttgcccaggctggagtacaatggtgtgatctcagctcactgcaacctctgcctcctgggttcaagcaattctcctgcctcagcctcctgagtagctgggattacaggggttctccaccatgcctgkctaatttttgtatttttttttttagtagaggtggagtttcaccatgttggtcaggctggtctcaaacccctaacctcatgatccgcccgccttggcctcccaaagtgctgggattacaggcgtgagccaccaygcccagccgttaattctattcttactgcttactcccttattttgtatgttcttcttctatcttacatcttttgcttttgctattgcttaagctagcctacgcccaagggtgctctttgccccctacttcctctgctattctctcgcctcagttccgctgcattccaagctcagcctgccccagcagcaggtctctttgacaaacctgcaattttggggaaaagtcagcccaagaaaggcagggggcccagacttatgctgtgtggcaaaagccctctttgatgggggaaggggaggactggaaaagcagagagatcyttctggatgtcctgggagagcagccctttgggtggtgggtggaggctggaggcagggaggaatcccctcacagtgccatgagaagggcccccaaacccaggcgagacagagggagggtcaagaacgccaaggcaaatgtcacttgtgccttgttttttccctaaagaaactaaacaaagcggccgcgttcggtggcccctcaggaaggccggtcatttcctgaggagatatcaggccagcccaggccccattgttcccggtttccagccatggctgccattacctgaccagcgccacagccggtctctctgcaggcgccgggagaagtgaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgtgagtgtttactctgtttccacatcactttaactccatgagcatcgaagcttctggaatcaacatgtttcttatgtttcttgcaggttcaagccttgagggtcaagaaaactgtaagtctgatgtttccactgtaacagatgtttctacctggcttcctcctttctcttctgtgatgcctaaaacgcacattaaattgctggggtttgatacttctaacaattaaggaaaagaatccaattgagaactaaagtttatcccatgtgggcatttttagaaaggcttagatctaagccaagttctggtcagtgtgttttagaagtagcacacgtttccttggctggtctgaaagtagtgggttatcttgatgaattgtttagtcagttacagatcaaactccatgttcttttctctgttctcacgactactcttgactagtctaaaaatatattaggttgttgmaaagtaattgtggtttttgccattacttttttaaaagatggcaaaaaacacaattataagtagcacacattttcttttttttttccttttttttttgagacagagtctctgttacccaggctggagtgcagtggtgcaatcccggctctctgcaaactccgcctcctgggttcaagggattctcctgtctcagcctcctaagtagctggaattagaggcgcatgccaccaggcccggctaatttttgtatttttagtagagacagggtttcaccatgttggccaggctggtctcaaactcctgacctcaggtgatccgctggcctccacctcccaaagtgctgggattacaggtgtgagccaccrygcccggcctcacattttctagatttcagtgcattgctgttttttgggatggggargtgatttttttattttaatgagcaattccataattagttttttgttgttttaccataatggcttatttgaatattgtaacctatccccaactgtttttatttgcaaatgagatataattgatttgttagacatatgaagacagatcctagtttaaattgttgctactttttttactcctaaatgataaaaatcacacactggagctcattttccattcacctgtgaggctacaagtrtatctgtaatattttgtgcttgtacaaagggaagtggggtgctgcctatctttgaagcctggtttatcttccactttacagctaattttgaacctttgtcttgagatgagagggttttgttctgcttcttctgggaccacatgaatgagggggctcagtagtgtcccggggctgtgaatagagggagagcccacagaacactatttccttgtcagaagtcactgcaatcagcaaagaatggaggtgactgggttgcaggcaaattgcacagctctttggaggtgaagtccatgggcaaggctagctggtgagtcaagcctcggagcagtggccccaggctggggagggctagttggccactggcaaagcccctctgccaggcttctctgctcaactgtaggtgcttccttgggcatttgatccccatggcaacccacggaggcaggatatccataatcttcataattatcctgctggactgatggtgtcaccaagcctcagaaataaccgattttaccagccgygttggctcacacctgtaatcccagcactttgggaggccaaggtggtcgaatcacttgaagccaggagttcaaaaccagcctggccaaaacagtgaaaccccgtctctactaaaaatacaaaaaattagctggacatggtggcacatgcctgtaatcccagctactcgggaggcaggggcatgagaattgcttgaacccrggaggcagaggttcggtgagccaggattgcgccactgcactccagcctgggcaacggagcaggactttgtctcagaaaaaaagaaagaaagaaagaaagaaccgatttgtccacgagagaggcagttggctgggcactgggactggaacttccactctctgaagctgcaccatttgtctggagccataggcctgactcaagtcttttagaccagttttacttaagctctttgatttgttttcccaatctgtaacatggggatgataagagaacttcgtgggcatgaagtgggtgtgaggttgagactggataaaaggaggtgattaattggcccccgcctcgaggtgattgataaatgacaatggtgtttactacacggtcctagcccccctttacgactgtgactcctgccctacccactctccctttgtccactccagccctcgtaccctcccagaccacaccctttgggccagaccctgccctgcagacactcacgctttggggtccctctttttcttacccacaacatcctgtttcccaaaaccgtggtgctctcccctctcccsctccacaccacatggaagtcaattgctccctcctttgggttcctagagaatgaatgttctttgtaccttcagggaagacgttggaactgcagcacatggcacagggagcgactctcccactgcctcctcaggcctctgccttgttttacactcaaggaaacagacccagrggccacaaggcaccaagcaagcagggtcaacactgggggtgggcagggcggcggctggaaccaggtctccattccttaggccccctaggccagcatttgcagtgcgtggcctgcaggcttgctctgagtctcccgctctgcggctggggtcctgggacagcctcggccctttcccttccttccatctcaggcctctttgttcccctccagcccgcacctcactgcagctgcctcacctcaggaggtgacggctgctccrtcttcacctagaaaacagtcatctggagggaactccctcaacttcccgcctgggcctggctgcaggcttatcagcctctccacccatcctctcggtttccctcccggcctcggaggacacatgcaccctgctcctcagctgatgggggccagccaggcacttaggctgagacccttcctcacccccaggaccccacgcctacgtgcattcaagtccctctcccctaccaccacttctagaatctctatttctgcttctggctctgttctctcagtgaatgggaactcttttttttaggaaaaagaaaaatcacaagcagacacccacccccaccgtttatctggtgtccccctatctggcctttctagtttcctttctcagtcgaacctctctgaaagttagtttataatctgtgcctacccccctcacctctcagacacgcctcgcctcccagcagcctggcctcaggccccacttctccggctgttgggtctcctcttgctgaggggtcaccaaggaccacctgatgccaaatgcaacggacacttccagccctcggctccctgtacccctttcctgcctttgacttttgatcgtgccccaaagcctcgctccttgaccttttccatcctcttccctgctttgtctcctcactctctaacaaaccctcttccttctcccccatggctgactttggacttactttgtcttctcctggagtctgaaccctgtcctggtctctgcgggctcctggtcttatcctccctggagaccagctcccctctcaacacctccacattcccccctcctcccctaagttcacactcctcccaccttcacagtccagccctggcctctgccctgagcctccagttaacacaggctgacctttgatgtctcctcccagtcctcctactggcccctcacacgcagctgcaccaccatcactttgtcttccttccttatctttttctgtttgtttgtttgtttttgtagagactggggtctcattttgttgcccaggctggtctcaaactcctgggctgaagccatcctcctgcctcggcctccgaaagtgctgggataacagatatgagccaccacacmcagctgcgtgtggcattttctattttagtttggtggcacacacatcctcctgggaatctaatccaggaagtttatcttccattctttcaaccccatatccaatcaaacaaagtctttttttaaattgtggtaaaatacaaataatataacatttattattaatgacatttagtacattcacggtgttgtgcaaccatcaccattgtctaattctagaacatwttctttctttttctttttttttttttttttgacagagtctcactcttgttgcccaggctggagtgcagtggttggatctcagctcactgcaaccttcacctcccagattcaagcaattctcctgcctcaccctcctgagtagctgcaattacaggcacgaaccaccatgcccggctaatttttgtatttttagtagagacaaggttttgccatgttggccaggctattctcaaactcctgaccttaagtgatccacctgtcttggcctcccraagtgctgggattcattctagaacattttcaacaccccagaaacaagtcctgttgagtccactcaggagatccccagcctatccttccctcatccccactgcacccgcctagctcaggcctcatcagctttcacctgaaccacttccaagctgtttactggccttgggtgctgtcacacccctcctgacaccctcaggacagggcccagcttgtcagcacagcaggccagccctccattctggcacgacagacccagccacctggcctctctagccccacactctggtttctgtaatgggccatgcccagaaggcacggatttctcacaccctcgtgtcctgggacacgctgttctcttacctggagcaccccactgcctgtccttggcctggcaggctcagttcagtggtcacttccttcagactccttgacctctcctgggcagcccttcctcttggtgcttactgatatcactggagtccagctatgtgggccccagcaacctttgctgtttgggacagcaaggatgatttcttacttactctgtcagcccagcacctggcacaggttctcgacacatgtctcatggatgggaacttgaactgaacttggagatgcttgagattcgggtaggaagatggctcagcatgctctctgatgagcacagaagttcatcagggactctatgcttcgtggctcccagtaattttcctgacgagggtgggcagcccctccttctcctgcaccctccactttctctctgagtcatttccaggttgagggccagggggctggctgactcatggtgccgcatgtttccagggagcaccaccatccactgatgagtggccttgaggtcaaggtcccactgtttttagcatgttggggtttggcactgtggtcactggctgttccgtggtgactttccaaatttagatccttctccgtcaaccttcatctccccgggttgaaaagatctgacctctttaggctgtcccacagccccacccttcatcacaatagtcctgaaactttttgggttcagtaaggaaatctgtgggccttctctccagaaaaagcacacatttgcacacaattggaggtagttgatgagcctcctaacacccacccatgcacctcccaggggctgtgtmccccaggttgtgaacagtcactctgtgtaaatagtgagacctacaggcagtaattcagtttggctgtgcttggctggtttatttagaaagaygataatgttttccatattatcaaaacaagaatcaggcagagacttttgaagtttggttgcgtggtatatttgttacctattgctgcwtaacaatttacctaaaacttactggcttaagataacacagatttattatcctgaagtttctgagggtcaggaatgcaggagtggctgagttgggtggtgctggcaccgggtctcattagattgcagataaattgttggtcagggttgcggttatctgaaggcttgactgagtctggggaatctgcttccaagctcactcctgtggctatgggctggaggccttagttcctcatcctgggtaccttccacagggctgcttatgctatgactgctggcattccccagaatgagggatcccagacaggagagagagtgatcaggataaaagctgcattgtcttttattacctgatggagtattttgttggttaatgttaaygtgggaggtgaccacgtgtaagtgtgatgagcagagggcaaggaycattgrggggggcatcttgaagggcttctatagcaagggaggtggtggtggttgtgscggtaaaaactaggtcactgtttttgttgttttgtcgatgatatttgtgttaagatgaagagctgagactcatatctcaacagagtttataaaatgcttttcttttttccatcctgccctctcttctcccttgtctgttygagctagccatgggaatgtggtgttcctgccagtgcatccattgagttcgtttattgttaatttatttattttctgagwtggagtttttgctctattgctcaggctggagtgcaatgatgtgatcttggctcactgcaacctctacctcctggattcaagtgattctcctgcctcagcctcctgagtagctgggatgacargtgcccgctaccatgcccggctaatttttgtatttttagtaaaggctaggtttcmccatgttggccagcgggtctcgaactcttgacctcaggtgatccaccgacctaggcctcccaaagagctgggattacaggtgtgagccgccacaccctgccgagtttgtttatttgagcagataatgtgtgttagagttgcttagaaaaacaagatggtggacgggccccatgctagtgggtaccatccctactggaaaaaccactgcttggtgcrttagccaaatttgctttaaaattgttttttaaaaagggagggcttttataaaaatcaaatgaactaggactggtyagtgggaggctcacgcaagggttgtgctgaggctggaaggcccagagtaggaagagttgtggagtgcagaatgagctctccaagggcagacactgccagcctcactgttctctgaacccccagtatgggggacagtgcttggcacrgaaaaacccccttaaatgtttgctatgaatggtgctaaggaagaaggcagagaatgtcaaccagaggccaggcactgggcaatatatacacggccccttctgtgccctcagccactttggcgcagtcactgtttaggttaaagataccagagaaggcaggtattcatgttcctacttcgtaggcagagacgtggtggcccagagaggttaaataactcccgagatcacccagctaagcactgtgggatcacgggtttgaatctggtatgtctgactcccttctgtacccagcactgtctgctggtctagggcataaccagccagggatgggcagctcgttcagtaaacaggagagcagatgaatgactcgtgtggagagcacgcagtggagtgagcaaaactgggaggctggagaagtcgctttaaattaacctgaaaatgtttaatatgctttttattttgtttattttttttgagatggartctatctttgttgcccaggctggagtgcagtggtgcaatctcggctcactgcaatatccacctcccaggttcaagtgattcttctgcctcagcctcccgagtagatgggattacaggcaactgccaccacgcctggctagtttttgtatctttaatagagatggggtttcaccatgttagccaggaggctggtctcgaactcctgacctcaagtgatctgcccagctcagcctcccaaagttctgggattacaggcatgagccaccacgcccagccttaaatatggtttttatttgaaaaaaaaaaaaatccctagaaacatgtagtggagacacagctttaaagctctgaatagttgattttcagctcatgcctgtaatcccagcacttggggaggctgaggcgggatgattgcttgaggccaggcgtttaagaatagcctggacaacatagtaagaccccatctctaaaaaattaaaattaaaaaataaaaaaagagtcgactttatttctgtaactggaagaatctagctaacatttctcaagcactttataggtgccaggaactctactttaagtaattaaactcaggttctcatttatacttacattccttgtgcctattgtatggataagcaaactgaggctcagagaaatttagggacttgccaaaggtcacacagctttgttagtagcagagatgagatttggcccaggtctggctccgtgcacttgatttctgctctttagtatctcctggttgagtcactggaatacacagcatagcttaaaatgaaggaggaagtactgaagaggtaatggaaggagacctaactgtctctgagagggaagagagtggttgggagggaactatattaattgaggagtgcagagaaattaatatggtccaaaggaaaaaaaggtttttttgagatggagttttgctcttatttcccaggctggagtgcaatggcatgaccttggctcactgcaacctctgcctcccaggttcaagcagttctcctgcctcagtctcccaagtagctgggattacaggcgcccaccaccacacccggctaattttgtatttttagtagagaygaggtttcaccatgttggccaggctggtcttgaactcctgacctcaagtgatccacccgcctcggcctcccaaagtgctgggattacaggcataaaccaccgtgcccggctggtccaaagaaagttgtgtgtcgagagctcatccagcaggcttcttaaatcaggagcttgtaagttgcatataaagacaaaaaagggagttccaaagagtaatgctgtgggaaatgacttgaatttaaaccgtcaccttgtttcatctcatggactggtcagacaccatttttgttgtcgttgttgttgttaaattaattgctcagaatatagcagcaggcgcaaattgtagtactcgttttaaaattgaagattaaattttaaattacccaacaaaggcctaactttgttaaaagagagggaaaggacaggttctgccagtatctctggccagctagctaactaacttttttcttattccaaaaaaatgacttgggaccacttataaaaattatgtattgttcaaygagatacaattaatgaggaaatcaggatgagagaaaaataaaggcagggaaataaagctatggcccatttagcacaaacrcatcccaaagattgctagaagcagaggtgaaatttttgctgtgtgttaacaatcaaagcaaaaagaggaacaaggtccattagaacattctcagaatccacaagatagaaatgaatcagttgttcagcataaacacagtgtttcctggtgctgttggaacactttgtgaaattagggacaatatctcatcaacatcccagaccaacatcccaaaagaccatttaatagcttgcatctgtgcttctccctaccccatagcccctccctccagagatgaccactatgctgacttgtaaaatattaatcttatatccagccacctttctttttcgtttgtttgtttgtgtttttgcagacagagtcttattctgtcgcccagtgcagtgttgtgatctcaacttactgcaacctgtgcctcccaggttcaagtgattcccctgcctcagcctcccaagtagctgggattacaggtgcatgccacaatgcctggctaatttttgtatttttggtagagacggggtttcaccatgttagccaggctgatctcgaactcctggcctcccacagtgctgggattacaggtgtgagctgccattcctggccttatccagccacctttctaaactcacatttatttctaataatttgtctgcagactctttgaggtttttacatatcatgtcatctgtctttgagagttttaaacattggactgctccattcactcaaaaattttaaaaaattccatgattgcattattcatacttcatggagatagatggggggctaagaaagcataccagacatagtcactttcaatcccaggtccaaatgctggataggtagcttccttgagaatgggcatggtagaaatttctggggggacgtgtagggatttgggaaaaacacctggttttatggtcatggactttcagtacatttttttccaaatcccctacagatcaattactttttctcttttttatacttatttaattttttttagatggagtttcgctcttgttgcccaggctggagtgcaatggcgcgatctcagctcactgcaacctctgcmtcccgggctcaagcgattctcctgcctcagcctactaagtagctgggattacaggcatgtaccacacccggctaattttgtatttttagtagagacagggtttcaccatgttggtcaggctggtcttaaactcctgacctcaggtgattcacccaccttggcctctcaaagtgctgggattacagccgtgagccactgcgcctggcctcttttctttcttttttttttttttgagacaggatctcactctgtcacctaggctggagtgcactggcatgatcatggctcacttcagcctcgacctcccaggctcaggtgatcctcccacctcagcctcctgagtagctgggactacagacacatgccatcatgcccagctgattcttttgtatttttgtagagtcagggttttgccatgttgcccaggctggtctcgaacttctgggctcaagcgatcctcctgcctcggcctcccaaaattctgggattacaggtgtgagccactgcacctagcttcatccatattttttttagccatgtatagaacatgagatgtttgaagttgttttctgacaggaatttggagagtgaatattttatggtgctgattaaacccagattcatgtgcttggaaaagacaaccacagggaagctagtgagtgctttgagatatgtcaaggggtaaaactaagaccacaagtgggctgcagaagcacctacaggcattgccaagaggatctccaaaaagcagttcaccctggtctgctctgaagtttggatacaagtcctgacccatgggcatggttcaggatcttctagcctggaaaattttcagggcagttgcccacaaccaaccaactgacaaaaacacagcaatagctagagagcacccaattttaagcaatccacccttccgtcagcctgctactgtgaatgagcctcaatatgtgatctgtagttagctgaattctattgacagcctatggttactggatataagccaattctgttctggggacttgccagaaatgacacaattggccagttgacccacagcctagttcctagcagagattggatagctgattgagcrttgtggctgttttgaggcttgaccagagattcctgccgttggcagaggggaatctgtagtctttgcttcttggtagcaggtgaggctgaaaacgcaagtagcaggctaaaaactggtttcaagtcctcaccatctggtgaaacctcagagcccatcagatagaaaatgccagctgggactgtgctaattcggtaaggcctgggtggagaaggagggcctgggcacgaccatctggtttcggaatggaggtagcagtcatttattaagyacttaatgtatatcgggcactgtacaggagacgttctggctgttctcctgtacatttcctgcaaagacctaatgagatatgattactccatcctacaggtaaggaaactgagctcagagagtctagctgcccagggtcacacagtaaatgatgagccaggacttgaacacttgactgcttgaatcctgtactccctccaggggccaagatgtggcagctcacagaatgcctatatctttttttttttttgtcttttgagacagtctcactctgtygcccaggctggagtgcagtggtgagatctcacctcactgcaacccccgcctcccaggttcaagtgattcttgtgcctcagcctctcaagtagctgggattacaggcctgcaccaccaaacctggctaatttttgtatttttagtagagagggggtttcaccatgttggccaggccagtctctaactgctgacctcaggtgatccacccaccttggtctcccaaagtgctgggattataggcgtgagccaccatacctagctctacatctttatcacaytctgttcctttgccttggtgggaaaagttgcagcttagtaccaactgcctcctgcttgagccactgtgcacagttactatcagcctggccctgtaggcacgtagaacccctggactcaatactgcataggatgggataagaccacatctgatgtggtgaaggtcaccgggatgatgttgtttctgagataacaggtatgtctgccttccttccctttgcatttagctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccagstgttggtggaaggtgagtccttggaactgagcacaggcaagcagatggagcawagcacacagtggcgtgaataacagctgtgaatgaatagtgacactggacttaactctccacccatcaccctctcattcatctgcctggcattttccttacctgaatacgtaagcactagacatattcccaataggccaggcccttccttccttccttccttcctttctttctttgatggagtctcactctgtcacccagtctggagtgcagtggtgtgatctcggctcactgcaacctctgcctcccaggttcaagcgattctcctgcctcagcctcccaagtaattgggattacaggtgtgtgccaccacacctggctaattttgtatttttagtagagatggggtttcactgtgttggtcaggctggtctcgaactcctgacctcaagtgatccacctgccttggcctcccaaaatgcttcttcatctcgtctcataaattaaaatttcttcttcaagactcaactcaatgatgtcttctctttccaaaacaaaatgggtctaccccagggtgccagtcagtacagctctgatgctctctctacattcartggtatttgtgtgtataaaggccacagcggtgtgttaagacacctcgttctgcagtcactctgcctgggtttcaatctgggcaagtcccttaacagctctaaacttcaaaatcctcaccagtaaaaggaagataacaacgatacccatttcaggcaattattgagagggttaaaagtgtcatgtgggtagagtgcttagcaaaatttccagcacctagtgagttcctaataaatagaaatgtatttatttattttgagacagagtcttcctctgtcacccaggctaaagagcaatggcgcgaccttggctcactgcaacctctgtctcctgggttcaagcgattctcctgtctcagcctcccaagmaactgggattacaggcacgcgccactgtgcctggctaattttttgtatttttagtaaggatggggttttaccatgttggccagcctggtctcgaactcctaacttcaagtgatttacccaccttggcctcccagagtgtcaggattacaggtgtgagccaccatgcccggtccacaaatattctatttcactcagtattgccatccrttcttacacatctgtctgctcttctggatagtgaaattgtaaagacagagatggtgtttggtttattcttatatcttgaacaatgaatstggctcatagtaggcattcagtcaatgttcatggaataaattaaagtcagtcctagcctgtggctgcattcaataaagggtaacaacaatcacagtgacactgacaaatactggctacctttcccctctaagcatcatctgttgggaatctgattgtgtcctcttcccaataggattataaaycattgaaaacaccaagtacatcttgaccatattttattttttaaatttatttatttatttatttatttatttttagacagagtctcactctgttgcccaggctggagggcagtggcacgatctcagctcactgcaacctctgccttcggggttcaagcaattctcctgcctcagcctcccaagtagctgggattacaggtgcctgccaccatgcccggctaattttttgtatttttaatagagatggggtttcgccatgttggccaggctggtctcaaactcctgacctcaggtgatccacctgcctcagcctcccaaagtgttgagattacagatgtgagccacctcgcgtggccttagtggtgattttggtggacccatcacccgagcagtgtacactgtacccagtgtgtagtcttttatccctcgctccctcccactctttcccctgagtccccaaagtccactgtatcattcttatgcctttgtttcctcatagcttagctcccattgagcatattttatattttttcctttcttttcttctcttttttgagacagggtctctgttgcccaggctggagtgcagtggtgggatcactgctcactgccgcctcaacctcctmggctcargtgattctcccacctcggcctcccaagtagctgggactaccagtgcacaccactaactacccctggctaatttttaatttttttttttgtagagatagcatttcaccgtgttgcccaggctggtctccaactcctgggctcaagagatccacccacctcagcctccagattttatatatttcaaagtgcctagtactgtgctgggcacatacctgttcatttattacctggtaggtcgcactgggtgttcagagaacaaaaaagagccctctcatgggtcaactacagtcactcagcggagggaggcttgtgtctctcaatcaggctgatactgacagactttctcttcaatcaggctgatactgacagactttctctttccccrtaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacgggtcagcatcctgctcccttcctcatcgttctttgtggtttctggtttggtatggggagaaagaacccagaactgggaaggggctgctgttctcaggacttaagacctgttcttaatcattttaagccagtatttttcaagcttttttgactgttatacagttaaattgcatacaatttttcagacaagagtttcaccaacaacactttactcttaatatatatgatgctttttgtttgtttggcttggtttttggggtttttttttttgagacagagtctcgctctgtcgcccaagctggagtgcagtggtgcaatcttggctcagtgcagcctctgcctcccgggttcaagcaattcttatgcctcagcctctggagtagctgggattacaggcatgcagcaccacacctgactaatttttgtatctttagtagagatggggtttcgtcatgttggccaggctggtctcaaactcctgatgtcaggcgatccacccgccttggcctcccaaagtgctgggattacaggcgtgagccaccaccccaaccttgtgtgtgtttttgagacagggtcttgctctgttgcctgagctggagtgcagtggcatgatttcagctcactgcaacctccgcctcccaggttcaagcgattctcctgcctcagcctcctgggtagctgggattacaggggcatgccaccatgcctggctaaatttgtatttttagtatagacagggttttaccatgttggccaggctggtctcaaactcctaacctcagatgatctacycacctcggcctcctaaagtgctaggattacaggcgtgagccaccgtgcccarcctatttcagtctttaaacactggccatgacacactacactgatgcattatgtgatctgtagtttggaagccactgctttaagccatcgagggtcagacaccaggaagytgggtttggaggggatcgggaggaaagaggggccaggtcctcagccttggcctcctgttgttcaacgtagatttgcgttggacaaacagcaaacaaatgaggtggcctgggaaatgctcccaggagagaaggaggcaacagcagagggaagctggggagtgtccaggacatacagggctctaggacaggtagtcagccactcccaggacccggtctcattygccaagccgggagaagtcaggggaaggcacacccatgtagatatttgcaaatatttccaaaataggaaacttacattttgtcataaatggtccccttcttttggcatcccactttatcctgcccattgtgtgtatgtgtgtctgtatgttctattatctgattataaaatcatgtgtgctctgggtagaattttcagacaaaagagcaggatataaagtatgtatataaagtgacaatcatttataatgcctctacttagagaaaaccacacatgatcctctagactttttctacatatatttatatatcatatacacacccagccacacacacacacacacacacacacagaaaaaacatcttttgtttttacaaaagatggggacctatcacactattttacagctttttaaaaaccagacaaaatcttatggacttttgtccatatgargaaatatagatctatctcattttagaactcagaacttgactgtagggatgggccatctctgcaaccctcaaactcctgggcttgagtgatttacctcatcttctgctgatggatatttaggtatttttctcagtgtttgctattacaacaatcctgcagtatagatatttgtacttgtaacttgtgtactttggcaactattttactattattatttatgtggttaattcttagtagtcaaattgttgaatcagatgttttgtgcattttcttttttatttatttatttatttatttatttatttatttatttatttatttgagacagagtttcactcttgttgcccaggctcgagtacagtggcgcaatctcagctcaccgcaacctccgcctcccgggttcaagcgattctcctgcctcagcctcccgagtagttgggattaggcatgtgccaccacgcctggctaattttgtatttttagttgagatggggtttctccatgttggtcaggctggtcttgactcccgatctcaggtgatccacctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaggagtttgagaccagcctggccagcatggtgaaacctcatctctactaaaaatacaaaaattagccaagcgtggtggtgggcacctgtagtcccagctactctggaggctgaggcaggaggatcacttgaacctggaaggtggaggttgcagtgagccaccgtgtcactgcattccagcctgggtgactgagtgagactccatctcaaaacaacaacaaaaacttcagtatgaaaaacttatcgtaaaataaaaagacaaatgacaaactggagaaaatatttgcatagtacctttaacaaacagctaattcctttaatttataaaaggtttggctgactgtgcctggctcgatgttgccaaagtgctagatattgccaaagtgctcttcaagatggttgaacattttcatcagtagtgatgctagtgtttgttttcccrcatccttaccaacaaactttttctttctttctttcttttttaaatagagattagggtcttgctatgttgaccaggctgttctcgaactcctggcctcaagtgatcctcccatctcggcctcccaaagtgctaggattgcaggcatgagccactgtgcctggtcctaacagagtatttcaatgttttattatttttgacaatctagttgaggtatagtgatatatatcattgttgtggtgatttgtatttctttagtttttagtgaggttgagtttgtttattcatctattacatttttttcccgtaaaccacctattcatatatgccttgtcattttcattgtgaatcacaaaactccagtgccacaaagaaacaagataggtaaatttgactaaagtcatttttattgttcctggttggatttgttcaagccctttattttatttatttatttatttttgagatggagtctcactctgtcgcccaggctggagtgcagtggcgcgatctcggctcactgcaacctccgcccaccaggttcaagtgattctcctgcctcagcctcctgagtagcyggcattacagggggctgccaccacgcccagctaatttttgtatttttagtagagacggggtttcaccatcttggccaggctggtcttaaactcctgacctcgtgatccacccaccttggcctctcaaagtgctgggattacaggtgtggagcaccgtgcctgacccctttattttattttaaaaaatattttataatatgttttttgagatggagggtctcaccattgtttcccaggctggtcttaaactccttagctcaggcagttctcctgcctcagcctcccaaagtgctggagttgcaggcgtgagccaccgcccctagctgagcctttaataaattgattagctatttgtcagtgatattatgcaaatattttctctagtttgtcatttttctttgagttttttgataagttttccatgctgaagtttttaatcttcatttagtcaaatttacctgttctgtttctttatggcgcctcagttttgtgattcatacttaaaggtcttctgcatgtcaagattattaaaggaaaaaaacacacccatgttttctattcctgtgctatggtttcatttttttccctctgcatttaaatatctggtgcatctggaggtgatttgggtgaaagaaaaacacccttcagctattattaaggttccccagaagacctaaaatttgagagtcctaaagcatgtaaaggatgccttccccttttttacttttatttgagaaggcaggctattattttatgataacttctaattatgaattgactttataatgttaaaaatcactaatgaatattaaagcattagnnnnnnnnnnnnnnnnnnnnactaatgaatattaaagcattagagtactctaagttcactattagcattttaaagatatccctaatctatattttacacagttggaatctgtgtatatattccagtttatgccctgggcttgtttttttgttgtaagtggaaacgaaagcctaggacctatccctacttccctgaagatcctatgccctggttggtatgtgatctatacttgattaaaactatttttctttttaaatagagatagggtctcactatgttgcccagaggctgttctagaactcctgggcttcctaagtgttaggattacaggtgtaaggccccacactcaggcaaaattgtttttcaaactgcatgagtcatgaaatcagtttagtgagtgatggccagcattttaaaaaatgaaatagaaaagactagaagccacttttttggaggcatgcgattatttaaatattcatttccatgaagcagcacgtttcacagagctgaacttttgaaagctatagtatcttcatgctgaaatgccaagcttccatgaagtgctgagaatagcctagaaaactcgtagtgggcaggaggaagatcatttctaaatactgtggttatttctgaagtcctctgaaggcgagatctagagaaggtgtttggcctttgggaagcttcagaaacccagagaattgcagtgaagaagcctgaagatgcaagagtgagcgagaagggagggagtatgagagcagccaaggcaaaagttctagagaagaaaggttgaatttttaaagttagttaggaacaatagaagtttgaaaaggggaagcagcaaaaagagcagaagaggctcctcttgcccaggtttgcacctgagtccaaccaggttgtcttcctctcttgcagaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacaggtagggctgctgctgcgggagggtgttggcatatggcgggctcaagaggccaccatgctgcaatccagcatggccaaagagagctgatacatttcctgcccctgcttatctgaatgaatgtgctcagatggggctttggtgctcgtgggargaaaccactgcagagcgagttaacagtctactgtgcgtgttgagggtrcaggctccggcaccaaagctcaaccctgccgctcactgcttctgtgaccttgggtgagttattgaacgtgccgcagcgctgtgagatggtgataatgaccttttaggactgctataatgattaatgagataactatactgtaagcatgagctgagagatttgtacagagtaagactctgaacactggttaatgttttcattactctgttatatttctccatcccctgtgacaagcactatgctagatcccagacgtgggtcctatgacagggccacaaatgagaaagcattagtaaactcaaaaataatgataacatggctgggcatggtggctcacgtctgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaagaaatgacaattaccctttgttgaacattgcatgatgggtttatatacattttcttttctttttttttttttcttttttgagacaaagtctcactctgttgcccaggctggagtgcagtggcacgatctcggcccactacaacctctgcctcccaggttcaagtaattctcctgcctcagcctcccgagtagctgggattacaggtgcatgcgccaccatgccctgctaactttttgtattttaagtagagatggggtttcaccatgctgtccaggctggtctcaaactcctaacctcaagtgatctgcctgcctcggcctcctaaagtgctgggattataggcatgagccactgggctggcccaggtttatatatattttcatttcatgctcataacaattcaaggagataggcataagaatgtccactttatggatgtggaaactgagactgtgaggttagtaactcaaccaaggattacagggttaccaagggggtagaacaagagtcaccctcaggcctgtttggctttcaaatccatgaacttgaaagttccctcagactcctaaccctccttacctggctttatttccctctaaagtacttagcaccaaaaatatactctacctttcttgtttattatgtgtatgcagccactagaatgcaagccgctgagaacaggaacattattttgttcagtgctatatccttaacacctagaacagtgcccggcacacaggaggaattcaatacatatttgttggatgaaggaatgagtgttagatgacaatgtttcaggggacagagacagtcagcacttcttggttgcacggtgaaggggttctcatgtgtctgcattcataacgttcattcattcatttgttcagttatttactaaaagcctcctatgtgtcaagcattgagtgtgcagtgtcagcaacagtctccagcaccataggtaggctaccaactacccaactggtatattggcatatacattgggtcctgctggtctatagtgtgtgctagcaatttagttaagtattgatcatgacttatattttgatggctcatggtatttttttactgatacaatttatattatctcattaaagaaaagtaccagttcaacacatattgagcattttctgtatgctgggcaacttactggggataaagagctacctaagacccggttttacctatgaagaattcatagacataactagaccagtctacagcattttgtggtagaagcccagatggactgagacattctgtctcagatactttccctggataactttctccaacaggcctttccatgattcccaaggctaggttcagtgtcttttttcttttcttttttttttttttttgagatggagttttgctcttgttgcccaggctgcagtgaagtggcactatctcagctcactgcaacctccgcctcccgggttcaagcgattctcctgcctcagcctcccgagtagctgggattataggcatgcaccaccacacctagataatttttgtatttttagtagagacggggtttcgccatgttggccgggcttgtcttgaactcctgacattgtgatccrtccacctcggcctcccaaaatgctgggattacaggtgtgagccaccacgccctgccagttcagtgtttttcctatggggtctgtgacaaataatgcatctgaatcaaccactaaatgtaagcactttgaagtcagagactgtttcttattcactgctatctctcagtgcctagcaaggggcccgccacagagagaacctgcaataaatacttgtggggtgaaatgagtgagtgaacaaatacatgagtgaatgcatgaatcattatttgctgcattacaagctgcaaaacttttcttttgttgcttttttttttttttttgaaatggagtttcagtctctttttttattattattatactttaagttttagggtacatgtgcacaatgtgcaggttagttacatatgtatacatgtgccatgctggtgtaccgcacccattaactcgtcatttagcattaggtatatctcctaatgctatccctcccccctccccccaccccactacagtccccagagtgtgatgttccccttcctgtgtccatgtgttctcattgttcaattcccacctatgagtgagaagatgcggtgtttggttttttgtccttgctatagtttactgagaatgatgatttccaatttcatccatgtccctacaaaggacatgaactcatcgttttttatggctgcatagtattccatggtgtatatgtgccacattttcttaatctggtctatcattgttggacatttggattggttccaagtctttgctattgtgaatagtgccacaataaacatacgtgtgcatgtgtctttatagcagcatgatttatagtcctttgggtatatacccagtaatgggatggctgggtcaaatggtatttctagttctagatcccygaggaatcgccacactgacttccacaatggttgaactagtttacagtcccaccaacagtgtaaaagtgttcctgtttctccacatcctctccagcacctgttgtttcctgactttttaatgatcgccattctaactggtgtgagatggtatctcatagcggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaaactctttagtttaattagagcccatttgtcaattttggcttttgttgccattgcttttggtgttttagacatgaagtccttgcccatgcctatgtcctgaatggtaatgcctaggttttcttctagggtttttatggttttagktctaatgtttaagtctttaatccatcttgaattaatttttgtataaggtgtaaggaagggatccagtttcagctttctacatgtggctagccagttttcccagcaccatttattaaatagggaatcctttccccattgcttgtttttctcaggtttgtcaaagatcagatagttgtagatatgcggcgttattcctgagggctctgttccgttccattgatctatatctctgttttggtaccagtaccatgctgttttggttactgtagccttgtagtatagtttgaagtcaggttgcgtgatgtctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgaccatggaatgttcttccatttgtttgtatcctcttttatttcattgagcagtggtttgtagttttccttgaagaggtccttcatgtcccttgtaagttggattcctaggtgttttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatccaatcatgtcatctgcaaacagggacaatttgacttcctcttttcctaattgaataccctttatttccttctcctgcctaattgccctggccagaacttccaacactatgttgaataggagtggtgagagaaggcatccctgtcttgtgccagttttcaaagggaatgcttccagtttttgcccattcagtatgatattggctgtgggtttgtcatagatagctcttattattttgagatacgtcccatcaatacctaatttattgagagtttttatcatgaagggttgttgaattttgtcaaaggccttttctgcgtctattgagataatcatgtggtttttgtctttggttctgtttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtatctctgcccggctttggtatcaggatgatgctggcctcatcatcctgagggaggattccctctttttctattgactggaatagtttcagaaggaatggtrccagttcctccttgtacctctggtagaattcggctgtgaatccatctggtcytggactctttttggttggtaagctattgattattgccacaatttcagatcccgttattggtctattcagagattcracttcttcctggtttagtcttgggagagtgtgtgtgttgaggaatttatccatttctcctagattttctagtttatttgbgtagaggtgtttgtagtattctctgatggtagtttgtatttctgtgggatcggtgatgatatcccctttatcattttttattgcgtgtatttgattcttctctctttttttctttattaggcttgctagcggtctatcaattttgttgatcctttcaaaaaaccagctcctggattcattaattttttgaagggttttttgtgtctctatttccttcagttctgctctgattttagttatttcttgccttctgctagcttaaggagtttcattcttgttgcccaggctggagtgcagtggagcaatctcggctcactgcaatctctgtctcctgggttcaagggattctcttgcctcagcctcccragtatctgggattacaggcgcccaccaccatgctggctaattttatatttttagtagagatggggtttcaccatgttgcccaggctggtctcaactcctgacctcaggtgatccacccacctctgcctcccaaagtgctgggattacaggcatgagccaccacacctggccacaagttgcaaaacttttctaatccttgtcattgaaataaattggattaacaagaaaggaaaacctgccattggaatcctaggcaaagaatgaaccctagctccttactggggtgatcgttaggtacatgagaagcaaaggaaaactttttgctggaagttggaagttggttctgccaagagcacctgagccaagggcctctccaggaagggtctttagggtggtggccagacacatctcgctccattcccactcactgtttttcagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtggtgagtatattgttgctgactcagaggacatccggggttgaatgggagaaaggaaatttatctgcagctgccgccctctccggtctgagcagactcaggcagggtaagaactagagggagagaagtgcgaaatcaaaggccaaagaaacaaggaggtattcctgctcagaacactgattcactgatgatgatgtggcctctgacttgctaagattctggcaagattctgcctcctggagcaagtacccacccaaaagttcaggaaggaaacactacttagtcaatgttaaacttttcttttttttttttgagacgtgtcgcccaggctagagtgcagtggcacgatagctcactgcaacctctgcctcctaggttcaagtgatctcctgcctcagcctcccaagtagctgggattacaggtgcccaccaccaygtctgcctaatttttgtatttttatttttattacttttatttatttatttatttatttttttgagatgcagtctcgctctgtcacccaggctggagtgcagtggcacaatctgggctcactgcaagctccgcctcctgggttcacgccattctcctgcctcagcctcccaagtagctgggactacaggcacccgcaaccacgcccggataatatttttttgtatttttagtagagatggggtttcaccgtgttagccaggatggtctccatctcctgacctcgtgatctgcctgcctcrgcctcccaaagtcctgggattacaggcctgagccaccacacccggccaagaatatcaaaattccattttttaaatctgtatcctggctaacccaaaagggtmagacttccagtggacagaatgtaggtatttgaccaccaggagctgggcttctcaggcctgaatgtgcatgcaagacctggttaaaatacaggttatgattcagtattttaggcccagatggggccaggttctgcatctctaactagcattttggtgatgtggatgctgttggtctctggaccacactttgggtggcgagattctggttgattatagaactccagtcaagttgtcactgtcactatattattcagtmacgatcctttcatttaacctgtggctgtgttttatccagctaagattttattatagcttcaactgaaccaggattttagcctatttttaatgctctaaccacctaactcaaaaggcaggaatgcaagagacaaatgtgtgttataacgttttattttattttttgttcttgggaggaggaaatctcattgtataaggtttaaataaactaatgcctaaataatgacctaatataattcttatctgttaagaggctgaagcactaagaagactttttttatctttttttttttttttttttttttgagatggagttttgctcttgttacccaggctggagtgcaatgacatgatctcggctcactgcaacctctgcctcccgggttcaagcgattctcctgcctcagcctcccgagtagctaggattacaggcatgtgccaccatgcccagctaattttggatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattggctggacctggtggctcacacctgtaatcccaacaatttggcaggccaaggtgggtggatcacctgaggtcaggagtttgaggccagcctggccaacatggtgaaaccccctctctactaaaaatacaaaagttagccgggtgtggtggcacatgcctgtaatcccagctactcgggaggctgaggcaggagaatcccttggacccaggaggtggaggttgtggtcagctgagattgcgccattgcactccagcctgggtgacagagcaagactcggtctcagaacacacacacacacacacacacacacacacacacatatatgctcagccaggtgtggtggctcatacttataatcccagcactttgggcagctgatgtgggaggatcacttgagtccaggagttcaagaccagcctgagcacatagtgagaccctgtctctacaaaaaataaagaattagccaggtgtggtgtgcacctatagtcccagctactcgggaggctgaggtaggaggattgcttgattctgggaggttgtagtgagctgtcatcgcaccagtgcactccagcctgggtaatagagtgagaccctgtctcaaatacacacacacacacacacacacacacacacacacacattttgttggctacttgttgtactttttctatgttttctgtgtctttgctcaacacaagaaaagtatattatgtgtgcatgtgcgtgtgagatatggtaaaatatgaacatgtatttctggggatgtaatgttttccttgaatttctgtcattctctgttttgcttattgtacttctctttccctttcccttctcaccacacacacacacacacacacacacacacacacacacacacacagcctgtcagtctcataggtgtcctataaaggtaaataaggcaggcaggcatttgaaattacagcagggatagaaagcaaagctcaggctttggaggaggaacctcttgtgctggatgctttgcttttaccttcagtgccttttggattgtttctccctctgttctagaaatgctctcccagcccaggatttcttatgatgcccagtttgaggtcataaaaggacagaccatcgaagtccgttgsgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccaygccaaaatgttaagtgaggttctgagggtgaaggtgataggtaagttgctgtgctgtgagaagaaatcatgtgggcttggggcattctttcacccccagggactgtgggracaataagagaagtagggggccaggtgcggtggctcatgcctgtaatcccagcactttaggaggccaaggccggtgaatcattgaggccaggagttcaagaccagcctggccaacatggtgaaaccccatctctactaaaaatacaaaaattagctgggcatgrtggcgtgcgcctataatcccagccactcgggaggctgaggcaggagaattgcttgaacccaggaagcagaggttgcactgagccaagttgcgccattgcactccagcctgagcaacaagagcgaaactccatctaaaaaaaaaaaagcgagagaagtagtgggtgcttatgcaaagtccatatactagatatgcaccaaagcagggccaaggttcagtaaaggaggctggaaaatatttgggggctattgatgaggacaatgtaatctctttccagaacctttcaacaaactgctaaaatatgataagcatgaaagtgtcctgactgcaggaagcactgaagttgtgcatatgggctcccttagcactttctccttttcagatacactgttctgagaattgtagatcaggactctgctgttgtgactcctagccgggcaaccctgccttgtgtgaattctgcagcagtgagagctacaggctgtggtctcatggcagttactaacatttgcctgggattctcatcatactcaagagaaatataccattgtcttgggggtggacagtttcccttaagcctctatctcatgcctctcagaaggcctcaggagtgccattgcttgcatgtcttagatattttgcatcctgttgtaaaaagtttaataaggcttcctcctctttgtccttcttgtttagtaactgcctatctacatgggctgctggtggatgtgaataggagagagggattcctgcttctattcatgtatagtctaatagtagccataccttttcaattaacattaacataggctggttgaggtagctcacacctgtaatcctagcgctttgggaagctgaggtgggcggatcacctgaggtcaggaattcgagaccagcctggccaacatggtgaaatcctgtctctaataaaaatacaaaaaattagctgggtgtggtggtgggcacctttaatgccagctactcgggaggctgaggcacaagaatcatttgaacctgggaggcagaggctgcagtgagccaatatcattccgctacactccagcctgggcaacggagcaagactccatctcaaaaaaaaaaaaaattaacattaacatagactaagcacctaatggtgtgaggcatacaaaaaagaagacatattctttgtttcaatgctgtggtaagaaacacaagctctcctaattaaatgatggagaaacatctgaatcataataccaataagcatagaaaaaatgttaggggtcatgtttggttgtcacgtgaactatatccttacagtgatggtgatagtaatttagggtatgycagacttcatctagcttaagtgggtaaacattgtgaaaaagctgggctaggtgccagggcttgagaatgggtgggcagagaaggctgaagatggctgaacatctccagcaaacacatgagccaaaaggtcccatggggcacttcaaaagactgtgcgcagccaggtgcggtggctcacgcctataatcccagcactttgggagaccgaatggggtggatcacttgagcccaggagtttgagactagcttggccaacatggcaaaaccccgtctctactaaaaatacaaaaattagcccagcgtggtggtgggtgcctgtagccccagctactcaggtggctgaggtgggagaatcacttgaatccaggaggcagaggttgcagtgagccaagatcgtgccactgcactccagcctgggtgacagagtgagactctatctcaaaaaaaaaaaaaaaaaaaaaaaaaaaaractgtggccaaatcagatggctggaaacaaaggctggagtttgggaatggagaatcaccggatatgagctgaaaaagtggctgagcctaagcgtgacaggtgtcaggtgccagtmtcaggagtaggcaattgtcctgcatgcagtgaaaagccagaagatggaaggaaggacaggatgcaaatgagttctcggaacgatccacctggtggctgggtcagggagcaggcatggtgacttcagacctcatggtacgttagaggctaatgtgaagcccatgtgaagctgttggtttaaactgggtcgatatcagtrgcwcacatttactgaccatgtgtccagccctgtgtgaagtactgtagtaaattgctccaatggaaactcacaataaccacagaaggccagtaacagcattgtcgttattttatcatgacgcaactgaggcttagggcagacagctggtgggtggtgggactgggatttgagcccactggtgtcccaggccyrgagcttggcttcttccattgtcttaccacagcctgcactcacaggagagtgactcataagttmcaataccatctgctgaccatctgctctcacactagaaggaaagtctacttgggaagacaatttaggatccgaattttggtagttgaggatggagctaggaaaagcggatacaggaggtasccaagttctgcttggacctgcagggagtgaggctggcygggctccaggtggaaatgcccaggtgaaaagggagacttggagttcaggaaagtaacctggactggagccataggtttaggtgtcagtggctcagagacagaagctcagcgtgtaggtgaaatcacccaggaggagaatggggatggaaaactgaggattgaattttgcaaaatgttcatacttccggggaaaacaaagaataaccagtgaataagaaaggggtgccaggtaagaagggaagagaatcagagtcatgaggaagcccagaagcccagaaaaagctgagttccacagtaagacctgggcaacagtgaagtatggagagcccaagattgggagcgtggaggaagagcatccaccactgaatttaatcagcaggggactcagggacgttggttggggaatcaagtgaccttcccagtttcttcaaaacttgagagagagtgcagtgtcacaagattgtgactacaaaagagtgcagtcagatttcaggggtaacaagaaagtgtgaaataagggagtcaaagcataaaggaaaaaggagaaaaaatggccgatagctagagaaggcagtgggtcaagattgtctgtggcctggcatggtggcttatgcctgtaatcccagcattttggaaggccgaggtgggcaaatcacctgaggtcaggaattcaagaccagcctggccaacagggcaaaacccygtctctaaaacaacaacaacaacaaaaaaatccaaaragttagctgggcctggtgggcgcacctgtcattccagctactcgggaggctgaggcaggagatttgcttgaacccaggaggcacacgttgcggtaagctgagattataccactgcactccagcctgggtgataagagcgggactctgtctcagaggaaaaaaaaaaaagttgagcagtggctgtctcatgttcctcttcctctgcccttctttkctcagtgtgaatccttttcctgsttttcagccccrgtggatgaggtccagatttctatcctgtcaagtaaggtggtrgagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctadcaaggaacaggagggagagtattactgcacagccttcaacagagccaaccacgcctccagtgtccccagaagcaaaatactgacagtcagaggtgagtcagggtctccatagcaagctgtgctgtgggctcccaagggcaagaccagaaaacacaccccttgtaagagggagttgggggggagtctagcttatgtgactgaaggctaggagagtaatgtcctccaggctcttggttgcaagtgacagaaacccactcaaattaagtaaaaaagagaaatcgattattataaggaattgggagaatgtcacatcgttccaattacaaattgttggcagactcaccattgagtcatcttgggtcaaacatccaaccacagaccacctgtagccaaggggattgggtcacgcagaacagacatgattggggaacccacttatgtgggtgggggcggtttcctggagaggaagagggctgaaaacacatgccaaaaaggagtctactccacttgagccctggagttggagaccagcctgggcaacatggtgaaaccctgtctctacaaaaagtacaaaaataggctgggcgcagtggctcatacctgtaatcccagctactcgggaggctgagacatgagaatcacttgaacccaggaggtagaggttgcagtgagcagagcttgctccactgcactccagcctgggcaacagagcaagactctgcctcaaaaatcaaaccaacaaaaaatagctgtgtgtggtggtgtgctcctgtagtcccagctactcgggaggctgaggtggaaggattgctcaagcccaggaagttgaggctgcagtgagctgtcatcagcctctagcctgggtgacagagtgagaccctgtttcaaaaaagaaagaaaaagaaaagagtctaccccagcaaagctggtttgttccctccttgaggaccacagctgacctctatttgtagcagaaacaatcatttctgcaccagctctgagtgcagaacccctcagaggtagatggatgctaaggcaagctgccagttacaagagctgtgagaatcagactgacttttgttgcttaagcctgatattatttcttcctggcagaggaagagcctatatacaaaaaaaattttttgttttgttttgttttcagtcattcttgccccatggaagaaaggacttattgcagtggttatcatcggagtgatcattgctctcttgatcattgcggccaaatgttattttctgaggaaagccaagggtgagcatagttctttccttccatactgactggtcgtccttgccaggaaaccagccagggatgcgtggtgcttttctgacccctggattcagctaggcaaaaatgaaagctattattttcctcattgggcaaaccagaaaagataaatttggggggaaattrcatctttgtgtggttagaagaagccatttctgtagatttgtccacacctagtcctgtaatgygtgtagagtggggtgcaagcgtcttggagacacacaaacatgcgcataacacccacatgttgcacacacacattgaatgctttgtaattaacctggtggttgtgctgtgacttctaccctatgcttgkggttagctaagtaagcccggctgagcagccaggaccacctgctgataaccaggaatcagagtcagctgtccaagactcaaggaaaagggcagagcatcagtaaatcctgcaaaaatttttttgtgggataaggtaggttcttttggagcctctggtgctgctgcccaggatgggaggggaagatggggtgaggaggggccctggtttttgtcaggaaagctgccacccatcaaggaagatagagcacaccctggcgttgatcttaggccagcttcgagttacaaacgcagggattgatttcgcctttactttttgtaattatctggaatcaaagagagtggtcaggcacggtggctcacacctgtaattccagcactttgggaggccaaggcaggcagatcacttgaggtcaggagttcaagactagccgggacaacatggtgaaacccccatctctactaaaaatacaaaaaattggccagacgtggtgatgggtgcctgtaattgcagctactcaggaggctgaggcaggagaatcacttgaacctgggaggcagaggttacagtgagcccagatcacatcactgcactccagcctgggcaacagagcaagactctgtctcaaaaaaaaaaaaaaaagagagagagaggaagagagctgcctgcttatctggctaatctggttcccatatcattgtctctttttccatcatatttcactaacaaaaatcacttctggctaaaatagtcaagatatcatgtttctggggaaatatcttggtataagaccaagagaatacctctttcttttctgtcttttgtaaaagagtgaatatatttggcttctttttctctctttttctgggtattcaatcttctgggaagtcaaacgtagctgaaaagagtgttccttcacagcttactaggagtaaaacaaaaagaaaagaaaagtgttttctatctattaggttagtgcaaaagccattggcgttttggccattatagtggtatggatgtgggtactgtatactgactttggtttttcgttttctgttttaaagccaagcagatgccagtggaaatgtccaggtgagtgtatttgtaagaagggggcggctgctctgtgagcacggtggacatgtctggagggagattctggtcattaggaagttttcagtggctcttggcaaacttagaaaaatataggccttccttgrgtgtgagttgtgtgtgtgagttgtgtgtgtgtgtgtgtgtgtgtgtgtatctccgtggaagaatgccaattgtcctttcatgggaaggaatggcttttattctgagatcatgtccttcctacatgattatttgtgaaatctccctttctttatgaaattataatggtagtagataaattttttaaaatttgacaaaatagagttggcctttaaaaaatggttttactacctttactgttgttgaaatcccaaatccaaaagtatagaaatgattgctctgttccagagagaaacagtagcgtgggataagaatttcaggggcttggtagtagcctgtgaaggactcctggtattcatgtgtgctttggtcctgatgtttattttaataggaaaaagttttatcaccgccaagcatggtggctcgcacctgtaatcccagcactttgggaggctgaggcaggcagatcacctgaggtcaggagttcaagaccagcctagccagcgaaaccccatctctactaaaaacacaaaaattasccgggcgtggtggtgcatgcctgtaatcccagctactcgggaggctgaggcacgagaatcrcttgaacccaggaggcggaggctgcagtgatccgagattgcactgctgcactccagcctgggtgacagagcgagactctgtctaaaaaaaaaaaaagtttttttacataatccttggagctgccaaaaaatatttgttttcccaaatgagagagtaaagttttccttaccttggaaaactcttcctggttttctcatgatcttcccttgtttactttggtggtttggggttagaacaataacaacaacaaatatatctatatattgttttctgtttttatatttcattttaaggccagcagtaccacttctgaactcyaacaacgagaaaatgtcagatcccaatatggaagctaacagtcattacggtaaagtcatgttctcctgccatttctaatttcccccaacttgctacatacttccttasccctctcagaagcagaatatgtaagtggtgggattacagttggaagagaaaccctggcttcaacagggtacttcatctcatcagccactgggccatgtaatatacrgaaacgtaaaaggaaaggtaacatattttattctaactttgycaccttccaaactccccgtagaagaaakatggagaataatcataatgccttcaaagactttgaacattgctcyagcgtaatattataattctccattttcaagacagagaccagrtattgaatgaaaacattggtaaaacatcttctcagatggaattattacaagcacaagacagttttacttcaaatttgccacaaagggaawgcaatttcaatattctctcagtaaaggcataaataaagtgttccaactaagaaatatctattcataaggctcatcagtagcttcagggtcagctcagctgaatgagtagccagtcctaggagttcttaatcccaggttagtaagaaaattgctcaagcatttcagcagggatgctacttacttcccagagggggctataattacatcacaaaargtcctgtcccagaccaaatttggaacactcttcctcttttctttctttcttttttttttagacagggtcttcccaggctggagtgcagtggtgcaatctcagctcactgcagcctctacctcccaggctcaggtgatcctcccatctcagcctcctgagtagctgggatcacaggcatgtgccaccatgcccagctaatttttattttttgtagagatggcactctaccaatgctggtttcagactcctgggcttaagaaatccttctgccttggcctcccaaagtgctgggattacaggtgtgagcccctgagcccagccacttttcttgctttatcagcaggtttggtcatagaatgctcatgttcttttctaattctataaatgtctcacaaaataagaaatttttaggatatactttttacagagacatattttgcttgagaaatatgttttaagaattgagtaattcatatagtactgaatcataaactttaaaaaaggaaaataaaatatttgtagtaataaaagtaatgtgtcagtaaatagaaacgagcaaatatattgtttaagaaactatattctaggctgggcgcggtggctcacgcctgtaatctcaacactttgggaggccgaggtaggtggatcacttgaggtcagcagttcaaaaccaccctggccaacatggtgtaaccctgtttctactaaaaatacaaaaaattagctgggcatggtgrtacatgtttataatcccagctactcagcaggctgaggcaggagaatcccttgaacctgggaggtggaggttgcagtgacctgagatctcaacattgcactccagcctgagcaacaagagcgaaactccatctcaaaaaagaaagaaagaaagaaactatattcaggccaggcatggtagttcatgcctataatcccagctctttgggaggctraggtgggaggatcacttgaggccaggagttggagaccagcctgtgcaacaaagcgagactaggagaatcgctggaatctgggaggaggaggctgcagtgagcygggatcgcaccactgcactccagcctgggtgacagagcaagacattgcctcaaaaaaaaaaaaaaaagaaagaaagaaaaaaagaaaaagactacacagcaggtcaaatggagcccacaggagggccaacgaggggacccaggacccagagacagtgctggttgtcactacactgaataaatcaggcttgactttgttaggggtactgaatttttaaaaggttttagaaaactagaatttcccttgtcactcaccctaattgttatttttcaactaggtcacaatgacgatgtcrgaaaccatgcaatgaaaccaataaatgataataaaggtaattatctaattacatgtttttattagaaccaacttttacattaaaaaaaagactcataggaaaagaaaactaaaacttgaaggactgtggataatttcccacctctcttaatgaccctgtacccagccgatgtgtcaatgaaggtagctagctgctttcaccagagatgctatctagtgtcctcagtgggaaagtcacctaaatcaaagtagggaagaactgggttatactcaaaaaacaacttcctgactcataatgagctactgggtaaggcagtggracctcttttttcttgagcattgaggtggtgatttttaaagacaatggacaataaattgctctcttctgcctgaagcactgagggattggactaaatcatttttcaaaattcctttcgctctgggctgctgccatgggagctaaggctcctaacaaagagaaaggattctgttaaggtctcttcctttctttcttttttttgtttttttcttgagacaagagtctcgctctgtcagccaggctggagtgcagtggtgcgatctcggctcactgcaacctccacctcccgggttcaagcaattctcctgcctcagcytcccaagtaactgggactacaggcgcctgccaccacgcccggctaatttttgtatttttactagagacagggtttcactgtgttggccaggctggtctcaaactcctgaccttgttatctgcccaccttggcctcccaaaatgctagaattacaggcgcgagccactgcgcctggctcttttttttttttttttttttttttgatacagagtcttactctgtcacccaagctggagtacggtggcacaatcttggctcactgcagcctccgcctctcgggttcaagccattctcgtgcctcagcctcccaagtagctgggattacaggtgtgtgccaccatgcccagctaatttttgtatttttagtattggtggatttttaccatgttggccaggctgatctcgaactcctgacctcaggtgatctgcccgcctcagcctcccgaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaatgtatctttgactgcagaatcattgttttggtagctgatgagaatccctattctttagggctttaaaaacaaaacagtaatgttatttttgacttgaagacaaactacttttctagctttcaccttagtaccctgagtgatttcattcacgtgtatgcctcacactctccaagtatttttagggtagtgacccctgttccccatttcccgaaatcctctcagtcttggaggtagctttgtttgcctgtggctgtggagaaggcttccagcatcttgagtgagactgaattgggagaactgctggggctgatactgggctgttttctgtctctactgacctgttccaagtccccccactgtagaaacagggacctaggccagagggtccctccacatcctggtaacagaggagtcagggaggaaaccatgggccccgaggccctgtatctgcctctgggaccagtgcggggttcgtactcccttcctcatcccgaatggaattaagcctgtgtctggctgccccctcaaaatacagaatactttaataacctgaatgaaaatctagccgggggcagtggcttatgcctgtaatcccagcactttgggaggctgaggtgggcggatcgcttgaggtcaggagttcaaaaccagcctggccaatatggtgaaaccctgtctctactaaaaatacaaaaattaaccccgtctctactaaaaatacaaaaattagctgggcatggtggtgcacacctgtaatcccagctactcaggaggcttaggcaggagaatcacttgaacccgggaggtggaggttgcagtgagctgagatcacaccactgcactccagcctgggtgaaagagtgagactctgtctcaaaaaaaaaaaaaaaaaagaaaagaaagtctctacttctatgatctgaggtgcccacaagagattccacctaaacaacaagctgctgtggtttctttgagcagagcctctgaactcagacgtgcagtacacggaagttcaagtgtcctcagctgagtctcacaaaggtaagtgccactcgagtgagtccccaggcattgcctttggcttgggtttaaaccccagtggtggsgggggtgctgtgttcagtgagaagagtctgtgcaccctcagtcgctccaaaggaagtgattagcagacctaccggcctgctaagactggaaggagcaaaggcccctggccctggccctgtctctgagctgtaaaatttcaataatttaaaagaaaaaaagaaaaggccaggcactgtggctcacacctgtaatcctagcactttgggaggccaaggcgggtggatcacctgagatcaggagttcgagaccagcctgaccaacatgataaaaccccatctctactaaaaatacaaaaattagccggctctggtggcgcacacctgtaatcccagctactcaggaggctgaggcaggagaatcgcttgaacccggaaggcagaggtggcagtgagctgagattgcgccactgcattccagcctgggtgacagagtgagactccatctcaaaaaatatatatatatatataaaatatataatatatataatatataaatataaatacatatataatatataatatatgttttctttgtgtataatatatattttataatattttatatatttttattttttatttttatatattttatatataatatttttatatttatattatttatatattttttattttatatatatatatattttttttttttctttgttgagacggagtctcactctctgcccaggctggagtgcagttgcgaggatcccgtcgacctgcaggggggggggggcgctgaggtctgnnnnnnnnnnnnnnnnnnnnnnnnnnnnnnnnnnnnnnnnnnnctcactgcaacctctgcctccgggttaaagcgattctcctgcctcagcctcccgagtagctgggattacaggcatgcaccgccacagccgggtaatttatttattttttttttgtatttttagtagagatgggatttcaccatgttggccagcgtgaactcgaacttctgacttcaaaagatccacccccctcagcctcccaaagtgctgggattacaggtgtgagccaccacactcggcctcaataattttaaaaattaattaaagaaaaatagagacagggtttcgccatgttgccctggctggtctcaaattcccgggctcaagcaatctgcccacttttgtctcccaaagtgctgggattacaggcgaagccaccacacctggccatttttgataattattcgttatgatactactaataataggtaagatttattgagcacttactaagtgccagggaattaggaagtactgagcaatttgtcccttccagaggtagaccccctgccaaacccagtgtgttcctaaagttgcttgtgcagactgaatgtgtgtcaatcaaatgcatgtttcaagatatcgagtgctttgccatttagagggacacttaggtaaaggcttttgaaagcacaagatccctgtccgtgtgagcagtggcactgattttacaccttgggttttgtttttgtgtatgtggttctctcaagggcaggctggcctggaagtccctgtctctggttctatgctggggaaatggatgcagagtgggctgctccatagaaaatgctagaacatcaatctcgtttgttttgggcaccataaaaaacatgcatctcctggccaggcacggtggctcacacttgtaaacctagtactttgggaggccaaggcaggtggatcacttgaggccaggagttcgagaccagcctggccaacatggtgaaaccctgtcttccactaaaaatacaaaaattagctgggcgtggtggcgcatgcctgtaatccatctactggggaggctgaggcagaagaatcgcttgaacccgggaggcagaggttgcagtgagccaggatcaagccactgctctccagcctggrtggcagagcaagactccgtctaaaaaaaaattaaaaatgcatctcctaactgtcctcctcctttgygaacccarattgggcagtacacagtccccgggggtcactgcacmctcctgcacgctcaaaggaaacagtggctcctgcacrctcaaaggaagcagtctcagaaccttcctgcccagctgggaagctccctgggatcattgccatctgtctcccttcctctgaggctaaccccaggctgcatccacctagccaggcaggcctggggtagttttcctgactgtgcaggctgaatgsgtgcagttttccaggccgtgccagccactagccagaccacatggcaatggggtcctgaaatcacmccttgctccatgatctgggaggagtcttggacttctccttgtcttctctttttgagcctgggctgagtgtcagcagctgtatgcacagaactttccttacagggatgccccgtagagccgctgggctgtgtgctgcaccactggggcacattcccatagcctaccaacagaatggcccccgggggttgtgtactgcccaatctgcacaactcacttccaagtctagactggacctgagaggggtggggaacgcggcaggcctgaagctctcttcctcattttttttttttttttttttttatgacagtcttgctcttgttgcccaggctggaatgcaatggcacagtttcggcacactgcttcctctgcttcccgggttcaagctattctcctgcctcagcctcctgagtagctggggttacaggcgcccaccaccatccccggctaatttttgtatttttagtagagacagggtttcaccatgttggccaggctggtctccaactcctgacctcaggtgatccacccgccttgaccacccaaagtgccgggattacaggtgtgaaccaccaggcctggcctcttcctctttatttcattgtagagtgattgactcgttgagataacaaattgtgattaaggccctacgcaggcagcacaagcacatacagaccctcccttgtggagggacagcctgagaggcagccaggaacacactgcagcaaagccctcctaaccttcagggatcacctaaccttcagtgatctgcccacctcagcctcccaaagtgctgggattacaagcatgagccactgcgcccggccctggttttctttttcttgctcaaaggtggggaagggttgaagggacaagaaggaggtattgtaatcccagcactttgggaggcagaggcgagaggatcacttgagcccaggcattcaagaccagcctgkgcaacaaagcaagaacttatttctacaaaaaatttaaaaataaggaggtatcgagaccctccaggattgggtgaagcagaggcggtcagcatgtgccctccttgccaagctgtgcagctgcagggatgccatcacctaactggtccctctttccccatttgcrcaaaagctgtgtgggctgcagaggtccaggtagacccgtaaagagggtcacttgggggcaatggagagctttttgggaattcaatttgagttttctagacccgtcctcctccttggcagctaaggagcagtgtgggaagtcaggcctgagcctcaggtgttccctctctgccttcctgtgggtggagagccaggtattaccaggtacgaaaaggggctttgtgggtacaaggccagtggtgagtacatttgacctggtcttgaccaagccagttccctgctctcaagacttcctcctcctatggaggaggggttgggaaccacatccagctctgaccctagtggcagccgaccaagtggtcacttggggtggaggaggggcaggaaggaactcagtaaatcctggtttgctgcatgtttgctctgagactaattgctgggaaaaccccatgacgttgaagccatctccttctctgttaacacagagaaaaacagaagccaaaataaagccccatccggaaacatccctgacagcagagacaaagagcctgccagcctggtttactcattagcaagcagctgctgccgtggagtgggtggggaggagaggtagtgatgagctgcaactctgcctgcccacccatcacttaactgggcagatttgggggcagctgcaactctagaagctccaccaagaagcagaaacccccaggcccaaacaccaagccctctccctccatttattcctcacctgccccagcccccactgtgggcctgggtcggagggtgagctggccgtgaccaccccaccatgcgcctggtatatggtgtttgatagcatttgttgcagtgtctgcgttgtttgtgcacctgtctgcctcrcagcctggagctcctgaaagctgggaccaggcccgatcacctttcctcttccacagtgcggggttcacactaggtgtctaggattctgctgagtgagtgatttggccaggcctgacatcaagcagagggtgtcttggggatgtggaggatcccccaatagggttggggatccctacagcttyccttgaggcccccacatctggtgccacagaaagagagtgaggggtgtgtgggcatctctgctgtcccagcagtgtggtgccctggtagctcagccactctactgagttccaaatcctgtttggtgccctggggaagtcagtgtaaggccctagtcaccccaaatgccccaagttcaactgtagggatctgacccacccccaggctttctcctcacaaatggttcctgacacaggagccaccaccattactgtcacttcaaacttggacaggtgcccccaggcagctgagcaagcctaggaatgggacatgtccaagaccccagctgtcaccccataggaggtcggggtctgccagggagacggacttgggaacaagtcacatcggtgtgttgtggacaaatgtcaccaacatgctgtggagctcagggggccctgtaacttcccagggcacagagggagagtgagtgtgggtgtgttggtacatgcgtgaagctccaccagggtcgtggggaaatggggcaaggagaaagggcagtgctggctgtggaggagtgtgtgtggggccaggaagtgagagtggggtgtccctggagcatggtgagacaagggcatctcagtgcaggtagagtccagggtcacaccccagccattcactccaaggagggaaatgcactgaccatggcacaggaagccccttaccctatctggggcttcctttccccatctgtaaaaggagaacagtggcccacacgacatcaggctcttttctacagtgaggcttcctgggcctttgtgcaggtgacaggagctgggaagtggccaggttccatcctgtttcctcagggttggtgggtatgtatgtgtgtgcacaccctgtgtgcatgagtgtgtgcacacccagattgcatgtttgtacatacagtgtgtatacaatgtgtgtagacacatcctatacactgtatgagggtatacatagcatgtatacacattgtgtgcatgagtgtgcgtgtgtatatgctgtgtgtgtatttttgtatacacatcctgtgcccataccccagtgtaaggtaaacagatggcaggaagggcgcccttgagtctcctccaggtatacgccacaccctgggtcagtcatcatgctgccatattgagagggtctagcccagaggatctcagccctgtctgcatattagggcccctgaggagatcctaaaaaaccagcaccagggacccccccagaccaatccaaccagaagctgcagtgaggcccaggagccagcagtgaaaacagccagcccagctgtctatctctgtaagagttctcagtcccagctattcctagggtcactgacaacccccaggctctaacccagacctcaggatctygttctggatcccggggtctgggctctcaggtgattgggaggccatagcccaaccctgcgttgagggacctggcagaatgtctggacaagggtcacggtggcaggggaagaggartggggccagcaagctggaggctgcaggcccttgctgggggcctctccatccgtggcccctcaggtccagggttcctctggtgcatgtggccctgctccacaatggcctgctgacctcctattcccagactgggagtgacgctcgttagaccaagaccttcttcttcttcttcttttttttttttttgaggtggtgtgtcactgtgttgcccaggctggagtgcagtggcgcaatcttggctcactgcaacctctgcatcctgggttcaagcgattctcgtcccttagctctcgagtaactgggatcacaggcacgcaccaccatgcccggctaattttttgaatttttagtagagacggggtttsgccatgttggccagaatggtctcaacctcctgacctcaagtgatctgcccccctcaccctcccaaagtgytgggattacaggtatgagccaccttgcccagccaggatcttctaacatcagaaatgacaagrtctctgggtgcttctggacctggttctggtggggtgcagtggtggggtacagccttgcctgcagagcctcagaccttttcctatgactgcagtggactgacctcgttcccagaggcagctactaacttatgcctggtcctttttccagatctaggaaagaaggacacagagacagtgtacagtgaagtccggaaagctgtccctggtgagtgagggtctccagtgccccagcctgggggatgccccctagaatcwctgatggggccttgggagtgggcagagaaaagaagaagcaaagaaggccaaaaaaggggtgccacctcttacaccagcgctgtgggcttcctctctcccaccacccttaaaaagtcacctcgggtcacatttactattcatgtagtcaacgagcgcttcttgaatgcttactgaccccagccggtgacccttacctgctccccacacaggccctggtggctggggttccccaaggtcttggacgtcgagtgttttgctttggagacccccagtagcttcagcctttcttcttgttttcttttttctcttttttttttttggatayggagtctcgctctgtcactcaggctggagtgcagtggtgcaatctcgactcactgcaacctccacttcccggatttaagtgattctcctgcctcagcctcccaagtagatgggattacaggcgccygccaccacactcagctaattttttttttttttttttgagacagagtttcgctcttgatgcccaggctggggtgcaatggagcgatctcggctcactgcaacctccgcctcccggttcaagcgattctcctgcctcagcctcctgagtagctggaattacaggcatgtgccaccacacccagctaattttgtatttttagtagagacggggtttctccctgttggtcaagctggtcgcaaactcccaacctcaggtaatccgcgcgcctcggcctcccaaagtgctgggattacaagtgtgagccaccgcgcccagcagcttcagcttttctgacagtagactgactttgggagtgggtgtgggtttgcggatctgctctatttcctttggttcrgctggccccacttcgcttcccgtgacgacccactgcttactcatgaaagggcttcccccagagctgagcacagagcttaagcagacccggaactgggggagctcaacaagtcctttttttcggtgggggggtataataactgtattcaattctggtgaaatgaaatacacaatgacaacttttaaattctgaaggtaagtcagcaatccgaaagacgtaaacattgtgggggaaatagtgactgtgtgagtatctcgctttgtacagcagacctctatttaagtgggttcttggaaagggaatcattaaaatggtccaggacatttctgcaaagggtggctactcaggctaggcgtggtggctcattaagcactcagtaagtgctttatttatttattcaaaataaataaataaatataaaaggatgactcctccgagtacagtcggcaaaccagcagcagcaatctygggcccagcccagacccacaaaactagtctctggaatctgaacttagccagcttcagatgtttctgatgctgccaatatttgagaagcactgtttgtgttttgttttgtttttttgtttgaaacagagtctcactctgtcacccagactggagtacagcagtgccatctcagctgactgcaactccgtgcaacaccccccggcccctaaggcttaagcratcctcccaagtagctagaaccacagacacacaccaccatgcccagctaagtttttgtatttttggtagagatgaggttttaccatgttgcccagactggtcttgaattcctgagctcaagcaatccacccccttcggcctcccaaagtgctgggattacaagcgtgagccactgtgccaggcaaaaagcactgttttagaagaaccatccaattctctgaggaccctgctttttatctgaaatagcgatcacttcttaattcacttttaaaagttggtatatctacaagaagaatagaaactcaacccttgtggaacttgaccctgaataatttttgaaaaaccaattctctggggaatttttagctcaaatacctcatttcacaatctccatatattcagagctaacaaaatgcaaatctgacaataaayagccgttctctatttgtctagtgtaagggaaagttataagygaggtagggttcaaggttgctcccattgtgcarttgtacaaaaatgccccttctactttcttggtggtccctgagagtgttcgctttcttggacactgctgaagagttcactttcagttgctttcgttaagcaaaatctcctatttgagcacttattgtatgtgctaagtggtctaagtacatcgtgtctttcaatgggatttgtccatgggattcaccacaaatcccattttacagttgaggatactaaggcatagagaggttaagacgcttgcccaagatcacgcagcaagcmagcccctgagaatcgttcctccccggagtggactccacgctcttgatcactgaggtgtactgtcttcggtttgggaaagtcgggtggtagaaggtggaagctgcagggatcctcgctgcaggaggccagctccttaccacctctgcctcgaggcctccagcgaagtctgtgatcatctgaggctactggttggaggcccttttataggtggtgaggggcaccttagtgtggattctagggaaaaacttaactttttttcctttactctcctaagtgctctgactggggccctgcgaattggacaagcagattaacaagaggaaaacagagtttattaacatacataacgcaaatcacacaggagaaacatcaatgatgagtaactcaaaggggtggttagcacttggggtctataaagcatcttaggctgatcgcagtggctcacgcctgtaatcccagcactttgggaggccgaggcgggtggatcacctgaggtcaggagttggagaccagcctggccaatatggtgaaaccccgtctctactaaaaatacaaaaaattatctaggcatggtggcatgtacctgtaaccccagctcctygggaggttgaggcaggagaattgcttgaacccgggaggcagaggttgcagtgagccgagatcacgctattgcactccagcctgggcaacaagaatgaaactccatctcaaaaaaataaaaataaatataaatatataaagcttcttaacaaagagcaataaatttgtagacaaatgacaagacaaaggaarratggtttttggcttyccagagtggcaaactgagaaagtcaatcaagtggccacaaatattttatgggggcatttacagcaggtgtgttttcttaggagtttctgcttttagggctgggcatggtggttcatgcctgtaatctcagcactttggaaggctgaggtgagagaatcgcttgagcccaggaatttgagaccagcttgggcaacacagtgaggccccatctctaaaaaaaaaaaaaaaaaaaaaattttaaaaaatttaaaaaaccaatataaaaacaaaaattagctgggcatagtggtgcatgcctgtagtcccagctgctcaggagactgagacaggaggatcgcttgagcctgggaggtggaggctgcagtgaactgtgattgtgccactgccctccagcctgggtgacagaatgagactgtgggttccaaaaaacttaattttcttcctttactctcttaggttttctgactggggccctgcaaattacacaagacagattaacaagagaaaaacagagaccctctttgtttttctcttgttaatctgcctcaaaaaaaaaaaaaaaggaagaagtagtttctgcttttagtcagataaacaagctctgggaagacttccttctacatctgaaccagctcaaaacaatccttatgccaaaggggcatattttgtggtggcatattctgatttccttcatctgctttagggcagctggctgttcaagtgggttctctcggggtctccaggttggttctagattactcagtccgggctgttggaacctgacccctcaggcagaaactataggcatcgtagaacccactcttgtaggatttgaggcggtgtagagcacaggctttcctgggagacatcccagtccccgttctgaggcagcccccaatcagctgagttactgtgaccaagatgtcttacccctcagagactcagtttcttcaactgttaaatgcaaatggggttaaatgagatagaatcatgggagatggtgctggttatccccacagtcactgtattatccctgccacagagtgagcacttaatcaatttcagtttaaaaacacaggaggaacttgagccctataragttcagtgtcttgcccagggtactactagagcagtcccctgactccgagaccaggaccctcccacagcaccacctgggccacctggagtcaatcagggctctgtcgctctacaaccttgtctctaaactggcagaccattagggaacctgccaggtctctaacctgcccaggggtgaaggtagagagagccctggttcttgcacaggctgtagccctyggggcctgcagctgcctgcagctgtgcctccaacccacctggaagcctctggtcctggaagccaaggggtttcctgtttgtcagtgcttccttgaggagaggagcctgcaggacatggctgatttcttttctttctctstttctctctctctctttctttctctctcgctctctctttttctttttcttcctttctttcctttttcctttctttccttttctctttcctccttctttctatctttctctctctctctctctccttccttccttctttcttttcttttctttcttttttgtaagacagagtctcactgtgtcacccaggctggagtgcagtggcacgatcacagtgaacagcagcctccacctcctgggctcaagcgatcctcccgcctcagcctctggagaagctgggattacaggcacgcaccaccatgcccagctaattcgccatgttgcccaggctattgcccaattcctgggctcaagtgatctgcccgccttggcctcccaaagtgctgggattcaggcgtgcgccacctgaatgctcagcttttctttcttttcctcttactggttgctaaagagcaggcatcccatttgaggaatttctctcctaaattctctgggacttccttaatagaaaacatcttccaagtaatctcttttccttcactccctacataaaatcagagagattccctcctctctgcctggggggagttagatgattctccaaagagccagatccttcagccagcagtaacccacccgcttaggcttctctcacactcatcctcagcctctctttgttcaagtcttccccagagcccagagctgttaaggatcatcatttctttctttctttctttcttttttttttttttgagacagggtcttcgctctgtcacccaggctggagtgcagtggcgcgatcgcagctcactgcaacctccagctcccgggttcaagtgattcttctgcctcagcctcctgagtagctgggamcacagctactgccaccacgcccgggtaattttttttgtatttttagtagagacggtgtttcaccatattggtcaggctgatctcgaactccagacctcaggtgatccacctgccttggcctcccaaagtgctgggataacaggtgtgagacaccacgcccggccagatcatcatttcttattcatcatcataaccatccccagattcttcatcattgccaaattcttcagcagctctttcctctggatattattccacctctgtagactgcagatttcttttgttccatgttgattgttttctccctatactctaattatcttgcggttgggcgggtcccttcctcctctgtcacagttaaagctaatatgtattgagcactccctctgtgtgagacacttggagccctaccttaatccccaagatcatctaacagttgatgggggttctattattattcttgctctgcakatggggaaacgggcccagaggttaactaatttgtccttgttccacagccagtggcagagcaaggactgaacccagggggcctggctgaagccatgctcttcaaagccttcctgttccctctctttttttctcttaattggtttgttaccaattgctgtccattgtttgttgccaaaccaattgactgcattcttttctgttttccatctttcttagtttaggcttcatgttatcggcataattggagaacktttgtctmcttttttttttttcagacagggtctggctctgtcactcaggctggagtgcagtggcatgatcttggctcactgcaacctctgtcccccggcctcaagcatcctcccctctcagcctcctaagtagatcctatctactttaaacatgaagagtaatattctactgtggcctgkgtgaccctgggcaagtcataragcctctcaagaccttggtcaccttctctgtgagatgaggtatgggctggaggcaggtcagtggtcctcgggctttattaaaacatcaatagtttggcgcaccccactccctgtgaatttcccattcactaggtctggagcggtgccgaaaacgtgcatttctaacaggtgtccacacgcagctgctgccgtcacgctggggcccgggctttgagaaccactcttgatgcagcatgttcctttctgattgtgccacgctaaggctctgcttcttgttggaaggagtagggtctttctcaccctccagaaatcctggagggatcttkcagcattggtgggcaggtaaaacccagaaacactgtgcttattagagggaaggtggtattgagtgacccccaataaaacagggggcccagggccgcgcgcagtggctcacgcctgtaatcccagcaatttgggaggctaaggcgggcggatcatgaggtcaggagatcgagaccatcctggctaacacggtgaaaccccatctctactaaaaatacaaaaaattagctggacrtggtggcgggcgcctgtagtccagctacatgggaggctgaggcaggagaatggtgtgaacccgggaggcagagcttgcagtgagccaagatcgcaccagtgcactccaggcctggcgacagagtgagactccatctcaaaaaaaaaaattggggcccagtgtggggtaggtytgtgagatcagtgagccagctgggtgcagagcggagtctttgctgacctttccccttcatgttccccrtcatcttctagcatgcagcatttcaggrctgcctattttgggaaatggcttaaagggcacagttctggcccttaaaccccctttcaccccctgagtaatacaaaataagccctcccctagataagcaatagggcatggggcaggcctgcctccaaggagcagccccagggccgaggagagagagctgggcgctggcccaggggacttgagtttgatgggaaagcttgcagacagtgggggagctgcctggtctttccagtcttggcttttggctctaagcacagcttttttttttttttttttaattgttgtatcatgaggcgccttccactcagctgcctccccacgttaggggatggacacagcactggcagggatccctgtgtgtctcagtttccctattgactctctgtggcctagagatgtatggtagaattccacactatgctttttttccaccttttttttttttttttttttttttgagacagggtctctcctctgtcacccaggctggagtgcagtggnnnnnnnnnnnnnnnnnnnnnnnnnnnnnnnnnnncaacctccacctccccaggcaggcccctctgactcagctgggactacaggcatgcaccaccgcacccagcaaaatatttttgtattttagtagagatggggtttcgtcacattggccaggctggtcttgaactccagagctcaagcaatccgcccgcctcagcctcccaaagtgctgggattacaatgcccagcccacttttttttttactttttacaattttattcttaaaattgtggtaaaacacatatcacataaaatttaccattttaactctaagtatccagctcagtggcactaagtactacacttttggttgtcatagcgtggtgaacagagaagagaatgctactgcgtctcgtggagagaggccagggataccgctaaacatgcgacaatgcacaggacagccccctccccaccacaaaacaccacccagcccaaaatttcaacagggccaccatggagaaaccctggccagaggaattcacctcctgcaactcctccaacaggagagctggttttcctctccagtaccagcttttgcctgccctctgtcttgggaggtgacttaaggcacatcccacctgattactgtggctctggatgggtgctgagtcttgctctgggcaccagccctacctgttgagccagaggcccacctccccatcayggaatctactcactcaatggtccatcttctacttttttgttgctattttttgttttttgagactaagtcttgctctgtcactcaggctggagtgcaatagcacgatcttggttcactgcaacawtcgcctcctgggtccaagtgattctcatgcctcagscttccaagtagctgggattggaggcayrcaccaccacgcccagctaatttttgtatttttagtagagacggagtttcaccattgttggccaggctggtctcgaactcctggccacaagtgatccaccggccttggtctcccaaagttctgggatgacaggcgtgagccactgcgcccagtccaccttctactttctatttgcctggaattcagacttccagggtgtttcttagggaggcagaaaccctggtcctcaccgcatcccctgccacccagtataccaagactagctgggccgagagtagccgtgacaggaaatggctgagaaagaaccaaagaaaaggaggcctctgtgccaagtctcctatgggaggaagagaagagcacttgaggatcagtccccacccatcctgtgaggcccagagccagtgaggccagagggcactgccaaccctgcccctggggaggcatttcctacttcagcgtgcaagatggtgaaaaagtatccccatgaaaaaatggatgctacctccaattcaactttggtgatgattgctctgttaccaaaaaaacaagaactgcaagtgtgcatggagtaagtgttccatccgtatttgagtttttcacattttgtcttcagattgctttagaaaatgcctacttgaggttctttygctgttgggaraggttccagagcccttaggggactaggagggtccaggaatcacggggtcctttgggtccttgcaggtcagatttgcattgggggtgctgtcctcaacctcactcaatgcatggaagttgacacaatggctcaacattascgttgggctgattcatcatttggctgttgacaccagcctctggcccagccaggacagaaaaagggcccctgaggaacttctggctctgttccctctatgggggaggggcagtggacttgtgataagacagggtgttagggtgaggtggacttggggaaacaggatatttctaaattagagaaacagaaggattgtgacccccgctgtgacagacaggccctgagcctgcccgaggtccaggaggaactgtatgtgagcttggggctgggtctatactgaggccccttggcrtacttttctcgataagactgaggacttatggccctcccaccattccctccaccaccttcgagaacagcaaccatccccaatgcccacatctcctcttggggtctcccccaggcagcaggtgaggtccccatgacttctctgtcttcaagtcagggtccacagtcagctgtttggggatctgccccagcatgtgggccactgaccattgggtggggtcctggtcctttccagaagggcaagccatacccgtcacttgcctctcataggaaacaccatctctaatgaatgcaggcagggatcacccaccacctatgcagagcttcctgctctcattggcttttctcascctcactgtcctcttgctgacatccggttgggaccatttgcgcaactgcagactggcagggccaggcaaacacagcatggcgcctgccaagaaggtggtgtgagactgggcacagtggctcatgcctgtaatcccagcactttgggagactgagatgagtggatcacctgaggtcaggagtttgagaccagcctggccaacatggcgaaaccccatctctactaaaaatacaaaaattacccggctattgtggtgggcatctgtaatcccagctacctgggaggctgaggcaggagaattgcttgaacccaggaaatggaggttgcagtgagccactgcactccagcctgggtgacagagctagaccccgtctcaaaaaaaaaaaaaaagaaggtggtgtgggctcccacacagttgagaggagactcctgaggggaaggggaaacagttgcccagatctgctaagagcgttggcaatgcttctgcctcctcctctgttgagcctgctcctggaagggattgacaaaatagtatgaaatctagaaatagctttattcccaaagaggataccggtggtgttattgaaaagagcaaaaacttggaaagcacctacatttttaaagtaaggaattggtgaagtcaatagttgyacatccatttaacaattatttagtagctaattggacaattatgcttaagaagttttcagaaaaagtttataaagccatgttatatgaaaaagttaagttataaaatggcatatactgtataattataactgctccccacccccaaaaaagccaaatcgtagtggaaaatgactaggaaaaaaaaaagtatcaacagggtttggagaatgaggccagrtatcatttttatctgctacttcctactttccatagttttcatttttttcttaaaaaaatatgtgctactaatttttttttttttttgagatggagtcttgctgtgtcrcccaggctggagtgcagtggygcratctcagctcactgcaacctctgcctcctrggttcaagcgattctcctgcctcagcctcccgagtaactgggactacaggtgcccaccaccacgcctggctaattttgtatttttagtagagatgggatttcaccatgttggccaggctggtctcctggcctcaggtgatccgcctgcctcagcctctccaactgttgggattacaggcatgagccaccacacccagccgtgatactacatttctaaaaaactgtttaaaatgttaaatgaggccagatgtggtgactcacacytgtaatcccagcactttgggaggccagggttggcagatcacctgaggccaggagttcgagaccaccctggccaacatggcaaaactccatttctacwaaaaatacaaaaaaaattagccaggcatggtggtgtgcgcctgtagtcccagcaacttgggaggctgaggcaggagaattccttgaatctgggaggcggagkgtgcagtgagccgagatagtkccagctgaggcaggagaattccctggaggtagaggttacggtgagccaagatggcrccaccacactccagcctgagtgacaaagcgagactctgtctcaaaaaawaaaaaataaagaaaattttaaatgaagtgccagggactttatgcgcatgtcatgtggagctagagggtcccggggaagctgtcttgcacaaaggagccataaacctctaagrgcacctgccggctgatgtctcctggctctcgcctcctccctcttttctcgacctgctcctgaccctgtgatgttgttggrgcagttgaactgggttatttgcgttgctcactgccatgtyatcctttgttttgtagatgccgtggaaagcagatactctgtaagtacacatttcatatacattatatttaaaagtactccactgaacagtgraatatttccagactcacccacgtcctgcattcacaygaattcttccccgctccctagtctgtttcagaccagaagccctgggcttctctgactagccttggccagttctgatttcgaatattctctcctgcaatttccatcattacatctcagcccacacgtgaagggattgggactctggggtgcttagcgccaaacaagcaaagcacacatttcgtttaacgccaaagtctaggctctggaagtgaggcagatctagggtgtatgcttggaggagtggagcagctgacagctcattgcaatttagccgatwctaattaccccctacacaccaggccatcagctgcaggagacacccaagcttcttgacctcagttcaccttctgatgagggaatcagacatgtgatcacttatcataaagcaaagtgagctatgccagagcctatgggaacacagaacagagacctagctagtggcctcttccccaaggaatcatttggaatgggccatgaagaatgaatggagtgatggcagcattgagggagaaagatcagcaggagcacaagggtgagggatgaccagtttcaagcagtgtgggatgggaaaagaagagtgtgacagtgacaagtgacgggagaaagataagtcagggcttaaatccaaaggatttacatgccttgttaagaagcttcattctgtaggaaatggagttaggaatctgctatttggcagatgggagggtttatgaaagacacagaggcccacgttcaacttttgcaaagacgtgtcttccaatcccaacctttttgtgagctacccagcaatgcaggagttaactgggcagctaatatctgaagaaatgaggcatttgccgcataaacttcttttaggtctgggaagaactttcagcaagatttctggtagctcttccagtgggcccctggcttcctttgttttgcccatgtctggactcttgtaaaacagagctcattatgcctttgacagacaggaagccactgacattctttttatggaagaaagctatgaatttaaggaaaagaggaatgaaatgaatggttgttttttttcctagccaaaacccactcagactcctgaaatcagagactatcgtgtcactgggacaaggagcccaatttacagatgaggaaactgaggcctgcactggtagaatagcrtgtctggggtcacctggatggctaatagagtgaggaacagagcccaggcctctatactctgcggccagtcctctgtcacgacagagactccctccaagatgtgaagttgctgtcccagcaataatggctttgagagagtggaaaatgaggtctttgctccctgggcagtgcgggacacaratgtgtystcctgaagcgataaacatggctgggtccacccaaaacaccctgtaggaccaacttatttactttgtcttggatccaaagggtgtctctggacaaaggcttggagctccaggccagacagaactttacccagaagctggcccttgggcctcaaagtctgctcccaggatggttctgagagctcacccatgactggtcctgtccccccagaaaaaagaatagagtcatttgatgggagcacagggtttccagccrttgggaaaggaattttgaacctttaagcaaatgggttttgtttataaaagaagcaggtatagcttccctaataatcagctggtgtgggtcaggagaaaattaattgaattgcccagtggggaaatgggaggagatttccttcctgaaatcaaacctggcgatcattcccagttgtttaatggccrttgcctctgaaaacattggaggaaatatcttaacaatgagatagccacgtagccaaagactaatttggtattgtttgacttgcttcaatggcacattctgacttcatttttcctctgccatttttaccttgtttataaattgtgtgtgtggccgacgcagacagatagcatggaagagaacaccctgtacttaaatgaaaggggtgaatctggacttgtgagagtcttgggatcttggaaaggaccctgccttcttacagaaagaaaggcaattggcagctatagctcgcctccccccttcctggaggccaggaggcagctgggctacagtggaaactgtccaggtgctaggatcaggggatgggaggggagctccagctttccagctgtcttttgggtgagcctgtcttcctcaagctcaagcttccttatctataaagtggagatggtgatgacaatgatgataagagcaacctattaggattttaaggatgaaatgagcaactgcaaccaccatataaaagctgcaagctgcaaaccaccatataaaagctggttgatctcaagctcttttcatcacttgggcaatagtaggtgtggatgggggacttaacttgatttggccatgaaatgaccctgccacatatggagaatgtagcagttgcttacccaaggcataggattcaaccaaggccaggctttgacttaggaatcagagacccacattaacayttgacttcccrcttcttagccatgtcaccatgggcaaatttcttggcctctcaagacctctrcttcctaatctgtaaactgggaatcataaactccctcacttggttgtygcaagggttgaatgagcacctggcatagacctggtctattgcaagtgcccacaggagcactttgtagaagcaggaactagagatcccagggtgtgttgaaatcaaaatgacctttgagggagaccacaccatattccgggtacaaggcagggcgatttcacaactgcacttgggtrgctgatggctggcttctgatttaagcacagcaagcccagaccttggatgtgagcgtgttaacctttacttcaaaatccctaaggccctgttgattgtggcccagcccttcctgtctgtggctttggttctgcaatggtgccccaggcattggctgcccccacagagagagagcggaggtgtctggggagggacttggtctggggcccacagaaaggctggacaccagagtcatgtctcccccatccaggcagagcagaggaaatagggcagggtggctgccggcgctggcaggcctccagcctctggggccagcacggcttgcttggcccacttgcatggggctctcctggcmgaggaggggccagagccttggctttctagttggggcacctcggccctgcatcctgttccccaagggtccttggacccagcagggctgaaacaaaatggagacactatcccagctcaccctcaggaagccagccaggctggctgtggaggtcccaagaccctgggtcatcctccatctccagcttctgccttgctgagttccacctgcagcagagtgtcctgtgcacatggagggtccagaatagtggacttaggtgctgcctgctcttcagggcccactgttgcccagggcccccctctactctggtatctcccagcaggccctgctctttttccctccaagggctccttccatttgtcaaaatccaatctttaggctgactccagagttgcttctgtgaatcccccactgcccagcccagagccctctcagtgcctctgaaccccttctgcagtttgttgagacctcttataccttctacttcrtagtggtgttgtttatcaataattgatacaatataaaattcttggggacagcttcttgcatccccagcatagagaacagtgtgggtcagataagggtccaggcactgataggtggataggtgacacaaataccatttgaagctgttaaagagcactacaggatggcagaaggaatccaggaatccttttgtgggtgtttttttgctttttttgtttgtttgtgtgttttttgagatgaagtctcactctatcacccaggctggagtgcaggggtgctatttcagctcactgcaacctccatctcccagactcaagtgatcctcccacctcagcctcctgagtagctgggactacaggtgcacaccaccatgtatgcctaattctttgcatttttgatagagatggggcttcgccatgttgcccaggctgttctggaactcctaaactcaggggatccacccaccttggcctcccaaagtgcygggattacagggatgagctaccatgcccagccaggaatccttttttttaattgtcataaaatatacataatattaartttaccattttctttttttttgagacggagtcttgctctgtcrcccaggttggagtgcagtggcgcaatcttggctcactgcaagctccgcctcccgggttcacgccattctcctgcctcagcctcccgagtggctgggactacaggcacacgccaccacgcccggctartttttgtatttttcagtagagacaaggtttcactatgttggccaggctggtcttgaactcctgacctcatgatccacccgcctcggcctcccaaagtgttgggattacaggcgtgagccactgcgcccgcccggcaaattcaccattttccagtgtatacttaaccattttaaagtgtataattcagttgcattaggtccgttcacattrctgtgcaaccaccaccactatccatctccagagctttttctttttaagtgaaagcaagtttattagagaagtaaagaaacaaaagaatggctactccataggcagagcagccactgaaacactgtacccattaaacactaactccccattgcccctccagcaacccctagcaaccactgtctactttctgtctctatgaatttgactatttgaggtacatcacataagtggaatcatatatttgtcctttcatgtctgccttatttcatttagcataacgttttcaaggttttcctgtgttgaaaatatatcagaatttcattctctttttaaggtagaatcatatcattttaaaacatttcagttggaccatctaagttcagtccttcattttcaaaattaaaaaacaggcctcaaacgggtrcatctcacgttagctagagacagaactggagctagmagtcagatctcttacaaagttgcctttcttcttctgtgggtaagtggggcacccttgggacgctgtgctgggcgtacatgggtgcttgatgaagttacttggtggactgatgtgattgatgtccaacatgtatgcagggacagaggctatggtccctacagagcaggcatggagagaaggagaaatacatacgggcaggagccaggagagggagggtgtagtgagcagagaccgcgccactgcactccagcctgagtgacagagtgagaatccatctaaaaaaaattgcttgctaaagaagtggtctcctgaggtcttaagaygttcctgacaatgtcttgagtgggtgggagagaggctgcagtcattgtgctgtggaatttcagaggtgagaaccacacctaaccaaaattactttccctgtttgcctcagtgacacagctgcaggaaccctggtgggtgttgtattaagtaaatttgacctttattctttgcagatctgtgaaatgttgtcttctgaggggccacgtgtatctgtagtgctgaggactccttgggcctctgaagtcacagagagaaccctgcagggtgggggaccagtgtgtgacagccctgctttgcattttctttgagaagtgctgtcattttgcatttctctccaccagggcaatcttcaatcttgagaggtgtgatcataacttgccttgtttcttgtcgctacagagaacggaaggctcccttgatggaacttagacagcaaggccagatgcacatccctggaaggacatccatgttccgagaagaacagatratccctgtatttcaagacctctgtgcacttatttatgaacctgccctgctcccacagaacacagcaattcctcaggctaagctgccggttcttaaatccatcctgctaagttaatgttgggtagaaagagatacagaggggctgttgaatttcccacataccctccttccaccaagttggaacatccttggaaaytggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcctggttagaggctggtttttkctcttttcctttggtccttcaaaggcttgtagttttggstagtccttgttctttggaaatacacagtgctgaccagacagcctccccctgtcccctctatgacctcgccctccacaaatgggaaaaccagactacttgggagcacckcctgtgaaataccaacctgaagacacsgttcattcaggcaacgcacaaaacagaaaatgaaggtggaacaagcacagatgttcttcaamtgtttttgtctacactctttctcttttcctctaccatgctgaaggctgaaagacaggaagatggtgccatcagcaaatattattcttaattgaaaacttraaatgtgtatgtttcttactaatttttaaaaatgtattccttgccagggcaggcaaggtggctcacgcctgtaatcccagcacttcaggaggctgaggtgggcggatcacctgaggtcaggagtttgagaccagcctgatgaaaccctgtctctactaaaaatacaagaattagccgggcgtggtggcgcatgcctgtrgtatcagctactcaagaggctgaggtgagattatcgcttgaacccaggaaacggaggttgtagtgagcggagatcgcgccactgcactccagcctgagtgacagagtgagaatccatctcaaaaaaaacaaaaaacaaaattgcttgctaaagaagtggtctcctgaggtcttaagacattcctgacagtgtcttgagtgggtgggagaraggytgctgtcattgcgctgtggaatttcacagatgagaaccacgcctagccaaaatcacttttcctgtttgcctcagtgacacagctgcagggaccctcgtggatgttgtattaaataaatttgacctttrctctttgcagatctgtgaaatgttgtcttctgaggggccacatgcatctatagtgctgaggactccttgggcctctgaagtcacagagagaaccgagcaggtctatgtttttgttttgttgttttgagacggagattcgctcttgttgcccgggctggactgcagcggcgcaacctctgctcactgcaacctccgcctcctgggttcaagcagttctcctgtctcagcctcccgagtagctgggattacaggcacatgtcaccacgcctggctaatttttgtatttttagtagagatggggtttcaccacgttggccaggctgrtctcgaatgcctgacctttggtgatctgcccgccttgtcctcatgtgtgctccacaggcctttgggttgggattgcaggcgtgagccaccatgcccagcctagactcttttgacaatatgatgaaagctgttggttcctttccccaacacacacacaccgagttgtatcacgaaaatgtcatacaatttccaggttttctgagtggtgggctcagattgaggtcaaaggatcagacgacctctaacgaccttcatgtctctgttgatgatctggggacagccagatcccctgtgtccagggagttccttagtcccttgccaccaccagagaagggcaattgccacgggagctgcaaagaccctattcctactcctggtgccttacttatgcagcacgactgaattttttgttttgttttgttttgttgagacaggggcttgctctgttgcccaggctggagtgcagtggcacaacaatggctcaccgcagcctcgaacccctgggctcaagcgatcctcccatctcagcttcctgggtagctgggaccagaggcgtgagccgccatagctggctaatttttaattttttttttgcagagatgaggtttcaccatggtgcccaggctggtctcgaacttctgggctcaagtgatcctccctccttggcctcgcaaagtgctgggattgcaggcatgagccaccgcccccggcctgtggagcacacatgagtttaaaattactttcccttctgcctatatttccgaggaggaaacttcatgcgcagggatctttcttagtggatttaatggctaaaaggtctgtctgaatccaggacgctggctttagccttcctcggcagctgccgtaaccccggtgtctaaacctgaagcatcccaggagcacccactccaggagttttctcggccgcggaactcattagttagagcgccctcttgtgttctcatgtggtaatcggtcaytgaaggacttaaaatggtccttagccaacacacagtaraacttttccctcttctgaccccaagaggtcagccacccatttcatgagcatatactggtcgccccatcagcgttctctgattggctaactgaacccactccccgacctagactcaagacaggcgaagtgacgcttaggtcaacattcactcactaaagcaacgactgtcgggcgattttgtctcccgctggttttggaatggtgtctggagacatttttggttgtcacagctgggtgggtgtgctcccggcatctggtgggtagaaaccaagcatgctcctaaacatcctacaggcacagaaccgtctcccacgaccaagcatgatcaagtcccaaatgccaataatggccaggttgagaaactctgcacagaagcatccagttatttgtctgtttgctcaacaagcttgtgctcatcatgctctgtgttcctgacgctgtgctgggtgttggcggtgggaagattacaagagtcacatggcagctgtcctcctggaaggtacaacccagtagagatgcagactaacagagagccaattacaaagcagtgtgacaagcgtcatggtggaaaattaaaagctcaaacaagggcacatgggaggggcttccaacacagactttgggggatccaggaaggtctaagaggaaagtgggtctcaccaaagccttgaccataggcagagggtaccagtggaaaaggtggggtgaagaacattgaggacaaaaggaagaagtgcaggaaggccctgaggcaagggagtggggggtgccctggagggatggcagcagggcagtctgtcagacccaagtggcctccagccctagaagccaattagtcctcctcaaaaagctgtcactgtcccctaagaattgctgccaggctcccactggcctgactcagtctttgagagtcttaaggaggaggtctctgaaaggtacacaccaagaactctccccagcacagctgtttttaagactctccaccagcgtcattggcgtgttgggaagaaaccctctgccacagaggccagcttcagcctttgcctaacaccgcaagggcaaatggaaaggtaaacgggaaggagatgtctccccagcaggctatttgaggacagtcttccctgcagaagatctcaacctggggtcmacagagtggaaatgttagagtagggagctaggcaaacatgagcaggacaggtgagggcccccacaggaatgtcaggctaccatcaggtgatggtcaggtggttgttaaactgtctctgtaaaataataattggttgcagccagctccaagcaaggacagtctctcaatagatacaaaacaccctgatctggtgatcagccgcttcccgataagatctcaggagctgggcaagcagcctggagcatgcgcaccaagaggcaaaatggcggaatttaaccagtatatgacctaccttcctctgggaacgcacgactggtaaggggaaaaatgcctcaagtgagcatgcgcgcaacttcagtaatcacactgtgcatgcgaccccttccaagtgctggcaggtcaccacatacgcggacagcctgctgcaagggaagaatcaggggagatgagacgtaaatcccagaactatgccaaatacataaaaccccaagttaagggtcaggcagggcacttagatctctcaagttgcctgcctgayccaagtgtagtgtacttccttttgttcctgctctaaaactttttaataaactctcactcctgctctaaaacttgccttggtctctccctgtgccttaaraccacttaaaaccacctctgcccctcagctgagttctgtctttgagaaggcaagcatcaagtttgctgcagacccattggattcaccactggtaacagaagttggggtaaggcgtggggcctgagaattctctaagagtaggtgcagccgggcgcggtggctcacgcctgtaaccccagcactttgagaggctgaggtgggtggatcagctgaggtcaggagttcgagaccagcctcaatatggggaaaccccatctctactaaaaatacaaaatcagccgggcgtagtggtgcatgcctgtaatctcagctactcgggaggctgaggcaggagaattgcttgaacctgggaggcagaggttgtggtgagccaagatcgagccattgcactccagcctgggcaacaagagcgaaactctgtctcaaaaaaaaaaaaaaagagtaggtgcaaaaggttatgagggtgtgcagttttctatgggagagaatccatagcttttatccatgtctttgtttgttttgagataaagagtcttgctctgtcacgcaggctggagtgcactggtgtgaacatggctcactgcagccttgacctcccgggctcaagcaatcctcctgtctcagcttcccaaagctgggaccacaggtgcccacgaccacacccagctaatttttaatttttttgtagagatgagggtgttactatgttgcccaggctggtcacaaactcctgggctcaagtgatagaactcctgcctcagcctcccaaattctggkattataggtgtgagccactacgcctggccttttatcagtttcttgaagggagatagggtccaaaaaagggttaggaacttctaaataattaaaaactcacatatgcttcatattatttgatgtcagttaaaaccccaaaatagtgatcaatacatttcttaccaaaggatctactttaaagacagttttacattcaatatccscagcaagactcggcttaccttcagaaaattgctcagaataaggaaacaaatggtgatttcaacatttgaagggggtagccctcatctctcaaaagtaataagctattagaatgttttggaataccagaccaggtgcagtgactcatgcctgtaatcccagcacttagggaggcagaggcagaaggattgcttgagcccaggagtttaagtcctgcctgggcaatatagcaagaccccattctccacaaaaaagaaaaaaaaaaagacaaaaaagagaatattttggaatatcaaagaaccagcagtaaatctattgaaaaacttcagagtccaaagtatttctaaagcccaaattgtcccttcatatatatttcataattcaatagraaaagaattctttcttcagaatgaactttggcaatagaaaagaaaccttatttccacattcagaaaggatgacaatgctggaaagcaaattaactttttttaacttttttgcttgtttagtttttgagtctcgctcttgttgcccaggttggagtgcagtggcaccatcttggctcactgcaacctccgcctcccaggttcaagcaattctcctgcctcagcctcccaagtagctaggattacaggcatgtgccaccayacccggctaattttgtatttttttagtggagatggggtttcaccatattggtcaggctggtcaaactcctaacctcaagtgatccacccaccctggcctcccaaagtgctgggattacaggcatgagccaccacgcctggccgcaaatacaattcttaaagaaaaataaaagctaaattggaataggggattggccaccagtcgattacatgaccttggatgtgtcacacatcctagggctcctctcctgcaaaggaaaatgtattcatcatttcccagggatgccataataaattaccacaaaccagctggctaaaaacagcagaaatctattcttgcacagttctggacacctgaagtccaaaatcaaggtgtcagcaatgccatgctcctccaaaggctctaggaaagaccccttctctgcctctcctggcctctgatggttcctggcaattcttgagattttctgggttgcagctgcactgctccagtcactgcctctgtcatcacagggcattctttcacatgcgtgtctgtgccttcacatggccttctgagaaggacactagagctgggtgtggtggctcatgcctgtaatcctagcactttgggaggctgaggcgagtggatcacctgcggtcaggagttcaagaccagtctggccaacatggtgaaatcccatctctactaaaartacaaaaaattagccaggcctggtggcacacacctgtaatcccagctactcaggaggctgaggcaggagaatggcgtgaatccgggaggcggaggttgcagtgagccaagattgcaccactgcactccagcctcggggatagagcgagactctgtctccaaaaaaaaaaggacactagttatcggatttagcgcccacccgaatccaatacaaccccatcttcactaacattatctacaaagaccctgtctccaaataaactcacattctgaagttccaagcagatatgattttggggtgacactattcaacccagtacagaaaagactggactagacgagctcaggtccttgtagctctgacttcccaggtttctaagatgctcatgtaaatcggaaggcagaaagatggtgattttccttcagataacatcatcttctcagcatcatcttttgagccttctcaggccagtgttctctcactgtgctctgttctcttgtgctttgtgtctcggcatctctgaaatattattgttttcttttctattttatttatttattata
